United States Patent 9,328,346 (POLYCOMB-ASSOCIATED NON-CODING RNAS) - sequence listing, part 93

SEQ ID NO: 17444 - RNA, 69107 nt, Homo sapiens
ugggauuggccgagaggcuguggcgacaaggcccggauuggacagcauggcgcugacugacagcgggggcggccgccgcgcccucccucucuccccggugugcaaaugugugugugcgguguuaugccggacaagagggaggugaccguggcggcggcggcggcggcucuguuuauugucccucucggugugugugugugaggaaaucggggcugcagcgaggcuaaggcugccuuugaagcagcggcggcgaccgggacgacuacucuggcgacucgaguggcuggccuucgcggagugugagaaggacaaggcaccucugcguccucgccacguccgagcgccucgggcuccccggccgcccucgcggcucgcacgcccgggcuucagcccggccugcagcggcgcccgcgggcgggcgagaaggcaacgccgccgcucggccgccgccggucgcucccugcuuucuccucagccgccgcgcuaggcccgggcgacgcggacgccgcgccucgaguuugagggcagccggcggcgcggccuccucagcgggcucggcuggacguccgcuccggaucuucgcgauggggcgcgggggucggcgcggcuaggagugcggcgaguggagcggugggugcggagcggcggggcccagcggcccgcagggaggcgggagcggcggcugcggccucagggccugugagcuggaggcacucgccauggccaagucggguggcugcggcgcgggagccggcgugggcggcggcaacggggcacugaccugggugguaaguggcugguccccgggacgggcggcugcauuguuccgggcccgcggcgggggcggaauuccgaacgggcgggggaggggaaagggagggaaaucccgucccccgaacgggcgcuccauaggggccugugcuugcagaauccuccagcccgcuccccgcgccuuuucuuucuuucuuucucuguacgucucuggaaguccugacugccagagcguaauguguacuugaaacuuuggggggacaaaaccgcgaacguaacauacagcccccgcuuccucucuuuucuuuuuaaccagacucuuccggggcagccgaaccugaaaugguggggauggcgauaaugcaagugugucuguguggggcagcauuuucuccaaauguaguucaagaaaacccugggaaaagggguguguguguguguguauucuaaaugcagcucuuucuggggcuuuaaucucaaagaagaaugcauugggauuucuacagcaacuugcacuucaauuuggaaagccucauucaaugcgcucaauugagagcgcauuggggaugacuuucacagcaguuaauacuguaggucgucccucugucagggugagauuauuaaaagaagugcuugucuacgucagcaucgcagguguaacggggugagggcugaauggauguccuggagaggugacugaagugcuuaguccugaaguuaaaggauuucgacgcucaguucuugcugggaaguagaaguaacugcagcggaaggaggaagggagacuggauucccacgacagaucgauaauucgccggcauuucacuugcucagcguagaguucagaccagggucauuuccuauacagaaaaccuagguauuucggagaaaaguaaaaaguguuacauuuuucuggacuuuugacggucuguucccccgucccuguuuuaaauaccucaagggagcuuucauauaggcauuuuuguuacuuaguucguuuucucuuuguuugggugagguuugggugaguugaauagcaauuugugcuauauugacaacugcuucuuauaaaaagggugcuacugacagcagcaaaacauuuuaaucacuuauguuugcgugccaggguacauugcaaaauaacuugccaugcucuuauuguugaaauucuuugaauguuguauauuacuccgauuauguagaaugaaaguaugaagggacuagggccaggagagaaaaugucagauacuaaguuagugguccauguggacuugcaguagaggguaugugagaggaagaaggaggagauggacacauacaugcaaaauaaugacuuucagaauuaauggcuuuuaccccugucacuaaaaucagacaucggaaaauugacuuagacagccaaaugguauuguaaguucucauucacuauuuggaaguguugaggccugaucgguguuuccucugaagaccucugguucuauaaugguaaacauuuugcuccguaguggauuguuggcuuuaacauuugauagcaguacuuuaauuaacuguuauauaauuuuguagauaauuaaaugacaauuuauuucuuucaagcuccauaggaaacucauugcuaauuuagcaaaacuuggagcaucucauucaagauagaaaaauccauuugaaacugaaauugacuuauugauuaaaggaauuuucauuauaaagcagauuauggaaaauaugggaaaugcaguaaaauaaagagaagugaagaucacuuaguguuuuauuuauagaguauaucuuauggaauuagaaguuuauuaaaaagauaaucacuccuguaagucuucuuuaagaguugaugcuuacucuaagguuauaugagcaucuuuauguccauaauauacaucauugaucauauagacugguuugauuuuaugggaggcaauauagugagguaguuaugggcuuugacgucaggcugauguagguucagauacugucucuccaacacauuuaguuggacuuuucccaaggaaccuaaccuuucuaagccuguuuuuuuaucugucaaauaagguugcauugagaaugaaaugagauaacguguguagcacagugcugggcuuaaugauguuuguuauuauuggugaacuucaagaaaugcacacucaaauaauagauugcaguugcuuuuacauaaaauaucuuuuagcugggguaaaagcaaauuaauuuuuccuuugcacgaguuggggcuuuauugcaguggucaucuguuuugagaaagguaacuucgucugcuuuauugaagcuaguguuauguugccaccugcuugugguaacagaaagaaauaaaaauagaauuagccccugauuucuuucuucugggugaggaguuguaugccauguguugcugauauuaacuacuguugggaugcaugccagcauguguuguuaaugucauugcaugaaaauuugccuuucaauaucugaaacuacaaagccaagugguuuuaggacuggcauuaacuuauuuuaauaauucauuugguuuguguuugauuuguaggaguaucucaaccagaauuuuuuauaauuaaaaaaagugaaaaauauaaacauggcaaagcuauuuugauuuaaaauguauagcaguuacaaaggcuucucuuaaggcagcaggguuucuugaauuaauucuuuguagagcuuugauuaguagauaguaauagucugguucauucugucagucuuguaucauaagugauuguaacaaagacauuuguggaaauacuagaauacaguuauaugacuuaaucuuuuucccaacaauauucuaacuugguagauuaaaaaaaauuuuuaauggaaaauguuaagcaucucaaaaagugguaaccagaguaguauaacaagcuucccucuauuuagccuuaagcuucaauaauuaucaaccugccgggugcgguggcucacgccuguaaucccagaacuuugggaggccaaggcaggcggaucaccugaggucaggaguucaugaccagccugaccaacauggagaaaccccaucucuacuaaaaauacaaaauuagcuggggugguggcgcaugcuuguaaucccagcuacucgggaggcugaggcaggagaaucgcuugaaccuuggaggcggagguugcggugagccgagaucacgccauugcacuccagccugggcaucaagagugaaacuccgucucaaaaaaaaaaaaaaaaaaaucaaccuaagaccacccacuuuaucccuucucauucuuuugaagcagagcaaauccuagaauuuuaucacuuucucuguaaauauuucaguauuuaucucuaacaguaaagucucuuuuugaaaaacuguauaaccacaaauaacauuguaguuuucucaaaagucacauuuuuugaaauauauaacauauuuuuggagugugaauaucucuaauuaaacaugacuauguauuuaaauauuguuuaaagauuuauuuuaagaaccuugcuuuagugguuuacuguugcgagucuaaauugcugagccagacuuucauaaacuaugugcccuuuccaaugaaauuuauuuauuauagucuccauaguuagauuuaucucuucacuguccccuacacaaguuaggcuuguuuuugucacuuugucuuuacauauuugccuuccaucuggaauuacuuuuucacuucucuuuacuagucuaaaucuuaacuguucuucagggcuagcucagagccuugucacauuauuauuuuccaguugauacucaucuuuuucuuucauugaauguuuguuacucucaugaaucauaaaacagaagucuuuauuuuuuauguaacuuucaugcaugauaacuuugccuuaauauuacaaauuucugaaguuagagagcauguauuuuccuuguuuauguccuucagaguguuaaacaaagaacuggauacguaauccagucucaguuauuuaaaaauuggauaauugacaugcugacuuccuaaaaagucuucugucauuaguaggacaagaguuuaaguagcaguguuuuuuagauacauucucaaguacaugauauagcaguauuuaggcacguuuuuaauaaacuuaauuuuucugaaucgaaguauguucaccuguaaucccagguuuguugguuaggugguggcaacaauugcauuuuacugaguacacuuuaaaaaauaaacuucuugaauuuuuaaaaguauuaacacguauagaaccccauuuuaacgaaaaguugaaguagcuauaguuauuccuauuugcagagaaggaaacggguuuagagauuagguaacaaauucuuaggcacaugguuaaggcacagguggaauuuaaaccagacucaguguucuuaacauuuacacagccuucaacuuuaaaaacauugaaagacaaaacaacucaucuuuuauacucugauaagacagaauaaggagacaucugggauauaccugucuuuuucuacuaaccuuuuacuuucauacaaaaagcuaaggaguauauuuccuuuucagaauauguguacuuaguauagcauaaugcuaagaguaugggcugugaaaucagaucaucuaguuucauaauucaccuuugucaaguacuaguuuuguuagcuuugggaaaacacuuaucccaaccuuaguuaucucaucuguacaaagggaauuauaacagugucuauuucauggagauacuauauaagaauuaauuaagauuaucguagugcuuggcacauaguagcucccagauggguucacacauacauucucccuucuuuuuuaauccagugauaaguauuuucauucccuuuauuauagagaaagccuauuuucauagcagaagucuaagcauuuguuacugucuuaaguaucucuuaucucuuccuugccccuuuguuuagaaggguauuucugaaggagcauagacaggggacaguuuguugcuuuuugcuucauuaaugguggguagauaacauggccucuccauuuacauauaggugaaauaugguuagaaugaacaucaugggauggcagccuugagggagaaaagagagaggagacauuauaaaagguugguguuaagucugaggggauuguacagaagaagguaaaagaaggggcucguugcuaggcugccagcccccacuuccacucuuguuggccuggugauggugagcuuucuguguugauuaugugaaugaguggcucaguucuuuuuuaguaccaacuggcaaaccaucuccuuuacccuguuugucagcaauucauucucccucagaaaaacaaacugggugcuucugccaaauugcuauauuucaggugacaauucuguccauugaagaaucuuuuguuuuguuuugcagaaugaucuugguguauagucguucugaaaaauaggaaguuuuacuggaauguuuuccauuuucuucugaagacugagaaauguucuugaaaaagaucaaaucuuggauuaguauuaaaucuguuuuuuuauuaggcauuagcaauauugcaaaagugccauaagauagguuaauauuuaaaauauauagucuauauaguuauuuugguauuuuuguuauaauuuuaaauuuucccuaaaugcuuuguuuaauuuggcagcugacuugaaauucagaaaaagucaaugauguuaucaucauauuuauaaaugaaaaagaauauaauuaaaacaacuuuuagauauguguaggaaauuuaauauggugauuauuuuacacuuuuauugucuucaugauaaugaaaauguagccuugauuuuuuagauuccaauuuaauuggaugcuggcauuguuuauuacuaucaguaguuugguaauuuguucacauaaauuaaggcagggaaauaaauuacaaauaaacuuaacaaguuuucaaucguuagucucaacgcaaauuuauucaaaaugcuuuugguaaauaauaauaauaauuauuauuauauauuuuuugagauggaaucucgcucuguuguugcccagguuggggugcaguggcgcugucucgacucacugcaagcucugccucccggguucuuggcgauucuccugccucagccuccugaguagcugggacuacaggcgcccgccaccaugcccagcuaauuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccugaugauccaccugccucagccuuccaaagugcugggauuacaggcgucagccaccgcgcccagccggugaauuauuauuuuuaaaggcauguuguuaauuuuuauucaauguggaguacugugagcaauugcuauagaacaugauaucuuauuacugugaacauauaagaauaaaaagagguaaaaucaaaagacucuucugggucuaaagugaguauaauucuguuagccugcaugugucagauauacaucacucucuuuuaugaucuguaaaguugaggugcuuuuauaaacaugcagauaggaguuugcuaguuugugguuguucaaggcaauuugcuguucucuuuucugaauauugucagcaagaguguuaaaauugaagagcuacccagggugacauuuuuuuuaagagauagagauagugaugauaacagcaagggagaaggugcagaauagguuucucauuuagcuucucucuucuaaggccaaaggugguuuguauuaaauaugcauaccuguucuagggaugggaucaucauauuaacuggguaaguugcccucucuccccuuaccccagauuuugauuuuuagugaccuggacauugcucaggggacaacuuucugcugacaaacaggaguugaaagagacuauuauuucagguuucuguuacaaaaacauauaaaagucucaggggagaaccuccuguguuugccacuagugagccagugagcaauguaaauuaccauuuguugagaaugggaacguaaaagacaaauuggauucuaguguuaauuucuacuuucuacucugccaaggcugccaaucuuauuuguguauuuugauuuuguuuuugcauagccucuagugagaaaguugggguugcagaaguaauaaauagguguaaacauugccucuaggaaaagaaaccuucaguuuuauucuagcuuaauuauguuuucacauacuuggguuaauaagccuuuaacauauuucuuuaugcauucauuguagaaauuuagaaaagguguagaaaagauaaaaguggcauguauuucuacucuauagauaauuuuuauugauauucuguugggcauauuucacauuuuuuccuaugcaugcauauauuaugcauaauuuuuuucugacaaaaaugggcucauguuuuauauauacuccuuuguaaugcccacuaaacagugccauuuugauaaacuacuaauuuaaacauacuugauuaucuuuacuaauauaaauuuucuauaaaaacuagagcaauaaaagauuaacaccaauuauuuuuaguauaguaauuauagacuuauuuacucauugaaacguccaaguuuaaggguuuauauuaaggauuuuuguuuguuuuuuaucuauuuauuuauuuauuuauuuuugugauggaggcuugcuaucacccaggcuggucucaaauuccugggcucaggggauugauccuccggucucagacuccagaguagcugggacgacaggccuauggcaccaugcccuagguuuuauaaguuguuugauauuauaauuggcaguugauuugaaauaucugcaaaugacuuccauuguauucuauaaauaauguguaucccuuaaggcuuuuccugacuuuaaauagaaugguauaucuuuuucuuuccucaauaguugucauaugauauuuagaaaaaaguguauugucacacauucaucacacuuauuuuacaguauuucuauguucuuccuagagaaaauuacaaauaauauuagacaaagucaucuacauuucacauguucaauuuuuuuuguuguaaaaaaauacaacauuaaauuuacugucuuagccauuaaguguagaguucgguaguguuaaauauauuuacauuguuaagcaacagaucucuagaaguauuucauuuucccaaacugaaacuauaucuacuaaacacuaauucccucuccccccagcccuugguuaaccaccuuucuacuuucuguuucuaugauuuugauuacuguggauacuuuauaugauuguaaucauacaguauuuguccuuugugacuggcuuauuuuguuuagcauaauauccuugagguucauccauguuauagcacaugacaagauuuccauguuuuuugaggcugcauaauacuccauuguaucuauauacgcauuuuaaaaauccauucauacaccagugaacauuuggguugccucgccuuuuggcuauuaugaauaauaccgugaugaacaugggugugcaaauaucucuuugagauuuugcuuugaauucuuuuggauauauacccaaaagugggauugcuggaucauauaguaauucuauuuuuaauuuuuugaggaaccuccacacuauuuccauaauggcuguagcauuuuucuagcauuuuauauucucaccaacaguguagaaauguuccaguuucuccacauccuuaccaacaguuauuuucugauggcugucuuaauaggugugaggugauaucuuauugugguuuugauuuucauuucucuuauuaguaauguugauuaucuuuucauaugcuguugaccauuugcauaucuuauuuggagaauugucuauugaaauccuuuauccauuugaaugggguuauuuuguuauugucgaguuauagaagcuccuuaucuauuuuggauauuaaccauuugaugguuuacagauauuuucuccauuccauacgcugccuuuucacucugucaguuguuuucuuuggugcacagaaauucuuaaguuugguguccuguuugucuauuuuugcuuuuguugccugugauuuuggugccauauccaugaaaucauugccaaauccagugucucaaagguuuuccuuuauguuuccuucuaggaguuucagaguuuuagguauuacuuuuaggucuuuaaucuauguuaauuuuuguauguggcaugagaguccaacuucauucuuuugcuuguuauccaguuuucccagcaccauuuguugaagagacuguccuuuccccacuguguagucuuggcauucuugugaaaaaucauuuggccuuuuauguaaggguuuauuucugugcucucucuucugucuguaugccagugccacacuguuuuagauuucuguuguucuguaguaaaaucagguuuugaaaucaggaggugugaggccuuuagcuuuauucuucugauuaaagacugauuuagcucuauggguccucuugagauuccauaugaauuuuagauuuuuuuuuguauuucugcaaaaaauaccauugggauuuugguaggaauggcauugaaucuguagaucacuuuggauaguuuggacauuuuaacaauauuuuaagcuuuuaaauccaugagaauggaaugcccuuccauuuauugguaucuuuuuuucauuucuuuuaacaauguuuuguauuuugacauuauucucaccucuuugguuaaguuuacucugugguaguuuauccuuuuugaugcuauaguaaaugggauuguuuucauaauuuccuuuuuugauuggucaugguuacugcaugaaaacauaaccaauuuuuguauccugcaacuugcugaaaucauuuauuaguuguaauaguuuuucuguggaaucuuuuggguuaucuacuauaagauuaugccauuugugagcauaauucuacuucuuuuccaauuucuaugccuuuuauuuccuuuucuugucuuaauugcucugacuaggacuucuaauacuaucuugaauauugauaauauugggcauccuugccuuguuccuccugaucuuagaggaaaaguuuuuagucuuucaccaguauaugugcuguuagcuguuggcuuuguguguauugcuuuuauuauauugagguguuuucuuucuauuucuaguuuguuauguguuuuuaucaggaaaguguguugaauuuugucaaaugcuuuuugcacaucaauugagaugauaauguguuuuuugcccuucauuuuguuaauauaguguaguacaaugauuuguuuucauauuuggaaacauccuugcauuucaaguauaaaucccauuugcuuauuguguguaauccuuuuaaugugcuguugggucaggcaugguggcuccugccuguaaucccagcacuuugggaggccaaugcaggagaaucgcuugcggccaggaguuuaagaccauccuggacaauaugguaaaaccuugucucuagaagaaauuuuaaaauuagccagguguggaggcacacaguuguaguacuagcuacuuggggcagggguugugggguauuaaggaggagggugggugugcugaggugggaggaucacuugagccugggagguugaggcugcagugagccauugucaugccacugcacuccagugugggcaacaaaaugagacccucucuuaaaaaaaaaaagugcuauugaauugaguuugccaguauuuuuggggggauuuuuugcaucagucuuuaucacggguauuguucuguaguccucuuguucugucuucuaguuuuuguaucagagaaaugcuggcuucauagaaugauucuggaaguguucccugccccucauuuuuugguaagaguuugaagaguuaauucuucuuugauuauuugguagaauuuucaagugaagccaucugguacugggcuuuucuuuguugggaaguuuuugauuacuguuucaucuucuuauuuguuauagggcuguugagauuuuuuauucaugauucagucuugguagauuauauguuuggaauguauucauuucuucuagguuaucuaaucuguugccauauguguggucauguaagucuuuuauaaucuuuauuucugugacaucaauuauaauguccccuuucguuucuaauuuuaguuauuugauuaucucuuuuuuuucuuauguaaucuagcuaacgauuugucaguuuuguuaauuuuuucaaaaaacaaacucuugguuucauugauuuuuuuuccucauuguuuuucuauucucuauuuuauuuaucuuuguuuuaaucuuuauuucccuucauuaauuugguuuaguuucucuuuuccuaguucuuugaaagggucuaaaguuagguuguuaauucgagaucuuuacugauuguuaauguuagguguaauacuguuuuagcugcauuacauaaauauugcucuauuguguuuugguuuucauuugucuccugauauuuucuaaauucgcuugugauuucaucucucacccauugguuauaugagagugaguuguuuaacuuccacuuauuuguggauuuuacuguuuuccuucuacuauugauuucuaguuuaauuccauuuuugauggaaaauauaccuuauaugauuauagucuucuuaaguuuguuaagacuuguuuugucacguaacauguggucuuuguuggagaauguuccaagugcaauugaaaagaauguguauucuccuguuguugauuggaguguucugaguaugucuguuagguccaauuggucuauaguguuguucaaguucuuugugucuuuauugaucuucugugugguuguucuauccauaacugaaagugggcuagugaagucuccuacuauuauuguguuggucucucucucccuucacuucugucaguguuugcucauaaauuugggaacuguaauguuagaugcauaucuuacuggugaauugacccuuuuaucauauaauguccuacucugucucuugugacaguuuuuaucuuaaacucuauguugucugauguaaguacggccacucucuucagauuccaguuuucuggaauaucuuuuuccauccuuuuauuuguagccuuugugcaucuuuggaucugaagcagaugucuuguaaacaaccuguaguuggaucuuauuuuuuuauuccauuggccaaucuaugucuuuuauuugggcacuuaaucuuuuuuuuuuuuuuugagacacaaucucccucuguuguccaggcugaaguacaguggcacaaucuuggcucacugcaaccucugccucagguucaagugauucuucugccucagccucccgaguagcugggauuacagguggcugccaccaugccuggcuaauuuuuguauuuuuaguagagauggcguuuuaccauauuggccaugcuggucucuuaacuccugaccucaagugaucugcccaccuuggucucccaaagugcuggaauuacagaugugagccaccgcuccuggcccaauuuauauuuaaaguaauuauugacauggacucacuauugccauuuugauuauuuuuuuauaugucuuauagcuuuuuuguccaucuuucuucccuugcugccuucuuuuguguuucauugauuuuuuuuuuuuuuagugacauguuuugauuuucuucuaauuucucuuuguguauauucuacagauauuuuccuugacuuuaccuugccauuacauaacauaucuucaggugauaaaaauaaauuuuaaauuaguaacuucaaugccauaugaaaacucuuccuuuuuucaccucugcccuccccugcuuuguuuuugaugauacuuuaccucuuuuuauauuguguauauuuuaacacagauuuagaauuauuuuuuaugcuuuaaaaaauucuauacuauauuuaagugaucuguauuacuguauuacaauacuagaagaugccauauuugucuguauacaaauagucuucaaaaaguucauggaaaauguguauuaugagaaaacuaugcauggauuucaaaauuuuuugguaucaaaauaaacuuguacuaacuuguuauaacgugucugaacaaaaucuaguuugcgguacuaagaaggauaagacaucauuuggaaaagagccccugucagagcaauaugaauuaugcuaaaauugaagcaagaacaaacaucaaguuuaugaagaagcuuaggugaaagaauggugaaaucauugauuuacaauauguuuacagggccaaugccucaaauaaaugagcaguuuacaaauggauaacuucuuuuaagaagagaugagaugauguuaaagaugaagccugcagcagcagaccauuacaucaauuugucaggaaaagauuaaucauguucaugcccuuauuuaagaggaccaaugauuaauagcagaaacaauagcuaacaccauagaugucucagucgguucagcuuccacaauucuauaugaaaaauuaaagauucacagacuuuccauucaaugagugccaaaaccauugugccuagaucagcugcagacaagagcaaagcuuuuaauggaaauuuuaaacaaaugggaucaagauacugacacauuucuucaaauaauuguagcaggaaaugaaacagggcuuuaccagcauaauccugaagacaaagcacaaucaaagcaauggcuacuaagagguggaagugguccaaucaaagcgaaagcagacaggucaagagcaaaggucuuggcaacaguuuuuuaggaugcucaaggcauuuugcuuguugacuuuaugaagggccaaagaacgauaacaucugcuuauuauaagaguguuuugagaaaguuagguaaaguuuuagcagaaaaauccccaggaaagcuucaccagagucuuucuccaucaugacaguacuccugcucauuccuuucaucaaacaagagcaauuuuaugagaguuuugaugauaaauaauuaggcauccaucuuauaauccugauuuugcuccuucugacuuuuuuuguuuacuaaucuuaaaucuuuaaaaggcaccuaauuuuuucaguugauaauguaaaaagacugcauuggcaugguuaaauucccaagacccuugguucuucagaguugagcuaaauggcugauaucaucacuuauaaaagugucuugaccuuuauggagcuuuuguugagaaauaaaauuuauauuuuuuauuuuuaucuuuugauuccauuuuuccaagaacuuuuuggagucuccuuggacuuuaccagggaguuauguauuuuuguguuacuguguugcuauuuuuuauccuuuugcuuuaagggacucccuuuaucauuucuuguugggcaaaccuaguggugaugaacugucccaguguuuguuuaucuaagaaaguauuaauuucuacuucauuuuugaagggcacuuuugcuggauacaauguucuugguuggcaguguuuuuuuuuuuuuucuuucaguacuucagauauauucuuccaaucccuucuaucuugcaagguuucugcugagaaauuggcuaguaaucuaacagaagcuccuuuguaauugaugauucacuuuucuguugcugcuuuuaagauucucucuuugucuaugacuuuugacaguauaauuaugaugugucuugguguaguuuucuuuagauuuauccuuggaguucuuugagcuucuuuaauuuguauaugcauuuauguccucagauuuggaaaguuuucagcuauuauuucuucaaauaggcucuuucuccauuucucccuuucuucuccuuugaggcuuacauaauguauauguuguucugauagauaguggcccauaaguucuuuaagcucuuuuuauguuuauucauuccuuugccuuuuugcuccuuucccuuggcaauuuugaaaguccugucuucaaauuugcugauuuaaaaaaauucugccugcucaagucuacuguuacaucccucuaguguauuuucaauucauuuacuguaugcuucaguuccagaaauaauguuugcuacuucaucauaguuuuuaucuuuguugauuuuuuccuuuuguuuaugcauuguuacaccgaguuuuuguuuguucaucuguacucauuuauuucauuaagcauccuuauggcaguuaauuugaauucuuuguaugacaauauauuuccauuucuuuaggcucaauuuguggugauuuauuuauuauuuuuuugagacaggcucuugcucugucacccaggcuggaguacaguugugugcagauggcucacugcagccucgaccuucugggcucaggcaauccucccgucucagccucccaaguagcugggacuacaagugugcacuaccacaccuggcuaauuuuuuuuuguuuuguuuugcuagagauaagauuuggccauguugcacagacugguuuugagcucugggcucaagggaucugccugccucagccucccaaagugcugggauuacaggugugagccacugcgccuggcugcaauuuaguuuuuuacauugaaucggcuguauuucccuguuucuuuguauuguuauuuucuguuagggcuuuggcauuugaaggcuuagcuaacucucuggucuuugcggucugguuucauacugggaagacuuucuucauccaguuagucuagcuagagaauccugagaccucacaaaucuuuuauggggaugcauccucuuuggguuuguaauuucuuaauugaagagguuugccucuguccaucugucugcucccucuggugugucuuugucugcuuuacuuguggcgucucgugcuguaguaaacuacaguacuggagcuccaccuugugucuguuucugauacugcagggucugaugcuaaaccaaagcacuuugcuuuuguuuucaauggcccucaaccuggcacccuguucaaugucaguacuuagauucagucaagaaguuucuaggguagcacugcccucagcuguuccauuggagguauauuccuuuucugcuccuccccagggagaagguggaaguuguuguugucuuguuuguuuuucucaaucuugccuugcuggggcagauaggagggaggacaugagcuuugaugcuauuuuaugcucaccuggggugcuggaacuuaucacaaaggcaguuggauuguuuguuauuguugaauccuugucuucauggggaaagaaaggccugggguuucuuguuuugccaucuggcugaccacacucaaauguuaccuguuuuuuuuagacauuaucuuagcaagaaugguaagucuuugaacuugauaggaauuugguggguucaagcuuucaaacuuuuuuuuguaauauauccauuugggaagaggugcagggaggaagagguggugauuauaaguaaggaaguguggaaaaaguuguaaauucuugaagaaagcaugagguaagguuuuacuccuguuuuuuuuuuuuuaucccugugugcccuuuaguucaguuuaguucauacaaauuagauagacaugagccucugguugagucuaaucuugaaaauauuuucuuugugaugggguugguuuuagaagaguagccuggaauacgaaagcuuuuauuuguaugguuaucaugugucuucaaccuuuaugucaauaauugcagacuuagaauagcaguucuaaguuaaugguaaaauguuaccuacuuucgauuccauagcaucuaucuucuuugaguacuuucuuagagugugauuuuaaugauuaugaucuuuguucuaacuauuuugaggcuucauuaaaaaauaaauuaugauuuuauuguuagaaucguuucuauaaauuaacgucacugcgccuggcccuuaaauguaaauuuguuuuuaucaaucaacuauuucuucauaaaaagcaaagaauacgauuagaaauuugaagacuaucugguauuuuaaaaauaaaguucaucuuucuggccggcuaguucaucgucuaacuuuugcagaaguggaaugugaaugugaaaacuuugugaaacagaauuauuuucuuuuauccaaagcuacuuuuaauugucuuugagcaguguuaauggaaaaacuuauaaauguaggaauguauaagaauauaguuuaaaaucuaguaaaaugaguuauuuuuaauacuuuuauuuugaaauauuauuaaaucuuuaauuguauauaaaacuuacugcauugugaaauuauaauuaacguuugaguuuccugaggauauauuaaauucuuaucuucguuuagacuuuucagaggucauguauuuugauuuuuaaacauacuuaaugauacaguuuuuaaaaauaaaaacuuuaaagcggaauugaaauugcauacugcuuguuuaaaugcacaaaaucucuguaucuccuauuaucuguauucuguuucuuuaauuucuacuaaaauuugaaggccucugaagauauuuuaauucucauugugucuuuugaguuauuuuuugauucugaaaagauaggccaucacaauaucuuuuuagugggaugucauauuugucagcauuaaggaaucccagaaggagagaaguauauucucugcugcucuuaagaagacaaggaaauuuguagaccuuggaaauuugauuugacauccucaucugcuguaggaauguuuagaauuaagaucaccaaccugugccuccuugaaacugguagagaaacugggaucaguauugggacacccagagcugauaugugaggaauuauuggcaugaucuacaaaugugugaaauuugaggauuuuauaagccauuucagucauaucaguguuuauuaacuacauagguuaauauuuuguguaggucauuuuuguuuauacuguagucuucaguagcuuaauggugggaagcuuacaucuggaagcuuuuggggcuccugcaccuagccagguucagucauugugauucuguaacuucaccagaacucaaauuucuugggagguuuugaggaccacaaaaauuaacuugaguccaggugugguggcucacaccuguaaugcuagcacuuugggaggccaaggcaggcugaucaccugaggucagaaguucgagaccagccuggccaacauggugaaaccuugucucuacuaaaaauacaaaaaaaaaaaaaaaauuaccugggcauaguggugcgcaccuguagucccagcuacucaggaggcugaggcaggagaaucacuugaaacugggagguggaggcugcagugagccaagaucacaccauugcacucuagccugggugacagagcaagacucugucucaaaaacaaaacaaacaaacaaacuugauaucuuacagaauugggaaauguuuguauuuuuggauugcuggagacugcucuagugauucuggugacuauacccacguuuugggcucagucaaaacuacagguucauguuguauaauaagagccagacggucaguaaauagaccuguguuuucuuuagauuuaaaaaaucagucugaaagauaauuuugccauuaaaaaagaaaacccaugucguguguccauacucauugucuaccccuugguagguuauuuaaauuugauuuuuugguuaauuuuagacucuuuuugaucagaacaaugcugcaaaaaaagaagagucagaaacugccaacaaaaaugauucuucaaagaaguugucuguugagagaguguaucagaagaagacacaacuugaacacauucuucuucguccugauacauauauugggucaguggagccauugacgcagguaauuauugcuaaaauugauugaaauuaggagaugugcaucuauauuuacuuuuuaauauguugauaaaauuauuguaauuacuugcuuuggaaauuuguaauuucaucugucauagucaaaguagggugaaagaucuagaaguagaaauguauuuacuucuuuuuggggauuaaaaaccgucagaagaggcugagcgcaguggcucacaccuguaaucccagcacuuugggaggccgaggcggguggaucacaaggucaggagaucgaaaccauccuggcuaacauggugaaacucugucucuaauaaaaauacaaaaaaauacaaaaaaaaaaauuuucugggugugguggcgggcgccuguagucccagcuacucaggagccugagacaggagaaugacagugaaccugggaggcggagcuugcagugagccgagaucacgccacugcacuccagccugggcgacagggcgagacuccaucucaaaacaaaaaacaaaaaucagaaaaaugaaguauagaguaaaauggugccauacgaacuuuuuauguaagucuuccccacccgccaucucccaucacccccugaugcccccccaccccgugucucgcucugucgcccaggcuggaguguaguagugugaucuuggcucggugcaaccucugccuccuggguucaaacgauucuccugccucagccuuccaaguagcugggauuacaggcaugcgccaccacgccuggcuaauuuuuguguuguuaguagagacaguguuuugccauguuggccaggcuggucuugaacuccugaccucaggugauccauccaccuuggccccccagagugcuaggauuacaggcgugagccacugcgcccaggcuuguaagucuuuaaguucauauugucauuaauguuaaugguaguaccuugcagaauuuguacauauacacugacuauuguuuacugcuuacuaggaacuuggcuuacauauauuaucucauuugauccuaaccauuuugggaaguagguacuguuaucucuauagaugaagaaagggaagcuuacauaaauuuaaguaacuuguucauaucucucaacuaguaagaacugggauucaaaguagaucucucugacuccaaagucuugcuuuguucguauuauuuuacucugcucccuguauuauaaaaaaaaaaaaaagcauuaauuuuccauuauuuaugaaaaguaauguuuuuauuuuuucaacuauuuaauacuguuucuaauaauuauugaugucuuacauuaaaacugacuuuauaauaauacaaacuugauacaaaaugaacaauuucucaauuuugagguuaauuuaauaugaauagugaaguugacuauuacugaaguuguauauguuuuucuacuuugcagaucuaaguauucauauaguguaaaugacaggauguggauuauacuaugaaaaauugauauuaaggauuuauugaguaaaauuuuuuuugaauuuuucaaugcaguucauguggguguaugaugaagauguaggaaugaauugcagggagguuaccuuugugccagguuuauacaagaucuuugaugaaauuuugggugaguacuugcuuaggauuuaaugcauguuucuauuaauaucaucauaguguccuuuuauauauaaagccagacuuaaccaguauaaauuugaaagguguaucucuggcuuuuauccuucugaauauaaaugaucuucagaaaauuuauaccaugaucuguaauguuuucauaucucuguuucaucuuuguuucauuuucuucaucuaugaaaucaauguguuauauuuguaaucccauaguuggucuguacuccucuauguguagucaucugggauaugcuagcaucacaguuaccuggagucaucuugaauauggagaugacagggacugauuuugcagauucguugaguuggugggauauguaaauauguuuuucaccaacaaaucagauauuucuguugggcagccaaguguaauaaccauugcuguaaaugaucucuguccucuccaaaucacaugauuaauuaaauuaugugaaugccuaguugacugcuagggaaugcuuguacuuuggaaauauuuuaaccaaggacacucuagaaauucucuugcucucccaccucaucagugcaacuugagguuucuuagugcaguuguaugggucucagaacuucuucuguugguauuuggugaagagauaagagauuaaaacuguguugcauuuuauaccuuuacucuugccuccauauuauaauuuuacuguuuuaaguuuauugcaaguguuugucaggagcauauuucuucuaugauuguguucaaauuuccuugaagcagugguuaaugaaugcaaaaauauuuauauugucagcuauagugccuaggauacagaauuuugauuucuaaggguguuaaagacuuuuucuuuguuuguaacugaaaaugaacugguuucuauucaauaugccuauaaagucacuaguuuauugaaagugaucaauagaaugcaauugcuuguuaccaagagaaaauauaauuaaacaaaaguuuuuacuuuuagaccuggauuuggguguuguaaaaugcagguguuuguucuuacuuaauauguuuugauuaauauguaucacuaaaacauuuccuccucuuuuuuugugguggaaaacauaacaguaauuuggugugauaauacaauuuaggaauauuauuuggaaaauaagauuuuauaugagaaguuaauaguaauuauuuucauuaacuauuaccauauguagauguuuauauuaagcagugaugcacauacaguuguguccauguauuuauuuauauaauuuuguauauuacucauugagguguuuaauuuuguaguuaaugcugcugacaauaaacagagggauaagaacaugacuuguauuaaaguuucuauugauccguaaguauauuuaaaguuuaauuuuuuaugcuaaguuuuauucagauaguccccaauuuaugaguacuccucaaauaauguauauggguaguacucuuuuaaaguuucccuguuguuugagacuuuguuauuuuugccucuuuucugugucauuuauugucuuuucuuccaaagaacuucccuaucggggcucuuggagaccauuuuucuuugaugcuguguaugcuauuucagcugcuaggguaaucacccuaucuuuucuuacccuuacuuuugggacucaaggcuaagggcuauuguuagugugauuccaguuauauuauacuuuaaguuuacuuuucaugacugguguuuggaguuuuccauuauuuaugacauaauuuaauagauuagguacuguuguuguaaccaguuguuuagcuaauuauauuacuguggugauuuuuauuauuuuuuugcauagaaugaagauguauaaaaaauaguagcauuaaaucagaaacauagcuguuaaauuuauccuguuuuuaccagcaugccuuuuguaaaauauuacauucauccuuuguaauuucauuaguaauuuagcaugauuuuaagauuuuucucuaguaaacauaaaaaucuaauaauucagguauagucuuacuaguaauaaucuaauuucaguuaagauuaguaguauaauaaaacuauaauuuguauuugguuauaccaugaaguuaacuauauuuuauaugaaaauguuaccauauaacugugcugucgagauuauuuauuuuuuucuccauuuuuuuuuaaauuuggauuauuucuauaaugaaugcauucuugagaaguuauauaaggcauacaagacauaaguuacaacuuauacagaaguuuaagaugguuucaaggacauuuuggcuguuaagauuccuuuuccuuauuuaggcaauugucaguuaaaaaccauaucucccuucauuuauuauguuuuaggagaguaaggaguaauagacacugaauguuugauaucuuugaauuuuuuucaaaauugaacaacucuaauuaaaacuaagaaagaaaggaccuuccuuaaauacacucuugaugaacauaguugcaauuguuuaguucuuuuaugugguucuggccauauuaguccaaagauuuuagccacauuaaugcaauaagauugaauuuaagaaauaguguauagcaugccaucauaacaaagugauaaagaagugagcuaagccaggugcggcagcucacgccuguauuccuggcacuuugggaggcugagucaggcagaucccuugagcccaggagcucgagaccagucugggcaacauggugaaaaccugucucuacaaaaaacaaacaaacaaacaaacaaaaacaccaaaauuaucugggcaugguggcggcaugugcuuguagucccagcuacucaggaggcugaggcgggaggauugcuugagccugggaggucaggcugcagugagccaugauugugccacuguacucuagccugggcgacagagcgagaccccaucucaaaaaaaaaaaaaaaaaaaaaaagacaacgaagaagugagcuauaagacaacucuguagacuggauaagggcucuugguuuauuuuacuuaucaguucauuacagauuuuguagaaagaguaauucaacauaauucuaguaauucuagugccuuuaucacuucauuuuauacucuguuuuuaaucagcaaacauuuuuguguaggcagaagagggagggaaaauuauaacuaaguuuauuugcuucuuaaugucaaugagguaucaauuuuuuuuucauaucccccaccucauuuuaacugcuucugcuagaaaauuauuuuauuucaauauaaacaaaaauccuuagcuauuccaagaagaaaaggugaugguaguauauuuuuucaccccuccuuucuuguuucuuuuguuguuuacaaaucauugaugaaaaaauugagucuugaucuugccuuuaauugaauuucauauacuccuaaaauuggcaguaggcaagcauuuugugagaaguugcugauuuguauauuguauuucugaguuuuaacuauaacauuuugucucuugugaauuuugucccauagucauuuuuuaccacauauacuauagaauuaguauuauuuugauuaaaauaaauguuauuucagaggugcaauuuuugcuucaguaagauuucuaauuuaagaagucauuuuaaagcuaaauuuaaaugagaaaaagagcuguugcacuguugauccaguugauccaguuuucucugcuguccauuuuuguauccuuugaguugcauucuuuuuaacauuuuuguauagcagauuuuuauuuuuguacauuugugcacauaaacuucuuguguggaggagagguuaaauuuuaauagcuaauggacaaaguauauaggauauauaguacaaccuagcucuuauucuuucuuuuccuccauaguauucugugauguagggauaaaauuuaaggaaaaggucaugguuguaaagccuugagaacagauuaaauacaagggaugccaugcagaauuuggacaguucuuccagaaguuagagaacuuagagcaacuucuuacaagggagcuuaacacuuauuaaauaauacaacauaacaguauugaaacaauuuauuuguggaugucuaucugauuaaaaacaaauguggaggcugggcgcgguggcucacgccuguaaucccagcacuuugggaggccaaggcggguggauuaugaggucaggaguucgagaccagccuggccaacauggugaaaccccgugucuccuaaaaauacaaaaauuagccagucgugguggcgugcuucuguaaucccagcuacuugggaggcugaggcaggagaauugcuggaacccaggaggcagagguugagugagcugagaucgugucauugcacuccagccuggaugacagagcgagacucuaucucaaacaaaaacaaaaacaaacguggaaagcauauuaaccagaguugaaaauauuccucuagcuuaaguguucuuuauuuagaguugaaauuuuaaaacuguagcuuucaaaaaauauugcauacucaugcuaaauuauauauguagacauuucuuuuuuuaacaaacggaaucauaguauauauacuauuuuaugucuuucccuuuauucaacauauuauagacagccuuccuuauuaacuuacauagauccacuuaauuuuuuaaaacuacucgcaaguauuuuauuauguugaugugucacaauuuauuuaaccucuugccaacugauaagcauuggauauuuagauuuucaauuuuuuucagccuaauuauuuuugaaacuuuauuuguaaacuauuaaaugcaguauucuuauuccuaauuuuuauugaagauuaucaguggagcaaaguuauaaaauucugaauaauuguuuagagauuacagaaauaaauaccagaucugagaaaugauacagauugaaauuuuauaagagaggugaguuugauagccaguuccaauuucauacucauauggacuuagagaauguuaaggaugccaaacguugauuuuuuuuuuugaaauugugaugaagauaauuaacuuacagaaugccuauuuuaauuacaguaccaugugcuaaacaugaugaaaccuuuuuuaaagguuuucucaugaguauguugccuuuuuugucauccugagauguuuaagaucuguaauuuuccauuccuugccuucauuuccuucauaauccuucucuauuaguuacgacucagggaaagaaauguuuguccucagcgaguauuuucuugagagaugaaucagugccuuccaauugauaaugacuaguaucuuauaaccauuaagguuuauucuagauuacuuuuuaaugaauuaauuuaucuuuacuauuuuaagcucuaaauucugcuuuuuuuuuuuuuuuuuuuuuuuuuuuuuuuuuuuuuuacagugaaucuaacauuauaagcauuuggaauaaugggaaaggcauuccaguaguagaacacaagguagagaaaguuuauguuccugcuuuaauuuuuggacagcuuuuaacauccaguaacuaugaugaugaugagaaaaaaguuacagguaaagucugaauggaauuuugguugaaaaauacuguuuucuuaauauaaaauguauaacuuacuaaggaaauugugcaguuuuggugugagaaaaucauugucagaauuaauauuuauaaacuaucauguauaaauauugucuugguaauaguuuaacagugacauuuaaaaaccuuaagacugauaguacauugacuuuauguuagaacugcuggaaguuuaacuuggcugacaguuugaguuuugauuuagauaggacugguaugaugucuauguauauaaauuuguuauuacauagcacugugucuuuugguauuaaguuacuuuuaaacuguuuuccuugagaaggucaggauugaaaaucuagacucuguaaauagaguugaaagugcuuugaccaaaaccauauauuuucauacuuauuuauguugcccaaauagguugauagguuuuuuguuuuguuuuguuuugcuuuuuaaaccaacgcuccgggaaaugauauagauuaaaauuuuguaauagagaagcaaguuugagagaaaguucagauuucauacucacagagauuugcugggucgugaaagauacaaagcuuaaugcuuuugaaauuguaaagacugugguaaauguacaaaauacccauuuuaauuacacuacuauauauacuaaaucuuaauuguauuuuucuuuaaauggaagaaaaucuaaauauacucuggaaucuucaauuggugauugguaaugcaguuaguggaacaguuuugcaacagccuugccguauggugguaaauuaacgaaguuccuuuaaaaucauuuuuacuaaaccuuuuacauuuaauuuuucuuacagguggucguaaugguuauggugcaaaacuuuguaauauuuucaguacaaaguuuacaguagaaacagcuugcaaagaauacaaacacaguuuuaagcagguaugcuagaaacacaucuauuucuuuuuuuaaaauaacguuuuauuaucuugccgagauaguagaaccuuggguaaauugcagugaugccuguauaacuucauuuuuuuuuuccaaagcauuauccaagucaaaucaucagaguaaagagacaucagaaugccugggagauuuaauauaagccuauuccucuaucauuccuuucaaacaaagugcuuuauuuaacagacuuuauuuaacuuaguuaaguauuagugaaaauguccugaaccucgcagacucauguacaugcaaccacuuaguguguuugaaaaauuccucaaugaaucaucaaauuuauauuucaaaauuuuauuuuauucuugaaggucuaugaaaaugauuugaaauuuuauauaagcuaaaauaauuuuuauuuuaaauuuucuuuauugcucuccagcaaccccguuguugaaguaagcuaaaauaauuuucucaggaaaagcaucaugcauguuuauuuuuguaaaagucuauauagucacguugaagaauuugagagauuuuguuggcaguuuauaaaguuguacaguuuaguuuauuuuuaacaugagauuauuaucacaguaauacaguugccucaggaggauugguucugggaugcccuuucuauaccaaaaaucagaggaggaucaagucccuuauauaaaaugggguaguauuugcauauaaccuauacacauccucccauguacuuuaaaucaacucuagauuacuuauaauauguaauacaguauaaaugccaugugaacaguuaugcuguauuuuaaaaauuuguauuuuuucccaaauauuuuuaagcugcaguuggucgaaucugcaaauguagaaccuguggcuacccaagggcugacuguauuuacuauuuuuuuuugucuguaauauuaucaaggauuuguuugguuuguugugaaguuguaaaauugauauaguuugauaaaugaaugaauuuaaugaguguagucuuuauauauuaugagauauggaagcauuauagaaauauuugaauuuuuuucuuuuaaagacauggaugaauaauaugaugaagacuucugaagccaaaauuaaacauuuugauggugaagauuacacaugcauaacauuccaaccagaucuguccaaauuuaagauggaaaaacuugacaaggauauuguggcccucaugacuagaagggcauaugauuuggcugguucguguagaggggucaaggucauguuuaauggaaagaaauugccuguaaguguccuguaaaauaguuuuaauacuauguuauuuuauagagagaauauuguugggucuuccuuuuuuaaagcucaucugguagucucuuuuacugguguguucagaugauucacauuuaaagugauuauugauacauuuggccauuauuucuucaaauaaugcuucugucuuguucuuuccuuuccuucuugguuauauauauguuacauuauuugauacugucugcaguucuugcaugcuuugucuauuuuauucacucuacuuccacuuuuuguauugguuuaauuucuauccccucucuucaaguuuagucauuugcagucucugcaucaaguuuccugaagagccugucaaagacauuccucaugccuucuauguuuuuuguuuuuaacauuuccauuugauuauuucuuauaguuuacaugucuuugcugaaguugcauauugucuacauuuuccauuagauacuuuaacauacuaauuaauuguaguuauuuaaaauacuuuaucugauacauguuacaaaaucugugagauacuuacucuguuucugauaaucgcuuuaucuuuucagauuguuuuuuucuugucuuuuggcaugcccuguaaguuguggaaaaccagauuuguuuuguagauaucgagguaaauaagcauuagugugggacuuagguuauauuuacccaggagaugggcuguguuugaaguuuguuuuugcuguaguuauuaguguugagguuuguuguugccgugaauaccagagacuuccagauucuuucuuguuuuugucuuuccccuuggcuuaggcccuucuuuuugagcugccccucagaggugaucugucucuugcagcucuuccagcugaaacccacuguuguuaauggaagcuugguagcaugaugguagauuuugggggagauguucucuaaugucucauuacaucccagucuuuggagugcauggugaaccuguaucucagggguuugaccuuuauaaguuuaugccucuccuccauagguaaagacuuuuuuucugcccucuauucucuuuccccagcugcagcagguuuccaccaguguucucagccuguguccuugagguuuccugcccugcagaauaagccuuuuuuugguuuuuuuuuuuuuuuuuuugguaagggagauagaucuggguugauuucccagugacuacuguuucugucucccagcuagcaccaugggagugcagaggggaaaccucuagauucucacuggucuucccugugagaauuugguggguuuucugaaagaaaaaccugcaagaguaugaaugaaugaacuuaugacuauagucccuagaagcuuuaugcauucaaacuaguauacacucuuccaguagcaauuagucaaaauuucuaguuuaaaguuccuacuagcuuauuaaauaucugccccagguaagcaaaagcuuagguuuuguggucuccuacagacacuuaugucucuccagacuucaggauggccagcucuccugugaucucaguucuucaguggguucaugaaaaacccauuaauuuguugucugaucacccguuuucuuacaaggauggaagcuuuuuuuccugcuaguucauuaucugucugaacugaaacuggaagucuaccuuaucauuuuaaaaauagaaauuucugaaauauuuuauaacaauuuaccugucccuucacauccucuuuuugucaaguacacauagaaaugaauuucuuuuuuaaaggucaaggguuaaggaauagaucugggaaaugccacuaagguuuggaucggugcacuuagaacuguuguaagugagaggaaaugaaaguauacguacugaaggugauucaccuauuugagcugccaguguaagauuuuuaauuguuuuuguuuuuuaaauuaauagguaaauggauuucgcaguuauguagaucuuuaugugaaagacaaauuggaugaaacugggguggcccugaaaguuauucaugagcuugcaaaugaaagaugggauguuugucucacauugagugaaaaaggauuccagcaaaucagcuuuguaaauaguauugcaacuacaaaaguaaguaagcaaauuauuuguuuccaagucagugguagaacaguacuucaauaaaaacuacaaaacaaauaacaauauccacaacccccaaaaaacccaaaucuguuuuuguuaaauaagaauugacuuaugaaaacaaaaaccuauuuucuaugaaauugcuguauuaaaauuuauuuaaacaauuauugagaaauaaauuuauaugacuaguguuuguaguugaacauauuuauauuuuaugaaauuuagaauaacaaauuccuuuuucuguaacuuuuagccccaccuuccccaaccucuggggagaggagagggggcuggugacugaguuaaaaaucaauuauggcuaugugauaaagcucuguaaaaacuccugaacaauggaguucacagaacuccuagguuggugaauacauuugaggugccaagaggguggcaugucuggguaaggcauggagcuuuguguacccuuuccccuguacuaugcccuaugcaucucuuccauuuggcuauuauugcuggauccuauauaaaaaacuuguaaaugaaguaaaguguguucuugaguucugugaccuguuccagcaaauuaucauuccugaggagugggucauagguucguuagaaguacaggaggccuaggacuuguaacuggcaucugaaguguggggaguccugugggauugagcccuuaaccaacccuaaauacuugugcuaacuccagguaguuaguaucaaaauugaauuacauuguugaacauccauuuggugucuggagaaucagagaauugguugcugguguugaaagcaccugagaauugguguuagaauugaagugaggaaagcaaacaaacaaacaaacaaaaaaaacacagcgguugguuuauuggcucuguagccaaaaugucuuauuuuuuuaaaaucucaacucucguucugagacucuauuacucuuuuagaaaauaggguuuauaauacagauaaaguauuuugcuacuuuaacaauacaggauuucagauuucauauauuuuuuuuucuuuaggguggacggcacguggauuaugugguagaucaaguuguugguaaacugauugaaguaguuaagaaaaagaacaaagcugguguaucagugaaaccauuucaaguaagggauguguuauauauuguacaugaugcauacauaugcauuauauauauacugaauuacuaaauaucagcucugauauugacuuuuuuggguauguuuucaacagguaaaaaaccauauauggguuuuuauuaauugccuuauugaaaauccaacuuuugauucucagacuaaggaaaacaugacucugcagcccaaaaguuuugggucuaaaugccagcugucagaaaaauuuuuuaaagcagugaguaaaacuuguauuuuuuuuauuguuguuauuaagaguugauuagguaguuuucuugauuuacuuuauuugugauuaguuucuuucaucguauuaacuguggguauaagcaugcuugcacuacaaacuaauaugcuuaauuugauaacuuuaaaggguagacuuuaauguuuccuaaaacaauuguuuugccaagaacuaaaguagggaauuauguaacuaauugcauuuuuagcuuuguauugaccauuguaaaggucagauuuccccuaacagauguccagauccuuaugcaacucuuucaucuuuucuacucucauuucaacuugaucuacugauucuuaucuuuauacauguuuaaaaauugugguaacauguauaacaaaauguacuauuuucuacauguucuuaaauugcuuugcuuugcacauaauuuuuuuaggcuaccuuaacuucucuaaaauaaggugagagcacaaauaaauaauggagaugaaucaaucacagccucuccucuuuggaauuuugguggggaaaugcucuauaacugcccuagaacuaauguauuucucaaauuccaaaaaguagauuaucagaaacaaaaacaaaaguuguuuuuuagguucuaacuuaaggccuguagaaauaguacuuuuggaucuaaucuuaaugaauucugaguacaaauuaugcuauauuaaugcuuucccaaauuucuguccucauaacaauuguuuccuugaugaagugauuugauuuuaaauuuuauacuuuuucauuuuaggugcacuaaguuuaaauuugacaacacaguucaccucuuuuguuuaugucuuaaacauuccagaaaacuguuuuauacaccuaacaucaaaucaccgaggaugauaaaaaaacuuuuaggacuuagaguuggagaugcuuaacuuucuuuuccuuuuucugucuggguuaacaucuugccacagauugauucacugcagaguacaaacaauauguaauguugaaaucuuuauuaccaagcuauuuaaagaauaaaagucuauucauaaguuaccaagguuauccuaauguuccuuuuagguuaauacuuuuugucauagugaauuaaagacucacguuuuguauugaaggauaucagaaaugucaacgucuggaauuugccggcuaguagguucauguguggaucuguuuucacuguguuaauuuuaauaaaauuaauuuguaacaagagcaaugcauauuccucauggaguuuauuauaauagaauguuucucauauguaaaaguuauccuuuuucauguauuuauauuuuagcuuuaauuuuacaguaguugaguaaaagcugauuagcauguaucaugaugcuuaucaccauuauuguuuugcccuaaaauaccuuaaaauugcacagauuccaggucuugcauuaggcccuauacauuuuagcuaaauguaugaauuuucagcuuguuuguauaccauuauucuuuuauuuuuaggccucuaauuguggcauuguagaaaguauccugaacugggugaaauuuaaggcucagacucagcugaauaagaaguguucaucaguaaaauacaguaaaaucaaagguauucccaaacuggaugaugcuaaugaugcugguaagauugauauuuuuaaauaagauuuugauuuaaguuucacuuuuauuuaguuacagaauuuuuuuauuuucuacauauaguuagacuaugauuuuccauucagaguaugauuuuacuucauugaaauuaucacauacacaacauauuacuaauuuucaggggauaggaauuuaauaaaauauacuuaauauuuauacugagcaauaauguaaaauaacuuuuauagucuuucacugucagcauucuaauguuaauuuucugacuucauuuuucucaucagugaaaguaugagaaauuuuuacuauguauaauuuuaaauuucucucaggugguaaacauucccuggaguguacacugauauuaacagagggagacucugccaaaucacuggcugugucuggauuaggugugauuggacgagacagauacggaguuuuuccacucaggggcaaaauucuuaauguacgggaagcuucucauaaacagguauguauguguguguauauauauguguauacacacaugcacacauacauaugacauuucuaauacuuuacuaaacuucucgaauuuuuaaauguaauuucugacucguauauuucaacacuucaaacuacucucagugcuuuuccuuuuugaacagaucauggaaaaugcugaaauaaauaauauuauuaaaauaguuggucuacaauauaagaaaaguuacgaugaugcagaaucucugaaaaccuuacgcuauggaaagauuaugauuaugaccgaucagguugguuuuaaaguuaccacauauuucaaauucaugucuucuucagauucucccuuuaauauuuguuuuaugagacuugcccgaagaugguauaacugaaagugauuauacaucaggaggaaaaaaugaaaaaaccacgucauuuaguggaaacauuuuuaugaagcacauuuuacauugucugauuuuugggguaacuaaggagaauauaauacagugugguacuauagcagccuaccuacaaguaggaacaaaauuauggaauuaacaaguaagaaagauuaaugauaaggguuaauauuuauacaugauggcaugauuuggaaugcacaaauaccaggacuuaaauaguaaaaugaugguaaucgagaaagaacuagaaaauugaaaaggaagaauuucagaugcauucaacuguuuucucuuaugcacucuaaaguauuuguagagaaaaucugcaacugaaaaaacugcuauuaauauauaguuuuaagcagaaauuuuccaauuuuuuaucuagggaagacuugugaauaucuguauuaccuggguuucccuaccauugcccauuaagguggcauuauaaccauguuuuauuuuauguauuuucuauccuuaaaucauucuuuuagugaaaucuggggaaacuauaaaacagauaaaaugauaauauauuuuuauaaugacagauucagucuauuacuacuauauucuuuauuuguguauuaaaaaauuuaguaugaucaucuuaauagcuuuuguaaaaugcauuucuaaaauucagaauuuugguuuuuugcauucacguuuuaaaauuuguuuauauaaguaaucauuuuauaaaaguauuacaacauuuuuuacuuuacuaacauuuauuuaggaucaagaugguucucacauaaaaggccugcuuauuaauuucauccaucacaauuggccaucacuuuugaagcaugguuuucuugaagaguucauuacuccuauuguaaagguacucuuugcauuaauauauuuuuauauuguugucuuaaaggguagcagaaaaacuaauuuuguuuuuuaauuaauuuaaggcaagcaaaaauaagcaggaacuuuccuucuacaguauuccugaauuugacgaauggaaaaaacauauagaaaaccagaaagccuggaaaauaaaguacuauaaagguuuguauuuuaaaauacuuagauuuuaaauacugauauaaauguauucuuaugaaagcaaucuaaaagaugacuugaaaguuugacuauuuuagacuucgaaaauagcuaucacugauuuuaaaguauuguuauagaaaaauguaugcaaguagaauaguguaauagauuucauugaaugggaucaccauuucaauggcuagucuuguuuccuguaaaccuccuuuauugccacuccauuaguuugaaaaaacuuccagacauuauagucuaguauuucaccuauaacuacuucaguauguauuucugaaagaauuuuuuuaaguaacccauaauaccauuaucauaaccuucuuuaauauccuauuguugagacagggucuugcuuugucacccaggcuggagugcaguagcaugaacacagcucacugccgccuugacuuuccgggcucaaaugauccucuugccucagcccccgcaaguagcugggacuacaggugugugccaccacacccagcuaauuuuuguauuuuuguagagaugggguuuugguuuguugcccaggcuggucuuggacuccugaguucaagccauccacccaccuuggccucccaaaguauugggauuacaggugugagccaccaugccuggcucccuuuuuuuuuuuuuuuuuuuaaauaauguuaaauacccagccaguguuaaaauuccccuggacuguauuaaaauuguuuauuuuuagaguuuuuuauuuuuauuuuuauuucguuuuuuuuuaauuguuuuuauuuuuuugagauagagucuugcucuguugcccaggcuggagugcaguggugggaucucggcucucuuccucauguguucaagugauucucaugcuucagccacccaaguagcugagauuacaggcaugugccacuaugccuggcuauuuguaguaugggugggguuuugcuguguuggccaggguggucuagaagucccggccuuaagugauccgcccaccucagccucccaaagugcugggauuacaggcaugagccaccaugcuuggccugaguuuguuuguuuuuuuccaaagucaggauccaaguaagguccacacauugcauuugguugauaaguuuauuaauauagcauuucucuuuuuauauuuuuuccuuguaauuuauuuguuaaagaaguuggguuguuuguucuguguaauauuccacauucuggauuuuguuaauuauauuccucuaguuacauuuaauauauaguauuuuccuuugcccuuauuuucuguuaacugaugguuaaaucagaggcgugaucagauuuggguuacauuuguuuggcaaaaacauuucauagguagcguugugugcuuucaucaggaagcaucuaaugucuacuuugucuuuaguugcuuauuaagauugaucacuuaguauagguguugccagcuugauccaucuauuacaacuuuuccaccagcuuuuuacuugaugguuuuaaacagacauugauauucaugacucacuuuuauuuuuaaaauugugcaggauuggguacuaguacagcuaaagaagcaaaggaauauuuugcugauauggaaaggcaucgcaucuuguuuagauaugcugguccugaagaugaugcugccauuaccuugguaauuaaguuaauuuuuuaaaagcuuuuguuagccaucccccuaccuucuauuccuuuccucccaguccugguucccuaugauaagucucuuuugaaugcucaagcuaguuaauuuuaauuuuucccccagaugaugcugugcuuguauaaacuucuuuaauugaaagaccuuaguuuaaauguguuuuugauuaaaauauuguaaaauaaccuaauuuuccagaaauuaagaauuaguuauuggccacuuauacauuuuaauuuuguaauaaaauuuauuuuauuuuuaaugugcaaaaucguuaccuggaaucuuucaggcauuuaguaagaagaagauugaugacagaaaagaaugguuaacaaauuuuauggaagaccggagacagcguaggcuacauggcuuaccagagguuagucuuaaagaguggugaccuggggaaagaaggagagagagacuagaauucaugcaguaauaaugauaauauugcuauauaacuuuucucuuagcaauuuuuauaugguacugcaacaaagcauuugacuuauaaugauuucaucaacaaggaauugauucucuucucaaacucagacaaugaaagaucuauaccaucucuuguugauggugaguaauauuuaaaaaccucauuuuuuaauguuauuuacuauaguuuaauuucauguacuuuaagccauccuuaugauacauauuaaaauucuuacuuuaaaucuuguauaugaagagcuuauucagaggaauuuaaggccuuuuugauuuugcuuuuguuuuauguuuucauagugcugaaaucuuuaauauuccuuaauuugaaacuuuuaaaccuuuuccgaguuuuucaggaaaauuaacuuuaaaagucuuaaagcuuuugcccaaguugucugcagauuuucuaaaaaaguaaaauggaacuuugauaauuucuaaaauauuuaucagagauuaaauuuuaaaaagcuuuuauucuguauuacccaaagccuaaugcuuuaacuuaacuugaaaaaaauuuaggaacuauuucuaauuugaaaaaaauuuagaaacuauuucucguuaguugaagcagauuuugaucuucuaucuagaacuuuuuuuuuucucauaaccuuuaugaaguuuguugaucuuuguauugcuuggcuuuucugguaauagcagauguuucuaccuaucccucaaguucuagccacaaaucgccuuucuucuaugaagccuuccuagcaauucuacucuaaauuggucuuagauaccuaaacuucuauaccaauuauuauguaccucuuauuuuaccuuuguucauuuugccucuagaauuagauuacaaaauucuuaaagaaguugccauauuuuaucauccucauguuuuuaccauacucuggguccaguaugauuacagugauagcauauacugaaaagauuguuacugugcuuauuggccuagagccagggugucuaaccuuuuggcuucccugggccacauuggaagaggaagaauugucuugggccacauguaaaaauacacuaacacuaacgauagcugaugagcuuaaaacaaaaacaaacaaaaaacaaaaauaauugcaaaaaaaccaaaaaacaaaaauaaucgcaaaaacaaacaaacaaaaaaccucaugauguuuuaagaaaacugacaaauuuguguugggccacaugcagcccacgggccacggguuggacaagcuuggccuagagcaagaagaaugguaagggagcagagugauuugcucacauuguuucaugcaauccuuaugaaaacuauauuaagaaaguaauuauuucuauuacuuggaugaggacauagacuuacuaguuauuugcuuagucacaugguaaauggccaaguugagaagaauauacagauuagugagauucuaaagccuuuauucuucacuaccacaauaaaucgcuuuuuauaaggguuuuccugaugugggauacuuagaauagauuucaggcuccuugauggcaugcuggcaauuuaguuagcuacaaauggcguuuugguuguuugaguguuuggaaacuacuguuaaaggaguuugguaccacuaggugauucuuuaaggccagaauguugucuuucaauuggcaguucacuuuuggaguagauggagauggcauaaaaacaucuuaguauauaccugcagauggcuuucuaggaaaaaacaaacaaacaaaacaaacguguuaguauguacucacuuuguuacagaaucucaaguaacaauuuuacugguguucuugaaaagcaaauuguaucuuugcuuuauuccccugaauuguuacaacuauaucuugaaguaacauuuuaaaagagcucuuuuaaaaauaggcuuuaaaccuggccagcggaaaguuuuauuuaccuguuucaagaggaaugauaaacgugaaguaaaaguugcccaguuggcuggcucuguugcugagaugucggcuuaucaucauggagaaguaagcauuaagauuggaaucaauugagaacuguaauuauugucuugaagaaugauaauuacacauaguauuuuuccuuuaguaaagucuuuggaaauguaaaagaauuaagagaauauacagauuagugagauucuaaagccuuuauucuucacuuggauuuuaauucaaguuggggaguaauuauagaaaauuuagaauauuaauguuauguucugccuucuucuguuguauagcaagcauugaugaugacuauugugaauuuggcucagaacuuugugggaaguaacaacauuaacuugcuucagccuauuggucaguuuggaacucggcuucaugguggcaaagaugcugcaagcccucguuauauuuucacaauguuaagguaaauauuugcugauauaaugguauaaaguuugauuugauuuggaaccaacuaacuaaauguucgauggaauuauagcuguggagagaugugauuaucugguuauucuacuuagaaggugaauguuccaaauuauuugaccacaaauagaaugaagucuguugaccuuaauuuuuaugaauuguuggugaaaucaguccuagugaauuaaggauguuuuucucaccaacuuuacucuuuaggcugaagauggguuauguacuuuauuuagaguaauaggaaauucuuuaaaaguuaucaauauuaaaucagguagguaaguacauaaguaaaauaggacuauuuuauucugggcuuguaacugagagaaagaugcauuugaauaauacaguuaggcaaauuuuauuauuaagcggauguaaucaaaauuauuaaaaaugcauucucuucaaaagauuuguuuuugcagugugaaguuuuuaauuauguauaaaguuuucuuucccaaagccaugacauuuuuucauuugcuucuuuuuguuuucauuagcacuuuagcaaggcuacuuuuuccugcuguggaugacaaccuccuuaaguuccuuuaugaugauaaucaacguguagagccugagugguauauuccuauaauucccaugguuuuaauaaauggugcugagggcauugguacuggaugggcuuguaaacuacccaacuaugaugcuagggaaauugugaacaaugucagacgaaugcuagauggccuggauccucaucccaugguaauuauuuggaacuuauuauuuauuuaacaaaugauaauguguaaacuacaaauucccgucauuuuagaaaaguaauggaacauuuuuauuuuagaacauauuguagaccguaaagaccuaauuaggguauaauuugauaugugccuacaguaaaaaguauaaacuuuggaaugaguuuuggagguaaguuucauggggagaaacuguuuauuuaaauuuagaaacaccucauauuccagguuuucaaaccucuaaacccuauauuauuagaaaacaauccuuuucugauaaaauuauguguaaccuuguuucuguucucaaacuaccgcuuaauaguuuguaaggaugcuuaaaaacacauuguauucauuaguguaccauuuguaaaaagacagaaaacaaacuaccuuguauauauuuuaauauauccccaaggcugggcgugguggcucacaccuguaauuccagcacuuugggaggccaaggcauauggaucaccugaggucaggaguucgagaccagacugaccaacauggggaaacuccaucucuacuaaauauacaaaaaaaauuagguguugcucaggcucacgccuguaaucccagcacuuuggaggccgagguggguggaucaccugaggucaggaguucuaggccagccugaccaaaccagguagaacccugucucuacuaaaaauacaaaaauuagccgggugugcuggagggcaccuguaaucccagcuacuugggaggcagaggcaggagaaucgcuugaacccaggagguggagguugcggugagccgagauugcgccacuguacuccagcuuggggaacagaaugagacuccgucucccaaaaaaaaaaaaaaaaauccccauuuuuuuuuuauguuuguuguuuucuuguaucauucacucugcucagaccuccuccaagaaaaauguccuuccuuccuccccaugauuuaaaauuaccuggagaaaaguguauuuuuauuaccaaaaugauaauguuuauuguagaaaauauagguaagcaaagaguaaaaaaauccauaaacccacaauauagagacaauauuuugauguauuuuuccaaguuuuauuucauuuuuguauuuuaaagugaaaguuauucuuuagcaauaagacauauauucugcuuuuucucuuaaauacuucaaaguacuucaaaauauuucuaacauaagcaucaaauuuuuaaugauaguguuuuacugaaaugguuuuggauuuuuaaauggauuuuagauuguuaagauaguguauuugaucaauacaugguucuuaugugccuacuauguguaugaaacugugcuaaguggugagauaaagagcuaugguuuuuaucuuugaaaaguuaaacaguugucaagacaagacaucaaagcaucaaggcuugaaguuuaacagugacaaacgauauugauaguugcuugguaugccagaagaaauguccuaugcuauaugcucaauuucuuucuuucuuuuuuuuuuuuucugagacagagucucacucugucacccaggcuggaguacaguggugugaucuugggucacugcaaccucugucucccagguucaagugauucugcugucucagccuccugaguagauggggccacaggugugcgccaccaugccugucuaauuuuuguauuuuuaguagagacgggguuucacuguguuggccaggcuggucucgaacuccuggccucaagugauccgccugcuuuggccucccaaagugcugggauuacaggcaugagccacugugcccggccuauauacucgauuucuuaaugauaauaacgaauaagaauuuuagaguaggccaggugcagugacucaugucuauaaucccagcacuuugggaggcugagcugggcagaucacuagcucaggaguugaagaccagccugggcaacauggcaaaacccugucucuacaaaaauacaaaaauuagcuggacaugguggcacgcaucuguaaccccagcuacuugggaggcugaggugggaggauccuuugagcccaggugguugaggcugcagugagcugauaucgugccacggcacuccagccugggugacaaaguggagacccugucucaaaacaaauaaaaacuuagaagagggagagaggacuuguaauucaguugggaaggaugaguaagauuuauguagaugaaugaugaauggaaugggguugggccugaauaugugucaggacuuguggauagagugaaagugagaauauucaaaauagucaaacaaaauaugggagaagaguagugguuuuguaagacaaaucauuagagaaaaaauugaaagccagauuggguccagacuaugaaaugcuuucaauguaaggcccaaggaguuugaauuuaaaggauauugaucuaggagagaaguagguguaggggaaguaggcugaaagaaaguacuguucuaggaagacuaggaaagaugauacuaacauuuugagauuggaggauguucagguuguaugaacagaagcuaugaauucaagcuuaauugaucaguuggaaagggacaauugaggaugagaaauucuguuucaguuguguuaaucugucaauguuagaccauagacucaugguacugguacucaagagagaagucaaugcuauuuaccuuuuucucuacagcuuccaaacuacaaaaacuuuaaaggcacgauucaagaacuuggucaaaaccaguaugcagucaguggugaaauauuuguaguggacagaaacacaguagaaauuacagagcuuccaguuagaacuuggacacaggucaguguaaauaugugaucugccugagggaagggcaguguauuaagcaauuuuuucugguaaggaugauuccaccguuguugguccuaagcgugcguaguguuaaaaaauuccuguaccuucuuuuacccuucaguugaauuugugcuuugaauauuuaaauaguauuuauaucuaaguagcguaguaugacuuauguuagguaaggcuuuuauagacuauuaucuuuguauuuauuuaaaauaaaaggaguagaauaugacaguguuuuuaauucuuguaaauauggucaguaaauucaugucagcaucagcuuuacaaaucuaaaaguaugcaugucaccucuugacaguuccaguugaugucauccuuuucauacucagccuuuaucuugcccuuuagaguaugagugggucagcaccauuacuucuuaugucuuuucccaccaccgagaucccuguguauugccuucuauacugauuggauaggagaugauagagauugagguuuccuuuuuaauuccccaugagaguugagaauuuucaagacuguaugacuuguaguaugagaacaugagagugugucaugaaaagaaucacuaauuuuuaaaucuuuauagguauauaaagaacagguuuuagaaccuaugcuaaauggaacagauaaaacaccagcauuaauuucugauuauaaagaauaucauacugacacaacugugaaauuuguggugaaaaugacugaagagaaacuagcacaagcagaagcugcuggacugcauaaaguuuuuaaacuucaaacuacucuuacuuguaauuccaugguaauuuauuagauuuacuguuaauuuaaucuuucuugcaugguauaagucggauuauuauaauugguuucaugaugggaguggcuauaguaagccugaaggcauuuuuuuuuuuuuuuuuuucccauccugcagauuugcugaagauucuaggggcacauuucuuucuucuaguauuguccacuacccuuauucucaacucuguguuuaugcaucugggcuugaaaacacaggauacacacaucuucacacacauugacuaaaaguuaugagagugguuauugcagggccuuuguguacuuuauggccaucucuauuagcauuuuaacuguagaguacucauaacucuaaucugcuuuauuaaacuugcacauuuaucuuuauuuauacaacuggggaggaagguagaaacuuuaagugugugauucaaguuccauuccaaauuagcuuuuagaucuaaaaaaguaaaaaaaguucagcaguaguacaguggcugagaaaaagugccauaauccgcugagaaaggcugauggaagaaagaaaaaggauagagaggaguuugggugacuggauuauagcacaaguaaaugugaaagcgagagaaaggggacaaaugcguauacacagaauauaugggggaggaaaaacuugaacauuuuuaaacuuagcaauagaauauguauguuuucaguuuggggaaaaaucauuuuuguaggugguuuuaugguuacuuuaagagcccuuuuuuuaaggccuauuuuugucuuucaauauuauuccuaaauacuuuuguugugagaauugaauuuauuggcuugcagucaccaaagaaauauuuacagaaaugugcuuaauagucuuaguucuguuuaaugguuuuuagggguagucuguguucacacacaugcauuaugguuauauauuaugguuauuuuaaguauuguagauguuauauaaguuaaaauaccaguacagaucuauaugaucugcaaaguauauguguuuugcuuagguacuuuuugaucauaugggaugucugaagaaauaugaaacugugcaagacauucugaaagaauucuuugauuuacgauuaaguuauuacgguuuacguaaggaguggcuugugggaauguugggagcagaaucuacaaagcuuaacaaucaagcccguuucauuuuagagaagauacaagggaaaauuacuauagguaagauacaaccuuuaaaaauuugaacauuaguuaaaauggaaaaaaaacuuuauuaauagaagacauuuuuaucaguagaauauaagcaaauacaaauugaaucucuuaucuugauccuaacuuuauuuuucccucacauagagaauaggucaaagaaagauuugauucaaauguuaguccagagagguuaugaaucugacccagugaaagccuggaaagaagcacaagaaaagguaaucauuugcagaaaaagacauucagagaagcuuuuaaaagcaacuuccaaaacaaacaaaaauucaaccccuaaauuuuaaauuuaguacuacuaaaggugcugaguugucuauuuagagacuaaagucuucuguuuauccacagaacagauaaaguacaggaauuuauaguacacacccaccacaaagcacuuggccagugugacucaaccagagccuggagaaaugacuccaggugugagaagguagcucagucuccuugaccuuuuuuccugagucugccauuaaaagguguugugguggugguuuuugugagguacauguauauuaccugggaaucagacugguugcacccagaaucagccuauguucacaguauggcauccagucaccacucacuugaucugguuuugguuaauacugggaagacaagagacaaaauguuaauuauuauagacaguauuuaucaaacaccaagcucugccucaugcuuagauuuuuagccagagauuuaaacccuggaacuucagauuaaaagucugauguuuuauuaaguaaguugcccauugcagaucacaaaauaguaauaauaguuaaaugaaugggauauugaagcuuugagaguccccucaauuagcuuuuugauguuuuguauaacuaaaagaaaaauuuaagcaacaguacaacauugugauugagaacagaaauuuauuacagaagaggaagaaaaguugaaugauuaauuuuuuggguauuagauuauuuugugcauauaugauuccauaacauuaacaucuuuaaaacauaguuauaauugugugacauaacuugaaccuuuaaacuucccuguacuugaguucucaaucauaauguuuuuguauuuuuuaucaaacuacauugaaauauugcuuuugcuuacauuuuucaguuugaagucaauaaaagucauauauuaaagugaguaaaauuagacuaaguuauauagaauagcaauuacauauuaagauaauaggcuuauucauuauuugaagaaaauucgguaggacaagaugggcgcauucagaguuaagaugauugaagcccuuuguuuuccucuuaauguguuuuauugaaccccaaauuaugguuucuacaacacuugccuuuugccuuucuguaucaccguugguuuaaacuauauguuuuuuuuuaaaaaaaguaacuaguaagcugaugaauuuuuaaugcuuagucuuaaaagauaaagauuucuacagugucagaauguccuucugguggaaguagaauuuauggguaaagccuagcuugauuucaguuauugcauuaccaccaucagaauuuuuucagcaucuuggccauguguacauuuuggggaguucagguaacaaaaggaacugcucuuacaagaguguccuauuauacagaguuggagaaaagagaauuauaaaguagcuaauuagaagauuaaaguuuuuuguaaagcauaauggaauuuugucauuagaacuugcaaaguuuauuuuuuuuuuuaauuucuggaaguguucuuagucauauuuauguuaacggugauagauacacauauucauagaacacuucuuaacaauacuuuggguguagucaaaaccuagaucuaauagacuagacccacuaaaugugggucuaaacaggauuuuguuguauccuagugauauuuuuauaguugucuaacaaccugaauacuccauagaaacaagcuguuucaugaagaauuuuucaaaaguguagaauuauuuauuguaaguuaucuagguacuuauuaaucaucuaucaacucaacaauagcauuccguauuuggcuaauguggcuuaaucaaauuuauaguuuuuguuuauauaaugaagcaucuugcuuugcaguuuuaauuuuuaucuuacuucugaaguacacguaaacuguacuuuguguauauacauuguuuugcuuacaaauuuuaauuauaaagcuuuuuuuuuuuuuuuccucuuuugguuaccaaaaguaaacuuuuugcuuuauggagugucaugguuaacucagucauuuuaaauuaaacaacuuagauaaaauuuuauuuaauggcuauuguuauuuuaaaaaauuuaaaggugauaucaccuaaaauaacuuuuauuaaauucauuguauuuugaaauuuaauauuagcacaaaauaauuuuuuuguugcagcuguuucuauagacaagggccugaugaauaaaauuucagcaaaacccugacgaaauucuuacucuaacucaccaacucuuaaauucuuaaguggacuuucucugaguccugacaugaauauucuggcuuuagagaaguuuuuauuaagaauucacccucagcgagugaauguaccuuaacauauuuauuauaacuguaaaauaauuuucauaacugguauuuauuuuguauuucagauuguucauucacucaccaguauaaaaaucugacaagaugcagugauaaaacauuaauucuacucucuuaacuuuaaaaugugguauccucucauuuuguuacugaguaccugaggaaaucaguuaauuuuucaucagauuccuggauaaauagggauaguguauaccauuccuucugaagaucuuauugugcgucuuuagaaaauuuuaaacuuuuuauaaggaaauauauuuuuauagguaauccaaaauaaccccaccauccugaagauguagcauuuauaguguagcacuuguagaauuuuaaacuaauuauucaauaaaauucaacauuaauuugauacuauacaagacuuuaauauacaguuuguuauuuuuuacaggcagcagaagaggaugaaacacaaaaccagcaugaugauaguuccuccgauucaggaacuccuucaggcccagauuuuaauuauauuuuaaauaugucucuguggucucuuacuaaagaaaaaguugaagaacugauuaaacagagagaugcaaaaguaugaacuuuuguggguuaaauaguuugaaacuauuucaguguuaucuguaucuuuuucuuuuuccaaaaauaaguauuuugauuuauccuucauauguuuuaaaacuauugaauguuuaaacuguacuuuuuuauuauaggggcgagaggucaaugaucuuaaaagaaaaucuccuucagaucuuuggaaagaggauuuagcggcauuuguugaagaacuggauguagguuaagucucuauuaaaauuuauuuggaaaagucauguuuaugaacaagaaugaaauucuuuuaagugaucuuaaaguuuucuuuaacucugugaagguuaauauguuuauaaguugaguuaggcuuaagcuucuaguuaugugaaguuauaaagaacuucuuguauggaggaauuuaaaugcuaugaaauugaaauuuagaauaaauuaaaucugcuuucaauuaguuaaaaauuuuuaacugaguuuuagauuaaauaauugauucaguuuaauguuuuccuggaaagagguaaggcuaauauguguguauaauugaauguaaguacuuugauuuuaggaguagaaugauagucucuacauuuauaacagacauuucaauauuugauuguuauaacauaguuuuuuccaaguagaauucuaauuuaaaaaauaaaaaaaauguagagauauaaaaagcacaccuuuucuaaaauugcccaauuaaaauauuggaauuaaugguagcauuaugaauaccugauuuuugaguagcaaaauguaaaauaccauuuauuacucauacuacuuuuuuuuuuuaaaguugcuuuguugauuuauugucuacaugcucuacuuuuacuucaguggucuaagucagaauuagaacucuuaagaacaagugugguaaauuagcugccuaaaagaauuuagaauuuuuuagugcuauuuuucuaggcucccucaacgaucuuucaagugcugcaaugugagucuuccuuuuuuugugcuuuccguauauuguucauuaauuaguuuuuuugcacauuguuuccugcugaguuauaauuuauuuaaaaauuauucauuaaaaaugaagccaucauauauuaaaagaaaaauuauuccuaauauuauugauauccugauauugcuuuaaauuuggucacuaauauagugaaacacaggaaacuuuugugguuaugccuguacauuuccucacuauugaaaagucgucauucaaaacaacccuagcaaaaaauacucuuucacuuuuaauuuaucaucuuauuuuauuauuugacaauuaaugaaauagguccaaacaacuuauuuaaauucuggauguauuuauuuuuaacauuuaaaaagauuuagacuuaaauuucaugucucucuguaucauuuaaagucuaaugauaacauuaauugaauaucuauuguacacuggcacagccuucuauguaaugcuuagagugacccucaccacaacuucaaaugaaugagguuaucauuaaccuguauuauacagauaaggauccugaagcuuggagagguuaagucacuuucuuaggaauuauaucauuauagaauuacucaucuucucagacacccacuuuccucaucuauaaaauggggaucacaggauuuuuuaaaugccuagcacaugguggaugcucuauaaauuaucuggcuuuuuuguuuuuuuuuuuugagacauggucuugcucugucacccaggcuggagugcagugguacaaucauggcucauugcagccucaaccacuugggcucaagcaguccuccuaccuuagucuccugaguagcugggacaugugugccaccacaucuggcuaauuuuugcauuuuuguguagagaugagguuuuguuauguugccuaggcuggugucaaacuccugggcucaagugauccaccuaccucagccucacaaagugcugggauuacaggugugagccacugcaacuggccucuguuauuuccugaggauacauaacuaguaaguggaagugcaguugaaauccagaacuaucugauuucaaagcuuggguaauuucuauuaaacuguugugcuacaaagaucuuuuaaaaaaaucucuaaagaaaugucauuuuuuccuugugccuuucaaagcuuauuuuaaggaauaauucugguaaaugcaaaaucuaggauauuaaucaugauuauauccuaauuuaucauuacauagaccugccugaguucaaucuaauuauauuggcacuuuuaacuucucauacuuucugacuuuaauuuacauuuaggagguuuuuuuucauauuuucuauuacgacuaaagcaauagaaaaaaauaacuucauacuuauuagcagaacugccuuuguauaugauuugcuaggauuuugaugauacuagguuaucagaggucuugauuccauaauauaucacgggauccaagaauuggcagagacuucucaggucauuuagucacuauugcccccucguauuacaaaugggaaacuaguuagaugaauugggauuacaauccaggucuucugauuuagaauucuuuauuuuuuuuccauuauuuaaucuugaauuagauaaguuaaaaggaaagcuuuauucuuuacugagugaauaacauuuguuucaguauuuuaugaaguagugauuaucuuuucuaagaaguuguuuauguuccuucugccuuaugauuauacuuuagaaaguggaaucucaagaacgagaagauguucuggcuggaaugucuggaaaagcaauuaaagguaaaguuggcaaaccuaaggugaagaaacuccaguuggaagagacaaugcccucaccuuauggcagaagaauaauuccugaaauuacagcuaugaaggcagaugccagcaaaaaguugcugaagaagaagaagguaugacauaccucuugucauugauagacucauuucuauaaugaaauauauguauaauuuaaaaaauuuuaaugcguguuuaaaucaugcuuuguuuuauucaaaauauauuucaaugguaauaggaaauccuucuaugacagcaguugaucuauagaaggaaaacauauugguaaaggaucacauauuguaaagagcuacuuaauucagcuuuuaaaaugagaaauagaaacacuccacucagcugccuucuaaguuaaaaucuuggaagccggccgggcacgguggcucacgccuguaaucccagcacuuugggaggcugaggcgggcggaucaugaggucaggaggucaagaccauccuggcaaacauggugaaaccccgucucuacuaaaaaauacaaaaaauuagcugggcgugguggugggcgccuguaucacagcuacuugggaggcugaggcaggagaauggugcgaacccgggaggcggagcuugcagugagccgagauugugccacugcacuccagccugguugacaagagugagacuccaucucaaaaaaaaauaaauaaauaaaaauaaaaaucuuggaagccaaaacaaaacaaaacaaaaaccuccaaaaacccaaccauaaguauaucaacuuuaaaguauaaacuuuagugcuacaucauaauccauuagagaagacuuagagugggaaagggucuguuuggcuuacaaaguacucugucaucuuuuacuauuuacuuguguuuguccuuaaacuaccaagcacauccugugucauuggcacugauaggugcuauugaggauuaaaaaaaaaaauggcguugaccuaaccucaagcaggauugaccagaguuagccggaagaaggaaacaucagaaaaaauguucagagcugaggaaacagggugcauguuggucuuagagaggcuaauguuuuuggacagguugauuuuuacaauccagaaaguauacguuuagauguguccaacaaguaggugggaauauagccucauucuuacuagagcuuggaaaaugagccuaaagagcuagaguuagagauuggagaguucucugugcagagcuaauauuugaagcguaggugcauuuugacaccagaguagccuuucucuucuguucugauaaacucaggucucuacuacuuuccucuuacuuggcuccccacggcacacagguucauuuacccagauacucuugccugucucccucggaagaugguuucuuuucaguuggcguuugucagauucauuucucagcauucuuuucucuaccuuauaugguccccucaaguaaccuuaucuaugcccagagcuuauuccauucauacugauggccccuaaaucuguguuccuaagcuauaaugcuuucaggagugccaagcucauagccacuugaaugcuugaagcccaucaaacucagcaugucugaaacuggauucauuauccugauuucaaaaucuguucuuugccuuaucccaguuaaugacacuaucagccaucaaugauauaagccaaaaaccugggaguuuugucauuuaaucaguaacuaaguccuauugacugccuacuaaguaauuccaaaauccacccccuuaucuugguccccauuugacauugccuuagaauuuuguguuuucucugagauacuuuaaagugguccucuuaacucucuguuucuagucauuuaaucaugauuucuccccuuuucuacuucauuccuuuaaguucuauauuuuacuacuagaaugaaaauucuaaaaagucagucugauuguuaggcuuaaaaaucuucagugacuccccacugacuaugcacaaauucuugguauacaguguuagcaccuguaugccucuguguguuucuucuccuggcuacuuuguucucacuuuuccuugaguucuagcagacuauuacauuuaaaaaccuaauucuuuaaacauuuaauuccuguuagauggcuuugugccuucugccugggaugcccuucccuccuuaauucccaccuggcaaaccuauguguuuccuuuagaacucagucagaaaagguacuucuccauggagacuuuuuugacccugccuugagcagaguuucucacuucuccccuugggccauggcuguaccagccucuauauuuguuauuuguauuguaaugacucauccuuguugugugccucuguguuuuuuguuuuuguuuuuuuaccccauggucuuaggguuggggucuaccuuacagugccuagcagugcaagacacauguuacuuauuuuccuucaauaauuugaagauuuuuuuuuuuuuugagacagaguuucgcuuuuguuucccaggccagaggcucaccgcaaucuccgccucucagauucaagcaauucuccugccucagccuccugaguagcugggguuacaggauuuuuuaaugguauauaaaggccugccugagcuauagaaacuuauuuugcagguaccuuuuagcuaguggucuggaaaucccucugauaaucaaaagcugccuucuuauuuuuuaugguugcuucuaaguagcugucauuucacugaauguacuggaaaauuaagaguuacaugcaauauuauuuacuauagauaagugaaguaaaacauggucugaucaaagucagcuguuaggaccucaucagaaucacuguuuuuaaauuuaccugauuugaaggcgcuaucuguugauugaaacuaucucuaaaauaugugauguuuuuauuuuuacucguggcuugauuuucuuuuuauuauguagggugaucuugauacugcagcaguaaaaguggaauuugaugaagaauucaguggagcaccaguagaaggugcaggagaagaggcauugacuccaucaguuccuauaaauaaaggucccaaaccuaagagggagaagaaggagccuggugagaaaugauuauaguuuugcaugugugugagagaaaaaauauuuguauagaguauuacuagauucuuuugauugugcucuuuuucugguaguugaaauaaugccuucaauuuucauaaacguuuauuuuguaaugaacuuuucauuauaacaauuuuauuuuuacuaaugacauuucuauaaauauggauacauaccuuauugcuauucuuuugcuuuagguaccagagugagaaaaacaccuacaucaucugguaaaccuagugcaaagaaagugaagaaacggaauccuuggucagaugaugaauccaagucagaaagugauuuggaagaaacagaaccugugguuauuccaagagauucuuugcuuaggagagcagcagguauuguaacacauuuaauauuacuguauauuauaguuuaaccuauacguugguauuguuaguauuaucaguguuguuuaaguacuaagccauuaguauuucagaaguuaaaguuaggaagaaggaaaaaauugccuuauagaacagucuuucuagcaaaguuggacauaaauuucucuaaagugaaucauguuucuuuccugauuuuuauuauaaaguuugguuuauauuccuuccacaguuuuaagauguuugggaaaaaauguaccuugccacaauaccagcaaugauagaucuauuaauauuagaagugcuuugugguuuuguuuuuguuugguuuucuaccccuuauaucaugaaaaauuuccucccgcuuuaaaagucugaguacauagcucucuuuuagauaaugauaguugugcgggugaacugcagaaucccauuuugcuguuauaauaauauaguacuuauaagaauauaauuugauccuuucugaauuuucauuaaggagaaguguugaaguuauuaacaucuagugaguuuucuauuuuguacauucuucugaaauuuuguuauuugaaaauuuguccuaauuuauuaaaaugaaugauacaacauuguggguguuuaccucugggaaguacauuuuuaauuauauaucagaccuuaaauucuuugguucugcaaucaccaagugauugaauuucuuucccuaguguacauagguagcauaauauaggugaaucuuuaauaugaguaaguuauaugaaaaugguuuauuacauuaaaugcuuuaaaauuguauuuacauacaucaaaagugaagugcaaaauuaacauccaaguaauuuaaaaauuuuauuccauaauacaugcuagaaauuauaauaaaacauacuugcuuuauggcaauaugccuuucacgauaauugguaucuuuuuaugcauuguauuauuguuuugugaauauauugaggucuuuaugucuccugucuuuuuucauucaucuaaaaaauuacugucuuuguuauuucauaguaaaacuaacucugaagagaagauagaaguuuuuauccaaaaaguuaagagaaaguuuaggugucgguacaguggcucacgccuguaaucucagcacuuugggaggcugaggagggaggaucacuugaggucaggaguucaagaccagccuggguaacauggcaagacccugugucuaaaacaauuuuuuaaaaaaaaucagccaggaaugguggcacaccuguagucccagcuacucagcaggcugaggggugaggauugcuugagcccaggaguuugaggcugcagugagcuaugaucauaccacugcauuuccugcccaggcagcagaacaagacucugugucaaaaaaacaagaaaguuuagcacuuuuaaaauaacuguaaaauuuguuguuugugauugcaaauaugggaaacauuguauuuguugucauuuguauaauggcuguaugagacaaggccauauugacuacuuuccucaguguuuuugauuaauuauuaaguauaucaauaaguacauuaguuuaugcucuccuaacaugcacaguauuaugugguagccuccuggaaaguguaagacagacauuaacacuaccagauaacuaaggccaaaguuguuggcuuuuauucuguaaaugcuugcuuuuauuucuuaugguauuuuuagagaugguuggaauauacuucaaaugcuuuaucaguaauaauaauucauguauacaaagcuaggauuugaguuuaacauucauuuuuauuuuuccuccuagccgaaagaccuaaauacacauuugauuucucagaagaagaggaugaugaugcugaugaugaugaugaugacaauaaugauuuagaggaauugaaaguuaaagcaucucccauaacaaaugauggggaagaugaauuuguuccuucagauggguuagauaaagaugaauauacauuuucaccaggcaaaucaaaagccacuccagaguaaguaaugcuauuuagugaugugguauaguuaauuguuguaaacauuugccaaagauauuauagugagcucuucuaagaaauuguuaucauucuaggcaaguucuucuucaugaaggaaucaaucuuguuaauauugcagcuguucccaucacaguugcuguaguuuaaaggaaggauuggcaaacuuuuuccauaaagggcucaauaguaaauguuuuaggcuucgugggccauauuguuucuaucacaacuacuuaaugcugccauucuaguaaaaaagcagccacaaaugauauguaaauaaaucaguguagccauguuccaguaaaauauuguuuacaaaaauaggcagcagguccaugggauauaguuggacaaccccugguuuugagaaaaguuacuaaguccuuagaauugggagguuuguuucuucccuaaauuuggccuugauagauuuuucuugcuuuuggugagcgugaauacaucugggauuugagguuugugaacuauuuuagauguuuuuuuaaaaguauuuucucaccuauuacaauuggccuucaccagauccugaaauaauugcccaccuguagucuugaauuagaaauaggauuguugccuggugugaugggaauucugucuuuuuccuuggguuuuuguccauaguuugcugaucuuaaauucuggaaugguuauuucuaucaacuguagaauuugguuuaagaauuugguuaaguauucaaaguauuuugaauaacuuuaaaccauugcuuaguuuccauucuuuuuuauauuaaauaauugauuuguauggugucugugugcauacgugguaugugcacauggaucauggguaugugugcacacuuuuacacauaagagagaaagaguuuuauuacccugucuuuaacagagaaagagaaagaaaugaaaacuaaaguuuuguucugugauuauaauccugcaguaaauauuauauauaauuuaucaggauugaaaucagauauuuaaauuguauccucugugguguuuauuuucuuucuaauagaaaaucuuugcaugacaaaaaaagucaggauuuuggaaaucucuucucauuuccuucauauucucagaagucagaagaugguauguucauuuagucuuuucauugguuauuguauuauugcuuuuagugguggagagaaaacaguaaauaaaucguuaggucaugauuuaacuucagaauuuuuaaugaguagaaaacuuccuuuuuauauuuugcucaagauaauaaggcuucuuuacuuuuucugaggugauuccuaacuaauuggucaaaauaggcauuauggaagcauuuagguggacaggcaaaugcuuaucuguguuuaugggugugaguguauguguaguguuuuaaugagagaaaagaaauaaugaaauuuugaaagcuugaaauuugauuuucauggcaaugugaauguauauacgacaguuuucuaaaucuguaagggcaccagugugauugcagauugguuguuaccugagagauuaaaaccgucauaagaacaaauuuaaucaguguguauacuucuuguuucguauuuuuuuuguguauggaauuuuuaaggucacuuaauugauucacuaucauuuuuuaauacacacaucuauacauuuagacauauuugguacauauucuauauguauacguacucauuuuugacagugugucaaaagaguuguguaaacauauuuauuuacauccaaguagcuauuuuaaaaguuugugcuaugguguuagggaagaacgcauuacacuaauuugagugcaagaguaaacugaagguaagccugucugccuuuuaaauuagucuucaaaaauuuauuuaaaaauaggaauacuuacuauucuuuuagauuuaaacauuauuacugauauuccugaaaugguuaauaguauuauuuguguagguacuaaaauaauacagugggacauuuucauaucucauuuuaaaauaaauuggcagcauguauuuuugaauuggucaguuauguuuuaaauauuuagcauuugggacuuuuaauuuuuacuacuuuaugcacuucuguguuauuucaccacauaguuaacauuuuugguguauaacugauacauuuuauuuuuagcuguuuguauauuguggauuauuuggucacaaaauaguaacauaagaucaauugucuagcuaaagggaagucaucaguuaaaagagucaaaguuuacugagagaucuuuauaacaucucuuuacuaaaagaaggcuuugcaauuuuuagauucagcuaaauuugacaguaaugaagaagauucugcuucuguuuuuucaccaucauuuggucugaaacagacagauaaaguuccaaguaaaacgguagcugcuaaaaaggguauguacuuauauuugauugaguuaagcauuggauagagauaguuaauguaaaaggaaauguaauuuaauuugaaacuauuugcauuuuuuuaucauaaaacaauuaagaaguauaagugcuuauaaggagaaccucucguuuucuagccaucugagggcguuaauaaaauuucuguaagacuuaauuuuaaagcuguuguaauuauaaaauaaucccgugcauuacuaucuaaagauagcuuucuacaaaagcucccuugugguuagguuguaauggagauuaaaauuuugucuugcuaguagcuugcuucuguuaucuauguugaucaugacucaacuccuuauguggagggauuggucagcucaguugagguccucuuuuucuaugugagucaugcagcuucucucuuuuucacagccuuagauuggccacaaaacacuuugaguugauuaaugaaucucuuacuaguaccaagauauauguaccguggucuuuuugaaagaggucaguauuugugcuuuguguuugaaggaugacacuuaaaaaaaaccccacaaaucuaauugagaugugugcuauuuaagacagcaaguaaauaauauggauuguucccucaaggauuuuaaaaauucacaacagacaacaucauuacagacacauguauugaauguagcagaacaacaauuuugaaaaguccugcuuauucugaaugcaguagaaccauauugagaaacugguuauuuacaagagucucuguagccaacacacugggugaccuacccaugucccuuaccacuuagugcauauugggcaauaucugccuuucguugccugaggacuuccucuuugccacugugcuggaauauuaacaccccccugcucccagcugccuuuaacuagcagauugaggaaaguuggucuauaaauaucucaguguccuugccucucaugugagccaacugugggauguguguuucacacugggacucaaaaauuucuuauggaauuaagcuccuagagugaugauuggcuugguaacuuaccuauuacuggcugccuucucuucauugucucauuuuugucucccccuccuuuaucucucaaauaaauacuuauacuugaauccauacucuaggauuaggcagauuggcccaaaucuggggaacccacauugagauggacccuauaauuucucuuuuuuaaaaaaacaaucaggcugggcgcaguggcucacaccuguaaucccagaacucugggaggucgaggcaggcagauugcuugaggucaagaguuuaagaccagccuggccaacauggcaaaaccccaucucuacuaaaaauacaaaaauuagccuggugugguggcguaugcaugccuguagucccagcuacucaggaagcugaggcacaagaaucgcuugaacuugggaggcagagguugcagugagcugagauggcaccacugcacuccagccuggacgguagagugagacuccaucucaaauaacaacaacagaacaaucaaaaagcaccuuuaaaaaauaaucuucauaugagcaucuuauaaacacccugaaaacuugggagccguauuacuuccugaaacauaccccguuuccuucaucaaacuguucacccauauuuaaccuaaugaguuuagcaugaccaaaaagcuagauuaucaugguaccuauccuacuugcuuccuucuucaguagcugaacuggccuugucuaaguugaauagguagacugccuguguggugugauuucagggaccccagcaaguccucagcuuuccuuuagccucccuuacgaaauauaauuccaauaaaauaucauuucaagaagaggaugcaucauaucccucugugggauugucuauguuaacuccaaauugcguauguuacacaaguuaaauucuguaguuccaauaguuuacagcagaaaggcagcuauaguacucagauaucugaccuguuugccugguagaauugaaagugccauguaacuccaagccaaggaaaaaaagugguuccuagaacaccuggcuaaguuuauacucccugcuaggagcugcccugugguucuugugguagauauagucaugaagacucaggugggaaaagccacacaaucugggugccacuuuccuagggcuccuccugcucuuggcuaacgaggggccuuauuuguagugucucaaauugcgacuggaauacauuuuccauagaaucaguguagguuuuuuuuuuuuuuuaaacaaagucuacaguuaauauauuuucuuccaaauuagguuuucuuaauuacaaaaagugauuuaucaguuuuuuuuuuuucuuuuucuuuuuuuuuuuuugagacagagucuugcucugucaccaaggcuagaguggaguagcgugaucuuggcucacggcaaccucccuugccuggguucaagcgauuccucugccucauccucccaaguagcugcgacuacaggcacacgccaccucacugggcuaauuuuuuguauuuuuaguagagaugggguuucaccauguugggcaggcuggucucgaacuccugaccuccagugauccgccugccuuggccucccaaaguucugggauuacagguguaagccacugcaacuggccuuauuuaucaguuuucacauagaacugcagauaaagcuguaaaacaaggucuauuuuucaaaauuccagaaagcaaaggccugguaucaauugucuacuuaucuaggauuuuauauuucuuuccacauaaaaaugccaagucuggauuucagcuuuugaauggaagugaguugguuucuauucauuguauucgaggaucccauacauuuuuuucucuaaaacauucuaaaaguuaggacuuaaucugugguuauaucuggguuauaauuaauuuaucaaauaugcuacucuuuugucaugacuauucuguauuuaaaaguuacugcuuaauuuauuuuaauggcucuuccuuaaaaugucuuaauuguauuaccuaagggcaaauuauacauaauuaaauaaaaagcauuuugucaucuaugagaaauuguuugccuuuacauugccgccaagcagagagaaaccauuucauuauuuaaggcgacucaauuuuuuuuuuugaagauagaguuuugcucuuguugcucaacuggagugcaguggcgcaaucucagcucacugcgaccucccggguucaagcgauuguccugccucagccucccaaguagcugggauuacaggcaucugccaccacaccuggcuaauuuuuuuauuuuuaguagagaugggguuuuaccguauuggccaggcuggucuugaacugcugaccucaggugauccaccccgccuuggccucccagagugcuggcauuacaggugugagccaccacgcccagccaggcaacucaguuucuaaucagcuauaagaaauuccauuuauauaggacucucuucaguuugguuuguugguaaguauauugaccugugaaauggaaauuugcuuacuaggaaaaccgucuucagauacagucccuaagcccaagagagccccaaaacagaagaaaguaguagaggcuguaaacucugacucggauucagaauuuggcauuccaaagaagacuacaacaccaaaaggugaggauuaucuucuuauaacccuuuaaacauaugcuguguggaaaagauugaauuuuuucuaccucauugaauuuagagaggcuagguaucuauuuuguuuuaaauugcuuuacuccucaguaagcagugugucuaggaaucagugcugaauauaguccaaaggaggcauagcaauuuaguucagucacuuuguuuuacaaauuaaaaaauugaggcucaaagagguuaaauaagaaucccuaagaaugguccaaauucuccccugcagccaacucacugaaaguuguuauuaaaaagucagaucaguacuccacacuaacugugacacuuauaguaaugggcuagauccaggacucuuaggcuagaacuuuuuuucucaccuaagaaauaacuguauucagggccacacaaggaacagcaccaguucuccauggcauccccucuuuaacuccagaaucuggaaagcccuugaagauguuuuguaaaauauguuuguaagacaugauaugaggguagcucaugcugugaggguagcugcucuaccuuuuauucaacugaaggauaucuuccucaguguguuucuuauauuucuuuaaggagugguugggauaaggagcuguagaccuacagggaaauggggauaauaggguggaaaagaaucacagugacugggaaaguaguacucaagauaugcaggauugaaagccuuuauaaauucaaaaaugcuauuucccugauucauuugaucaaauaugacaucccaagauuauuuaagucuaucuucguacuuguccagucuagcugucaagggauuuuaaagauauaaaauugcuauuuaguuguuuuauuucauuggcaucauugugggauggagaacaucuggccccuacuuaaauauuaccuuuucuccuuccaccuccaaugaugagaauaagagguuagguaggugaaaaaaaaugcugcaugugcugagucuaggucugagaaggaauauguauuugacauuuuauaguuaauacuggugguucucauauggugccacuuaaugugggauaugcaauugguuguuacuagucuuugauaaguaaaacggaguaaacauuuagaccuuuauaauaauguguuacuaaaacagcaugugauuacauuuuuuaguaauuuguguucuaugguauuuuuaaaaguauuggcccaugacaaauuagaaaugaaaaaaaauauuuaaaucccauguaauuuaagaaguacucuuccaagauauuuccuuuucaggcucaaggaccaaauagcaaauacaaauguuuuauguaugaagggauucaucauuaaaauuugucuuugggacuuucccacuaguuuaaauguauuugucaaaaagucuuuggucaugucaaccccagaauugaaaugcuacugccaaauuguuuauaaucacucauaguaagagaucaggacugcaaugcuccacugauugggcaugccaaagaaauaaacuacaauguuguggcauuuaucuuuuuauauugcacuuaaccacggaagaaaaaaccuuuuguaucauuuuaagguaaaggccgaggggcaaagaaaaggaaagcaucuggcucugaaaaugaaggcgauuauaacccuggcaggaaaacauccaaaacaacaagcaagguaaccgggaacaucauugcauauuagugcauggcuuuuuaaaaaaagaucuguaagugacuuaguuugcuuaugacuauaguccuggaacagcuuuccaccuagcaucucguaucaauauggggcuuguauuugguuaagaaauuauucaaguauaaauuuauauaaucaggacuauuuccuaaauaacugugcuauaaauuaaccuacuuagaaccuuccauuucauccacugaacuguaguaguguuaugcuaccuaaauauuagacucuuucagacuaaaauauuauuuuucagacuaaagacuguuuccuuuuaacuuggauuuauuugaccagggcuaauuugauuuuuuuuuuaauugaauucauuugacuguggcugauuuuuccaauuagucugacccuuuuccagaaguacacuauuucuuuuagguaaaugaaugacaucagcucccccgcaucccuuuuuauguugauuuccacauugaccucuuccauucagucaucuucuaugucucagguccaccucggugaugcuuugcauuuuuuuaaacacuuacagugcacacauacuacacacggugcaggagucuuguuuccucccaugaauucuugauauguacuuaccaguaggacagcuugaauuuuuacuaaucugggcauugugcauacuuuuuggguaauauauaauuucagaaauaaagguguuacauuuuucaggcuagaacuugguaaauaugaaaccaccaagguggugaauuacuguauguaaucuuuuuccuccaaaaaauaagauaacuggucuuacacuuagguuagcauuaugauucuaauuuuaaaagcaccauuauuuguaauacuuccuaaacauaagcgaaguuuaaggagugauaguucuuaauacuagucuuuacuuccuuucauaacuuuuaaaucuauugaaaaaaaaucuagaaaccgaagaagacaucuuuugaucaggauucagauguggacaucuuccccucagacuucccuacugagccaccuucucugccacgaaccggucgggcuaggaaagaaguaaaauauuuugcagagucugaugaagaagaagaugauguugauuuugcaauguuuaauuaagugcccaaagagcacaaacauuuuucaacaaauaucuuguguuguccuuuugucuucucugucucagacuuuuguacaucuggcuuauuuuaaugugaugauguaauugacgguuuuuuauuauugugguaggccuuuuaacauuuuguucuuacacauacaguuuuaugcucuuuuuuacucauugaaaugucacguacugucugauuggcuuguagaauuguuauagacugccgugcauuagcacagauuuuaauugucaugguuacaaacuacagaccugcuuuuugaaaugaaauuuaaacauuaaaaauggaacuguguucucugucucuuuacugaagauaaagguguaguaaaagcucccacacaccuuuaaaauaaauauauuuuauucuuugccaggagacuccauggaaaaagguaaacaguauaugaacauagaaagcauuguuaaacaaacaaucucaauguacaaacagagccagugaaaguacaucacagacuugcuaauauaucaaaaaaaaaaaauuccacuagugcuuaaaugagaacuaagaaacugacacuuguaucuguuaaccacucuaccacagcuuucacucugcuucauagugauugaacaaggucaaaggaggcagauucuaugccuguuucuuugggaguuguuaauauuaauuagccccuuggcaucaagaaggcuggaaaaaaaaaucccaauaucaggcaugaaucaggaaggacacuagaguuacaugguccaggugguagaccagccugcuaauuaucccaugaaauuucccuaauggcuugugaacaaguaaacaaaaacuuaacacugaaaaguguuucugccuuggaggcuaucauuacuguaaaaaaauuuuuuuuaacuaacuguguaguuaugucauuaaacaaguaauaaaccacuuuuaauuuaaagugacauuaacaauugaacaaaugacauuugauuaacugaacuggcaguuacacugauacagaauucucuucugcuagugcagggaauuuguauacuuuuacugggcaacaugaaauaaaagaugcaguuugagagcaucagaaagagcaaagacaagcuuccauacuaacuaaaguagaauaucuucagccuuaucuugucauacuguacaauaguccugucaauaguccuguuuccuuaccuugaugucuugacuauuccaugaaagcaagacaguuaucuuuuugaaccuagguagacguguacaguagucuauuucauaaccuuggugucaugguuauuuugaguaugcaagacaaaaggaaagcaccaaacauacaguauagaaagaacagagccauacuucuguauguacaaagucuucagaaacuuaaccagggguaaaucauuuugacugggucuuugccaugcaaucuugaguguucaaagaggaaaauagaagcuuuuaacuaguuucugguugcaugaaauggcugauuuuuuaaaauuggaaaaguuuguauuucuagguaaguuacacagugaggaguauauauauugauacauaugaaaacuucuugguccuucuugaguuuuaauaucuuuucaguccaaaaacuaagcagcaguaaaaauguuuuuucuugcauuuuaaauccuggaacugaagguacuggggaauguuugaaguagcuagaaaaugucuuauugcacgaguggugacugacugaccccacuguuuuccacugagcugggugagaugcuaggacugugcucugcuguguucccacuugaacuuggggucaaggguucauguccuucagaauucuccagcauuucuugaaugagagguggcauugauccaggaauuuccauuuucaagguaauuacacgcucugcaccuuuucaaaagagauaauggaaauaugguuaagauaaggaguuaagcuaugacagauaaccagggaccaauuuucauauauuuuaacagagguguuuccuaagauucuugcuuaggaauuaugaaauguagauaucagguggcuuuuuguugaaaaagaucuaucgauuacuaucacacucauaaauacaaagaaagauaaauguauuuggaaugggaacugcauccaccaaaaaucauguguuaguuuauugcaaaguuaguuagauuggguucucaaccagcucagacucauaguauguugauagagagggucuuuuuaugaucugcuagaacuucauucgucuuuuaugcaagcaauaacugauacaauugcuccuuuugauaacagaaaauuaugcaaacaaugccucccagaggcuauccuuauuuuacaccauuaaaacauuuuuacuuuguggaaaagcagcugagauauggugacguuuaaauaugaugucuuaguuucagg

SEQ ID NO: 17445 - RNA, 4241 nt, Homo sapiens
guccauuuguuuuaguuuaauagacauuuauuccuucaguugaacaaccucuacacaauuaaaauguaugacuuaagaucuuuucuuuuuuugugaagaaauuuaggucucaagaacuuuuaugaacuugcuaugaguacuuccuggaaaucaauuaacugagucuuuugaaaccccuagagaagauaggagaaaauugguucagaacgagcauuuaaauuaagucagcaaagucagaauuuaaaauugggcaauuccuugucuacauuuucuuuacacucaaauugacccuggacaacaguagucuagucuccuggaagacauggugcaaacagaaaugcaauguggugguauacucauagucaaagugggugcacaagugaugguccaacuuuguggaaugguaaggauuuuuaggguuguuuggccagaacaagagaaauaacugcagaaaacacauaugguuggaaaccaugcgcuugugacuuuuucuguagccuaugggaguggacagaguggguaacccaagauguuuuuaagacugacuggacuaagaaugacguacuuauagccaacuacuuucccccuaaugugacugaagggauucauaaugaucacaauuagcauuacgguuaaguauuuuaggguugacgucuaagcucacacuugaaagguauuuaucuaauggccacuggcucaccagcuucccacccuagcauucauugcuagcuuaccaaucuuaaggcuaauaauuuuaucgcacauucaacuucaaaacacaccaguguuuaccauuaccacuaaucacugaaugccaugaagccauggcacugaaccaggagcuuucaccuuuuaugugaauuuaaaaugguacuguggaggcugaggcaauuuucuucaggcuaacccagauuuucuaaagcccaacuuaaaaagucuacaccugccaaacuaaaaaaaacgcagccacuugaaaauaaaccagcagagcauugccaucacuccgauaaagcugcagguuucaucacaugcaccagacaaaucuacagggcuaguuucaguucucuccuuuuaaagaauuuauuaagccuguuauaccacacaguauguuuuauacacugacauacaacucccuaauaagauaaagcaaagacaaaaaaguuuaucuuauuagaaacaagauacaccaccacuuauugucuucaaacauuauugcacuuuaacuuucuuaauuugacaaagcauucaagaaacaucugcagacuaguuuuaacagacaaauaacaccuguaagcagacaugacuguccuaaauuguuuauuaaguaugaauuuuacaaacuuuacuuauauuagcgguaacgguggagcuggagaguauugcgccuucuccaagcugcccggcgagagccaccaauagugugguggaacuuguggcccuuuccaaggccacggcucuuucggccugcagaugucagcccacgcaucucccugugcuuguggacugguuuggugauccacugggugucaggauuucuucugauagcuuuauggaauggaucaaugaggauaaccucaaaaaauuuguauguggaaucuucaccaacccaguaagaauucaggacucucagagccccacaguggcguccagcucgcuccuagaauaggaaaaaaggcccaaggucaaucucccacauugccuauagcagcaagucagaaagaauuuuaauucucaacucuaguucaccaccagacaagagucuuuuacuacucaaguuauuuacuaagcauuucucccuagacuaucacaaguguaaugagauaauguagacuugcuaaaacaacacacauagacugaaacacaucauucccucuuaauacuccauuccugacuagggcaggaauauguuaauaucuggguaacaaaauuuaggguuuggggaccuuaucuuuuuccauacaacugagagcucagcaacguuuagcuuuaaaaauauuuaguauauauuuuaggcugugcaggccacauuuggucucuucugcauauucuugccgcuuuaaagcuuagguuccacaaguacuuccaguauauacacacgcauuuguaacaaagacaagucuuucaagcaauuacucuucaccaagauuaguaaaaaucacaaacccuguuuuauauacgagacagcucaccuaaguacaaucagaaaaguugcuuaaucucucucucccaccauccccaggcaguauucaauauaacugcuacucaaaaccauuuaccucugcaacggacugaaggcuucgagcaaacuuuagcugguuaacaccaugauggacaggcuugccguaaguugcacccuuaggaacugggcguuuucggccaccacggcgaacacgaauccuauauauaacguaaccuacacacaaacacacacgaaauuagugauuuuauaggaagccguaaggcuuaagacucaauggcuugucacuaauacuccaccaaaaauacuucaacaguaaguuaaugcuaucuaauagaaaaaaauaaaacacaucccagucuuuuucaaugcaccuuaggcuacucacacagggaggcacacuguuuauuuugcuuuagucugaacucauucagauuuguaaccuuugacacacuugccacuuuagacaacagugcauacaguaacugaccaguguugcuagcuuuuuucugccaaagcccuaugcgaagaaagacacugaggcagcagugucuuccuaacagcugguuuccaacuuuucucgaauauaauuuuauccaagcauccacgcagucgaucacguaccuugcuuggccuuguagcccagucggcgcgcuuuaucaggccggguggggcggggagcccuguggagagcagagagcuggcgguacugccagcagcggacccucagaagaaagcgcaugacaucagacugcuucuuucuccauagcuccuggauguacuuguaugcacccaucuuggcuuaccugugaaaucaaacuguguauuaaauaucauccgcuuuaaguacaauaagacgacuguauccguccaucuuaguuccccaacaaaaacaaggaaaccgccgggaaugaaaauggcucugcaccaacugccggggacagcuagcccaacccccaccacugcgcccacggagccgcguucagucacuuccgcaaccccagcacagagcggugcucggcacguuuugguggggcgaauuaacagaaccagaacugagcaccaagggggcggguggcugcggcaggcggcguccccaaggaggaccugaaaggagaugccgcugacaucacaggacaagguacugcugcggccaccgaggauuaacucucgaggaaaaugcaucuaccccacccaaccagcagccucacuuuaggcugccuugucccgggcgccccauucgucagccccacgccuccuccaggauccgggcccagcucgaauucgcgccgccaucacaucuucgcucaacccgccccgggggccgccucuccaccccuuugcugucccgcauccugaccaaacucuggccgcacaggagggagaccuaucuccgaggacgcaggguccccggaccuggauggcugaagaggaagacgaucaaaggcggauggaagagcaaagauccucaacgcagccuaccugauggcugccgccagacggaaaggaaagagcuguacucccacaaugccuuuugggcuccucccccaccucagccacccucuuuccgguggaaagcugcggccucccagagcgucaugggacauguaguuccggcaucgcgccugguggcggaguucugccgaguggggcgccgcggccgcuauugucccgcccccugcuccgcaagauucgagccugagcggccugggcgucucgagaggugagagaguuggcggcgaggucucggcggcuaagcgagcgucggcgacugucucuccgcgagaggaggcaaguugggguccaggcuccaaagccgguggccgcguaccgcgguggagccgcugucuuugaggucugaggagagaacagguuuguuucacgcaccgcgggcucucccccugcggagucucugcgucuccgcgucuccgcgcugcgcugucccucucuggccaccgcacgacgggcgcagaaaucugggccccagagcugcgcugagagaucccccgacgcuuccccagccucccagggaggccuucgcgga

SEQ ID NO: 17446 - RNA, 17248 nt, Homo sapiens
gaucucccuugaguuuagaaaucuggcugagaaauaccaaacagugauugccgacauuugccggagaaugggcauugggauggcagaguuuuuggauaagcaugugaccucugaacaggagugggacaagguuagucucauaaaacagugucugugugugauguauuagacagagcuggcaguccucauagugaagcucagaacaagaaaaguuguccaguauuuucagccccucugguuuuacaauucaucuguuuagguugaaugucucaucauaaacaguuuauuccagaguuaauuccaaaccagcagcuauguaggauaucagccaggcuaggaguaggguacuggagagaagugcuuaucuagacaaagggauguaauugaccaugaagauuaaaacuacacaucaaaacauaagguaggguuaggagucuugccuauuuuucauaggaaugguguuugugagacuuacucaucacuucuguggaaguaaagacauuuuauuuauuuauuuuaaagccagucagauuuagcaggcagagacauuucagacaucuaaaguguugauguauuucauaccuuuaacugugcuuaaauuaggaucuccgaaaagaugcugcuacauggucacuacguuaguguagguccaaggucuugggccucuuaauuuuucaaaccucaaaacuugacagcaguuaucuuuggaacugcugauuugugcuuccuaaguuaacagcauacaaugacugcuagaaaucaauuucugcauuuaaggugaaguuagccggguacuaugguuuaccuguaaucucagcacuuugggaggcugaggugggaggaucauuugagcccaggaguuagacacaagccuaagcaacauagcgagaccccgucuuucaaaaaauuaaaaaaugagcagggaauugguggcaugugccuguggucccagcuacucuggaggcugaggugugggaggauugcuugagcccaagaguugaagguugcagugagccaugauugugccacugcacuccaacgugggugacagagcaagacaccaucugaaagaaaauaaaguugaaguuaaaacuucuggccaagaaccagcacugguuaugauaguaacucauuuucuguugugcagauuuauucaggaaacuuaauuuuagguuguugaauagaaguuuugaucagauaaaauugaauuaaaaaaaauuuuuuuugagacagggucuugcuguuauccaggcugguguguaguggugugaucacggcuccccgcagccucaaccuccugggcucaggugauccucccaccucagccuaccgaguagcuguaacuacagugcaugacaccauaccaggcucauuuuuguacauuuuuuguagagagaggguuuugccauguugcccaggcuagucucaaacuccuggcaucaaacaguccucccacucuggccucucaaauguugggauuacaggcaugaccagccaauuauuucaaggaguuauuuuuuuucuucuacuuugggggaagaugaauuauauaagucuccauuuuaggaguauuucuaccaaaagaacuauuaucuucaaauauauuuuuggauaguacuauagauauacuaauuuuuuuuuaaauuucuaguaauucuuuugaagauuuuguauagcuguccaaagccaauuucugucuaccuaauuucagcaagauuucacucuuuucauguuacuuuugucccagaacaaauuucaagugcuuucucuucaccugugcauucuucccccugauuagucucuggcuuuguauuacuuucagucagagacgacuuuuuuuuuuugagacagggucucacucugucacccagacuggaaugcaguggcacagacaaggcagccuugaccuucugggcucaagcaaucuuccuugcccucagccuccugaguaacugggaccacaggcacguugccaccaugccuggcuaauuuauuuuaauuuuuauuauuuuugagacaggguauugcucugucacccaggcuggaguguaguggcaugaucaaggcucacugcagccuucaccuccugugcucaagcaguccucucaccucagccuccccauuagcugggacuauagguccacaccacuacaccaggcuaauuuuuguaauuuuuugguagagacaggguuucaucguguugccuaggcuggucuugagcuccugggcucaagcgauucaccugccuuagccucccaggugugagccacuacacucagccuuuuaaaauuuuuuacagagaugaggucuugcuuuguuggccaggcuggucuaaaacucuugggcucaagcaguccccucuccacagccucccaaaauuccgggauuacaggcgugaacuucggucauuuccuaacuuuuacccuuccuaaugacacuccagagcuuaccuucuuuacuuuugcuucuuaaguuaacuaauagacaauuauuguauguggauauugcauuaaguugucuuaggauacccuuuucagaggaggacagcuuuugacaaauugcugucgcggaaaaaaaaaguauuuggcaauuaagaguugcauuuacugaaaucucuguugagagaggggaaguuacguugucucuaaaagaaaaacuaaaaagaaaaggggaaguuuuagcaaaguuguuaaagccugacacuuaagucauacuaccuaguuuugaacucuuagccccugccacagacacggcagccccuugaaccuuccuggguucaagcgagccuccuacuucagcccccugaguaacugggaccacuggccugugucacugugccuggcuaauuuuuuuuuuuucucacaugggcaauguugggcaaguuaaaucgacuucuuugugccucaguuuccucaucugaaauggagaucauacugcuauguaccugauacaauguuugugaggauugaaugugcagaguucuuuuuuucuguuguuguuguuuugagacggagucucacucugucgcccaggcuggagugcaguggcgcgaucucggcucccugcaagcuccaccuccuggguucacgccauucuccugccuuagccuucugaguagcugggacuacaggcacccgccaccaggccagcuaauuuuuuuguauuuuuaguagagacgggguuucaccgucuuagccaggauggucuugaucuccugaucucgugauccgcccgucucagcuucccaaagugcugggauuacaggcaugagccaucgugcccggcugaaugugcagaguucuuaaaaccgugucaagaacauaaaauaguuauuuguucuuucauauaaugaugauuuugagggccugcggaucuugacauguuaucagauuggucaaaaaaagauuaaaccauaguugguauuguccuaguuccuguuaccagaauauuccaucuuucaucguugccuucucucauaguuuuauguaucaaaaaguuuauuguaaagcuagggcgggcacggugucuugggcugguaaucccagcacuuugggaggccaaggcuggcagaucaguugaggucaggaguucgagaccagcguggccaacauggugaaaccccgucucuacuaaaaauaaaaaauuagcuggaugugguggugggugcuuuaauuccagcuacucaggaagcugaggcaggagaaucacuugaacccaagaggcagagguugcagugaguugagauugugccagugcacuccagcccaggggacaaagugagacuugaucucaaaaaaaaaaaaaaaaaaaaaguuauuguaaagcuagacacggugguauuugccuacaaucccagcuguucgggaagcugaggcagaaagauugcuuggguccaguaguuugagucuaacgugggcaaauauaugagacuccaucucaaaaaaaaaauaaaaaauaaaaauaaaaaaauguuuacuaguuuuuuucaguagccuuuuauuauaguagcaguacauguguauuguagaaauuuggaaaauacaagugaaaaauaaaaacaucaaauucccgucagccagagacugcuaugaaauguuuugagcacauccuucuugaauguuuuuuaaauccugguauguauauuuguauuuuaaaaucaaaaugcauucuuacccauucucuuuugaaccugcuuuuuuguagcuaaugaucucuaguguguccauuucaguaaaaauuccauuauuaaagugcuuuaaaaaucgucucuuacaguacugccacuauguugcugggcuggucggaauuggccuuucccgucuuuucucagccucagaguuugaagaccccuuaguuggugaagauacagaacgugccaacucuaugggccuguuuuugcagaaaacaaacaucauccgugacuaucuggaagaccagcaaggaggaagagaguucuggccucaagagguaacagauucaggguauuuugggggaaaauaacuuuagacauucucugaaaaauccuuuaacucuugugguugcgggugacagaaaaacaagucaggccucccccaggcagcauaaggggauguggaaaauaggauagcuugacaugaguuugcuucagguagacuggcugacucccaggauucacaccacguaaucaguauauucaagccuugcuguccuugauuucuuucagacggucuuucuccaagugguggauaugguaacaacccaugugcacuagcuuaacaaaaaguucuuaggaauggcuuuguucggccuggcgcaguggcucaugccuguaaucccaacaguuugagaggccaaggugggcggaucaccugaggccaggaguucgagaccagccuggccaacaucgugaaaccccguguuuacuaaaaaauacaaaaauuagccgggcgugguggcaagggcuuguaaucccagcuaccugggaggcugaggcaggagaaucgcuugaacccaggaagcagagauugcggugagcucagauugugccacugcacuccagccugggcgacagagugagacucccucucaaaagaagaggaagggcuugguucuucugcucagcccugaaucaguuacuguugcuacacagcugaguucucuggccucgccuggauuacgucuacacaguacacacagaauggauuucccccaaagaaagaauucugcagcaggaaggggaaagggauggcagguagacaaaaacuccaggugucuguaauaagggacagggucgaucuuuaauuaaaacauggacagggaacagaaagcuuuugauacugauuuuguucagaaggaaaguagaaaauuuuaugacuguucccugaauuuauuccagcauuuaccuuuugcuuuccauaaaaguguuuccugcagccaaguacuuuaaaguuuuaaaaagacgggugaggcuaaguguggugucucauacuuauaaucccagugcugaggccaggaguucaagaccagccugagcaacacagcaagauaccaucucuauaaaaaauuguuagaaaaugauucugcugaaagagcaaaaauaaaaauuaaagaaaguagaaaaaauaaaacuaaauuuaaaagauuaacugggcauguuggcaugcaccuguauuccuagguauucgggaggcuaaggcacaaggaucccuugagcgcaggagcucaagguuggauugaguuguaaucacaccacugcacuccagccucgguggcagaaugaaacugucucaagaaaaaaaaaaagugacagagggaaacaauauuugcaauucauagagcagauacaggguucauauuccuaauauuaaaaaaaacuucuaaaaguuaagaaaaaggccaacugccccacagaaaaaugggcaaggagauaagaacaagauaguucacaggaagagacacacagaugauuauuaaaaaucugaaaagaugcugagucuuacuccuaagaaaaauucacauuuaaacuacucugggggcugggcaagguggcucacgccuguaaucucaacacugggagaccaagguaggaagaucacugaagccaggauaucgagaccagccuggacaacguagugagaccuuaucucuuaaaacaaaacaaaacaaaacaaaacaaaaaaaacaguaaaaauuggccgggcacagugacuccugccuauaaucccagcacuuugggaagcccaggugaguggaucacuugaggucagguguuugagaacagccuggccaacauggcaaaacuccgucucuacuaaaauuacaaaaauuagccaagugugguggcauacgcugguagggccagcuacuugggaggcugaugugagacuccauuuaaaaaaaaaaaaucaaaaauuagcuggguauaguggcacaccccuauaguucucgcuccuugggagguugaggcaggaggauugccugagcccaggaguucaaggcugcagugaaccaugaucgcaccacugcauucuagcagccugggagacagagcaaaacccuugucucaaaacaaacaaacaacaacaaaaaaacaaaaaacacuucccucagcucagacauggccuuuuaaguuuccuaggugacucgugugcagccaggguugagaaaccacucuugucuuaccccucuuuugcagacacagggcucagagaagggaaggggauugucuggggauguauagugaggcaguggcugccuuggaaguggagucucagucucccggcuccuaggccagccccugaccacuguuccauugucucccagacagaacaucagccacgggcaugugaugcaugagcgugagccacaccaucuugcacacacaggagcagagcccugcucuucucauucacuuacuuuaucuguaaaauagcaucauuucuaccacacggugguggugugaauaaaaugagaugaacuucuagcauagagugcuuaguaaagguucuggacauuucguaguaguugaaucaugccaaaugugguccuaggugauuggcuucuuuugcuagcauguuuucagggcuccuccaugcuggggcauugcaucacugcuuuauuccuuuuuaucgccuaguauuauuccacuguguggauagaccacauuuauccauucaucaguugaaggauauuuggguucuucccauuuuuuuuggcuauggugaauaguacuguguacauuugcauauaaguuuuuguguagauguguguuuuccuuuuucuugggucuaugcugagaaguggaauugcugguucauacagcagcucgaaccuugugaggagcugccagacgcuuuuccaaggucgcuccaccauuuuacauucccgucagcagugugagagucccaguuucaccagcacuuguuguuaucucuuuuuaacuguauguauauauacuuaacauuuuauuuauaauaaauguacauaauagagaauuugccauuuuaacuauuuuuaagucuauuauucaguggcauuaaguacauuaaugauguuauauaaccaucaacacuauguuuccagaacuuucgcuagcuucagagaauccucuaaauaauaucauuaaaaaucaucaagccgaaucccacuguuagaauuaaagguuuuauuucacuuucaaguuaucaggauccagggagguguaauacacuuagaggauagacucagcucauuucccagcuaugccuuucagcagcuuucuuaccagaguaggaauauaauguuagucauuauuuagaggccuggccaucuugagaagguuuacuguuuagucugcaguacaauuauaacuguuuuuguauauuggguuauuuuuuucagaaguaggccaguagcucuaacaggagccucuuuagccugaauucguccaaguagugcaguguugcacuaguugucccucgggacaugcuccccaauacguaacucacuuccagguugcaacuggacacuuacugguagucagaaauagcuauugcauggagcuuaaaaugaacuugaucuucgugaaagaugagucugcagcuaagagacuuuacuguauaucauaguguuuuuuuuuguuuuguuuuguuuuuguuuuugugacggagucucacucuuucacccaggcuggagugcaauggcgagaucuugacucacugcaaccuccgcccccuagguucaagcaauucuucugucucacccuccugaguagcugggauuacaggcgccugccaccguacccggcuaguuuuuguauuuuuaguagacacaggguuucaccaccuuggccaggcuggucuugaacuccugaccucgugauccacccuccucggccucccaaagugcugggauuacaggcgugagccacggcgcccagccuguaucauaguucuuaugcacaaagacccuuuaauauuguuuguaaauucuccccuaugcacacgcugaccuguuccuuaaucuucuuaucugucuagguuuggagcagguauguuaagaaguuaggggauuuugcuaagccggagaauauugacuuggccgugcagugccugaaugaacuuauaaccaaugcacugcaccacaucccagaugucaucaccuaccuuucgagacucagaaaccagaguguguuuaacuucugugcuauuccacagguagggaagggggcuccucuggguggauacggggcuaaagggagugggguaggaguaaggguggauuuugcugugcuauauucaaggauaugauuccuuaaaaagacgaugacuccaguuuauuacgcugggaguuucauagcacccgccuuugcuuccagccaccaaacucagcucagccuugagguuaagccugcuccuuuucagaaccuucuuucuggauuuacuauuuucuacagcuauccuaaacuaguuagguucuuuuccucacaguuaagucaaggucuuuggcuuagauuuauggggagugcuggguaaaaccugggugaagcuguuaucauuaaaaagucuucauuaagcaccuaauuacugcuguccuuuuccuagacccggcauaaaaagaaccugguccgguagaccuagccucucaguaugcuaggaacuuacacuuuuuaguugccuuuaccaaguauugcagauacuacugcaaauaagugaagaaaguaacagcauuuaacugauuugggaacuugguuugaucuuguucuaaugaccaacuucgaauggugguugaaaguaaaaucuguaucgccgucuuauguuuccauuuaccuagaaauacuuuaccuuugagcacaggaaauuaauccccuucugguuguucucccccuggcauugguuuuaaauauauaaugauuauguuuguuguaggaaaaauagaaaaacaacuacaauagaaaauucuucccauauauuauuuugaaauacauauuuccgauccgauaauccauugcucuagcauggaaaauguuggauuuacuuguguuugcuuuuuccaaauaaaauggaacuuuuguggcuacauuauagaauuguuuuagacugcuuaauucuguguguuguugagaaagggaggaguggggaagguaaaaaucuugacauacuuucuucguggguauuuuuucuugagcgauuccaucuuaguugauuagcaguuagcaauugcccauucaacagaagguuuucuuaccuuuuugugauaaugauagcuaacgacaucauuucuucuuuuuucccucucuucuuguugucucuaggugauggccauugccacuuuggcugccuguuauaauaaccagcagguguucaaaggggcagugaagauucggaaagggcaagcagugacccugaugauggaugccaccaauaugccagcugucaaagccaucauauaucaguauauggaagagguggguuuuuauuuaacuacuuggauaauuuguagcuacuuuuaugauuuaguaaugucacuguuuaaccagguuuggauauuagaugauccuaacaauucacuauccuguggccuaaagagacaggaauugauauccuuuauaaggaaaaaagucuauucacaggagccgagcagauugcucacugcuguguaguacccuggugagaggagauaaauggagcaaggcuguagguuggagccccucaguagaaucauagauuuugagcugcaagaugaugcaggaggccaaccaagcuucuuguugcuggugaggaaugugagguugaagcuugucugugcugaugcagugcgugauugaguggaucucuggcucccguccauguguccugacacccagucugguacuuucauuaugccacaggccucaauugaaaaaucacaguagggaauuuaggccaaggaaagccaucaaguugcaauuauuuccuaaauuuucuuuggaaaauuucauuucaaauaccaaaaccauccuauaaaaagaaaacuuaccuucuuaggucaaaucucuaauauuugacuagguucaaaaaguuuauuucuggccaggcacaguagcuuacuccugaaaucccagcacuuugggagaccaaggugggaggaucacuugaggccaggaauucaagaccagcccgggcgacauagcaagaccccauuucuacaaaaaauuuaaaaauugucaugguggugcacgccuguggucccagcuacucaggaggcugaggcagguggaucacaugagccugagaggucgaggcuacaguaagcugugugauuucaucauugcacucuagccugggugauagagugagacuuugucucaaaaaaaaaaaaaaaaaaaaaaaaagucuuagagaccagaagucuuuguaaucucuaauaaucucuaggcccuagagcagugguuuguaaauggaggugauuugcuccccuccccccagaggacauuggacaaugucuggagacauuuuugauuguccuaaccggcaggaaucgggugcuacuggcaucuggugaguagaggcccaggaugaugcugugauccucaggugugauccuguugagaaugaaacacuguagacuuuaugaaaacauacaagacccucaucauuuuuccuuugccugagcucccuccccagagguuaccucuguucaugguuuugugcauccgucuagucccccuguuacgcguuuacaggaauaugguuugcaacaguguuuucaucuaaauagaauuauacaaaauagcgauuucugauuucucuugcauauugcacauucuucuuauacuuccucccuaccuuuaucugacacagaaaugcuguauguccagaacuucuaucagaggcaccuauggaagucuaagggaagaccacaucgcuuuuaaaaacccuaaaauuuuguagucacuagaugaaaauauucagccagugacccaaaaaauugcuaccaaugagacucuccauuuugccauguagccagaacuuacuuugaucuaugugccugggguagugaccaaguagguggguaggaguaaucucagggaaacuugaggccccagccucauggcuagggucauaauuugaacccaggucugucugacaucagaauccaugauguuaaccccaauucuaagggguucaacuacccuuucuaaauggaauccugcuauauuaagcacuauuuauucauuuuauauaaacuagaaacauuuuauguaguaaguaguugagaguguuuugguuuugcaguuugaucacuaguuuuagaaaccaguuuuuaaacacuuuguggccaauuccauuacuauauuaaaauucagauuuauuugguuuuuccuuaacuauugggauuaaauccugguuguaauucauaguuugagggcgagggugggcagucuacaguuggcugagcccuguuuuugugaauaaauguuaucagaacacagccacacccauuugcuucuuugucuucuguggcugcuuuugcaaugugacggccgaguugaggagcugcaacaggcgaugacuuguaaagcugaaaauauuuuuuggcccuugaauaagagguuugcugacuucugacuuaggguaucaguuguucuguuaucccaguaaaacucaaggcauuaggggagaaauguuaauauuaauacuuaaguugauuugauuuagggaaaucuuugaagauuucuaagucuuaagcaguagaaccuguuaaugguuuuaguuucagcaguaaggacauuuuacaaguaaaguuuuaaaugaaaacauuuuguaugaagccacaagucgucuggccucuugcugguguccagauauuaacacugauccuauuucuccuugcugaccaagucuguccuuuguaguaagaaaggaagaaacguugacucuguccgaucucuggacuuaguguuguagcgagcaugcaccuggaagggacuugccagaggaccuccucaugcuucuccagugcuuagugggggcuuggagugcagccccaggucuucacgagcaguuggccacacugcagggcccucaccccacucuggagcagccucugcuucaaaccagccuggaugcuugucagcuggggagaagaucaaccugcuauuuugggauagaaauaaaugcucagccaaacggccagaaacccccauuccccucucugccaaagugaauuccuuggcagggagaaucuuguucgugucucugcacacuuccugugcccuccugugguuaagucagagaaucauccggcucuuugagccccaggugccuagcugcucaaggaugguccccagccagcagcugccaggaaucaccugggagcccauuaagacauccagcccccacccaaacguaucgaaucagaaucugccuuuuuuucccaaaugauguuuuugcuuuaauggaaguuuagauguucauagacaagaguuuuaaaugaugaucaagcugauuccauauucgcaguuguaaguagaacugcugagacguggaaguaccacauggacucacagaggagcugcuguauguagcacagcauugcacaagagcuuauuucagucuaguaaacauuuauaggagccugugucauuuaaucaucaagccucgcacuguggcucacaccuguaaucccaaaacuuugggaggcugaggcaggcagaucacuugagguaaggaguucgagaccagccuggccaauauggcaaaacccugucucuacuaaaaauacaacauuuagccaggugugguggugcacacuugucaucccagcuauuccggagccugagacaugagcaucgcuugaacucgggagguggagguuguagugagcugagauggcaccacugcacuccagccugggcaacagggugaaggcccuuucucaaaccccucaaguauuuggcuucaacuuuaugccgggcauguagaugaaaagucggcuaugaccuguccuugacaagcagauguaacuccuugauugaggcuaguagguuuuuaagaccugaauaauugaguuugcagaaaccuacugugugccuucagguaaauggagagugggguuuggucuagcaacgaagcaucuagaaggucccuuuggccuuaccggcucuguuuuagguaaguccacgucugaguaccagugacugcagcucuuccaguugugcugucaugcuuauauguuagaaaugaucaucaaaggacucaaaaguuuugccacuaauuguauuaccggggacugucacaaccaagauuucucuuaauuuauucaccuuacuuaucuccuggaagggcauauugaagugcucuuggaguucucuaaaaggguuuuuguugguuguguauauucacuugggugccagcgauugauuccaaauaaguaaaucuuuuuucccaaaaggauguaagauggcuuaugguuauaaguacaacaggcuaacaaaguacaaguagaugagaaaguaaaaugaagaaauaaagucauaggagccacagaauuaacccaggaaugaauaaguguguaguuuggugcugauguuaucauccuuuauuuguacauugcuuguacaguugcucugagaagguaagucuuaaauuuucaaaagugaaaugucaccgagcaugguggcugaugccucuaaucucagcacuuugggaggcugaggcaggcggaucacuugaggucaggagugcgaaaccagccugacuuaugugaugaaacccugucucuacuaaaaaaaaaaaaaaaaaaaaaaaauacaaaaguuaguugggcaugguggcaggugccuguaaucccaccuacuugggaggcugaggcaggagaaucgcaugaaccugggaaguggaggcugcagugagccaagauugcaccacugcacucuagccugggugacagagcgagacaccaucuuaaaaaaaaaaaaaaaucuacaauauaccaaaaccauuacuuaccugagaaacuauucucagggucauuguagugaaugccuauuuuauggcuuuugauggcaucagggcacucaggucauuuacaagaguagugugugagacccugugugucacugccacucaucuuggccuucggccacugcuguagcaaccaguuuccaaguagggcuggaccuugccuucugcuccagagaccucucgcuuccugcccuugggcuucugacgagcugcaggaacugccuggcacguggguccccacaacccagaggaggugagggccaccucucugcuccucagggccaccuuucauaaggcuccuugaaggucccucaagaucaagccaacucaacacauccuugauaggccuuccugccuucuguuucacuucuccacucguuuccaaauaaauggcugcaugcaagcuuuugccucagguucugcuuuuaggaggaaggcuaagacaagcaguaaagcaacaugggcaggcagaaggaugacuucuaauagaauuaucucaucacuauauauuuuacuuuauggaugcuuguauugaaaagucuuggcuggguggaguggcucacgccuguaaucccagcccuuugggaggccgagguggguggaucacuugaggucuggaguuugagaccagccugaccaacacugguaaaaccuugucucuauuaaaaaugcaaaaauuagccagggaugcacgcuugcugugugccagcacagggcuaggcuggagauaaaaaggugaguaaguaggugcgguguagucagggugaaaacuacagaugguccauuuccacguaaguggaaagguaaagguauguacaauaggguggcuccuggcugaaccuggagcugcagacagguuuucuagaaggcauaauccugaaguugagacuugggggccuagguaggagccaguugaagggacgugggaggcgcauuccagagagaaggagugguaugagacuggaacagaggugugcagcagcaucgcaugggcgaaacaacaguagacaguuguucuuuuguuuuuguuuguuuuuugagacagggucuuguucugucauccaggcuggagugcaguggcaugaucucggaucacugcaaccuccaccucccaggcucaagugaucuucccaccccaguccccaaguagcugggggaccacaggugcaugccacgaugcccggcuaauuuuuguacauuuuguagaaacaggguuuuacuguguuguccaggcuggucuuaaacgccugagcuuaagcagucuacgugccucagccuccugaagugcugggauuccaaacaugagccacugugccuggcccggcaacuguuacuagacuguagagagggaggugggcaagggcuggugacacuagacaggugcaguaggucuggaccauggguggccuugcgcuacacauuacagagcucaggcuuuuuuucuccaggugagagggcuggugccacugaggcaucaagcagagguuugagaucuccuuggugacaguguagagcagacagguagauuugggaauuuaagcuuagacucacguuggagacugagauagcucaucugagaggcacucagggccuaaucucaggcaguaauuuuagggauguaggggaagagauggauucugcacauacuugggaggcuuguggaggaguggggagggaggcacagggaggacuccagggugguucauacggcucccugcuucuguuccugucccccuuugucaagcuguggucuguacugcguguuccaucuuguuucuaagcugcuuuugcccagucuuuccagcauuucccuuucgucauguuagucugugccugucuacgugaacuauggugacguuuauugggccuggcacugugaggugcuggggaugugaagaucauuguggcucagccgcugcucucgagggccucugggugcaguaugcacaccugugccuccuguuugcucaggaagacaggcuuugagaugagcuggggcugacauccccaccuuaucauugggauggcuuuggguaaguuauguucauguucucugagccucccuuuccucauugguaaaauggguauaaaauaccugccaguggaggguuguuguaaguagccauggaaaauguaaagcacauagcacuuaucauuuuuuccugugucuuuaacagauuuaucauagaauccccgacucagacccaucuucuagcaaaacaaggcagaucaucuccaccauccggacgcagaaucuucccaacugucagcugauuucccgaagccacuacucccccaucuaccugucguuugucaugcuuuuggcugcccugagcuggcaguaccugaccacucucucccagguaacagaagacuauguucagacuggagaacacugaucccaaauuuguccauagcugaaguccaccauaaaguggauuuacuuuuuuucuuuaaggauggauguuguguucucuuuauuuuuuuccuacuacuuuaaucccuaaaagaacgcuguguggcugggaccuuuaggaaagugaaaugcaggugagaagaaccuaaacaugaaaggaaagggugccucaucccagcaaccuguccuugugggugaugaucacugugcugcuuguggcucauggcagagcauucagugccacgguuuaggugaagucgcugcauaugugacugucaugagauccuacuuaguaugauccuggcuagaaugauaauuaaaaguauuuaauuugaagcaccauuugaauguucguaauaguagaaaauga

SEQ ID NO: 17447 - RNA, 17248 nt, Homo sapiens
ucauuuucuacuauuacgaacauucaaauggugcuucaaauuaaauacuuuuaauuaucauucuagccaggaucauacuaaguaggaucucaugacagucacauaugcagcgacuucaccuaaaccguggcacugaaugcucugccaugagccacaagcagcacagugaucaucacccacaaggacagguugcugggaugaggcacccuuuccuuucauguuuagguucuucucaccugcauuucacuuuccuaaaggucccagccacacagcguucuuuuagggauuaaaguaguaggaaaaaaauaaagagaacacaacauccauccuuaaagaaaaaaaguaaauccacuuuaugguggacuucagcuauggacaaauuugggaucaguguucuccagucugaacauagucuucuguuaccugggagagaguggucagguacugccagcucagggcagccaaaagcaugacaaacgacagguagaugggggaguaguggcuucgggaaaucagcugacaguugggaagauucugcguccggaugguggagaugaucugccuuguuuugcuagaagaugggucugagucggggauucuaugauaaaucuguuaaagacacaggaaaaaaugauaagugcuaugugcuuuacauuuuccauggcuacuuacaacaacccuccacuggcagguauuuuauacccauuuuaccaaugaggaaagggaggcucagagaacaugaacauaacuuacccaaagccaucccaaugauaagguggggaugucagccccagcucaucucaaagccugucuuccugagcaaacaggaggcacaggugugcauacugcacccagaggcccucgagagcagcggcugagccacaaugaucuucacauccccagcaccucacagugccaggcccaauaaacgucaccauaguucacguagacaggcacagacuaacaugacgaaagggaaaugcuggaaagacugggcaaaagcagcuuagaaacaagauggaacacgcaguacagaccacagcuugacaaagggggacaggaacagaagcagggagccguaugaaccacccuggaguccucccugugccucccuccccacuccuccacaagccucccaaguaugugcagaauccaucucuuccccuacaucccuaaaauuacugccugagauuaggcccugagugccucucagaugagcuaucucagucuccaacgugagucuaagcuuaaauucccaaaucuaccugucugcucuacacugucaccaaggagaucucaaaccucugcuugaugccucaguggcaccagcccucucaccuggagaaaaaaagccugagcucuguaauguguagcgcaaggccacccaugguccagaccuacugcaccugucuagugucaccagcccuugcccaccucccucucuacagucuaguaacaguugccgggccaggcacaguggcucauguuuggaaucccagcacuucaggaggcugaggcacguagacugcuuaagcucaggcguuuaagaccagccuggacaacacaguaaaacccuguuucuacaaaauguacaaaaauuagccgggcaucguggcaugcaccuguggucccccagcuacuuggggacuggggugggaagaucacuugagccugggagguggagguugcagugauccgagaucaugccacugcacuccagccuggaugacagaacaagacccugucucaaaaaacaaacaaaaacaaaagaacaacugucuacuguuguuucgcccaugcgaugcugcugcacaccucuguuccagucucauaccacuccuucucucuggaaugcgccucccacgucccuucaacuggcuccuaccuaggcccccaagucucaacuucaggauuaugccuucuagaaaaccugucugcagcuccagguucagccaggagccacccuauuguacauaccuuuaccuuuccacuuacguggaaauggaccaucuguaguuuucacccugacuacaccgcaccuacuuacucaccuuuuuaucuccagccuagcccugugcuggcacacagcaagcgugcaucccuggcuaauuuuugcauuuuuaauagagacaagguuuuaccaguguuggucaggcuggucucaaacuccagaccucaagugauccacccaccucggccucccaaagggcugggauuacaggcgugagccacuccacccagccaagacuuuucaauacaagcauccauaaaguaaaauauauagugaugagauaauucuauuagaagucauccuucugccugcccauguugcuuuacugcuugucuuagccuuccuccuaaaagcagaaccugaggcaaaagcuugcaugcagccauuuauuuggaaacgaguggagaagugaaacagaaggcaggaaggccuaucaaggauguguugaguuggcuugaucuugagggaccuucaaggagccuuaugaaagguggcccugaggagcagagagguggcccucaccuccucuggguuguggggacccacgugccaggcaguuccugcagcucgucagaagcccaagggcaggaagcgagaggucucuggagcagaaggcaagguccagcccuacuuggaaacugguugcuacagcaguggccgaaggccaagaugaguggcagugacacacagggucucacacacuacucuuguaaaugaccugagugcccugaugccaucaaaagccauaaaauaggcauucacuacaaugacccugagaauaguuucucagguaaguaaugguuuugguauauuguagauuuuuuuuuuuuuuuaagauggugucucgcucugucacccaggcuagagugcaguggugcaaucuuggcucacugcagccuccacuucccagguucaugcgauucuccugccucagccucccaaguaggugggauuacaggcaccugccaccaugcccaacuaacuuuuguauuuuuuuuuuuuuuuuuuuuuuuuaguagagacaggguuucaucacauaagucaggcugguuucgcacuccugaccucaagugauccgccugccucagccucccaaagugcugagauuagaggcaucagccaccaugcucggugacauuucacuuuugaaaauuuaagacuuaccuucucagagcaacuguacaagcaauguacaaauaaaggaugauaacaucagcaccaaacuacacacuuauucauuccuggguuaauucuguggcuccuaugacuuuauuucuucauuuuacuuucucaucuacuuguacuuuguuagccuguuguacuuauaaccauaagccaucuuacauccuuuugggaaaaaagauuuacuuauuuggaaucaaucgcuggcacccaagugaauauacacaaccaacaaaaacccuuuuagagaacuccaagagcacuucaauaugcccuuccaggagauaaguaaggugaauaaauuaagagaaaucuugguugugacaguccccgguaauacaauuaguggcaaaacuuuugaguccuuugaugaucauuucuaacauauaagcaugacagcacaacuggaagagcugcagucacugguacucagacguggacuuaccuaaaacagagccgguaaggccaaagggaccuucuagaugcuucguugcuagaccaaaccccacucuccauuuaccugaaggcacacaguagguuucugcaaacucaauuauucaggucuuaaaaaccuacuagccucaaucaaggaguuacaucugcuugucaaggacaggucauagccgacuuuucaucuacaugcccggcauaaaguugaagccaaauacuugagggguuugagaaagggccuucacccuguugcccaggcuggagugcaguggugccaucucagcucacuacaaccuccaccucccgaguucaagcgaugcucaugucucaggcuccggaauagcugggaugacaagugugcaccaccacaccuggcuaaauguuguauuuuuaguagagacaggguuuugccauauuggccaggcuggucucgaacuccuuaccucaagugaucugccugccucagccucccaaaguuuugggauuacaggugugagccacagugcgaggcuugaugauuaaaugacacaggcuccuauaaauguuuacuagacugaaauaagcucuugugcaaugcugugcuacauacagcagcuccucugugaguccaugugguacuuccacgucucagcaguucuacuuacaacugcgaauauggaaucagcuugaucaucauuuaaaacucuugucuaugaacaucuaaacuuccauuaaagcaaaaacaucauuugggaaaaaaaggcagauucugauucgauacguuugggugggggcuggaugucuuaaugggcucccaggugauuccuggcagcugcuggcuggggaccauccuugagcagcuaggcaccuggggcucaaagagccggaugauucucugacuuaaccacaggagggcacaggaagugugcagagacacgaacaagauucucccugccaaggaauucacuuuggcagagaggggaauggggguuucuggccguuuggcugagcauuuauuucuaucccaaaauagcagguugaucuucuccccagcugacaagcauccaggcugguuugaagcagaggcugcuccagaguggggugagggcccugcaguguggccaacugcucgugaagaccuggggcugcacuccaagcccccacuaagcacuggagaagcaugaggagguccucuggcaagucccuuccaggugcaugcucgcuacaacacuaaguccagagaucggacagagucaacguuucuuccuuucuuacuacaaaggacagacuuggucagcaaggagaaauaggaucaguguuaauaucuggacaccagcaagaggccagacgacuuguggcuucauacaaaauguuuucauuuaaaacuuuacuuguaaaauguccuuacugcugaaacuaaaaccauuaacagguucuacugcuuaagacuuagaaaucuucaaagauuucccuaaaucaaaucaacuuaaguauuaauauuaacauuucuccccuaaugccuugaguuuuacugggauaacagaacaacugauacccuaagucagaagucagcaaaccucuuauucaagggccaaaaaauauuuucagcuuuacaagucaucgccuguugcagcuccucaacucggccgucacauugcaaaagcagccacagaagacaaagaagcaaauggguguggcuguguucugauaacauuuauucacaaaaacagggcucagccaacuguagacugcccacccucgcccucaaacuaugaauuacaaccaggauuuaaucccaauaguuaaggaaaaaccaaauaaaucugaauuuuaauauaguaauggaauuggccacaaaguguuuaaaaacugguuucuaaaacuagugaucaaacugcaaaaccaaaacacucucaacuacuuacuacauaaaauguuucuaguuuauauaaaaugaauaaauagugcuuaauauagcaggauuccauuuagaaaggguaguugaaccccuuagaauugggguuaacaucauggauucugaugucagacagaccuggguucaaauuaugacccuagccaugaggcuggggccucaaguuucccugagauuacuccuacccaccuacuuggucacuaccccaggcacauagaucaaaguaaguucuggcuacauggcaaaauggagagucucauugguagcaauuuuuugggucacuggcugaauauuuucaucuagugacuacaaaauuuuaggguuuuuaaaagcgauguggucuucccuuagacuuccauaggugccucugauagaaguucuggacauacagcauuucugugucagauaaagguagggaggaaguauaagaagaaugugcaauaugcaagagaaaucagaaaucgcuauuuuguauaauucuauuuagaugaaaacacuguugcaaaccauauuccuguaaacgcguaacagggggacuagacggaugcacaaaaccaugaacagagguaaccucuggggagggagcucaggcaaaggaaaaaugaugagggucuuguauguuuucauaaagucuacaguguuucauucucaacaggaucacaccugaggaucacagcaucauccugggccucuacucaccagaugccaguagcacccgauuccugccgguuaggacaaucaaaaaugucuccagacauuguccaauguccucuggggggaggggagcaaaucaccuccauuuacaaaccacugcucuagggccuagagauuauuagagauuacaaagacuucuggucucuaagacuuuuuuuuuuuuuuuuuuuuuuuuugagacaaagucucacucuaucacccaggcuagagugcaaugaugaaaucacacagcuuacuguagccucgaccucucaggcucaugugauccaccugccucagccuccugaguagcugggaccacaggcgugcaccaccaugacaauuuuuaaauuuuuuguagaaauggggucuugcuaugucgcccgggcuggucuugaauuccuggccucaagugauccucccaccuuggucucccaaagugcugggauuucaggaguaagcuacugugccuggccagaaauaaacuuuuugaaccuagucaaauauuagagauuugaccuaagaagguaaguuuucuuuuuauaggaugguuuugguauuugaaaugaaauuuuccaaagaaaauuuaggaaauaauugcaacuugauggcuuuccuuggccuaaauucccuacugugauuuuucaauugaggccuguggcauaaugaaaguaccagacugggugucaggacacauggacgggagccagagauccacucaaucacgcacugcaucagcacagacaagcuucaaccucacauuccucaccagcaacaagaagcuugguuggccuccugcaucaucuugcagcucaaaaucuaugauucuacugaggggcuccaaccuacagccuugcuccauuuaucuccucucaccaggguacuacacagcagugagcaaucugcucggcuccugugaauagacuuuuuuccuuauaaaggauaucaauuccugucucuuuaggccacaggauagugaauuguuaggaucaucuaauauccaaaccugguuaaacagugacauuacuaaaucauaaaaguagcuacaaauuauccaaguaguuaaauaaaaacccaccucuuccauauacugauauaugauggcuuugacagcuggcauauugguggcauccaucaucagggucacugcuugcccuuuccgaaucuucacugccccuuugaacaccugcugguuauuauaacaggcagccaaaguggcaauggccaucaccuagagacaacaagaagagagggaaaaaagaagaaaugaugucguuagcuaucauuaucacaaaaagguaagaaaaccuucuguugaaugggcaauugcuaacugcuaaucaacuaagauggaaucgcucaagaaaaaauacccacgaagaaaguaugucaagauuuuuaccuuccccacuccucccuuucucaacaacacacagaauuaagcagucuaaaacaauucuauaauguagccacaaaaguuccauuuuauuuggaaaaagcaaacacaaguaaauccaacauuuuccaugcuagagcaauggauuaucggaucggaaauauguauuucaaaauaauauaugggaagaauuuucuauuguaguuguuuuucuauuuuuccuacaacaaacauaaucauuauauauuuaaaaccaaugccagggggagaacaaccagaaggggauuaauuuccugugcucaaagguaaaguauuucuagguaaauggaaacauaagacggcgauacagauuuuacuuucaaccaccauucgaaguuggucauuagaacaagaucaaaccaaguucccaaaucaguuaaaugcuguuacuuucuucacuuauuugcaguaguaucugcaauacuugguaaaggcaacuaaaaaguguaaguuccuagcauacugagaggcuaggucuaccggaccagguucuuuuuaugccgggucuaggaaaaggacagcaguaauuaggugcuuaaugaagacuuuuuaaugauaacagcuucacccagguuuuacccagcacuccccauaaaucuaagccaaagaccuugacuuaacugugaggaaaagaaccuaacuaguuuaggauagcuguagaaaauaguaaauccagaaagaagguucugaaaaggagcaggcuuaaccucaaggcugagcugaguuugguggcuggaagcaaaggcgggugcuaugaaacucccagcguaauaaacuggagucaucgucuuuuuaaggaaucauauccuugaauauagcacagcaaaauccacccuuacuccuaccccacucccuuuagccccguauccacccagaggagcccccuucccuaccuguggaauagcacagaaguuaaacacacucugguuucugagucucgaaagguaggugaugacaucugggauguggugcagugcauugguuauaaguucauucaggcacugcacggccaagucaauauucuccggcuuagcaaaauccccuaacuucuuaacauaccugcuccaaaccuagacagauaagaagauuaaggaacaggucagcgugugcauaggggagaauuuacaaacaauauuaaagggucuuugugcauaagaacuaugauacaggcugggcgccguggcucacgccuguaaucccagcacuuugggaggccgaggaggguggaucacgaggucaggaguucaagaccagccuggccaagguggugaaacccugugucuacuaaaaauacaaaaacuagccggguacgguggcaggcgccuguaaucccagcuacucaggagggugagacagaagaauugcuugaaccuagggggcggagguugcagugagucaagaucucgccauugcacuccagccugggugaaagagugagacuccgucacaaaaacaaaaacaaaacaaaacaaaaaaaaacacuaugauauacaguaaagucucuuagcugcagacucaucuuucacgaagaucaaguucauuuuaagcuccaugcaauagcuauuucugacuaccaguaaguguccaguugcaaccuggaagugaguuacguauuggggagcaugucccgagggacaacuagugcaacacugcacuacuuggacgaauucaggcuaaagaggcuccuguuagagcuacuggccuacuucugaaaaaaauaacccaauauacaaaaacaguuauaauuguacugcagacuaaacaguaaaccuucucaagauggccaggccucuaaauaaugacuaacauuauauuccuacucugguaagaaagcugcugaaaggcauagcugggaaaugagcugagucuauccucuaaguguauuacaccucccuggauccugauaacuugaaagugaaauaaaaccuuuaauucuaacagugggauucggcuugaugauuuuuaaugauauuauuuagaggauucucugaagcuagcgaaaguucuggaaacauaguguugaugguuauauaacaucauuaauguacuuaaugccacugaauaauagacuuaaaaauaguuaaaauggcaaauucucuauuauguacauuuauuauaaauaaaauguuaaguauauauacauacaguuaaaaagagauaacaacaagugcuggugaaacugggacucucacacugcugacgggaauguaaaaugguggagcgaccuuggaaaagcgucuggcagcuccucacaagguucgagcugcuguaugaaccagcaauuccacuucucagcauagacccaagaaaaaggaaaacacacaucuacacaaaaacuuauaugcaaauguacacaguacuauucaccauagccaaaaaaaaugggaagaacccaaauauccuucaacugaugaauggauaaauguggucuauccacacaguggaauaauacuaggcgauaaaaaggaauaaagcagugaugcaaugccccagcauggaggagcccugaaaacaugcuagcaaaagaagccaaucaccuaggaccacauuuggcaugauucaacuacuacgaaauguccagaaccuuuacuaagcacucuaugcuagaaguucaucucauuuuauucacaccaccaccgugugguagaaaugaugcuauuuuacagauaaaguaagugaaugagaagagcagggcucugcuccugugugugcaagaugguguggcucacgcucaugcaucacaugcccguggcugauguucugucugggagacaauggaacaguggucaggggcuggccuaggagccgggagacugagacuccacuuccaaggcagccacugccucacuauacauccccagacaauccccuucccuucucugagcccugugucugcaaaagagggguaagacaagagugguuucucaacccuggcugcacacgagucaccuaggaaacuuaaaaggccaugucugagcugagggaaguguuuuuuguuuuuuuguuguuguuuguuuguuuugagacaaggguuuugcucugucucccaggcugcuagaaugcaguggugcgaucaugguucacugcagccuugaacuccugggcucaggcaauccuccugccucaaccucccaaggagcgagaacuauaggggugugccacuauacccagcuaauuuuugauuuuuuuuuuuuaaauggagucucacaucagccucccaaguagcuggcccuaccagcguaugccaccacacuuggcuaauuuuuguaauuuuaguagagacggaguuuugccauguuggccaggcuguucucaaacaccugaccucaagugauccacucaccugggcuucccaaagugcugggauuauaggcaggagucacugugcccggccaauuuuuacuguuuuuuuuguuuuguuuuguuuuguuuuguuuuaagagauaaggucucacuacguuguccaggcuggucucgauauccuggcuucagugaucuuccuaccuuggucucccaguguugagauuacaggcgugagccaccuugcccagcccccagaguaguuuaaaugugaauuuuucuuaggaguaagacucagcaucuuuucagauuuuuaauaaucaucugugugucucuuccugugaacuaucuuguucuuaucuccuugcccauuuuucuguggggcaguuggccuuuuucuuaacuuuuagaaguuuuuuuuaauauuaggaauaugaacccuguaucugcucuaugaauugcaaauauuguuucccucugucacuuuuuuuuuuucuugagacaguuucauucugccaccgaggcuggagugcaguggugugauuacaacucaauccaaccuugagcuccugcgcucaagggauccuugugccuuagccucccgaauaccuaggaauacaggugcaugccaacaugcccaguuaaucuuuuaaauuuaguuuuauuuuuucuacuuucuuuaauuuuuauuuuugcucuuucagcagaaucauuuucuaacaauuuuuuauagagaugguaucuugcuguguugcucaggcuggucuugaacuccuggccucagcacugggauuauaaguaugagacaccacacuuagccucacccgucuuuuuaaaacuuuaaaguacuuggcugcaggaaacacuuuuauggaaagcaaaagguaaaugcuggaauaaauucagggaacagucauaaaauuuucuacuuuccuucugaacaaaaucaguaucaaaagcuuucuguucccuguccauguuuuaauuaaagaucgacccugucccuuauuacagacaccuggaguuuuugucuaccugccaucccuuuccccuuccugcugcagaauucuuucuuugggggaaauccauucuguguguacuguguagacguaauccaggcgaggccagagaacucagcuguguagcaacaguaacugauucagggcugagcagaagaaccaagcccuuccucuucuuuugagagggagucucacucugucgcccaggcuggagugcaguggcacaaucugagcucaccgcaaucucugcuuccuggguucaagcgauucuccugccucagccucccagguagcugggauuacaagcccuugccaccacgcccggcuaauuuuuguauuuuuuaguaaacacgggguuucacgauguuggccaggcuggucucgaacuccuggccucaggugauccgcccaccuuggccucucaaacuguugggauuacaggcaugagccacugcgccaggccgaacaaagccauuccuaagaacuuuuuguuaagcuagugcacauggguuguuaccauauccaccacuuggagaaagaccgucugaaagaaaucaaggacagcaaggcuugaauauacugauuacguggugugaauccugggagucagccagucuaccugaagcaaacucaugucaagcuauccuauuuuccacauccccuuaugcugccugggggaggccugacuuguuuuucugucacccgcaaccacaagaguuaaaggauuuuucagagaaugucuaaaguuauuuucccccaaaauacccugaaucuguuaccucuugaggccagaacucucuuccuccuugcuggucuuccagauagucacggaugauguuuguuuucugcaaaaacaggcccauagaguuggcacguucuguaucuucaccaacuaaggggucuucaaacucugaggcugagaaaagacgggaaaggccaauuccgaccagcccagcaacauaguggcaguacuguaagagacgauuuuuaaagcacuuuaauaauggaauuuuuacugaaauggacacacuagagaucauuagcuacaaaaaagcagguucaaaagagaauggguaagaaugcauuuugauuuuaaaauacaaauauacauaccaggauuuaaaaaacauucaagaaggaugugcucaaaacauuucauagcagucucuggcugacgggaauuugauguuuuuauuuuucacuuguauuuuccaaauuucuacaauacacauguacugcuacuauaauaaaaggcuacugaaaaaaacuaguaaacauuuuuuuauuuuuauuuuuuauuuuuuuuuugagauggagucucauauauuugcccacguuagacucaaacuacuggacccaagcaaucuuucugccucagcuucccgaacagcugggauuguaggcaaauaccaccgugucuagcuuuacaauaacuuuuuuuuuuuuuuuuuuuuugagaucaagucucacuuuguccccugggcuggagugcacuggcacaaucucaacucacugcaaccucugccucuuggguucaagugauucuccugccucagcuuccugaguagcuggaauuaaagcacccaccaccacauccagcuaauuuuuuauuuuuaguagagacgggguuucaccauguuggccacgcuggucucgaacuccugaccucaacugaucugccagccuuggccucccaaagugcugggauuaccagcccaagacaccgugcccgcccuagcuuuacaauaaacuuuuugauacauaaaacuaugagagaaggcaacgaugaaagauggaauauucugguaacaggaacuaggacaauaccaacuaugguuuaaucuuuuuuugaccaaucugauaacaugucaagauccgcaggcccucaaaaucaucauuauaugaaagaacaaauaacuauuuuauguucuugacacgguuuuaagaacucugcacauucagccgggcacgauggcucaugccuguaaucccagcacuuugggaagcugagacgggcggaucacgagaucaggagaucaagaccauccuggcuaagacggugaaaccccgucucuacuaaaaauacaaaaaaauuagcuggccugguggcgggugccuguagucccagcuacucagaaggcuaaggcaggagaauggcgugaacccaggagguggagcuugcagggagccgagaucgcgccacugcacuccagccugggcgacagagugagacuccgucucaaaacaacaacaacagaaaaaaagaacucugcacauucaauccucacaaacauuguaucagguacauagcaguaugaucuccauuucagaugaggaaacugaggcacaaagaagucgauuuaacuugcccaacauugcccaugugagaaaaaaaaaaaauuagccaggcacagugacacaggccaguggucccaguuacucagggggcugaaguaggaggcucgcuugaacccaggaagguucaaggggcugccgugucuguggcaggggcuaagaguucaaaacuagguaguaugacuuaagugucaggcuuuaacaacuuugcuaaaacuuccccuuuucuuuuuaguuuuucuuuuagagacaacguaacuuccccucucucaacagagauuucaguaaaugcaacucuuaauugccaaauacuuuuuuuuuccgcgacagcaauuugucaaaagcuguccuccucugaaaaggguauccuaagacaacuuaaugcaauauccacauacaauaauugucuauuaguuaacuuaagaagcaaaaguaaagaagguaagcucuggagugucauuaggaaggguaaaaguuaggaaaugaccgaaguucacgccuguaaucccggaauuuugggaggcuguggagaggggacugcuugagcccaagaguuuuagaccagccuggccaacaaagcaagaccucaucucuguaaaaaauuuuaaaaggcugaguguaguggcucacaccugggaggcuaaggcaggugaaucgcuugagcccaggagcucaagaccagccuaggcaacacgaugaaacccugucucuaccaaaaaauuacaaaaauuagccugguguagugguguggaccuauagucccagcuaauggggaggcugaggugagaggacugcuugagcacaggaggugaaggcugcagugagccuugaucaugccacuacacuccagccugggugacagagcaauacccugucucaaaaauaauaaaaauuaaaauaaauuagccaggcaugguggcaacgugccuguggucccaguuacucaggaggcugagggcaaggaagauugcuugagcccagaaggucaaggcugccuugucugugccacugcauuccagucugggugacagagugagacccugucucaaaaaaaaaaagucgucucugacugaaaguaauacaaagccagagacuaaucagggggaagaaugcacaggugaagagaaagcacuugaaauuuguucugggacaaaaguaacaugaaaagagugaaaucuugcugaaauuagguagacagaaauuggcuuuggacagcuauacaaaaucuucaaaagaauuacuagaaauuuaaaaaaaaauuaguauaucuauaguacuauccaaaaauauauuugaagauaauaguucuuuugguagaaauacuccuaaaauggagacuuauauaauucaucuucccccaaaguagaagaaaaaaaauaacuccuugaaauaauuggcuggucaugccuguaaucccaacauuugagaggccagagugggaggacuguuugaugccaggaguuugagacuagccugggcaacauggcaaaacccucucucuacaaaaaauguacaaaaaugagccugguauggugucaugcacuguaguuacagcuacucgguaggcugaggugggaggaucaccugagcccaggagguugaggcugcggggagccgugaucacaccacuacacaccagccuggauaacagcaagacccugucucaaaaaaaauuuuuuuuaauucaauuuuaucugaucaaaacuucuauucaacaaccuaaaauuaaguuuccugaauaaaucugcacaacagaaaaugaguuacuaucauaaccagugcugguucuuggccagaaguuuuaacuucaacuuuauuuucuuucagauggugucuugcucugucacccacguuggagugcaguggcacaaucauggcucacugcaaccuucaacucuugggcucaagcaauccucccacaccucagccuccagaguagcugggaccacaggcacaugccaccaauucccugcucauuuuuuaauuuuuugaaagacggggucucgcuauguugcuuaggcuugugucuaacuccugggcucaaaugauccucccaccucagccucccaaagugcugagauuacagguaaaccauaguacccggcuaacuucaccuuaaaugcagaaauugauuucuagcagucauuguaugcuguuaacuuaggaagcacaaaucagcaguuccaaagauaacugcugucaaguuuugagguuugaaaaauuaagaggcccaagaccuuggaccuacacuaacguagugaccauguagcagcaucuuuucggagauccuaauuuaagcacaguuaaagguaugaaauacaucaacacuuuagaugucugaaaugucucugccugcuaaaucugacuggcuuuaaaauaaauaaauaaaaugucuuuacuuccacagaagugaugaguaagucucacaaacaccauuccuaugaaaaauaggcaagacuccuaacccuaccuuauguuuugauguguaguuuuaaucuucauggucaauuacaucccuuugucuagauaagcacuucucuccaguacccuacuccuagccuggcugauauccuacauagcugcugguuuggaauuaacucuggaauaaacuguuuaugaugagacauucaaccuaaacagaugaauuguaaaaccagaggggcugaaaauacuggacaacuuuucuuguucugagcuucacuaugaggacugccagcucugucuaauacaucacacacagacacuguuuuaugagacuaaccuugucccacuccuguucagaggucacaugcuuauccaaaaacucugccaucccaaugcccauucuccggcaaaugucggcaaucacuguuugguauuucucagccagauuucuaaacucaagggagauc

SEQ ID NO: 17448 - RNA, 64300 nt, Homo sapiens
ccgcccaggcgcccgcggagauccagguucgaggcuggcgcggcgcggagagugggcuggaggccggggcgggacgcguugugcagcggguaagcgcacggccgagcgagcauggagggggaccggguggccgggcggccggugcugucgucguuaccagugcuacugcugcugccguugcuaauguugcgggccgcggcgcugcacccagacgagcucuucccacacggggagucguggggggaccagcuccugcaggaaggcgacgacgaaagcucagccguggugaagcuggcgaauccccugcacuucuacgaagcccgauucagcaaccucuacguaaguucagcccccuccuggcacuuuucccgcagcuucuucccuggggucggucucacggaaacccugccuccagaggggaggaaacagaccccacuccuggagccccccagcacccuugcggugguacccggccagagagcgaugccgcugccugccccgcugcuguaggggagcaagaaugaccuggaggggagagcaagaauuguucgcagccacguacgcgucccaggcagaaaagguggcguugcuagggcggccagcgggcuuugcaguuaggaccgcgagaaggcugugcccgucugcggagcugggguguucccucuucagaccuggaggcuuccucuccgaggacauggggcuccgggguugugaggggagugagaagauaggugaacgaguuuuagggccccuggaccuacugcagcgcggagcugggacagucgcaaaaguugcgcuuguuucccugaauccagacucccuggccaguggggaaggagagagaggcuuuuugccuaagucaguucccuucccucccugcgcgaaaggguagcguccuugggcuugagcgacugucaccuuuuugucccucuccucucccaggugggcaccaacggcaucaucuccacucaggacuuccccagggaaacgcaguauguggacuaugauuuccccaccgacuucccggccaucgccccuuuucuggcggacaucgacacgagccacggcagaggccgaguccuguaccgagaggacaccucccccgcagugcugggccuggccgcccgcuaugugcgcgcuggcuucccgcgcucugcgcgcuuuacccccacccacgccuuccuggccaccugggagcagguaggcgcuuacgaggaggucaagcgcggggcgcugcccucgggagagguaagugaccagggauauuugacugcugaggaaauugaaggaugggcuuaaauucuggggcagcgacccagggacuggcucggaguuguuucugagccuacucuugcgcugaaccugaccuuggaggcagcagggcuggaguggcuugggagugaggaaagacguugucucuaggcaucuucugaggcccuggcagguggucacucccuugaggaaaaaaaugcuuagcggauaugagagcgggagugcagaugugggagccccuuugaacauaaggcaauuuacuguuugguugcuuauuuuuagaaccaucucuaaguauacaaguauuucuaauuauauguucauugaaggggaaaaaaucagaaaauacagauaauuuuaaaaaagaaaacaaccacucauuuucccaccacugauaaacauuuuucugcguacauuuucagaguuuuuucuucugcauaucuuuauugcugucuauuaacaaugaugaguuuacacugcacauacuguuuuauaacuugcuuuuuucacagaauaguguauuguaaauauguuucaaugucaauaaauguauuucuacaucauuuauaaugaugcauacuacuguauccugcuauuauccuguauaauaguggguguaccacaguaugcucaaccaguguugggccauuaaggcuuuuucugguuuuucauuauuauaaauaauagcgugaaucacuuuuuaaaaagcuaaaucuuugcacauguucuuaguugacauuccaggaagugcaauugguaggucagagaggaugcacuuuugauaaaguucuugauaacuucugccuaauugccuuccagguaccaguuuacaaguuucuuaguuuauaggagucugccgucaaugugcuuuacagucucuaccugcggaaaguaaaaaauuccaggcuccuggucuuuagucuugucaucaacauuugaaguccuccaaauggauaugaguggggccagcgugcuugguaaauggcaaacugccucauuccugaagaaaguaagggcuuccuucuauggaauuagaccugaaucuaaaauaccauacucuaggggcugaaaccauaugauucaucucaauuuuaacuuacggaaaugcuucuucacuauagaaggaugguacaugcccccuguaagaggugagguugcuugcccaugucacugaucucuaucuuguaaggaugcugugacuuauaucuuuuguauggggacucuuuauuuuuuaauuuuugaggguacauaguagguguauauauuuaugggguacaugggauguuuugguacaggcaugcaauacguaauaaucacaucuuggagaaugggguauccauccccccaagcauuuauccuuuguauuacacacaaucuaauuacacucuuaguuauuuaaaaauguacaauuaaguuauuauugacuauaauaaccuguuaucacagguuauagucacccuguugugcuaucaaaugguaggucuuauucauuccuucuauuuuuuuuuuuuugguacccguuaacuguguccaccuuccccugaccccuacuacccuucccagccucugguaaccauccuguuacucucuauguugcauaaggacucuuuaaaugcaagguuuuuggaauuaaaacuuuugucugguccuuuucuggggugggggagguuuaggguagaagagauuuguaaauuccaucucucuuuuacuuuucuaauuaaaauccaccugcagacauuaccauuugcuaguuggcuucagaauguuucauuaagaaaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccuuaaaaaaugaugaguucauguccuuuguagggacauggaugaaauuggaaaccaucauucucaguaaacuaucgcaagaacaaaaaaccaaacacugcauauucucacucauaggugggaauugaacaaugagaucacauggacacaggaaggggaauaucacacucuggggacuguggugggguugggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaauaaauaaauaaauaaauaaauaaauaaaaaagaaaggggaaaaaaaaaaaaaaagaaaggaggauucuguuuggauaggggauguucuuucaauuacccacauugaaguuucuuccaauauuuuaaagagcucugggacuugaguucuuguuuuaauaguucuuuggagauagacuuuggcaaacaguaaucuaauuugcuugaaggacugaguucuacauggcguucuuaaaguuuggcuuacuaacuuuauauugcaaaguuacuggaaacuggaagauucaaagcaauggcaucuuugccauuaaaaacaauugcaguuggugcccuuuuucuccauggauauuccugucaggugugaccagauguugcaccugauauugcaggaaugucaagguguaauuguaucugaaaaaaaaaugugaacaaauaguguuugucaauucaguuaaucugagauuucuugaacucucauagguaguucacagagcaaaaaaguuaugguguagaccuuugaaauacuuauugaugggagacauagaggacuaauguuuagcugugcuuuuuguggggaaagaggaguguuuuguuuuugucauuuuagggaugggguuagagacagcugaguuauauagaucucuguaauguggggaauguuuuguuuaucuggaauuuaagucagguugaaagggcuaaaaagaauggauauugagaaugagguaucaagagagauuguucugagcaaaaacaugacccaggagaagguugagagagcaaccuauuagcaaaggggccagagaaauggaugaaggagucacaggcaguaacauaagacagaugagugcaagguugcccgcuaugguugaauauuuguccccucugaaaaucauguugaaacuuaauccucaaugugacaguauugagagguggggccuuugaaaggugacugggucaugagggcucugcccucaggaauggauuaauuuauucauucauggauuacuggauuaucauggagugggccugguugcuuuauaagaagaggaauugagaccugagcuagcacauuagcacacucagcuuugucgccaugugauaccguaaguacccuggcacucugcagucaccacuagccagaaggcccucaccagaugugaccucucaacuuuggacuucucagccuccauaauuguaagaaguaaauuccuuuucuuugugaauuacccaauuucaaguauuuuguuguaaacaacagaagacaaauuaagacacugcccaauggaggccuccaucuggguggagacugagacauguugacuugguucaaagguugauagucauugauggaggugguuggauuucacagagaaaaugagagguaaaagcaggacuuuauuguagcuuuuugacuucuggagacaagguuuagaagagggguggucuacagcccauccaagagaguucagacugagucugagauaucacugugaagaugaagagaauagagacauauauggaaauugguuaaugcugaaccauauauggaaauuagaaaugcugacguuuugcugaagaguaucaggaaggauauaguauuagggaugugauagcacucagcauuugucuuugaauuuuuggcaggaucuguaggauuuagugcaguaaaauaaaugagggacagucccccaugugacaguguccuacaggcagugggagaugaagaacuacacuaaggaauggagguuaguguucacagcaaacacuggaggccagacccaaugauccuagagcucuagaggacaugugguccugaggaagaugacaaagagaacuuugugaccccuauaagagucacccuaauucuucauuuccauuuucauuuucauuuugauaagccucuauaggcaagccccuugaagaaaaggaugucacuauucugauuuuuguccagauagcugcaguuaauuaaaugaauugaaaaaauuagaaacucuuagagggguguauguugcaugcaucagccuggcucugaugagugucacuucaacauugauugggauguccuguaccugggagggagagucaggcucugguuucugcagagggcucuggcuuuucucucuuucugauaacagggccugcagccacucacccugauccucucugugcugcuccucucccuguggaggccccucucuccucucugggauccugggggagcugggaaccagugacucguuugucagguuuggcagcccaucugagggcuucucuuuggagacagagccugugcggcucuugcaaaagcuuguaucuaggaaugugaggaccuuuccuguuuggaagccagucaaggaguuuuuugagagggggagcccuucaagacuucaugaagugggcucuuuagcaauuagauguagaauuuuguagaacugaccaagaacuuuacaagugaucauuuaguguguggguggcuuuuaaacagccaaacucuuuuggcguguacuuugggaucauaaauucuacuuaaaaggaaguuguuuccuuccucugauauuugccuauuuugguggagacaaagaaauuaaauacuugccacccauaaugagugcucaucucaagaacaguauauagaagauguugaauaaauuuuaauugaaaugaauuuguuggcugguugaaugaaugaaugaauaaaauaaagugcuaaaugcccagaguucacagcaaaaagucagacucuccucuucacagcucuguuuacuacucucuuccccccuuccccauccccuucaauucuucacagucucuacaaccuccuuaucuuauggaauuucucuaaauuuagaaccaggauucucuccuaucucacauuuauuauggcagaucaaugccaggagcuuugaaagcuuagcuuuuugaaaugggguuuuuucuccuuccucuaguacuuuucuuucccuaguugauuuuucuuuauucugacuaauguauaacucugaaguuauugaguccacauuaguugaugaugucgacuaucuuauggauagacaugaggcagaacagccuuuguuuauauuuggcaguaguuguggcuuccuaguauugagaagcucuaaaaacauuucuugcuuuuuguuuuuggaaaagucaagcuuugcugaugaacaaucaacaacuggaacaauaacaaauaaacuaggcaccuguuacuuugugaauugaaugaaugaaaaaagcaaagcaagauguuguuuuuucuggguuagagaacuaaaagaacugcugauuguauuuuauuuucucuugaaaaguguguuacaucuauauuucuuuauccuauuagcaaaaccucaaaaccuuacuuugaaauuaaacauugaaaggaaaaauuaacauuagaaaagagcuagaacaacugugggaguagacuuagaacaaagggaagagcccauuccuuccuugcuguuuccuucagugaaaugugauguucuucucugugcccgaguuugucugucuagcagaauggaaagguaaugauacuuaccaguaaauaauauuucuaagagucacauuauuugugaaguaaguuguguuuuaaaaauaccuucccaguuccuuacuaaauuguaaaaguagugugauuuagugagagagagacaguuucagaagccuaaacauaacagcuuuuugagaaucaagcacuguucacagaucuuuaggaggagcggucgcugaaugaagguaaaggcaaaaaucucaucuuguugaaaauaugaggguaaacagaauguuaaggagugauccuauaaggaccuggguguugaauuggcagcugauucaggcuccuggucccucucuggucuguguuggcuccugcaguguuuauaacauucaccagcugccucugugacaccucccaaccuccacccugagauccuggacacacaccccggcucuuggccucuaccaccuucuccagugacucuccuaccauuucaaccauggcuguuucccaguccuacaccgugagacucuccugggcaaagccugucuuuugcuccuucacauccucagcaucaagcauaacgucuggugcuuaaguagacacuuggcuguuugaauuaguguaugaaugaauaaaugaaugguguuuacaaacauauaaacaacuaaccaagcauaaugaggugaaugcucacuagagaugcccauaaagguguuacagagguucagagaacagaaauuauucuauagggaaucacaaacaccucugaguggcagcauuugaagguuaggaggcuuucuaggcacagggaaccacgaacaaaguguagaagcauccaaggacaugguacaaauggggacuauuaaauagucugacaaagaugcaguggaacugagccugggagggacguaugcagccagguuacaacucaccuugaaugccauguugaggagggguuaggguguccuagggugugggcucuagagcuggcuggcccaccaccacauacuugccaccugaccugaggaagaccuguuagccccugugucuuuuucucaucugugaaaugaggauaacccugaugcucguaugaaaggguagauggaagaggaaagagagugaugcugugagacaguaaggaggccuuuugaccaacuagugccuaacacagugccugcccauaguggucauuuaauaaauggaugaaugaaugaaugaaugaaugaugcaaaugagagaugcugagugccuaggguuauaaacuagggcagugacugcaggauggacaaguuaauuuugcugauugcucuuagcucugaaagaguuuacaugagagaaguuugaaaccuuacaaaguauauauuuuuuaaccuauguuuuaccaaugcguauuucaacuauuaaucuaaauugacaaaugguauuugcaauaauaaauaauauugcuuaugaaauuauauuguuaacuugaagaggaaauuuuaaagaagguuauguuuaaaaacaauuuggaggaauccugaaaaaggggaaguucuuugcacguuaugaugcuuugcuugcauucuguuucuuucuucuuuuauuuguuuuuuacaggauguuucucucucucucucucucuuuuuuuuuuuuuuuccucacagcugaacacuuuccaggcaguuuuggcaucugaugggucugauagcuacgcccucuuucuuuauccugccaacggccugcaguuccuuggaacccgccccaaagagucuuacaauguccagcuucagcuuccagcucgggugggcuucugccgaggggaggcugaugaucugaagucagaaggaccauauuucagcuugacuagcacugaacagucugugaaaaaucucuaucaguaaguaacauugagcugaagcccuuuccuauuugaauauaaggacuuuuaggaaguaccugaacacaagugaccauaagaccauuacauaauauauugguggcuucuaaguaaggcaucaagucaaaaccaaggaacuagauucaacccuggaaggaucaaguucaccaaaacauaaaagguccuuuauuuuuccugcucuauuggguauagauacuggaaacagaacaguauguguguguauuuguagagccacugaggcuugcuaugaaaaacauugcucuuggaaccacauaaaaauauccagucauaaacugcccaguuugagguuuuccagauuaaucauuucacaggaggaaacauugugauuuagucuuuuggacagauacuguuaaacauuaaauugagcaauguaauuugcaggaaaaauaacuaagauuuauagguuuccagaagucugaggaugucucucuggcuucauuaccuaaaaugaauugaacccauuccuuagacucaucagugucugcccauaaugggcauuuaauaaauagaugggugaaugaaugaaugauccagagggcuuacuuagcuagugcaauaauaagcucuucugcauuuugccaguacagauagugccaguaggauauuuauugacuucaggguuuuuuggggggugugugaggggagguaggggugcccucgcuuuuauucguuuccugaauauagaagccagauagaauacauugguuacuuccuggccuccuuuaacugcuucuugacuucauuaaaucaauccuggguagguauagaaacaccuuacacuuuuagcaugccauccacucugcucggcuaccagaaagagaccacuauagccagguuugcuuacucagagcugacauuuauugaaaacuuacuacuugccaagcaucaugcuaaacacuuuccagauguuaucuuaauuaaaacucacaagaauuguagguuaguacuacuauuuucccaguuuuacagaggagcuuagggaaguuaaguaaauugccuaugaucucaaaguuaaguggcaaagccaaaauccaagcucaagucuggagugcugaacuacuuauuuuaucuuaugcugaguccuuguuuccuuucccauccuuaugauccacauugggcaucuuuagggcuccaucuaggcugccgcuuagucuggacucuggagcaaacucaguuccuuacucucccuccucugguuccacccucucuucuacuugggagcucauagauuuauuauuccauagauuuauuauuauagagaggucacaauggccaagcacauggaauacaaagauuucuaagacacugguccugcacaucagcagcuuguacccuauuaggguugauagacaaauagaucaacaauuacagagcccuggguaagugcuggcaucuacacaggagacaggagacaguggggccaaaagaccugugggaaaaagcaguuguguucccugagcagagccauaaaggucucuuggaacuaacauccacaaucacgugugacacacaaacacacagacagcauuuccacuuacccccuuucaugccuucccucauuuuuaucuuugauacuucccagaaaucucugaauugcuuggcgaaagcagaguaagauauggggccaaaugacucacguauuuuucuuuauuguaauccaugcuuaauacaaauaauaaaguacaagcaaugcagaauaaugugaaauaaaaguaaaaguuauccaugaucacuacuucaagugauaacaaguguuaaugguccuucuagaauuuagguauauacaaaacuuuuaaaaccaaaaugguucuuuugcuauguaagugguguuuucacauuaaucacuucuuauaggggucuuuuagucagaugucugucuauacuaccauuuuaaggcuacaaaacguuaugucauauauguauaaagacagcuuauuaaugaacauuucauguauuucugauuuuucuuguuauaaauaucauugcaguaaacagcauaauaaacauugcucacauucucguuucucccuaaaacaaauucuuaaaaguggaauugcugagaaaggguguaugauuuaaaaguuguacauuucagauugucaaaguuacuggucuuuuccuuucugauuuuggaucuuguuguuauucuuaggaagaacuucuguacaucaaauuuauagaaauguccuucaauauaaucuucuauuucacuuuucauuauuuaaaauuucaaaaauauacagaaaaguggagagaauaacuagaugaacacccaaaugcccaucaccuagauuuauacauuguaaacauuuugccauauucauuuuuuuguuuguuuacauuuuuuucuuuucuuuuuuuuuuuuuuuuuuuuuuuugagacggagguucgcucuugucgcccaggcuggaguguaguggugugaucuugugcucauugcaaccucugccuccuggguucaagcaauucuccugccucagccucccaguagcugggauuacaggcgcccaccaccacacccggcuaauuuuuguauuuuucguagagacuggguuucaucauguuggccaggcuggucuaaaacuccugaccucaggugauccaccugccucagccucccaaagugcagggauuauggguguaagccaccauacccggccuguuuaaauguuuuaaaguaagucacaaacaucaugccaguucauugcuaaaugccuuaguaugcaucucuuaaggguaaaguuaggcugggcaaggugguucuaaucccagcgcuuugggaggccaaggugggaggauugcuugagcucaggcauucaaggccagccugggcaacauagcgagaccuaaucucuacuaaaaauuuaaaaaauuagcugggugugguggugugcacccguagacccagcuauuugggaggcugaagugggaggaucacuugagcccaggggguugaggcuacagugagccaugaucaaucacaccacuaugcuccagccugggugacagagggagacccuaccucuaaauaaauaaguaauuaagaguaaaguuauuuuccuagucaauuguuuucuuccucaaauuugucucacaacugugagcucaaaggucauaaauuauauaguucauaauguuugucauacucuuccucugcaaauuuaaauacgaauucacacguguauauuuugaaaucauacuuuucuaucuucuggaagacaagacaguaguuaauaaguauuuaugauguuuagggccagugauaggcauuuuauuuauuuauuuuuuugagauggagucucguucugucauccaggcuggagugcaguggcaugaccucgguucacugcaaccucugccuccuggguucaagcuuuucuucugccuuagccuccagaguagcugggauuacaggcacacaccaucacaccugacuauuuuuuuuguauuuauagugggguuucaccauguuggccaggcuggucuugaacuccuaaccucaggugauccgcccaccuugauuucccaaagugcugggauuucaggcaugaaccaccguaccuggucagugcuaggcauuuuaaugugguuuucucacuuaauucuccuaacaacccagggaggaaggcauugucaucccauuuuguaacccaauuuuccuuuguagaaauaaauuaaguucuuucuauuacuaagcuuuccaaaugaccuuggauuuuaaaauaaacucaaauugguuacuuuuccauuaugcauaaugacaaaacccagauagugauuuauauauaauuagaagguuauuuuauuuagcuuuuauuggccauaaucuguauuuuuccacuguuugaagauuuuauaguuucuguuucuaacuucaagaagaaauuucauaguugcaccaccucuaaugugauaauaaacucaauauccucagaacuucaggauuuucuccuacugucuuuaguuuuccuuauuugcuugccaauaaacaccaacauuaauucuuaugaacuuaacaaauauguauagcauauugcacacaaaaucaguuuuucuuucuaugcuuuuuucccuaaauuuaccacaacaguaaccacagcauauacauauauguacaugcauacacacacacacacacaaacacacacaagagaaagacauuuucaaauuguacugaaaaauauuguuacuauagaaauccacaugaacaugaugaguacccacccaaaugaaggaaaaucuuuuguucuuauacaauuuagugaaguuuuuauuaucuuauuaggcauggacuguuauuccucauugacugacuuuugaggaaauuccauugcuugggagaaugugagcauaguguuuuguacaaauaucagaggaguauacaaacuggcauauucaaccuaaccagacucuuguucacucaaguuuucccauauuuuuagaaaucauauguaguuguucucuuuaggguauaccauugacucuaaaauaauggguuauugggauauuuggaaacucaauggaguucauguucuuuucucauggagaaaacgagagagcuguuuccagaagucuuuaaaagacuucuaagcuacuuucuuauuugcuccuuaacuuuuucagugcaaaaacaaauuuuuuagguuuuggcauuuguauuuauuugaauuuuuuuacauugacucaccauucuuuguggauuagggaauuaaucaguucaagugaauaaacaaugaaaugucuuuaauauucuguagaguaaugauaauucagaugcuuauugacugcagugugugguaugguuuucugucauaauauaacauagaugaguagagcaugggcuuugguguuaacugaauucggauccaauuguuuguuaugugaccuucagaagaucaguuagccuuuuaaagccuauuuuccccucuauaaaauugaauaugaucaccucuauuugcagauuguauugaagaaugugaaacacuuggcacagggaaggggcaucaccaauucaugaaaguaugucguagucauuugggugucaguauuugguagaguuuuaagcauacauuuuuaaaauguguuauguuuccagacaaguagaggaaggaugaaacauuccuacauuccuuguuuauuuucaaauagccagauuuuagauaaaccauuuggauuauggggcagauugauaauuugaugaucuggcauucuguggcauacagcuuugaaacauaauguuaaauaaaagguaguucacaucaaaaguccaguaugaucccuuuaguuaccauguaagucugcuuuuauuugguuuuauauaccagugaaaacugaaccugaucuuaauagccuuucagguuuuuuguuuuuuugagacagggucucacucugccacacaggcuggggugcagugguugcaaccaaagcccacuguaaccuggaacugcugggcucaagugacccuccugccucagccuacugaguagcuagaagcacaggcauguggcaccaugccuggcuaaguuuuuuagaaaaggguuuuguagaggcagggucucacuauguugccuagacuggucucaaacuccugggcuuaagucauccuccuacuuuggccuugcaaagugcugggauuauaagugugagccaccaugcccagcugucuuuccguuuuaaaauaaguuguucaccuucuaggaaggugggugaauggacacuuuuguuacauuuguuacaaugacuguuuccuuuuuauuuagacuaagcaaccuggggaucccuggagugugggcuuuccauaucggcagcacuuccccguuggacaaugucaggccagcugcaguuggagaccuuuccgcugcccacucuucuguuccccugggacguuccuucagccaugcuacagcccuggaaagugacuauaaugaggacaauuuggauuacuaugaugugaaugaggaggaagcugaauaccuuccgggugaaccagaggaggcauugaauggccacagcagcauugauguuuccuuccaauccaaaguggauacaaagccuuuagaggguaggaucuccccuccagauucugaucuguccucccccuugcauccaacaccuacuuauuggccauucuauccugaaacagaaucuuccaccuuggauccucacaccaaagaaggaacaucucugggagagguagggggcccagauuuaaaaggccaaguugagcccugggaugagagagagaccagaagcccagcuccaccagagguagacagagauucacuggcuccuuccugggaaaccccaccaccguaccccgaaaacggaagcauccagcccuacccagauggagggccagugccuucggaaauggauguucccccagcucauccugaagaagaaauuguucuucgaaguuacccugcuucaggucacacuacacccuuaagucgagggacguaugaggugggacuggaagacaacauagguuccaacaccgagggugagugcauuagaaaacugggugcuaagguuucaucuuaaccaugcugguuuugcauagcguugugauuuuucucuuaaguggguaggugaaaaguuuagcaaaaagaagauuggaucuaauuuuuaaucccuguguuucaagagauagaguaaauuuccuuugccaaauaaaucuuggcaggcagauucuguucggaaucucuugaucauuaauaauguuuuuuuaaaauaugggccucaugaagugagugggggaaaacuggguuuguuaugccagcuacgcucucaaguguaaugaacuauuucaguuugaaaguucagcaaagguaaaacauuuugcggcuucauacacauuccagugauggacggguuugugcuuuuuaaaguggugaguugugcuggcucagaugaacaugccagauucauacucuguugugagacaagccuagcgcuucccuugguuggggagauaugcuugugaugugugggagaggagagcccacagggaaagaaaaugacuaaacaccugugucuguugucauuucugguucauggcuaugcagcuguggcaugaaccucccuggagccuuguccucauuucaugacccacugaucggacugagaggcgaggagggagauggcgaaagcaggcggugguuaauuaucauggacauggggucuaugucagucuucuaguccuuguugagacuugucaugccagcuguuucuuccccaucagacauggaaagaugugaaugggaaacugacuccagauuguuuguuccagggacugcucaucugaccucugauaggaagaaagaggucagaggugacugcuuuguucugaaucuccauguuuuuccaccuuuucuguuuccugucacuguuguggcaaaaacauggcugaccuagcagagagggccuucuggguucugcucugguauuaucugcaggcuauugcauggagagguacuaauuucaggagggaagaaaauauuuucugacuaauguggcauuguguaaggauucgagggaguacauuggugucggcuucgaguuugaauccuggcugccaagcuugcugggugaccugaaguaacuuauguaacccauaagccucugauuucucaggaauuacuugggaggauucaaugagacagcguaugugaaguucuuggcuucgugucugcacucacugguucuuaauaaauaguggcugcuguuacuaauuuuagaagauuuaaaacagugggaaugggguggaggauggguagagaaugaagaaugugcuuauuaaagaguuucacauuaauuugugccuaagggaccacauuuccaugaaguugaagauguaaauuuuauuggaagucuuuagaaccuucagauccuucugagaaucuccagaauuuacaguaugaguuuccucuaaauacauuuuaaggccaaguaucaaagauuuucacaaagggauuugagguaaagacgcauuccugaauggccuucucauuuguggguugugauuuccuucccugggaagagcgugggaauauuaaaaagcagaucuauggagucauguauuaaaggguuaagaagggacugcacacccugcuuugggcucugagagcuugagaucacuggaguaaagugcaggaggcuucaggaaccagccauagaguagaacagaggcacagcuauaacccuuguggggcaugaacuaugauauuuaucagcugccggaugcagucuacuauagacauccugguaauggcaaaaaacgccugugaaaaagcugguuaauacgcauuuuggaggaagaaaucuagaaguguuugaaacuuagacaaaaaaaauccaguuuuuguuuuaaaagaauuuacggggauguaugaaguauagaagcaugcaauuguuaaauacuuuugaggggaugcagugacuguuucuuucacauaaaacauuggaggcucagaggucugucugguaagugugggcuuccuccgggaagcuguggggugggaguggcagagacacagaacauuguccgguacuaaguacccagccauguggcaucugccuggcuuuuucugcugauggaauagaaagcacaugguuuuggugcugguuggacuugaccuugacucccagcucugcuaugugguuuggggcaagacauguagucuguuugacccuuggcucuccucagcucuaaaacagaguuaaugaagaccucgucauauacuugcaagaacugaaauugagcuugggaagcacccugcccaauacauuuuaguuucccuuugaagcuuuaggguagucaucuugcuaaaccaagaaauuaagauuuaguuaaaggcccagaaaauaucacuccuuuuuacauuuuuuuccccuuagggacucauuuuacagaccuuucuuuuuguucagaaauuuagauuuucagaucauaucuacaccaggcaggaauguccuggccacacucgagcucugucuuccuaggccacagaacagcaguagauggaugugcaagcaugcuuucucugaggagucuuguuuccagggagcucuggucguuuuguugucaagucaaaaaguuacccaagcaccugccguguaccugucucugacucggugcuaguggaaguuuuggcuggcauuugcuaagugcagccugcugcucuaaagugagaacuuggcauuagauugcauuaucacaguuaguccucagaauugcccuguggggaguucgagaccagccugggcaacauagggagaccuugccucuauaaacaauuuuaaaaauuagccgggugugguggugcucaccugugguccuagcuacucgggagacugaggugggaggaucacuugagcccaagaguuccaggcuacagugagccaugauuguaccacugcauagccugagcaacagagagaaauauugucugaaaaaaaaaguuguccuguaggguagguacaaucauccuucccauuuuacagagauggaaacugagcuuggaaauacuuagugacuugucuagcaagggcaaagacugcaacaaagucaugaagaaauuagagaaagcuguagggugacagagagucaaaggcacuguccaggagugucacugcuguuggggaagucuuugugaggaaggaggggcuugagccaggccuggggucaaagucugagagggagaaugugugaaaacauuaugaacagagaagugacaagagcggaguugcagagaugggaaugaggagggaggaaaggagggagagagacagagacaaagguugauuaaggcaguggggugagagaguugccagugagggcuucagcugccugggaccaugggacugccuguguugugaguagaaaggaaugagguuuacugauaggggucuuaguuauucuuaagccugcugaggcagugcuauacgcagcuuaauuuaaucucaaucugcaugaugaguuaggaggaaggacaccuggcuuucagaaaccucauguagucccacuccacuuuuggccuugugaaaggcugcaggaguguguugcaagcucaacuuccacccugagaagaauuuaagcagguucugcugccagugcaacccuccaggugccaaagaccauccccugggugcaccuccagguugcagagggucugugaccaggagccgccgccccccgaugccugugaagacaccuauaugaggagauuccaugguagggccccucucccuucaccagaaguggagagagccuguuagugucaugccagcaguuguaaaaggccacccccagggucgugaucacugccaccagcaucauuacaugccacacacaucaaaauuaaacaaacaugaaaacuggacgaaaaagcauuccacuguuuguuauaaaguuggauaugguuuuucuaacuagucugucauucugagagaugggaaaacuuagaagaauuuuuccugcggugaaaaugacuuuuuuuuuuuuugagguagcaguaaaaauuguuaguaguugcuccagcuguccugaagcagcccugugcacgaagccuccugugucccucuguguuggcccagugaacccagucgacaccauggaaccuccccugugucuggcccagggccuucugugaagaagggcaggccggccaagggcugcagacaggugcuuaaguguuucugggaaaaugaagauugaaagauggcucagaacaagugcagaggagaauuuuccauuuuuguuacgaacuccuaguuaggacaagucucaaguccuuuggcagggcauuucuuucuuuccucugauaucuccccaccccauuuuucuuucuauuaaggacaugagaaaaguuaaaaacaaacaaaaaaaacauuaaauagaaaaaaaagagauuuaaaaaaucuucauguuaagaauccuuuagcaacuaucaaaccucaguuaacaaauccaugacaaaaugaguucauucaaaccuggccagccuccacccuccugcugugcccugaggugucagcaaacuucuuuauggucugacucuccguggcaggagcuuccuggcauagugugggucccagaggaggccauggacuagaaacuguauuucucaaagugugggcacucauccaccuuccucucacucagcugggagccugguuaaaaacacugauuuccaagcgccuccucuaccuucugaaccagaaacugcauuuuuaagccaccucacuccuucaacaccuccaggccucugcccaaaugucuccuucucccgaggucuucccugaccauacuauuucaaagagccaggugugccugcccucucucacccucuugucugacccugccauauuccucugcacuucagugauucugaugcccccucaauuugaugggauuuagagccagaagauuguuucaucucuguaggccucaauuuucucauuuauaaaauggagauaucuucuaacuagaauaggaagaagugcaugaaaauacacucaaagccaugauagggacaugaaaaugaccaccgaaaagaaaaagugccacuuuuccucggguggguuuauugcacaucucaucuagcugggauccagaucuugauucccagccuucaagaaguucagccucuuugaauuucacugcaauucccauagaaauuugagcagucacguuggccggaggucuggcuuuucucgcccuggauaaauagcugcacgugggcucagcaccguucuagcuccaggucucccccuucuucagggaagggcuaucuggcugcugugcgucuguauuacuuucacuaaagaaucuucacguuguauucuuguggauggaugcccaaaugggccguaagcacugagcucagcuucucagguggccagaaaugagcacgagaaauuuccuaacauucugcccaccccaggagcugccaauuggucagauuaaauuuguuaacgacauugaugagcaacaccuagcucagaaauccaaggcuuguuguaucccaagccuucuaucaacaccaauuggugugagaaucacuggcgggguggcuaaaguguagauugcuaggaugcacccagagaguggaacugguaggucuaaggugggcccucagaauuugcauuuuuaacagaaaucucaggugauccugaugcaguggucucuggaauccaccgggagaaaugcagcucuccgugugaaggacugcauggugcugugcugaggguguaaguuguuauucaccccuuggugaauuuccuugaugccucaugcuguugucagaacugaaccccacaaaccugcuccuccucagucucccuaucucaguaacuggcagcuccacccuuuugguuucccacaucaggacugaacaucaucccacauccagucuaccagcaaacccucucgguuccaccuucagaauaucccagaccugggcccuucuuauccccuguaccagcacuucuuaccaccaagggaccagcuccugucugauuuacuguagucggagcauguuacucuucugcucgaaacccucuagugcuucccaucucacucagaugaaagcucaaauccuuccugugaucucugagacccugcaugaaugacccaggccaccucuucucucaccaucccucccacaugcccacacaccccuccugccugacacagcaccacgccugcccucaucugugggguucacucccucaccuccuccuggccucugcucagucaccuucuccugaggucuucccugaccaugcuauuaaaaagagccauguacaccugcccccucccacccucuugucuuucucugcuguauuucuuugcacagcucuuacacauccaccccacuaaguaauuuacuuguuuauugacugcugcuggggagaauguaagcuucaggaugugaauuuuugucucuuuugcucccugccauguccucaguuucuagacuagguacaggucuauagugaaugcucaguaaauacuuguugaauuagugaaugaaugaacaaaaauuguaagaagcauuuaccuuucaccuaacaagcugccauuguaaaugguaagugugcaaaccugugugugcacuuggguaugaaggcaggcguggaagagggauuauaaauggaggcuugccuucccccggauuaggggcugauccaucuucuuuccuucauguggcuguuaugaagcugaaagagacaguguguguucuuggcucaguaaguaccauccuaaaaauacaauauuccacaaaacuguuuaaaaagacucccagguuagcuuaacaguaacuaguuagcccauuguaauuacaguuuaagucucauaauagccuuucaugggagccugcucauuguuauaacuucuuuuucuguaauagaaaaauguaguacagcuuccaaucuauuuauaaaccuuugcacaguugcacuuguaaguugcuggcugcaucgcccugccucuuuuuacuuagauaaaagcuaugacuccaccuaguuuaacucuccauaucuagacugucucuccuccaucuucucucuccuuguuucauaauucagccucagaauaagaauuggguugcagaauaaggcuucacaaaauaacugaaauaagauacaauccaagccuguuauuuccuuaauuugugggcagaacagcuuguaaaguuuggauugauuuuuaucugaauauuaugaaaacggcuuuuuuuuuuuuuuuuuuuugagauggagucucucucugucgcccaggcuggagugcaguggugcgaucucggcucacugcaagcuccgccugccagauucacgccauucuccugccucagccucccgaguagcugggacuacaggcgcccaccaccacgccuggcuaauuuuuuguauuuuuaguagagacgggguuucaccguguuagccaggauggucucagucuccugaccucgugauccgccugccucggccucccaaagugcugggauuacaggugugagcugccgggcccagccaaauggcuguucuuuagaccuauagcagauugccuuuuuacuugguguucagaaguacauuaagaagaaaugcgacuucuggcaaugcaggggugaggaagagguguucuacuuauuuuagagaugaggaagcugaaagacaguuugcauaguuuccacaaagcccccgagggagggcugagguugaguccuagagcuuggcgcuuucugcagccccucauuccuugagcucugggagaaaguccugauggcccuuaagccaugagcacacuggugagugugugagucccuccuguagcugcuuccuuacacuuaguugugaauuucugagcuggagaaaccugagauuuugacacauccaaguuacauucauuuccuuuuacucuaaauguuuuuuucccuuucuuaaacuaauagacagugauacaguuuucuucacagccaucuauuuuaccaugauccauccuggguuuuuuuuuuuuuuuuuucugccuugaguuuuauaucacuuuucuguuuaaguuaagcuugucacuuucuuguuuaaauaaaguugagucaugccuaauuuucuauuuuuaucaaacuggaauuucuuagccaagucaucaaggcccuauacuaaaucuugagucauaacuucauuccuacuauguucuaaucagauuuuccacuugaaccuacacugucuguccugccaacccucagcuugcugcuuucccaaggaucugcaggcagcacuccaguacuguucaaaagcuaaugccgcugcugcuacucucauuucuuaccugugcuguuuuucaacaugcuguaauagucaucucgauaaucuucccugcuugcuucuaccauuaaacccaguuuauaaaguaugacucgaauuauacuugaagucugugcugauuaaccccagacauguggugaccccuaaucuagugcucaugaucuccguacuuggaucccauugaaggggucguggagaguagcaguuaagauucuccagcuagauguccuagguucgguucccaccuuugccacucacugccuaugcgacuucaggugcuuuagucuacugugccucagcuuuaucugcaaacggguuaaaaaauugucccuggccagagugguggcucauaccuguaaucccagcauuuugggaggccuaggugggaagaucacuugagcccaggaguucgagaccgagaccaaccugggcaacgcagggagaccccuccccccaacccacccuaccaaaaaauaaaguaggcaggugugaugcaugcuuguggcugcggcuacucaaaaggcugaaauaggaggaucacuugagccugggaagucgagcuuucagugagccgagauggcaccacugcucuccagcuugggugacagagcaaaacccugucucaacaacagcaacaaaaaaaagucccugcuaccuaggguuguugugcaaauuaagaguuguuggccgggcgggguggcucacgccuguuaucccagcacuuugggaggccgaggcagguggaucacgaggucaggagaucaggaccauccuggcuaacauggugaaacccugucucuacuaaaaaauacaaaaaauuagucaggcgugguggugggugccuguagucccagcuacucaggaggcugaggcaagagaauggcgugaaccugggagguggagcuugcagugagcugugaucgugccacugcacuccagccugggcgacagagcgagacuccguuucaaaaaaaaaaaaaaaaaaaaagguuguuaaauguaaagcuuguauauguuaagcgcgauugaaguguuaacuuuguuauauuuuuauuugcugauggaggucuuuaucuuggugacauuguaccuauaaugcuaugucucauuagcuccuuuacuuucuguucucccugggaauacuggguaaagauugaucuuuggauuucuuccuccccuccugucuccucguuuccagauagaccuggaacacaacuaccacuugguuuuuccuaagaguaggguggguguccuccuucaugccagcauccgugucucacacuagaauuccaugccaucccugcucaacagcaugcuccuggagucuccagccaacuccaccuccuggggauguggaggcagaggugugugcagccgcuuggccuccugguggccaugcuugggauuggcauauuuccuagugccccggagaaagcacccuccuguccauccacaacccccgccacacccuacccccuuggcuauuuccuuuaugaacuauggcauuugcuccaguuuccccauuucuuugcagcacagauggcccucuucuuuuaaugggcagaauaaguaggaaauggaagaaacagcugccagagcacugaauuuauccuaguccuccauaauuucuuggaagaucugcgaguggggcccaagcugucugcuacugcguggaaaucaugcuuguaccauacccaucauaguuaaacccugccaagggcauagggcauuuuaauagcuugaaucccuguuguuuugcccuccucuguccccuucuccccaugccuuuucuuugagguaggugcguguguucuuuaagacccuucccucaaaacaaucuugguagcgagaccagcuauuaucuuuuuuaaguucaguguucccuaaaagaaggaugguuagacauaagacauuuguuagcuucucuauuaugucuuccucucaggauguguuuagguugaaccauauaaaagugcugauauuuagcccuuuuugacccacaaaaauagugguuucaugaaguucaaccuaacauguacuuacugguuugcuuucauuuuacugcacucaaacccacgggugcagucucaucuuaguucaccaacucugcaaugggacccagccgggagcaguaagcaauucuucuugccagcagacaaagcagauuaauucccuuggguugaauguuaugccggucucuuaaacaucaaaaacuguuuguuaugaucuaaacugcuucuauggagcagauguuguguccccgaugcagcagugacauuggaaucauuuaguccuuuuaaggcaaguuuguuuuauuuuucagucuucacguauaaugcugccaacaaggaaaccugugaacacaaccacagacaaugcucccggcaugccuucugcacggacuaugccacuggcuucugcugccacugccaauccaaguuuuauggaaaugggaagcacugucugccugaagguaauugacuggggccaggaacuccugugugucuauuccugcugcuuaccuguuuccagcuaccacugugagcucugcuuuauggaccaaacaucuccacuacuuaaaucagagugcuaucaacuugcaggugcucaauaaaugugugaggaaugaacugguuugggcugauucccaauuugaggauuauccagaaaugcuuccuucugccagcucauuagagccaaaguguaguggaguagaaggaggaggggagaaaacagacuggaggcaggacuguuucauagauggauaauugguugguuaggaaaucauuaaagugacuugcuaaagagugaguuuuggaaguugucaguggaauaauuauaccuggguacacccaucucuagccaggaugacguccaagccuaacuggauuugcugucuuuuaggggcaccucaccgagugaaugggaaagugaguggccaccuccacgugggccauacacccgugcacuucacugauguggaccugcaugcguauaucgugggcaaugauggcagagccuacacggccaucagccacaucccacagccagcagcccaggcccuccucccccucacaccaauuggaggccuguuuggcuggcucuuugcuuuagaaaaaccuggcucugagaacggcuucagccucgcaggugaguagggccucugagaaggccgguagucagcauugcuuuggcaguggugcuccuuggggcacugucuuuaggccuuuacgcagugacagaggaaucacuuguuuaauguacuagagccacauguguguaguuuucuggccacagguuguugggaaugguuugaccucacaucacugauuuuugaaaggcagugauuucgucuaaauguucucccagcuguucugagaaacaggaugauuccauucagaacauuuguguccucuuaccccaauuuguugcagcauauuugucaggcuuuuuaaauuaugcacagaucugucaaaugcaaaaaugguacuuggggcaccuggggaugauuuuacuucauggggaaggggugcucuucuccucccagcuccacaaccuauaauaguauaggccggugcaccccagacuugaaccugcacacacaucacuuggaggucuugucaaaauguaaauucugguucagcaggccuggggugggguccgugauuuugcuuuucuaccaagcuaggaggugagguaccaguguugcuggaaaggccacccguugacaacaaggauuuagaagauacuuuuuggauucucaccuuccaaccugaaaacuuguuugcuagagguuuuaucuuuauugcauuaaaaauaguuuugugagaaguucuuucuccaucuuuaacugcagagcucgguagcuguuaauagguucuugcuuuaaucaaaauuugaauaaagcccuugggucaaaaguagauaaaaaauggcacaccuggauaaauuuguauuucagauaaacaauuuucuaguauaaguauuacccacauauuucaugagacauacuuaucugaaauucaaacaaaacccugaaugucuuaggugguaguuuauuuguuuuuguuuuuuuguuguuagguuuauuuguuuguuuguuuuuugcuaagucuagcaaccuuagagaaaagucaaggacguucccaagaguauuucucacagaauacaagcuuguucaaagagaagcugggugagguaaggcaggaugaaaccauauucuucaauggaaaaguuugggaacuuauggaaucaacagcugauagugcuuacucucagauaucagauaaucuccuuaggcacgaucuccaacagcaguagaaauugggagcgggcaguauauacugguaacuguuuaagcaagaccucuuuucaucccugugcugaauguuuuucaucuccaggugcugccuuuacccaugacauggaaguuacauucuacccgggagaggagacgguucguaucacucaaacugcugagggacuugacccagagaacuaccugagcauuaagaccaacauucaaggccaggugccuuacgucucagcaaauuucacagcccacaucucucccuacaaggagcuguaccacuacuccgacuccaguauguauaaccagucuucacaucuguaaaauggggauuaugcccaucucacaagauagauacaaggcuuaaaugacuuacauggcauguccuuagaacagugcauggaacauaaaaugagcucuauuauguuauuacucuuauuguuaccaugaaauauaucguguaagugagcagaauggcugcuauacauaagaauaucuauaucccuacauaguauuuucaaauaauaaaaucaauagcaacauuguccaugggguggguagggaugguauaauuauauacaguuuuuaaccauccuacuuucugcaacauggaaaaauagugauuauuggaauuuauauuuaucucaaccuuguuucagcugaugaguucaggcugcuuuaaaaaaaaaaaaaaucacagaaagaggccaggugcaauggcucaugccuguaaucccaccacuuugggaggccaagguggguggaucaccugaggucaggaguucaagaccagccuggccaacauggugaaaaccuguuucuacuaaaaauacaaaaauuagcagggugugguggcacgcuccugcgaucccagcuacuugggaggcugaggcaggagaaucaucugaaccugggaaguggagguugcagugagccgagauugugccauuguacuccagccugggcgacaaagcaagacuccaucucaaaaacaaaaccaaaaaacacagagaugcuauaauuuauuauaaaacuaaugcuagauuuggagucaaaagauaagaauuuauauccuggacuugccauuuaauaucuauagggaaaggccucuuaauaucugagaauguauuuucucaucuuucacauggaacuaaaaaugcuuuuucuauauuaugugaucaaugugugcgaagcgugauguguucugugaaaguacuaccugcgcacaggaugcugccuccaucacagcugcuguugugcagcacagcaauccggauugaguugugccuuuccucugaccccugcugcuccuaugcugagagcuggcagccuggcaggagauguagggaagacaaggggaagcagagaccugggcugugaacaaaauggucaguguccggaucacugaccugagcuugacuccuagacucagauggugagagacaacccuuucccuucucuggaauccuucagauuuacugaagugcgagguguuggaagucgucacuucugugaaauguagaagauggauugguuuaaaauuuaggguguagagucaaaccaaugugaguuucaguuccagcucuaccauguggcagcauugcaucuuaggcuacuuaaccuuugugagccucugaucacaugauuuagugcccaccucaccaggcuguugugaggaauaaaugaggcaguauguagagagcacuguuggcauggcuggcccuuaguaacacuuauucuuuguguauaauaacauggacaauuguagugccuucucccucucagcacuguggcuuugcauccacucagguuuuugggauuuccuuacacauuuuuucauauaaacucaggagguucccaagggaacacacuccaagaauuagaugaaaaaaacugcagaaaaauccaccucacaugaaaaucucuguauuuaauauuuuuaaaaaauuaccacuguguuuguugcagcugugaccucuacaaguuccagagacuacucucugacuuuuggugcaaucaaccaaacaugguccuaccgcauccaccagaacaucacuuaccaggugugcaggcacgcccccagacacccguccuuccccaccacccagcagcugaacguggaccgggucuuugccuuguauaaugacgaagaaagagugcuuagauuugcugugaccaaucaaauuggcccggucaaagguaagguuuccuuuuuuguuguuggguaaaaaugacauccuuuuaaguagaguuagaaugauucacagagguuacuaaggguuaccuagugccaugcuguguuaugugcuagguauaaggaugaauagagcagauccuugcccuugaguuggaaacagaggcagaaaagaguuuuagggcagggaacagugucccugccaaagucaggaaauagagcauaguaugugaagcugguuuauagcaauacccaacugugcgugccaaucaggaauauaccugugaacaaggcagacuggaauuaggagggagagugaugcugacaaguauuuguuacaagugugaugagagcagggcacugugagucuaguuugaagauucagaaaagauguccccaagaaagugacauuuuagcuaaaacagaugagaagaauuucauccaaaacuaagguggagcaaagagcuaguaucuggaaaaaccaaacaucauagaacuugauguauaaccucccccuccaugauucccagaacauuauacuuaauggugaaagacuggaugcuuuucccugaagcuuaggaacaagacaaggaugucugcuguugccacuuuuauucaauucaguacuagaauuucuagccagggugauuaggcaagaacacaaaauaaaagccaucuaaauuggaaaaggacaaaguaaaauuagucucagaugacauuuuguguagaaaaucucaggaauucacuaaaacacuauuagaacuaaagaacaaguucgcaauguuauaagauaugcaagaucaguacaccaaauuguauuucucuauaguagcaaugagcaaacuaaagauuaagaaauuguuucaaaaagagauaaauuuuuaaaaagaagugcaguacuuguacauugcaucccacaaaacauuuuuggaaaaaaauuuaagacccaguuaaaugggaagauguuccacauucauggauuggaagacuuaauacuguuaagaugugaauacuucccaaauugaucuauuaauucaacauaaucccuaucagaaucucagcuggcucuuugaagaaauuggcaagcugauucuagaauuuauauggaaauucaaagaacacagaauagccaaaacaaucuuggaaaagaauaaagucagacuuguauuucucaaacucgaaaucuagaguaaucaagacagugugguccuggcguaaggauacauguaaagaucaaaggaacagaagugggaacccagaaauacucacauuaaaagucaauugcuuuuucaacaacagugccgggaguggggagggauagcauuaggagauauaccuaaugcuaaaugacgaguuaaugggugcagcucaccaacauggcacauguacacauauguaacaaaccugcacguuguaaacauguacccuaaaacuuaaaguauaauaauaauagaauucugaugguuaaaagacaaaacaaaacaaaaaacacagugccaaaacaauucaauggagaaagaauagucuuuuaaacuauuguuaacuauggugcugggaccacugagugaccacauacaaaagaaugaaguugaaccuuuuaccucacagcauauccaacucaaaaugggccaacagaccuaaguguaagaguuaaaacuuuuagaagaaaacauauggguaaauuuuugugacuuugaauuugcuaaugguuucuuagguacgacacuaaaagcacaagcaacagcaaaauaaacugggugucaucaaaauuuuaacaguuugugcuucagaggacauuauuaacaaagugaaaacacagccauagaaugggagacaguauuuuaaaucaugugauauuuguucuagaguauacgaaguaucuuacaacucaauaaaaaaacaagcuaacuaaaagaugggcaaaagcucugcaaggaccucucuccaaaaagauauacagauacccaaugggcauguguaaagaugcucagcaucauuagucaucagggaaaugcaaaucaaaaccacaaugagauacuacuuuacaucauguggucgaguauaaucaaaaaacggguaauaacaaguguuggcgagaacauggaaaauucggaacccucauacguugcuggugugauuauaaaaugauguggcuacugugaaaaacaaaauagugguuucucaaagugaaacacaaaguuaccauuuaauggagcaauucuacuccuuucuauauacccaaaagaaaugaaaacauagauccccacaaaaacuuauucguguauauucauaguggcaguauucauaauagccaaaagguggaagcaacauacaugcccaucaguugauggacaccaaaaaauauauucauauacuggaauauuauucaaccauaaaaaggaaugaaguacggauacaugcugcaacauggaugaacucugaaaaccuuaagugaagguagucagugacaaaggacagcauacugaaugguuacaauuaugugaaauauccaaaauaggcaaauccacauacauagaaagcauauucaugguugcccagggcuaagagauaaugagagcauagggcguuaauagcuaaaggguacaggguuaauuuugggggugaugaaaauguucugaaauugauuguggugacgguuggauaacacugaauagacgaaauuguuuaauuauguacuuuaaacggaugaauuguaugguaugugaauuacuucucaacugaaggccaggcauacuggcuuaugccuguaaucccagcacuuugggaggcugagguggguggaucaccugaggucaggaguucaagaccagccuggccaacauggugaaacccugucucuacaaaauaaaacauauauauauauauauauauauacacaaaaaaauuuagccaggugugguggcaugugucuguagucccagcuacucaggaggcugaaacaggagaacugauugaacccaggaggcggagguugcagugagccaagauugugccaucgcauuccagccugugcaacagagugagacuccgucucaaaaaauaaaaauaaauggaagcaaauaguaguagaaacaaaacucuaaaaccauucucaucggguacaguggcuuacaccuguaaucccagcuacucuggaggcugaggugggaggaucaccugagcccaggaguuugaggccagaguuggccacauaacaagaccccgucucaaaguaagcagugguucucaaauuuuaaugaccauuagccucaccugugaagacugauuuuaaaauguucuaggcauaucaugucacagaaagacaugcaggaaacuuaaaagcauguugcucugugaaagcagcuagucugaaaaggcuacauacagaaucauucuaaccaugacauucuggaaaagguuacacuauagagacaguaaaaagaucagugguugccagugguucaggaggaagaaggagaaggaugcauagguggaacaugggauuuuuagggcagugaaacuauucuguaugauauuguaauguugguuauaggccauuaugcguuugucagucuauagaacuguccaacaccaagagugagcccuacugcagacuaugggcauuaguuaauaaugugucaguauugauuggggauaacaaaugcaccacacuaaugcacaauguugauaauaggggaaacugcacauuuuggguggggggauaugggagcucguacuuucugcuccauuuuucucuaaauguaaaaccauccuaaaaagcaaggucuuaauuauuaaaaaauguuucaagcaagccagaggaugagcuugugaagucagggaacucuacagaugggaaguggcuuugucagaucaaggggacauuuuaauucugaaaaccaggucauguuuuccccuagaauguaagagccacaccaggagaaaaaaaccaucuuccucaauucagccacuguauugaaacuguugagcccagaguuagcuccucagugaggugaaucuguaagugauacgcgguucugugcuuuguuauuggagcugagggcuccuuaagccucagcaggcucaauaaagaaguguugcuucagcaauaugacaagauuaagguacaaggacuagacucuuuucuaggaugcgaaagugacuuguaaugagaaucccgaggugcuuugguuuuaagaaacuugguugggaauguaggcauuaggugcccagauauuggauuguaagguagcaaaugaacacaugaaaaugugaguugauuuuagaggaacauguaaauuagaaagggaaagauugcuguaguagauuucucaaagagagauuuaaaccuacuggggagaauggucuuuaccuuuaaauguccaggucagcccuguguuggguguaggcaucugaucuguaaaagcaacuguuagugaaauuucccaggcuauggagucccauucagauucuggaaccauuuaggaaaaagaugugucucuggguauauuuuuccuagagacauaccaaaugagaguaagaaaggaucagagaaagcaaacuggcagguaccaaguugcuuguuuucuuuagaauuuuaugauuuucccucccaccccagucaaauaauaauaucaaaggaugguuuacuuggugccaaguacuguucuaagcaccuuacaugaauuaacucauuuaauccccacaaugaccucuacccaaugguggggugggggugggguuauuuguuaucccauuuuacagaugaugagacugagguauagaaaugaaguaauuugccuggucauaguaagugaccugggugagcugggacucaaacucaggcacuggcuccaguacgcacacccuuaccccucauggcucugcuguuccacaguggccucaugacugccucauaauuuagaccaaacuuugaaagaggcaaugugugucuuuuaaacccuuuguguuugaacccuacuucauccacacacagcaguacuguucauucuaccugaauaggagggaaaaaaagaaaaacaaaaaagaaacacccaaaaguuuuuucuuuccccucuugguacacagcaguaucuuccuaagaacugcucaguuuuuccagagggaacgauaguuguuggaauucaugugaaacagcgcagcuguccacaccugauguggguguggugcgacuucccagggcgaggaugcagaacuggggugucuuucccagugaguaauuggagccucugucccucggugacuucucaaccagcagugccaccccccaccaguuguuugagcuuuaagcuuuaagugugagucagcuguuuuuuguuguuguugguugguugguuguuuuguggggucauaaaacacgauccaaaaaugcuuccuguccuuccacuucacggguccuuuuggcgaguugaggaggcucugggcagagggcugugcagugaagcugaagggacuguuccuuuaaggaaaaccgcucuuccccuugauuaaaugaguaaauuaguuccagauccucuguuaagagagucaggcaguuuaagagggugagggcgaaauagaaaaugucuuaagaaggauacuguguucuuuacuuacuauaauaggagaaaagcuuacaagucauagagaaugagucgugaaaugguuuuagaaauguauuuuaaaaauguuuugggaagccaaguucagugaauggggcccugugcucagaagagccccaugcuugguuuaacgcuuugcuuugaaccaugggcuccacauuuucauuuugcacuggggauugcaaauuauggaacuaauccugucagugacauacauuuuaaaucaguauugaguaauuagggacacuuucuucucaauuuuagguaggauaauauauccuguccaaguuugcaagucaacuuuugagcugagauuuuuuuuuuuucuuuuaaugccuagcagggugguaagcucuugauguccaugugaacacacuaaucuuugcuggaaugugccauggugaaauuuugaugcuggaaaguacugaauaagaaggcuaagcauuaguauuuauaaaucaaaacauguugacaauuacuuccugcuuuggugggguaugccaggcauuuuguacagaaucuuccuaaaauggagaaaugaugggagaugaucacguucuugucuuacauuggguccuaauggaugaagacaugaccuuguccuuaguuauaaccuauugaggacugacucaggaaccuggucuaggcucaaguuaacucggcaaccacaaccccagugcggugccucuuuccugucagccaagagauccagaggaacggaccuccaaggaugucugcaugcuucagggagcuaggcuuaugcugacauaguucaucagguuuaaaaagugcuggaauuauuuauugguccuuuguuuuggcaaagauucuguuacuccagccgacaacauuguggugaacugaggauaaacccauagcccuccuuauuuucagccaauaauacgggaaucaauaauacgggaauauuccacuacaagaaugcacugugguguuucuuauaaagugggauggaaagaguuuaccagaaaacaaggcugucucagccaaggcaucccagcucacagcaggcuaugacagggcacuggaagagccauaacgugggcaguagggcaggcacgggggagaaugccagacacccugaaggacuugggagcgaguccagucuaugaggucagcugcagcagucagcacuugggaucuagauuaggagucacucugggcaagucuccccccauagcagugggguugugguugccaaguuaacuugagaguauagaccagguuccugagucagcaucuguuacaauggagaacaacagggucauguccucauugaaggcucaguauaagacaagaaccugauucucuccuguuguuauuucuccauuuuaauagaagauucuguacaaaguggggugggagacacgggucagaaagagugaaaugauagagaauccaggaggaggugguaaaaugggugguacugccagugucugccuacagaugccaugaugcuggugucugugaguagugagaacuggugagcaggaugggacucagaggaugcuaagcuggcuaucaagacagggccucaggcacagaaguaugaggcagaagccugaguuauuacaacuuagauggaucucccuuuguagcagagauggcucaauguagaaccugacaggcuuagcuggggcucuggaaaucuuuugagucuaagauuagaguuaauucuagggacugagguugagcuagaaccucaaauaaugaugaacaguggccccacugagaaggcagaaggagugcagucaguagagacuggguagaccugccaauggggaauugccuuucaaauauguucuguuggguuuucuuaauuuucuuuagcaggauuggcagauguacauguuccuauuuccauuuuacauggcagacucagaaguacacagaagugccagaguugauagauucauucuaccugagcaucugacacuccuuccaauaccucugugccauuggcuuagacuagauaacuucaugaaguuccuucagugaggguugcagcaaagcgguggaaagcaugagcuauggaaccagacugcuagacuuuuauuccagcuccauccaccucuucugacuguguaacccugggcagguuauuuggccucucugugaugcagcagaaguggagauaguauuuuccucaccauguaguuagaaggauguaaucaggcauccuccuaucuguuuagaacaaugccucacacauaaaugcucaaugagcauugacuauuauguagaaauaaauauauauauuuuaagacaugguccuguucugucaccuaggcuggagugcaguggcacaaucauggcucacugcaagcuuaagcuccugggcucaagucauccuccugccucacccucuggaguagcugggacuacaagcaugggccaccaugcucggcuaauuuucuuucuuuucuuuuccuuuucuuucuuuucuuuuucuuucuuucuuucucuuuuucuuucucuuucuuucucuuucuuucuuuuucuuucucuuucuuucuuucuuucuuucuuucuuucccuuccuuccuuucuuucuuucuuucuuucuuucuuucuuucuuucuuucuuucuuucuuuucuuucuuucuuucucuuucuuucuuucuuucuuuucuuucucucgagauaaggucuuggcauauugcccaggcuggucuugaacuccuggcuucaaacuauccuccuaccucagccucccaaagugcugggauuacaggcaugagccaccaugcucagccaaaauagauuucucuaggggagauuucagucguuaaguaaucgcuaccuagugaguagauggauccuugguaaggcuacuccugaagaguaaauacugggaaagucauuccuguuuagucuuagaaaucuuuaaaaaacaagauuuuuaaaauuaauuggauuuaccuauaaaaauugggaauuuuaguaagagaucaacagauuuagaaccaggaaguuggagucugagucuuugcugugccacuuccugacuuugugagcuugggcaauuuuucccaugucucacuugauuuccuuaucugugaaaauuacacauaauggggaaaacaacucaccacauagaaucaucccaagaaucacaggaaauaauagagcaaaagcacuuuuaaacagauguuuugggcguuuuuauucccuggaugcaaaccuacugaaagcaaguaaagguacuaguugucuauaggguaggcaauaggaagccaugcuggaguuuaaaacugaagugcagaaaauccacccuagcuucagauauggauaauuuaguaaggucuuccggugugucacaaaacacagacaugcagucaguuccgaggacuccucuaucuccgugacauuugcuuaccaauagccagauugugcuuuuauuuccccucuacucaugcagaggauucagaccccacuccggggaauccuugcuaugaugggagccacaugugugacacaacagcacggugccauccagggacagguguagauuacaccugugagugcgcaucuggguaccagggagauggacggaacuguguggguaagagccauguucucgugucuccuucuuguagcccuuguuuuuccucugcccuccccagccuuaugucuguagaagacaaguaucugucaccuuuacaaccuccauugucaaugauuuuagcagcuguuaaucugaauauaguuauuuaaaaauuaaagcauagcuguuuauguuugaaaagaugguuuggaguggaguggauuuugcaccggggcugugaaaagaaaacaucuguugcaguuccuggauguuuugaguuaaguuuuguaauuuugagcuuuuguaguaaguaguucuuagacuuaccaaaaagcacauuuucugauuuucuuuaaauuuuagacagacauugugugucuuauauccccaaaaggcaacgguagaaauuucuugauauuaaaaaaaauuguugguuuucuuccaaguauccauucuuuuuaaaacaguuaaagaauucuuagaauauucacuuaaaaauuuaucuuccugugguguuuacuugaauggcaugaaauuuuuacuauuucugauuaucugcaacaugcauucauaucugauuuuuaaaaauucuacaucugccaaccauuugucccauugaagcaucauacuagugagaaaacauugaguuuuuagacccuccacuucugggacccuugaauuaagcagaauuuuucucuucucauuucuucuuagaugaaaaugaaugugcaacuggcuuucaucgcuguggccccaacucuguauguaucaacuugccuggaagcuacaggugugagugccggagugguuaugaguuugcagaugaccggcauacuugcaucugugaguuccaaaaucauuuuccuguguggccaaaauggugcucuuuaaucuugcucuuuaaucugucaguguuuugacuucugcuauucagaggcucugcuauaugguuuucuuaagaagacaguuuacaucaaaauaacccaaagcuggcuggaugugguggcucacgccuguaaucaucgcuuuggaaggcugaggcagguggaucgcuugaguucagaaguucgagaccagccugggcaacauagcaaaaccccgucucuacaaacaauacaaaacauuagccaggugugguggcacacgccuguagucccagcuacucaggaggcugagauaggaggauugcuugagcgcaggaggcagagguugcagugaacugacagcaugcuagugcauuccagccuagguaauagagugagacucugucucaaaaaaacaaaaaaaaaaacaacaaaaucucucaaagcuauggcucaguuucagcccuguuuauuuucacuguuuuucccuaaauagauauuuuugguguugaguuauugaaggaugcccaccucaguugggauuucuggcccagucauguaacaagaugaugaacuucacuaguaaacaccuccagcucuuuagauagagccuaaaguauuuuucaaauuagaagagauggauuuauaauucacugaugcauguccuacuugacuggcuaaagagcuccuucuguaacaaauuaccucuucuguauuuccagaaaauacuacagaccuaaaaauggaucaaaagaacuaucccaauucaucccauugauaaagauggaugagaguaaagaaaaugcacucuuuagccaggcaugguggcucacgccuguaaucccagcuacucaggaggcugaggcaggagaaucacuugaaccagggaguuggagguugcagugagccgagaucacgccacuguacuccagccuggcgacagagugagacuccaucucaaaaaaaaaaaaaaaagaaagaaaaugcacucuuuaauucagugggaugaggguaaaagugacaggagaaacugcguguguguguguguguguguguguguguguguguagcaauugcucuggaguguuauaaacuuuaauugaggacugcuuaggugauggguuuuugugcuuaguauuuuaacagcaaauucauaccaguacuugaacuuuaauagcauacaaaccaucuaggaaucuuauuaaaauccagauucugaaucacuggaccuuggguagggucugagaaccugcauucccuggucuguugcuguuggucuguggaucaugccaugaggagugaggcucauccuuugcaggccuaaacucuggaugcccuuaucuucuucucuuuucagugaucaccccaccugccaaccccugugaggauggcagucauaccugugcuccugcugggcaggcccgguguguucaccauggaggcagcacguucagcugugccugccugccugguuaugccggcgaugggcaccagugcacuggugaguaacugcaggucagccucaaugacuggaaaguugcuuuggaugcacauccccacauagauggagcucucccagaaaagacaaaggacuuccuuugacucuaacagccuuguggcugccaaaauagugagaaaaaagcguccuuugaguuagaaaggggagccaagggugauuuccucuggacuagaugggcgagcauauauggcuuccuuggcggagacguuccuguagcacucgggagcuucuaaccuugguuccuuggagccagcgcaggcuggaggaauuuagggaaaguugcauaccuuccuguuaggcggucuccaccuuaauucaacacuuaugguugugcucuucugcuuuaagugauauuuuaagcaaucucuaaacacauauguaauuucuaauuuuucuccucuuucaaaagagagaacuccacauauauaaaaagacacauaucaaaacuuuucucccagaaaucuaucuuuaagacuuaaugcaguauuuuauaaaagcaccaaaccauuugcaaggcuagccauuggaauuuaacuuagaaagaaugugugagguuguuauuuaaaggcucgacauaacucucugaguauaaauguccaugaaacuaggauuaggaguacuuuaaaauagaaaucauuaaauaaaucuuaaaucacaaaagguuuuccaaacauacccugugguaugugaucagauugaaacucaguuucacgugagucacacacacacaguuaggguaaaacgacacacuggggaugagagaauggugggaaacguguuuagaaugggaaagggccugcuggggaacaugaaccuuaaaaggcagacuuuccccugcuccugguguugcugugugcaucugccuccauccgcccaggcccaccgagcugaugugcuaagaacagcuuugcaauuccugggagcuuuauaccagauccgaauagcacgggccucccuccuccucaccagauguuugauucucauccuucucccauuccuuuuuccccuuugguuucagcaggaugggcugaguggacagcaggcugaggccauguguuacugacagaacaaaggucacugugacagcagcucagcccuccacuucucucuggauggggcaagugcacauggugguuucugagccucauucuuacucuuuccacuugugcuguacagaagcucugcugcaugguuuucucgaacaauuuaugcugaacuaacccaaagccguggcucaguucagcccuuuuauuuuuuucuuucacuaaauagauacuuuugguggugguauugaaaguugaagcuauggcuugaauauucgucuucuucaaaacucauguugaaacuuacauuccacuguggcaguauugagagguagggccuuuaaaaggugauuggaucaugagagcucugccccuaucaauggauuaauggguuaucuugggaauggaacuagaggcuugauaagaagggaggccugccuaaaauaacauguuagcacacucagcccccucaccaugugauguccugcaccaccucagcccucuacugagagucccaaccagcaggaaggccaucaccagauuucaacccuugaccuuagacuucucagccuuuagaacuauaagaaauaaauuccuuuccuuuagaaaugacucaguuucagauauucuauuauaaacaacaggaaauugacuaauacagaugguaacccucaguugggauuccugugugucuugguauuaggcccaguaauguaagaagacuauggaccucuugaauaaacaccccuagcucuagauaaagaguauuucccaauuagaaugagguagauuuguaauucacagauguuugucccacuuaaccagccaggagcuccaucugucauagauauacuggugagaaaacauugaguauaucuauaauagauacacucuuuacagauacccucuacagguauggaguucagggugaggugccaaagccugacagugggaaugaugcuuuuccuucguguggaacacaucguuuguuugguuuaacccuaguaccagcucuaagaaaugugaauccacugagaaaaaucuugucuguagaauuuauuuaaacaucuggcugcucagaucagcagagauggugcuuuuaaaauauuuaguuccuuagcucucugguuuaaagcaaagaaguugaaauuaauuucagccuagauaugaugaguguuaaucagaauauuaauuuagauuagaugcugcaugcuuugaucacuucuacaaugauucucucccuccuuuuuucuucuacuuguccugcaagacuuugauuaccuucuggggucauguuagggcucugaaauugacuacuuuuccauauugggaauuuaaguauugucauuuuuuaauuugcccuauuuuugucauuuucaauugucccuauuuuauuucugguucucugcuuuuaggauucuuuccaaagccuacaaacuaaaaauaugccaaacccaucaggugcuucccccaguguauugguuaucuauugcuguauaauaaauuacccuaaaauguagcagcuucaagcaauagacauuuaauaucagugguccagggaccugggaauggcucagcuggguccugugcuuuaggaucucucacaaggccacagucaaagugucuggugggucaguggucucaucugaaggcuuaacuggggaaagauccacucgugguuaugggcaggauucgguucuuugaggaccauuggauugaaagccuugguuccuugcugguuguuggcugccuucaguuucuugccacuugggccucucuaacacuacagcuuacuuuauuaaugccagagaaagucugcuagcaagauggaagucauaaucacaaaaaugacaucccuucaauguugcuuuauuaauuaaaagcaaguuacugaaaggguggggauuacacaagaccaugaauaccacuagguagggacuguugggggccaucuuagaggcugccuaccacagccacuuaccauguaguugucuucuaaacuuucagauuguggaguaguagagaaugaauggucauuuuccuaaagacccaugcauaaaucaggcuaggcuaaucaugaaaguaacuugaagaauaaauauugaaauauauguguaugugugcauauuuaaaggcauuccauaggguacaugugucucagugaccaaagaacagaggcuguauuuugugggugcuaugcauuguuaaagcacaugcucuuuuacuccaucaaacuaacaauaagggggugugggaguuuuucuccagccauaguuuguuaaaaaaaccggcucccuggagaggcugcacuuggauuuggguucucagucuggucugagucacuagccaggaggcuuuuauccaaguagaguuaaauccucugcagcuucccucaaucuggagugauuucaaacuuguguuggugugagcuggauauuucucagacauguuuguccuuuuggauuguugugacuuggccaggugcaaaagcagauugucuugaguugggaccuucccaggaggagcaagugugaguugaggaagcuggguuacagauggcccauuacccagagccaucauuacucaggggccugagggaagauacugacauuauucuuucuuggguuuccuggcguuuuuucuuuucuuauuuuuuuuuaauuuuuauuuauuuauuuauuuuuuuaggcagggucuuacuuuaucacccaggcuggagggcaguggugugauuacagcucacugcagccucagccuuccaggcucaagugauccucacaucucagcccccccaaguagcaugcccagcuaauuuugguaucucuuguagagaugggguuucaucauguugcccaggcuugucucaaacuccugagcucaaucgaucuaccccccucagccucccaaagugcugggauuacaggcgucagccaccacacccggccuagcuucucucuucuuugauaacgaaagcaugaucuccauuaugugccuggccagguuuccuguuccaagaauguagguagauguuggguaugguaugguaaaaucagugugguuauaggaggaggcaaggaugaagcuugaaaggaaguaguuuauuacacuuacaggucuggaguggguucaccacaugccauacagggguacaaucagcagggugcccaauugaacagauugugcaguagagagagagugggaccuguggguugaauccuuuauugggaucugggauggguuugagguuaauugaugccaagaaauuucacugggcucaaaggcaagugggcaguggugaaggggcgggagccugggggaacucgaggccagggguuagguuuaucauccaacaguuccugcugguuuugcucaguacuugggcagugagaaggauguugaagcacgaaagcaugaacucgaaggauuuuuaacacauuuuccaaacagguucuuuacuagcuuaauagaguguaggauugcacugagauuaagcuaccucucauuaccugagugauaaaggggcucuacgacuucuugaacguuuuugucuuuauagcagucccuacaggccccugcuaguaaugacuaagcauaagcaguggccuccuucuccuucuccaauaaaguuccucccuugccagggggcugaaagucuuuccauguuuucucucuugacaucugauguccugugcaugcccaggucccgggacucuagucucuaucauggugugagaggcccuccaaggaggagucaggacugcgaauucagggagucucaaucuuuggggcaggaauuucucacuugugauaucuucagucucuuuggggacuuucuccuccuuguuggucauuucuaauaguuucugucuacccagaacuuuaguaucuuugaugaugccaacaguaucuguggggaggaaggcuggucuuucagauugagucagaauucuuaggcugaagguucuaagcacaccguugauuuauuugguagcucuggggaauccccucucucuugaguucaaaaguaacaauaagaaacugcuccaugggcuccagaaauaggcccugugucucaggaauuccugcuuccugucauugcuugggguuccuguuaccauuagaaguacuuuuagcaugcguauugugaauagcuuuaauuuccugcauucggcugaauguuaauuuuuacagguuuaguuuuacagccaguuuuacagccuauuccagguccaagguauuggauggucaccaguuuugcccagcugggcauuugaauuguccuguugaagaggcagagccaagcucagggauaauuaugacaacauugguugauuucaggguaacugaggagccaaucugguuuguuucuacccuugcagaugaauugauaucugcuuucuugccuuuauaggcgaaaugaugguauccagggaggccaaccacucaccuggguggagacucuauggguugcauugaguucagaauuuuugggggaggacuccuaggaacugauauaugcugacuaaacuccccagagacagaagauaagcagaauacuuaccuucuaauuauaacauaagagauuccucucuagggaacagaacaccuacgcuuaaugcccaguguguguacuuaaugguauucgagaaagcacauuaguuauuagaggaugacccagugacaguguggucuggacaaaggguggugcagguaacucuagaagagguuccaugugggucaugggagccugggugaggagcuagcccuguucccaacccauucacaucaaauuuagggcuucaaauaucugucuucccaugcugaugugucucuaccaugggcugcaccguauugaugcaacacauucucauuuucuagguuucacacugaucacaccaucccacauuuuuuuuuuuucuauucacacauuuuaaagaaacuugguuauuacuauggauggaacuacugcuuuguuuuauuuucagccaagccuuaaucggaccuacacccuuuguuuauccuccuuuuacucugaaagacuuccugucucuuaaaguagcuuaucucaucccuugggcguuaguuuuaaccauucaauucucagagcugcuuuuuuucugcuggggaugggaggggugggugacuugcuauugucggcauaugcggauuucauuaaauaaaaggaauguaaguuggcuuuuguuugaagugucaggauuuuguuguuuugagaaauaugauggugaaaauuaauccucauggugcuauguggagaguguaggggccugaauuguuuguacugauaugccuggcaaauuuagauuuccauuuuguaaguauuauuucaaaacccuagauaauauuuuuuucuuauuucuucuaaaaguggaaaguaaagaaaauaccugguuaaugggggugugguucuagauaguaagauucuaauuagucaagacagaaugugcuucuuagcugaaaaauauuugggccucaucuggcuccuuugcaucuacagacgaauguuacagggagauggugccaacaacgaaagaaaaaaaaaccauuguuggauauauuugucuuuauugcagcauugcugaaaggaaguuaaugacuuauagucuaaagguuaguucaaagguaauaacuuccuugaauucacugucaaugaaacaugcuguaagauguguuguuuuuuucugugagcgacuacccauuugauuucuacacugaacacguuuagucuaguguguuaacucacauguuccuugauuuuuuuucuuccuuucuauuaagcuuaccuuuaggugucagcauuuuucugcucaugcucaaaggucuucugaagcugacaccucacuggguguugauccacauauccaaagcccaugcagucgcacagauugugugagugaagucauaguguucuuugcuucuuucuucuguuucugaccucugcagauguagaugaaugcucagaaaacagaugucacccugcagcuaccugcuacaauacuccugguuccuucuccugccguugucaacccggauauuauggggauggauuucagugcauaccugguaaguuucagagggccagauuaggcacaugaaucucuuagcuccuucaaggauauuuuucuaugacagcccacucuugauuuagccuggucuggagccuugguggauuuuccaagcuguggauuuuuuuccuugguuaccuccugcugccuaguuuacugauaguucacugauucguaacauuucuggaggccugcgggagacgacccacccaucguccuaccucauagccccucugguuaacugcccuagugaucugcuugaccuugaugagugcaauuuggaugaaguguugagaucaagcuuauuaagcagagccuuaugcgccgguagccaggguuaagcccguggcgaccguguuagaggagcuuggcuagcuuggugcagucucgugaguggugagugccguuggcuugcagcuucucagacuuaaccugugggccucagggcaugaaugagcuuuggcuuguuuucuccagagucucuugggauguugggcagaugccaccgcuaucccucauuuuccccagaugacaauagggaggggccgggcugcuuuacacuuagagccagcuagggaccuauaggaugaacuagaagaacuggagagaaaugagguaaauaguggcaagguauuauaaaauaagaaucucgggcuccaaaaucccagcgcuuuuccaugccacgcugugggcuggugaaguggauggguugcaaugccuucuauuucucuuuugugucuuccucugccuugauccuggaagacuccaccucaagccugacacccugugaacaacagcagcgccaugcccaggcccaguaugccuacccuggggcccgguuccacaucccccaaugcgacgagcagggcaacuuccugccccuacagugucauggcagcacugguuucugcuggugcguggacccugauggucaugaaguuccugguacccagacuccaccuggcuccaccccgccucacuguggaccaucaccaggugagcuuaggccuggggcucaagaagcagaauggcacuggugguagguagaucauaauuccugcccagaccacgcaggcacggggccagucaccauccuucauagccucuuuccuccugagaagacuugaauaauagugcguacaaauaugcauguuugugucauaaggacauagagauaugcaauacaugacacauaugaucuguuacacauuugccucuuagacccuuguccaguacaaacugaaaguugagauuguguauguaggucagacugagaacacuacccuagaccuguuauagagcagcuuagggagaucugacaguuagaagaucuggccagacuggcguuuugaccagaaggaaaacugcuuuccuauguaacuaucucacuuaccucugccuucugaauggcaggaaacaguaugaacgcucuguuaguaucaauaggaaaaauuagaaaaauaacaccugcuaguggagccaguuaguuuucucuaaacugacaaucccagcccucuguaacccagcccaacaucucagaggaggcacagacaucugguuucuguuagcccauacaaccugagaacaugccugcuaccaucuagagcauuccccagcuggguggggcauggugaucaagugcucacagucgauuccaacagcaggcagauaaggcaacuuucuguuccuuguugaauuauucagggauagguaaaacuuguuucuuuaaucauuacagaagaacuuuauuuaaugaagagcauaggauuggcuugauaccguuuuagccaaaaugauuccgacacagcuugcuauccaaagauccauuuuuacuauugagaaggguuccauaaauacuagucuuggcuuuuaaugugugaaaguaagaagaacuggagaauuaccaauaguuuuuuucccuuuuaaugguguuaacuguugcccggguaugguggcucaugccuguaaucccagcacuuugggaggccgaggcggguggaucacgaggucaagagauugagaccauccuggccaacauagugaaaccccgucucuacuaaaaauacaaaaauuagcugggcgugguggcacgcaccuguagucccagcuccucgggaggcugaggcaggagaaucacuugaacccaggaggcagagguugcaguaggccaagaucaugccacugcccuccagccuggcaacagagugagacucuguuuuuuuuguuuuuuuaaaaaaaggucaggucuuggcgguucucagauagguaaaaauugguaaugguuugauccauagucgcucuuuguuucuauuuuuaggaaaagauuuuaaagguccaaaaaagguacagagaaauucuauuucccucaugccuucucuuugaaaaugucuugguucuaacuccaucugggauuugaagaaaucaaaugguugggaggugccuuuggggaaugguucagaauucgauuaaauuuauuaagacaggcauguguuaaggacaaugauuuuaaagggggaaccaagauuuuaaaggggggggaaccaagagacugagaagugaaugacgaaaauagggucguguucucuugugcggacuuuuuccugcccacacucucucggcgcugguuuggccccaacugcuaucucugacuggucucauguuugauggggucagcuugagggaggguaaggacgcucugugcccacaauuucaaaauacuuaaacccuugccaaccagaagcacaagagaaagaaauucaugguuggguugaaaaguagcaaauaguaacgaaugaaagggaugcccauguaugagugauuugggacacccauuucccaggaguuaggcaugucucuuuguuuggaaugcagacacauagcacaggguggucccuuaaagcaaaaauggauccuuggaguucugaauguggagcagggguggaauugggaacuucuccaggaaauccugcaguguuugaggaaguagcauuucccucucuguguuccuugagacacauuuggcugaagaagucagagucuuaccuucuccacggggucuuaaaaagagcuuugucucccaugggucaugagcuacagugacaacuuaacggcauucgcuucccccaauucuggugagucgugcaguugagcuagagcuaguuggguuugagcucugacaacuucauucgcagucuuuuguguuccaagaggaauuguaggugcuggaaccugaucauaaugcucccagcuuuguucuuuagagucacuggaggguuuugaacggagugacaugaaaugccuuuauguuuaaaaugggccauucuggcugcugcuaauugaauuuacacugguuuuggagagagugagggcauagaaggguggaagcaggaaaaccagugggaaggcuguugcagaaauugcagggagaggaugaggcuuuuugaccagggugagggggugcaguagugagaaguaaagauauucuaaguggauucugaaguuaccccuaaaaagaguuuuugacauaucaaauguggauggugagagaaaggagggucaaggauaauuaggucugagcaguggaaaaauggaggugccauuuacucauaugggaaagaccaggggagcagcugguuugauggugaaggcaggggcucaguuucuauuaguuucugauuucuauuauacaucuaaauggugguagcaaguaggguuauuggcuaugugauucugcagaccaugugcuuuaaguugcaggaauuaaaaaggaaggagaagcaccuccucuuguuuaaguuccuuuggguaguccuaacauaaaugaacaaguuaucucaauaaccuucugcagcagagucuucucagaacaaccuguauuuuggacaaagccucaauggcacuguggaagcagccugggaggaaacugcuuugcaaccaaagccagcaggacuucaaccauggagugagcugugagggaggggacaagaggagaggaugcuggagaaagggggggaaagggcaacacggcaggaagcuagagccugcaggaaaagauucagcuuugagauaaucccaggcgcaggguggcuaaagcaauucuggaaacugggcuguggaagaaccauuuuuaagcuguuugccaccaccucugcuaugcuuuacuacuaauuccacucaguuuuaccuuuacuccauguaguuuuccaguggguagacagagggcaccguggcgcugggcuuucaguaauacuuucuaagacacacacuggccagucgcaagauggcccucuccucagcagcuucgagcuugaagcuugaagcaaguggggaaugaauacaaauuggcuuuaagcaucaccucggcuacugaguccccaaggaucaccugcacaagugcucugucagcagaggcgcccgagguacaggcaggaugggccuugugggccucuccuggccagaaggagaucaugccccuucccaggcugagugagcugcacugcugaucuuaccuccucuuguucuuucuugauguggcugggccuugaugacagacccuccuggcaagaaagaagcaucacaugaucuauuucugauucccaugguggagaaguacuuagaacacauuugcuucccaaguuugguguccacgggcuuggcugagaccuggacaguaggagaaggaaggccaggaggccaggcauggggucuugagcuacauuuugcauucuguccuugacucacaaucaaagguuuuucuucuucccucuuccccaucugcucagagcccacccagaggcccccgaccaucugugagcgcuggagggaaaaccugcuggagcacuacgguggcaccccccgggaugaccaguacgugccccagugcgaugaccugggccacuucaucccccugcagugccacggaaagagcgacuucugcugguguguggacaaagauggcagagaggugcagggcacccgcucccagccaggcaccaccccugcguguaagcaccuggccgcccccgcuccccucagcuguaucuaaggccuuugcuagggauggugccugcuguggugaaguggggggacauguggggucaccaggucuaaugaaagaagucacuaugugcuauguugauuuauaaucugguccacacaagaucccaauuugcguuuggugucugguuuuugucauuagcagcuuccauaauuggaacaucugcaacucgguucagcaggcaguuacucccccuccccagcccagggugacaggggacacgugucacucuggaguccuaaaaggaagcugacacaaugcuggcucuguuuuuuuuuucucuugaaaaaaaaaucuguucugcuuuguucugagggaaguguuuugcugucuucuucccuaguaaauggcagauuuacauaauugauccuuaaaaaaacccuagaaauuagaauuucuuuugaagaacaucuggagcacaucugcguagggcgaagaacuuuugauauuuuuggaggcucugguaugugguaaaguaacuuuucuucccaucucccugccugcccuuguuccccuuccugcucucccacccucucucccacagguauacccaccgucgcuccacccaugguccggcccacgccccggccagaugugaccccuccaucugugggcaccuuccugcucuauacucagggccagcagauuggcuacuuaccccucaauggcaccaggcuucagaaggaugcagcuaagacccugcugucucugcauguaaaguggauuucuccuguagggggcagggcugcguggcuuucccagugggagccaccucacaggcccuguugcagugagguggacuggugcagggaaguccuggaggguuucugagcugcagcccaucggcaugggcccgaugccaccaccauaggaccagggcucucucuugcugggagucaccugucacugaccaaggcugugcucucugguucguucauggaguuucagauaauauggaaagggaacuuuagaguugucagcacauggaggcuguauggugauccaagggaaaauggaccgacucuuacccuaaguccccaggguuguaugucauaacaucuccauggaaauccuggaaaucaaagugacaggacaacuagucacaaggugugaucucugcgguuuguuggggacuccaaguggaagucaguuaaugacugucucaccguugcagcccuucccuuucacuuugguucugucccuuugacccacuucuuuccuaaccuucccugacuccauagaugaaaacuugaggagugugugaugcugggagaggaguggauggagccuuccccaggggauguuugaugcuuccugagccagcagccucccuaaugcaaggcaccccauuuuggggagcggguuuucucaaaaauggaggaaaaaaaaggguggcugucucgaauggcaucgacacaguggaaaaucaucugauuccauuguugaacuucacacuccaggcacuugcucaucccugagaaagaauaguacggcauucaaguuuacauuuacuucuguuaaugaacgacacuuauuugguuccagaaaagcuuagaggcagccaguguuuaggaagagauguguucuuuuuaagauucgaguuuguuggguccuguccccucccccaagaaaacucucacauuguuuuguaaaacuuucucuggaagagguagagacuaagaaguugacaucacuuuaagcuaacccucuuuuauucaagucauagagcuugauugccuuucugaacaugccccugaccaggacaggguggugaugguagugguaguggaacugaaagaaaugggacguggguuauuugcacauuuuaaggaaauuuacuuaaacugggacuuuuucucuaaccugagguuaugacauggguuuaugaaucccaugauucccggguuaauggaagcucauuugaauguguacucuugccugggacaaacgacuuuucaauuuucaaauaaaaguguaguugaccuuaggcccgccccccauauaagcugccuguuuuuccacugaagccaaaucccguuuuguacaaucuuucuuggcugacuacgcucccagggggcguaagugaagccaagccccaggaggcuguuaggcaaggcaggaacuuguaugaccucagggacagccagcuaaccccugaauguuggcuuugcacaucugcugggcuucucagagcaggagccuggauuggaaacugaaugaagcaaguucugcauggaguugaggaaaaauaucagacucagcauuuuuuuuauuuuuauuauuuuuuuaaaagacuugucauuuauuuagcaaugaggaggagagaccucacuagccagagguuggauaaccacuacucccuaguuccuuaacccaauaaauuagauuuuuuccuucuuuugagacaggguguagcucuguguugcccaggcugcagugcaguggcaccaucucggcuuggugcagccuugacuuccugggcucaagcgauccucccaacucggucuccugaguagcugggacuacaggugcgugccaccaugcccaguucauuuauuuuuuguuuuuuagacggggucucacuauguugcucagucucgaacuccugggcucaagcaauccuccugcuuuggccucccaacggacagggauuacaggcgugagucacugugccugacuacacuuucuuuaguacaggauauaaccaacaucuugccuccuaagagucaggggcaggaguauaggugauuguacuucagguagaggaaagaucucauucacagaggaggggagaguagauuuuguuggcauauaguggcaaauuuuauuaaggcucugggaaaagugcugaugacauugggaaaagauucaguuuuuacccaguaaaauauuaaaaacuuauuuugcuuaaggccauguccucuaauuacugaaggggcugauuuuuuuuuuuuuuuaaaucaucagucauaauagcaccuauugaagggcuuacuguaugccaauuacugauuaggacacuuuacaagcacuuauaguauuaauuuuuauagcaaccauaugaggcagguacacuauuggccucauuuugcaaaugagacaaacgcauagagguuaaaugcccaaagccacauggcuacuaaguggcugagccuagauuucacccgagugcccacauguccagcuacucugcucuguugccugcaggaucacagugcaguguugcucacugcagcugugcaugagcaaggcagcugagugugaacaaaggggaaauguaaccuaauucuucuaauucuaugauuugaugcacaaagggcuccauaaucgugggaauugauuacgacugccgggagaggaugguguacuggacagauguugcuggacggacaaucagccgugcuggucuggaacugggagcagagccugagacgaucgugaauucaggucagcagcuucacucagcagucugcauuucauuugauucuacaaagucacuugucuacuuuacgccgaagucuccccucgauuuuucuccauuaggggagguuaaguucuaggcaagucauuuuauugagcuguauaagacuagcccccucuguaagcaaacaccuucauacauacggaaugaaauaggugauuccuacugugcgcacuucuuaaaagaauucaugguaagaauucagggugacgccuucguuuauucagccuggcucuggcacuguggaugccgguugucaucaaacugguaggucugcuggucuagaagcuagagguaguggaauauguaacaaaaguacuuguuucucuauuaaccugguucuuggggacuuggagacacuugggcuuugcuuuccccugcugaccccccugcccacccgaccguuggagggcuucagguuugcccuccauauccugcaaacacuccaguccugacuuugcuuuauuuccaggucugauaagcccugaaggacuugccauagaccacauccgcagaacaauguacuggacggacaguguccuggauaagauagagagcgcccugcuggauggcucugagcgcaagguccucuucuacacagaucuggugaauccccgugccaucgcuguggauccaauccgagggucagcugggcuucccuaauucuucucuuaccuguagauccugaugugaagcccuuggguuuuaaauacaauguggggaaggucagaacaagagagugaaagcucaaaugcauucauguaacaaagauuuacugaggaucuaagaggugucaggaccuguucuaggaaaagacaaggucuguucuuucauggcacuuauauuuuauuaggaggaaacaagacugguauaaacaauauuagucugugaugugauauguagaaaauucagauaguguugugagaacuagggcuacucugaaucaaaugaucaggcgaggccucagcugacacuuaaacuggaagugaagugggauuccuccagcagcacauuuagaaaccaggguugacgcucacaguagggcugaccuacaucaagugacauuagccaaagcucagacaccucuggcuucaguguugcuguagcagaaaucaagauaaacauuuucccugucuguauaauugcuaaggucaucaaaugugacauacaggauuuguucacugucucaguacuuguuacaaucagggagaauuuuuauaucuugagaaacucuugccauguuuaaguggaguuucuacgaaaugaaauucccagaugcccuucaaaucaguaaagaaaaccuucagcuuuaauuuucagguaagugcuuuuugacuaugaaauacuuagugcagugccucaaaggugguuucaaacuuuggguucuacacacaggaaaaguaccuguauccuucucuauuccaguugacuuaacaggaauuaauagcccucuuaaaaacucuuugcauaggcuugccuuucugacauuuggacauuuggaagguccuuuuuucuuuuuuuuuucuuuuuuuugagacaaggucuugcuuuguugccgaggcuggggugcaguggcacagucucggcugacuacaaccuccaucucccggguucaagcaauucuccugccucagccucccaaguagcugggacuacaggcaugugccaccaugcccagcuaauuuuuguauuuuuagucgagacaggguuucgccauuuuggucuccaacuccugacccugggugauccaccugccuuggccucccaaagugcugggauuauagguaugagccacugcgcccggccccuuauuccuucuuggugcuugaccugaaaacuggggagagcugccaucuuguaggcaaugaaacuuuggccaugucucuggagucuggggaaaaagcauacuuuuaagcugaaauccacaucacagccaugaguuuaaauaugaaaguagaacuuucuuauccagacagcaaauauaaaugcuaaaggacuugaauuuuuaauaaaaagaaaacccaccuugaaccagguugcaauauaacacauguaauuacaucuccuucaacugcguaacagaaugguugucaagccuuccugcauauuucucauuugcuuucuauagauuucaccuuuacaacuuucuuccucuggcaauccccaaauaauuuacaccaaauaucugugugagcuuguuucagacuuauuguuguugaugauauuaaaucauuuuggggaggagacugaucagaagcgaugaagcaaugauaugcaugcuguacccucuggccaccuccaccuuagcgcaaaguggaaacugcuuucuagcuuuugcucucagcuucucucugcuucaucuguugggcauaagggaugaaauucgcaacaggggaaaccuaugguuucuuccucuccucucacugagguucucuguagcccaacugauuuauucaaagcuucuauagcuuuuauaaaauaguauuuuauaaaaagugcuuucaacauuauuucugcucuaacgauaaaccuguuuguuuccuuauaaccuauuuccacuuaauaggaccauauuuccucguuaguaucuguuaugaauauauuucauuuuuaacguggcauuuaaaagguaaagugcuuaacuuaaaauguuuccaucccugggugccagguaccccuucaaguaccaaauuguauuuuuggcagaagaaagaacaguuuccuucucaaaucccugguccacaucucuucaaguuccauaguuuguaucgaagccauuccuaacagcuguauuuguuucuauucuaaaacccaagauccaauucaagacuucaacaaacggaggguuuuggggcaguugagucaagggguaucuuggaggcagggauucugauaguaacuuaguaaugacuucucccacauagugacaauaaucagaaaaccuugugauacagguaaaaguggaauauggcuguguauuaguuaccuacugcuguguaagaaauugcccaaacccucagcaguguaagauaacauuuagucucacaguuucugugagucaggaauccaagugugucuucaccgagcucccucaggcauggagucucucacaaggcugcaaucagguaauggccaaacugcagugaucacaaggcucagcucggggaagacacagcccaagcaugcucacaugggcuacaggcaagacuaaugucucuggccaacagcccucaaggacaucaguuccuuggcacauguuccccuuuacaggguagcuugcaacauggcauccagcuucccucaaagggagcaagagagagccccuaaggcagaaaccaguuuuuugagaccgaauaucggcagugauagccuaucacuucugcuauacucuaugcacuagaagaagcaagacacuacuaaugcagcccaaacucaaggggauugcuuaaggcuauaauacaugaggagauggagaucacugggggcugcuuagaugcugccuaccacaggcuacauggcuauucuuuuacaaucuugauuuuuaacuuacagcaacuuguacuggacagacuggaauagagaagcuccuaaaauugaaacgucaucuuuagauggagaaaacagaagaauucugaucaauacagacauuggauugcccaauggcuuaaccuuugacccuuucucuaaacugcucugcugggcagaugcagguaauacuacugauggaaugcaaauagauaaccucucaucacagugaaugugagcacuaacagauuuuacuacaaaaugaaaucccaucacuuagaucuccuuucuuuggucuguaaacuuuuaaguacuaguaaauuuaaguacuaguaaaugagucuuaaaaugaacuuucugggguuuggguggagggaaggauauaucaagcaguaaguuuguacugcuugccugaccaugagugccuggcauauuuuuaacaguuaaaagaauuagccauuguugaauugacaaacuuaagugaaguuauucuuaugcggggagagggucacuauaacuuaccuauaaacaucuguuauaaugcuaaggacauucuuuggaaagcauuguagcaggguagcuuccuucaguaauaacauggguauuagcaaccuacauuuguuugcuuuuaucagcacaacugaaaaaaugcugugugucuaguucuauacuaaagaauaugaaaaagacuguucuugaauuuguaaucuaauaaaagggccuaauguacauaggucacuuuuauaacccaguuguuuaaaacaaguuacauuucuuaaaaggauuugaaauuuaaaucggcuccaugagaaaugugaaacuuggaaauucuugaaugguuuagcuauuguaaaaauuuuuaagacugauuccuuuacauugaaauaugaguuauguuaccauuuuagucacuuuuuuccuccuaccuagaaaauauuuuaaaaauacuaaggauuuugguuaaaagguugccucaguaauuauagacauagcuuacaaagggcaaguauuuacccagauguuauaauuuauaagcuaaggcuugaaaucacacaaauuauaaaaauaauuauguuuaaugcccuacuuuggcagaaacuuaccagauuucaguaaaugcaauccugucuuccaaaaaaggauugaaaguuugaaucucuacuaaaaacuggagacuaguaauaggacagguaauuuuacaguugcuaaucuaugacuguaauggaaguaaaauauccuauuuccccauucuaucacugugucacuaucacuaugucacuaucauuuuuggcaaagcagcugaaggaccucauuuucccccuuuguuuuaaaaggaaccaaaaaacuggaguguacacuaccugauggaacuggacggcgugucauucaaaacaaccucaaguaccccuucagcaucguaagcuaugcagaucacuucuaccacacagacuggaggaggugagccccacaaauucuggacaagccugaaaaggccaacuguuccagaggacacaccacuuguuuuaccaaaagucaguaccugacuugacucauuaagcccucugaggcuuuuguuucaucaccuccucauuggcagauaagauccuucaaggauguuuuucauccuuucauguuuuugaaaucauccuuuuacuucacccagaaaucgaaugguauugcucacauauagcuuaaaaaguagcaaagcuauuggauaaugucucaaaagggagcauauuaaucuaaauauguucuuuagagaauaagacuacccuugauaccaugagcuauauuacagggcuuaaguuggcuuuugacacuguggacauauugucugagggaccgaaaaauacuauuuagacuaguucucaaaugaggaacuguggaacauuaaagucuaagcccuuuacaccaugcccuacaacucugauuugauagcucaucaugugauucuaacaugcagcuagagaugagcaauggauuuagagcaauggucuucaaacuucaguauggcuuuagcaccagcccugggacagagaaggcugccagaaauuuuccucuauugcaacugauuuucuguggcugacugacuucuuuaucuaguaaaugacugucccugaauucacucuuccuuucuguuaccagggaugguguuguaucaguaaauaaacauaguggccaguuuacugaugaguaucucccagaacaacgaucucaccucuacgggauaacugcagucuaccccuacugcccaacagguaaaaaguaugcuuuaggaugcuccuuuaaauuagcaggguagagaagggauauauaugguauuugauuaccccugcugccugugacacugccaccauugccuucuuccugcccugagggccagucuuuacuaccuuaaaucuaccuaguuuauacacaaaaugcaaagacuugcuguugcaacuugguuacaauauacucacccaccacccugucccaccccugcucuucucucacaggaagaaaguaaguacaguaauguaaaggaagacuuggaguuuacaaucagaaccuggacccuaaagaacagugacugcaaaggcaaagaaaguaaaaaaggaauuggccauuagacguuccugagcauccaagaugaacauuuuguagugcaaaaagacuuuugugaaaagcugauaccucaaucuuuacuacuguauuuuuaaaaaugaagguuguuauugcaaguuuaaaaagguaacagaauuuuaacuguugcuuauuaaagcaacuucuuguaaacauuuaucauuaauauuuaaaagaucaaauucauucaacuaagaauuagaguuuaagacucuaaaccugauuuuugccauggauuccuucuggccaagaaauuaaagcacaugugaucaauauaacaauauaauccuaaaccuugacaguuggagaagccaaugcagaacugaugggaaaggaccaauuauuuauaguuucccaacaaaaguucuaagauuuuuuaccucugcaucagugcauuucuauuuauaucaaaaggugcuaaaaugauucaauuugcauuuucugauccuguagugccucuauagaaguacccacagaaaguaaaguaucacauuuauaaauaccaaagauguaacaauuuuaaaauuuucuagauuacuccaauaaaguguuuuaaguuuuccu

SEQ ID NO: 17449 - RNA, 64300 nt, Homo sapiens
aggaaaacuuaaaacacuuuauuggaguaaucuagaaaauuuuaaaauuguuacaucuuugguauuuauaaaugugauacuuuacuuucuguggguacuucuauagaggcacuacaggaucagaaaaugcaaauugaaucauuuuagcaccuuuugauauaaauagaaaugcacugaugcagagguaaaaaaucuuagaacuuuuguugggaaacuauaaauaauugguccuuucccaucaguucugcauuggcuucuccaacugucaagguuuaggauuauauuguuauauugaucacaugugcuuuaauuucuuggccagaaggaauccauggcaaaaaucagguuuagagucuuaaacucuaauucuuaguugaaugaauuugaucuuuuaaauauuaaugauaaauguuuacaagaaguugcuuuaauaagcaacaguuaaaauucuguuaccuuuuuaaacuugcaauaacaaccuucauuuuuaaaaauacaguaguaaagauugagguaucagcuuuucacaaaagucuuuuugcacuacaaaauguucaucuuggaugcucaggaacgucuaauggccaauuccuuuuuuacuuucuuugccuuugcagucacuguucuuuaggguccagguucugauuguaaacuccaagucuuccuuuacauuacuguacuuacuuucuuccugugagagaagagcaggggugggacaggguggugggugaguauauuguaaccaaguugcaacagcaagucuuugcauuuuguguauaaacuagguagauuuaagguaguaaagacuggcccucagggcaggaagaaggcaaugguggcagugucacaggcagcagggguaaucaaauaccauauauaucccuucucuacccugcuaauuuaaaggagcauccuaaagcauacuuuuuaccuguugggcaguagggguagacugcaguuaucccguagaggugagaucguuguucugggagauacucaucaguaaacuggccacuauguuuauuuacugauacaacaccaucccugguaacagaaaggaagagugaauucagggacagucauuuacuagauaaagaagucagucagccacagaaaaucaguugcaauagaggaaaauuucuggcagccuucucugucccagggcuggugcuaaagccauacugaaguuugaagaccauugcucuaaauccauugcucaucucuagcugcauguuagaaucacaugaugagcuaucaaaucagaguuguagggcaugguguaaagggcuuagacuuuaauguuccacaguuccucauuugagaacuagucuaaauaguauuuuucggucccucagacaauauguccacagugucaaaagccaacuuaagcccuguaauauagcucaugguaucaaggguagucuuauucucuaaagaacauauuuagauuaauaugcucccuuuugagacauuauccaauagcuuugcuacuuuuuaagcuauaugugagcaauaccauucgauuucugggugaaguaaaaggaugauuucaaaaacaugaaaggaugaaaaacauccuugaaggaucuuaucugccaaugaggaggugaugaaacaaaagccucagagggcuuaaugagucaagucagguacugacuuuugguaaaacaagugguguguccucuggaacaguuggccuuuucaggcuuguccagaauuuguggggcucaccuccuccagucugugugguagaagugaucugcauagcuuacgaugcugaagggguacuugagguuguuuugaaugacacgccguccaguuccaucagguaguguacacuccaguuuuuugguuccuuuuaaaacaaagggggaaaaugagguccuucagcugcuuugccaaaaaugauagugacauagugauagugacacagugauagaauggggaaauaggauauuuuacuuccauuacagucauagauuagcaacuguaaaauuaccuguccuauuacuagucuccaguuuuuaguagagauucaaacuuucaauccuuuuuuggaagacaggauugcauuuacugaaaucugguaaguuucugccaaaguagggcauuaaacauaauuauuuuuauaauuugugugauuucaagccuuagcuuauaaauuauaacaucuggguaaauacuugcccuuuguaagcuaugucuauaauuacugaggcaaccuuuuaaccaaaauccuuaguauuuuuaaaauauuuucuagguaggaggaaaaaagugacuaaaaugguaacauaacucauauuucaauguaaaggaaucagucuuaaaaauuuuuacaauagcuaaaccauucaagaauuuccaaguuucacauuucucauggagccgauuuaaauuucaaauccuuuuaagaaauguaacuuguuuuaaacaacuggguuauaaaagugaccuauguacauuaggcccuuuuauuagauuacaaauucaagaacagucuuuuucauauucuuuaguauagaacuagacacacagcauuuuuucaguugugcugauaaaagcaaacaaauguagguugcuaauacccauguuauuacugaaggaagcuacccugcuacaaugcuuuccaaagaauguccuuagcauuauaacagauguuuauagguaaguuauagugacccucuccccgcauaagaauaacuucacuuaaguuugucaauucaacaauggcuaauucuuuuaacuguuaaaaauaugccaggcacucauggucaggcaagcaguacaaacuuacugcuugauauauccuucccuccacccaaaccccagaaaguucauuuuaagacucauuuacuaguacuuaaauuuacuaguacuuaaaaguuuacagaccaaagaaaggagaucuaagugaugggauuucauuuuguaguaaaaucuguuagugcucacauucacugugaugagagguuaucuauuugcauuccaucaguaguauuaccugcaucugcccagcagagcaguuuagagaaagggucaaagguuaagccauugggcaauccaaugucuguauugaucagaauucuucuguuuucuccaucuaaagaugacguuucaauuuuaggagcuucucuauuccagucuguccaguacaaguugcuguaaguuaaaaaucaagauuguaaaagaauagccauguagccugugguaggcagcaucuaagcagcccccagugaucuccaucuccucauguauuauagccuuaagcaauccccuugaguuugggcugcauuaguagugucuugcuucuucuagugcauagaguauagcagaagugauaggcuaucacugccgauauucggucucaaaaaacugguuucugccuuaggggcucucucuugcucccuuugagggaagcuggaugccauguugcaagcuacccuguaaaggggaacaugugccaaggaacugauguccuugagggcuguuggccagagacauuagucuugccuguagcccaugugagcaugcuugggcugugucuuccccgagcugagccuugugaucacugcaguuuggccauuaccugauugcagccuugugagagacuccaugccugagggagcucggugaagacacacuuggauuccugacucacagaaacugugagacuaaauguuaucuuacacugcugaggguuugggcaauuucuuacacagcaguagguaacuaauacacagccauauuccacuuuuaccuguaucacaagguuuucugauuauugucacuaugugggagaagucauuacuaaguuacuaucagaaucccugccuccaagauaccccuugacucaacugccccaaaacccuccguuuguugaagucuugaauuggaucuuggguuuuagaauagaaacaaauacagcuguuaggaauggcuucgauacaaacuauggaacuugaagagauguggaccagggauuugagaaggaaacuguucuuucuucugccaaaaauacaauuugguacuugaagggguaccuggcacccagggauggaaacauuuuaaguuaagcacuuuaccuuuuaaaugccacguuaaaaaugaaauauauucauaacagauacuaacgaggaaauaugguccuauuaaguggaaauagguuauaaggaaacaaacagguuuaucguuagagcagaaauaauguugaaagcacuuuuuauaaaauacuauuuuauaaaagcuauagaagcuuugaauaaaucaguugggcuacagagaaccucagugagaggagaggaagaaaccauagguuuccccuguugcgaauuucaucccuuaugcccaacagaugaagcagagagaagcugagagcaaaagcuagaaagcaguuuccacuuugcgcuaagguggagguggccagaggguacagcaugcauaucauugcuucaucgcuucugaucagucuccuccccaaaaugauuuaauaucaucaacaacaauaagucugaaacaagcucacacagauauuugguguaaauuauuuggggauugccagaggaagaaaguuguaaaggugaaaucuauagaaagcaaaugagaaauaugcaggaaggcuugacaaccauucuguuacgcaguugaaggagauguaauuacauguguuauauugcaaccugguucaagguggguuuucuuuuuauuaaaaauucaaguccuuuagcauuuauauuugcugucuggauaagaaaguucuacuuucauauuuaaacucauggcugugauguggauuucagcuuaaaaguaugcuuuuuccccagacuccagagacauggccaaaguuucauugccuacaagauggcagcucuccccaguuuucaggucaagcaccaagaaggaauaaggggccgggcgcaguggcucauaccuauaaucccagcacuuugggaggccaaggcagguggaucacccagggucaggaguuggagaccaaaauggcgaaacccugucucgacuaaaaauacaaaaauuagcugggcaugguggcacaugccuguagucccagcuacuugggaggcugaggcaggagaauugcuugaacccgggagauggagguuguagucagccgagacugugccacugcaccccagccucggcaacaaagcaagaccuugucucaaaaaaaagaaaaaaaaaagaaaaaaggaccuuccaaauguccaaaugucagaaaggcaagccuaugcaaagaguuuuuaagagggcuauuaauuccuguuaagucaacuggaauagagaaggauacagguacuuuuccuguguguagaacccaaaguuugaaaccaccuuugaggcacugcacuaaguauuucauagucaaaaagcacuuaccugaaaauuaaagcugaagguuuucuuuacugauuugaagggcaucugggaauuucauuucguagaaacuccacuuaaacauggcaagaguuucucaagauauaaaaauucucccugauuguaacaaguacugagacagugaacaaauccuguaugucacauuugaugaccuuagcaauuauacagacagggaaaauguuuaucuugauuucugcuacagcaacacugaagccagaggugucugagcuuuggcuaaugucacuugauguaggucagcccuacugugagcgucaacccugguuucuaaaugugcugcuggaggaaucccacuucacuuccaguuuaagugucagcugaggccucgccugaucauuugauucagaguagcccuaguucucacaacacuaucugaauuuucuacauaucacaucacagacuaauauuguuuauaccagucuuguuuccuccuaauaaaauauaagugccaugaaagaacagaccuugucuuuuccuagaacagguccugacaccucuuagauccucaguaaaucuuuguuacaugaaugcauuugagcuuucacucucuuguucugaccuuccccacauuguauuuaaaacccaagggcuucacaucaggaucuacagguaagagaagaauuagggaagcccagcugacccucggauuggauccacagcgauggcacggggauucaccagaucuguguagaagaggaccuugcgcucagagccauccagcagggcgcucucuaucuuauccaggacacuguccguccaguacauuguucugcggauguggucuauggcaaguccuucagggcuuaucagaccuggaaauaaagcaaagucaggacuggaguguuugcaggauauggagggcaaaccugaagcccuccaacggucgggugggcaggggggucagcaggggaaagcaaagcccaagugucuccaaguccccaagaaccagguuaauagagaaacaaguacuuuuguuacauauuccacuaccucuagcuucuagaccagcagaccuaccaguuugaugacaaccggcauccacagugccagagccaggcugaauaaacgaaggcgucacccugaauucuuaccaugaauucuuuuaagaagugcgcacaguaggaaucaccuauuucauuccguauguaugaagguguuugcuuacagagggggcuagucuuauacagcucaauaaaaugacuugccuagaacuuaaccuccccuaauggagaaaaaucgaggggagacuucggcguaaaguagacaagugacuuuguagaaucaaaugaaaugcagacugcugagugaagcugcugaccugaauucacgaucgucucaggcucugcucccaguuccagaccagcacggcugauuguccguccagcaacaucuguccaguacaccauccucucccggcagucguaaucaauucccacgauuauggagcccuuugugcaucaaaucauagaauuagaagaauuagguuacauuuccccuuuguucacacucagcugccuugcucaugcacagcugcagugagcaacacugcacugugauccugcaggcaacagagcagaguagcuggacaugugggcacucgggugaaaucuaggcucagccacuuaguagccauguggcuuugggcauuuaaccucuaugcguuugucucauuugcaaaaugaggccaauaguguaccugccucauaugguugcuauaaaaauuaauacuauaagugcuuguaaaguguccuaaucaguaauuggcauacaguaagcccuucaauaggugcuauuaugacugaugauuuaaaaaaaaaaaaaaaucagccccuucaguaauuagaggacauggccuuaagcaaaauaaguuuuuaauauuuuacuggguaaaaacugaaucuuuucccaaugucaucagcacuuuucccagagccuuaauaaaauuugccacuauaugccaacaaaaucuacucuccccuccucugugaaugagaucuuuccucuaccugaaguacaaucaccuauacuccugccccugacucuuaggaggcaagauguugguuauauccuguacuaaagaaaguguagucaggcacagugacucacgccuguaaucccuguccguugggaggccaaagcaggaggauugcuugagcccaggaguucgagacugagcaacauagugagaccccgucuaaaaaacaaaaaauaaaugaacugggcaugguggcacgcaccuguagucccagcuacucaggagaccgaguugggaggaucgcuugagcccaggaagucaaggcugcaccaagccgagauggugccacugcacugcagccugggcaacacagagcuacacccugucucaaaagaaggaaaaaaucuaauuuauuggguuaaggaacuagggaguagugguuauccaaccucuggcuagugaggucucuccuccucauugcuaaauaaaugacaagucuuuuaaaaaaauaauaaaaauaaaaaaaaugcugagucugauauuuuuccucaacuccaugcagaacuugcuucauucaguuuccaauccaggcuccugcucugagaagcccagcagaugugcaaagccaacauucagggguuagcuggcugucccugaggucauacaaguuccugccuugccuaacagccuccuggggcuuggcuucacuuacgcccccugggagcguagucagccaagaaagauuguacaaaacgggauuuggcuucaguggaaaaacaggcagcuuauauggggggcgggccuaaggucaacuacacuuuuauuugaaaauugaaaagucguuugucccaggcaagaguacacauucaaaugagcuuccauuaacccgggaaucaugggauucauaaacccaugucauaaccucagguuagagaaaaagucccaguuuaaguaaauuuccuuaaaaugugcaaauaacccacgucccauuucuuucaguuccacuaccacuaccaucaccacccuguccuggucaggggcauguucagaaaggcaaucaagcucuaugacuugaauaaaagaggguuagcuuaaagugaugucaacuucuuagucucuaccucuuccagagaaaguuuuacaaaacaaugugagaguuuucuugggggaggggacaggacccaacaaacucgaaucuuaaaaagaacacaucucuuccuaaacacuggcugccucuaagcuuuucuggaaccaaauaagugucguucauuaacagaaguaaauguaaacuugaaugccguacuauucuuucucagggaugagcaagugccuggagugugaaguucaacaauggaaucagaugauuuuccacugugucgaugccauucgagacagccacccuuuuuuuuccuccauuuuugagaaaacccgcuccccaaaauggggugccuugcauuagggaggcugcuggcucaggaagcaucaaacauccccuggggaaggcuccauccacuccucucccagcaucacacacuccucaaguuuucaucuauggagucagggaagguuaggaaagaagugggucaaagggacagaaccaaagugaaagggaagggcugcaacggugagacagucauuaacugacuuccacuuggaguccccaacaaaccgcagagaucacaccuugugacuaguuguccugucacuuugauuuccaggauuuccauggagauguuaugacauacaacccuggggacuuaggguaagagucgguccauuuucccuuggaucaccauacagccuccaugugcugacaacucuaaaguucccuuuccauauuaucugaaacuccaugaacgaaccagagagcacagccuuggucagugacaggugacucccagcaagagagagcccugguccuauggugguggcaucgggcccaugccgaugggcugcagcucagaaacccuccaggacuucccugcaccaguccaccucacugcaacagggccugugagguggcucccacugggaaagccacgcagcccugcccccuacaggagaaauccacuuuacaugcagagacagcagggucuuagcugcauccuucugaagccuggugccauugagggguaaguagccaaucugcuggcccugaguauagagcaggaaggugcccacagauggaggggucacaucuggccggggcgugggccggaccauggguggagcgacgguggguauaccugugggagagagggugggagagcaggaaggggaacaagggcaggcagggagaugggaagaaaaguuacuuuaccacauaccagagccuccaaaaauaucaaaaguucuucgcccuacgcagaugugcuccagauguucuucaaaagaaauucuaauuucuaggguuuuuuuaaggaucaauuauguaaaucugccauuuacuagggaagaagacagcaaaacacuucccucagaacaaagcagaacagauuuuuuuuucaagagaaaaaaaaaacagagccagcauugugucagcuuccuuuuaggacuccagagugacacguguccccugucacccugggcuggggagggggaguaacugccugcugaaccgaguugcagauguuccaauuauggaagcugcuaaugacaaaaaccagacaccaaacgcaaauugggaucuuguguggaccagauuauaaaucaacauagcacauagugacuucuuucauuagaccuggugaccccacauguccccccacuucaccacagcaggcaccaucccuagcaaaggccuuagauacagcugaggggagcgggggcggccaggugcuuacacgcagggguggugccuggcugggagcgggugcccugcaccucucugccaucuuuguccacacaccagcagaagucgcucuuuccguggcacugcagggggaugaaguggcccaggucaucgcacuggggcacguacuggucaucccggggggugccaccguagugcuccagcagguuuucccuccagcgcucacagauggucgggggccucugggugggcucugagcagauggggaagagggaagaagaaaaaccuuugauugugagucaaggacagaaugcaaaauguagcucaagaccccaugccuggccuccuggccuuccuucuccuacuguccaggucucagccaagcccguggacaccaaacuugggaagcaaauguguucuaaguacuucuccaccaugggaaucagaaauagaucaugugaugcuucuuucuugccaggagggucugucaucaaggcccagccacaucaagaaagaacaagaggagguaagaucagcagugcagcucacucagccugggaaggggcaugaucuccuucuggccaggagaggcccacaaggcccauccugccuguaccucgggcgccucugcugacagagcacuugugcaggugauccuuggggacucaguagccgaggugaugcuuaaagccaauuuguauucauuccccacuugcuucaagcuucaagcucgaagcugcugaggagagggccaucuugcgacuggccagugugugucuuagaaaguauuacugaaagcccagcgccacggugcccucugucuacccacuggaaaacuacauggaguaaagguaaaacugaguggaauuaguaguaaagcauagcagaggugguggcaaacagcuuaaaaaugguucuuccacagcccaguuuccagaauugcuuuagccacccugcgccugggauuaucucaaagcugaaucuuuuccugcaggcucuagcuuccugccguguugcccuuucccccccuuucuccagcauccucuccucuuguccccucccucacagcucacuccaugguugaaguccugcuggcuuugguugcaaagcaguuuccucccaggcugcuuccacagugccauugaggcuuuguccaaaauacagguuguucugagaagacucugcugcagaagguuauugagauaacuuguucauuuauguuaggacuacccaaaggaacuuaaacaagaggaggugcuucuccuuccuuuuuaauuccugcaacuuaaagcacauggucugcagaaucacauagccaauaacccuacuugcuaccaccauuuagauguauaauagaaaucagaaacuaauagaaacugagccccugccuucaccaucaaaccagcugcuccccuggucuuucccauaugaguaaauggcaccuccauuuuuccacugcucagaccuaauuauccuugacccuccuuucucucaccauccacauuugauaugucaaaaacucuuuuuagggguaacuucagaauccacuuagaauaucuuuacuucucacuacugcacccccucacccuggucaaaaagccucauccucucccugcaauuucugcaacagccuucccacugguuuuccugcuuccacccuucuaugcccucacucucuccaaaaccaguguaaauucaauuagcagcagccagaauggcccauuuuaaacauaaaggcauuucaugucacuccguucaaaacccuccagugacucuaaagaacaaagcugggagcauuaugaucagguuccagcaccuacaauuccucuuggaacacaaaagacugcgaaugaaguugucagagcucaaacccaacuagcucuagcucaacugcacgacucaccagaauugggggaagcgaaugccguuaaguugucacuguagcucaugacccaugggagacaaagcucuuuuuaagaccccguggagaagguaagacucugacuucuucagccaaaugugucucaaggaacacagagagggaaaugcuacuuccucaaacacugcaggauuuccuggagaaguucccaauuccaccccugcuccacauucagaacuccaaggauccauuuuugcuuuaagggaccacccugugcuaugugucugcauuccaaacaaagagacaugccuaacuccugggaaaugggugucccaaaucacucauacaugggcaucccuuucauucguuacuauuugcuacuuuucaacccaaccaugaauuucuuucucuugugcuucugguuggcaaggguuuaaguauuuugaaauugugggcacagagcguccuuacccucccucaagcugaccccaucaaacaugagaccagucagagauagcaguuggggccaaaccagcgccgagagagugugggcaggaaaaaguccgcacaagagaacacgacccuauuuucgucauucacuucucagucucuugguuccccccccuuuaaaaucuugguucccccuuuaaaaucauuguccuuaacacaugccugucuuaauaaauuuaaucgaauucugaaccauuccccaaaggcaccucccaaccauuugauuucuucaaaucccagauggaguuagaaccaagacauuuucaaagagaaggcaugagggaaauagaauuucucuguaccuuuuuuggaccuuuaaaaucuuuuccuaaaaauagaaacaaagagcgacuauggaucaaaccauuaccaauuuuuaccuaucugagaaccgccaagaccugaccuuuuuuuaaaaaaacaaaaaaaacagagucucacucuguugccaggcuggagggcaguggcaugaucuuggccuacugcaaccucugccuccuggguucaagugauucuccugccucagccucccgaggagcugggacuacaggugcgugccaccacgcccagcuaauuuuuguauuuuuaguagagacgggguuucacuauguuggccaggauggucucaaucucuugaccucgugauccacccgccucggccucccaaagugcugggauuacaggcaugagccaccauacccgggcaacaguuaacaccauuaaaagggaaaaaaacuauugguaauucuccaguucuucuuacuuucacacauuaaaagccaagacuaguauuuauggaacccuucucaauaguaaaaauggaucuuuggauagcaagcugugucggaaucauuuuggcuaaaacgguaucaagccaauccuaugcucuucauuaaauaaaguucuucuguaaugauuaaagaaacaaguuuuaccuaucccugaauaauucaacaaggaacagaaaguugccuuaucugccugcuguuggaaucgacugugagcacuugaucaccaugccccacccagcuggggaaugcucuagaugguagcaggcauguucucagguuguaugggcuaacagaaaccagaugucugugccuccucugagauguugggcuggguuacagagggcugggauugucaguuuagagaaaacuaacuggcuccacuagcagguguuauuuuucuaauuuuuccuauugauacuaacagagcguucauacuguuuccugccauucagaaggcagagguaagugagauaguuacauaggaaagcaguuuuccuucuggucaaaacgccagucuggccagaucuucuaacugucagaucucccuaagcugcucuauaacaggucuaggguaguguucucagucugaccuacauacacaaucucaacuuucaguuuguacuggacaagggucuaagaggcaaauguguaacagaucauaugugucauguauugcauaucucuauguccuuaugacacaaacaugcauauuuguacgcacuauuauucaagucuucucaggaggaaagaggcuaugaaggauggugacuggccccgugccugcguggucugggcaggaauuaugaucuaccuaccaccagugccauucugcuucuugagccccaggccuaagcucaccuggugaugguccacagugaggcgggguggagccagguggagucuggguaccaggaacuucaugaccaucaggguccacgcaccagcagaaaccagugcugccaugacacuguaggggcaggaaguugcccugcucgucgcauugggggauguggaaccgggccccaggguaggcauacugggccugggcauggcgcugcuguuguucacagggugucaggcuugagguggagucuuccaggaucaaggcagaggaagacacaaaagagaaauagaaggcauugcaacccauccacuucaccagcccacagcguggcauggaaaagcgcugggauuuuggagcccgagauucuuauuuuauaauaccuugccacuauuuaccucauuucucuccaguucuucuaguucauccuauaggucccuagcuggcucuaaguguaaagcagcccggccccucccuauugucaucuggggaaaaugagggauagcgguggcaucugcccaacaucccaagagacucuggagaaaacaagccaaagcucauucaugcccugaggcccacagguuaagucugagaagcugcaagccaacggcacucaccacucacgagacugcaccaagcuagccaagcuccucuaacacggucgccacgggcuuaacccuggcuaccggcgcauaaggcucugcuuaauaagcuugaucucaacacuucauccaaauugcacucaucaaggucaagcagaucacuagggcaguuaaccagaggggcuaugagguaggacgaugggugggucgucucccgcaggccuccagaaauguuacgaaucagugaacuaucaguaaacuaggcagcaggagguaaccaaggaaaaaaauccacagcuuggaaaauccaccaaggcuccagaccaggcuaaaucaagagugggcugucauagaaaaauauccuugaaggagcuaagagauucaugugccuaaucuggcccucugaaacuuaccagguaugcacugaaauccauccccauaauauccggguugacaacggcaggagaaggaaccaggaguauuguagcagguagcugcagggugacaucuguuuucugagcauucaucuacaucugcagaggucagaaacagaagaaagaagcaaagaacacuaugacuucacucacacaaucugugcgacugcaugggcuuuggauauguggaucaacacccagugaggugucagcuucagaagaccuuugagcaugagcagaaaaaugcugacaccuaaagguaagcuuaauagaaaggaagaaaaaaaaucaaggaacaugugaguuaacacacuagacuaaacguguucaguguagaaaucaaauggguagucgcucacagaaaaaaacaacacaucuuacagcauguuucauugacagugaauucaaggaaguuauuaccuuugaacuaaccuuuagacuauaagucauuaacuuccuuucagcaaugcugcaauaaagacaaauauauccaacaaugguuuuuuuuucuuucguuguuggcaccaucucccuguaacauucgucuguagaugcaaaggagccagaugaggcccaaauauuuuucagcuaagaagcacauucugucuugacuaauuagaaucuuacuaucuagaaccacacccccauuaaccagguauuuucuuuacuuuccacuuuuagaagaaauaagaaaaaaauauuaucuaggguuuugaaauaauacuuacaaaauggaaaucuaaauuugccaggcauaucaguacaaacaauucaggccccuacacucuccacauagcaccaugaggauuaauuuucaccaucauauuucucaaaacaacaaaauccugacacuucaaacaaaagccaacuuacauuccuuuuauuuaaugaaauccgcauaugccgacaauagcaagucacccaccccucccauccccagcagaaaaaaagcagcucugagaauugaaugguuaaaacuaacgcccaagggaugagauaagcuacuuuaagagacaggaagucuuucagaguaaaaggaggauaaacaaaggguguagguccgauuaaggcuuggcugaaaauaaaacaaagcaguaguuccauccauaguaauaaccaaguuucuuuaaaaugugugaauagaaaaaaaaaaaaugugggauggugugaucagugugaaaccuagaaaaugagaauguguugcaucaauacggugcagcccaugguagagacacaucagcaugggaagacagauauuugaagcccuaaauuugaugugaauggguugggaacagggcuagcuccucacccaggcucccaugacccacauggaaccucuucuagaguuaccugcaccacccuuuguccagaccacacugucacugggucauccucuaauaacuaaugugcuuucucgaauaccauuaaguacacacacugggcauuaagcguagguguucuguucccuagagaggaaucucuuauguuauaauuagaagguaaguauucugcuuaucuucugucucuggggaguuuagucagcauauaucaguuccuaggaguccucccccaaaaauucugaacucaaugcaacccauagagucuccacccaggugagugguuggccucccuggauaccaucauuucgccuauaaaggcaagaaagcagauaucaauucaucugcaaggguagaaacaaaccagauuggcuccucaguuacccugaaaucaaccaauguugucauaauuaucccugagcuuggcucugccucuucaacaggacaauucaaaugcccagcugggcaaaacuggugaccauccaauaccuuggaccuggaauaggcuguaaaacuggcuguaaaacuaaaccuguaaaaauuaacauucagccgaaugcaggaaauuaaagcuauucacaauacgcaugcuaaaaguacuucuaaugguaacaggaaccccaagcaaugacaggaagcaggaauuccugagacacagggccuauuucuggagcccauggagcaguuucuuauuguuacuuuugaacucaagagagaggggauuccccagagcuaccaaauaaaucaacggugugcuuagaaccuucagccuaagaauucugacucaaucugaaagaccagccuuccuccccacagauacuguuggcaucaucaaagauacuaaaguucuggguagacagaaacuauuagaaaugaccaacaaggaggagaaaguccccaaagagacugaagauaucacaagugagaaauuccugccccaaagauugagacucccugaauucgcaguccugacuccuccuuggagggccucucacaccaugauagagacuagagucccgggaccugggcaugcacaggacaucagaugucaagagagaaaacauggaaagacuuucagcccccuggcaagggaggaacuuuauuggagaaggagaaggaggccacugcuuaugcuuagucauuacuagcaggggccuguagggacugcuauaaagacaaaaacguucaagaagucguagagccccuuuaucacucagguaaugagagguagcuuaaucucagugcaauccuacacucuauuaagcuaguaaagaaccuguuuggaaaauguguuaaaaauccuucgaguucaugcuuucgugcuucaacauccuucucacugcccaaguacugagcaaaaccagcaggaacuguuggaugauaaaccuaaccccuggccucgaguucccccaggcucccgccccuucaccacugcccacuugccuuugagcccagugaaauuucuuggcaucaauuaaccucaaacccaucccagaucccaauaaaggauucaacccacaggucccacucucucucuacugcacaaucuguucaauugggcacccugcugauuguaccccuguauggcauguggugaacccacuccagaccuguaaguguaauaaacuacuuccuuucaagcuucauccuugccuccuccuauaaccacacugauuuuaccauaccauacccaacaucuaccuacauucuuggaacaggaaaccuggccaggcacauaauggagaucaugcuuucguuaucaaagaagagagaagcuaggccgggugugguggcugacgccuguaaucccagcacuuugggaggcugagggggguagaucgauugagcucaggaguuugagacaagccugggcaacaugaugaaaccccaucucuacaagagauaccaaaauuagcugggcaugcuacuugggggggcugagaugugaggaucacuugagccuggaaggcugaggcugcagugagcuguaaucacaccacugcccuccagccugggugauaaaguaagacccugccuaaaaaaauaaauaaauaaauaaaaauuaaaaaaaaauaagaaaagaaaaaacgccaggaaacccaagaaagaauaaugucaguaucuucccucaggccccugaguaaugauggcucuggguaaugggccaucuguaacccagcuuccucaacucacacuugcuccuccugggaaggucccaacucaagacaaucugcuuuugcaccuggccaagucacaacaauccaaaaggacaaacaugucugagaaauauccagcucacaccaacacaaguuugaaaucacuccagauugagggaagcugcagaggauuuaacucuacuuggauaaaagccuccuggcuagugacucagaccagacugagaacccaaauccaagugcagccucuccagggagccgguuuuuuuaacaaacuauggcuggagaaaaacucccacacccccuuauuguuaguuugauggaguaaaagagcaugugcuuuaacaaugcauagcacccacaaaauacagccucuguucuuuggucacugagacacauguacccuauggaaugccuuuaaauaugcacacauacacauauauuucaauauuuauucuucaaguuacuuucaugauuagccuagccugauuuaugcaugggucuuuaggaaaaugaccauucauucucuacuacuccacaaucugaaaguuuagaagacaacuacaugguaaguggcugugguaggcagccucuaagauggcccccaacagucccuaccuagugguauucauggucuuguguaauccccacccuuucaguaacuugcuuuuaauuaauaaagcaacauugaagggaugucauuuuugugauuaugacuuccaucuugcuagcagacuuucucuggcauuaauaaaguaagcuguaguguuagagaggcccaaguggcaagaaacugaaggcagccaacaaccagcaaggaaccaaggcuuucaauccaaugguccucaaagaaccgaauccugcccauaaccacgaguggaucuuuccccaguuaagccuucagaugagaccacugacccaccagacacuuugacuguggccuugugagagauccuaaagcacaggacccagcugagccauucccaggucccuggaccacugauauuaaaugucuauugcuugaagcugcuacauuuuaggguaauuuauuauacagcaauagauaaccaauacacugggggaagcaccugauggguuuggcauauuuuuaguuuguaggcuuuggaaagaauccuaaaagcagagaaccagaaauaaaauagggacaauugaaaaugacaaaaauagggcaaauuaaaaaaugacaauacuuaaauucccaauauggaaaaguagucaauuucagagcccuaacaugaccccagaagguaaucaaagucuugcaggacaaguagaagaaaaaaggagggagagaaucauuguagaagugaucaaagcaugcagcaucuaaucuaaauuaauauucugauuaacacucaucauaucuaggcugaaauuaauuucaacuucuuugcuuuaaaccagagagcuaaggaacuaaauauuuuaaaagcaccaucucugcugaucugagcagccagauguuuaaauaaauucuacagacaagauuuuucucaguggauucacauuucuuagagcugguacuaggguuaaaccaaacaaacgauguguuccacacgaaggaaaagcaucauucccacugucaggcuuuggcaccucacccugaacuccauaccuguagaggguaucuguaaagaguguaucuauuauagauauacucaauguuuucucaccaguauaucuaugacagauggagcuccuggcugguuaagugggacaaacaucugugaauuacaaaucuaccucauucuaauugggaaauacucuuuaucuagagcuagggguguuuauucaagagguccauagucuucuuacauuacugggccuaauaccaagacacacaggaaucccaacugaggguuaccaucuguauuagucaauuuccuguuguuuauaauagaauaucugaaacugagucauuucuaaaggaaaggaauuuauuucuuauaguucuaaaggcugagaagucuaaggucaaggguugaaaucuggugauggccuuccugcugguugggacucucaguagagggcugagguggugcaggacaucacauggugagggggcugagugugcuaacauguuauuuuaggcaggccucccuucuuaucaagccucuaguuccauucccaagauaacccauuaauccauugauaggggcagagcucucaugauccaaucaccuuuuaaaggcccuaccucucaauacugccacaguggaauguaaguuucaacaugaguuuugaagaagacgaauauucaagccauagcuucaacuuucaauaccaccaccaaaaguaucuauuuagugaaagaaaaaaauaaaagggcugaacugagccacggcuuuggguuaguucagcauaaauuguucgagaaaaccaugcagcagagcuucuguacagcacaaguggaaagaguaagaaugaggcucagaaaccaccaugugcacuugccccauccagagagaaguggagggcugagcugcugucacagugaccuuuguucugucaguaacacauggccucagccugcuguccacucagcccauccugcugaaaccaaaggggaaaaaggaaugggagaaggaugagaaucaaacaucuggugaggaggagggaggcccgugcuauucggaucugguauaaagcucccaggaauugcaaagcuguucuuagcacaucagcucggugggccugggcggauggaggcagaugcacacagcaacaccaggagcaggggaaagucugccuuuuaagguucauguuccccagcaggcccuuucccauucuaaacacguuucccaccauucucucauccccagugugucguuuuacccuaacugugugugugugacucacgugaaacugaguuucaaucugaucacauaccacaggguauguuuggaaaaccuuuugugauuuaagauuuauuuaaugauuucuauuuuaaaguacuccuaauccuaguuucauggacauuuauacucagagaguuaugucgagccuuuaaauaacaaccucacacauucuuucuaaguuaaauuccaauggcuagccuugcaaaugguuuggugcuuuuauaaaauacugcauuaagucuuaaagauagauuucugggagaaaaguuuugauaugugucuuuuuauauauguggaguucucucuuuugaaagaggagaaaaauuagaaauuacauauguguuuagagauugcuuaaaauaucacuuaaagcagaagagcacaaccauaaguguugaauuaagguggagaccgccuaacaggaagguaugcaacuuucccuaaauuccuccagccugcgcuggcuccaaggaaccaagguuagaagcucccgagugcuacaggaacgucuccgccaaggaagccauauaugcucgcccaucuaguccagaggaaaucacccuuggcuccccuuucuaacucaaaggacgcuuuuuucucacuauuuuggcagccacaaggcuguuagagucaaaggaaguccuuugucuuuucugggagagcuccaucuauguggggaugugcauccaaagcaacuuuccagucauugaggcugaccugcaguuacucaccagugcacuggugcccaucgccggcauaaccaggcaggcaggcacagcugaacgugcugccuccauggugaacacaccgggccugcccagcaggagcacagguaugacugccauccucacagggguuggcagguggggugaucacugaaaagagaagaagauaagggcauccagaguuuaggccugcaaaggaugagccucacuccucauggcaugauccacagaccaacagcaacagaccagggaaugcagguucucagacccuacccaagguccagugauucagaaucuggauuuuaauaagauuccuagaugguuuguaugcuauuaaaguucaaguacugguaugaauuugcuguuaaaauacuaagcacaaaaacccaucaccuaagcaguccucaauuaaaguuuauaacacuccagagcaauugcuacacacacacacacacacacacacacacacacacgcaguuucuccugucacuuuuacccucaucccacugaauuaaagagugcauuuucuuucuuuuuuuuuuuuuuuugagauggagucucacucugucgccaggcuggaguacaguggcgugaucucggcucacugcaaccuccaacucccugguucaagugauucuccugccucagccuccugaguagcugggauuacaggcgugagccaccaugccuggcuaaagagugcauuuucuuuacucucauccaucuuuaucaaugggaugaauugggauaguucuuuugauccauuuuuaggucuguaguauuuucuggaaauacagaagagguaauuuguuacagaaggagcucuuuagccagucaaguaggacaugcaucagugaauuauaaauccaucucuucuaauuugaaaaauacuuuaggcucuaucuaaagagcuggagguguuuacuagugaaguucaucaucuuguuacaugacugggccagaaaucccaacugaggugggcauccuucaauaacucaacaccaaaaauaucuauuuagggaaaaacagugaaaauaaacagggcugaaacugagccauagcuuugagagauuuuguuguuuuuuuuuuuguuuuuuugagacagagucucacucuauuaccuaggcuggaaugcacuagcaugcugucaguucacugcaaccucugccuccugcgcucaagcaauccuccuaucucagccuccugaguagcugggacuacaggcgugugccaccacaccuggcuaauguuuuguauuguuuguagagacgggguuuugcuauguugcccaggcuggucucgaacuucugaacucaagcgauccaccugccucagccuuccaaagcgaugauuacaggcgugagccaccacauccagccagcuuuggguuauuuugauguaaacugucuucuuaagaaaaccauauagcagagccucugaauagcagaagucaaaacacugacagauuaaagagcaagauuaaagagcaccauuuuggccacacaggaaaaugauuuuggaacucacagaugcaaguaugccggucaucugcaaacucauaaccacuccggcacucacaccuguagcuuccaggcaaguugauacauacagaguuggggccacagcgaugaaagccaguugcacauucauuuucaucuaagaagaaaugagaagagaaaaauucugcuuaauucaagggucccagaaguggagggucuaaaaacucaauguuuucucacuaguaugaugcuucaaugggacaaaugguuggcagauguagaauuuuuaaaaaucagauaugaaugcauguugcagauaaucagaaauaguaaaaauuucaugccauucaaguaaacaccacaggaagauaaauuuuuaagugaauauucuaagaauucuuuaacuguuuuaaaaagaauggauacuuggaagaaaaccaacaauuuuuuuuaauaucaagaaauuucuaccguugccuuuuggggauauaagacacacaaugucugucuaaaauuuaaagaaaaucagaaaaugugcuuuuugguaagucuaagaacuacuuacuacaaaagcucaaaauuacaaaacuuaacucaaaacauccaggaacugcaacagauguuuucuuuucacagccccggugcaaaauccacuccacuccaaaccaucuuuucaaacauaaacagcuaugcuuuaauuuuuaaauaacuauauucagauuaacagcugcuaaaaucauugacaauggagguuguaaaggugacagauacuugucuucuacagacauaaggcuggggagggcagaggaaaaacaagggcuacaagaaggagacacgagaacauggcucuuacccacacaguuccguccaucucccugguacccagaugcgcacucacagguguaaucuacaccugucccuggauggcaccgugcuguugugucacacauguggcucccaucauagcaaggauuccccggaguggggucugaauccucugcaugaguagaggggaaauaaaagcacaaucuggcuauugguaagcaaaugucacggagauagaggaguccucggaacugacugcaugucuguguuuugugacacaccggaagaccuuacuaaauuauccauaucugaagcuaggguggauuuucugcacuucaguuuuaaacuccagcauggcuuccuauugccuacccuauagacaacuaguaccuuuacuugcuuucaguagguuugcauccagggaauaaaaacgcccaaaacaucuguuuaaaagugcuuuugcucuauuauuuccugugauucuugggaugauucuauguggugaguuguuuuccccauuauguguaauuuucacagauaaggaaaucaagugagacaugggaaaaauugcccaagcucacaaagucaggaaguggcacagcaaagacucagacuccaacuuccugguucuaaaucuguugaucucuuacuaaaauucccaauuuuuauagguaaauccaauuaauuuuaaaaaucuuguuuuuuaaagauuucuaagacuaaacaggaaugacuuucccaguauuuacucuucaggaguagccuuaccaaggauccaucuacucacuagguagcgauuacuuaacgacugaaaucuccccuagagaaaucuauuuuggcugagcaugguggcucaugccuguaaucccagcacuuugggaggcugagguaggaggauaguuugaagccaggaguucaagaccagccugggcaauaugccaagaccuuaucucgagagaaagaaaagaaagaaagaaagaaagagaaagaaagaaagaaaagaaagaaagaaagaaagaaagaaagaaagaaagaaagaaagaaagaaaggaaggaagggaaagaaagaaagaaagaaagaaagaaagagaaagaaaaagaaagaaagagaaagaaagagaaagaaaaagagaaagaaagaaagaaaaagaaaagaaagaaaaggaaaagaaaagaaagaaaauuagccgagcaugguggcccaugcuuguagucccagcuacuccagagggugaggcaggaggaugacuugagcccaggagcuuaagcuugcagugagccaugauugugccacugcacuccagccuaggugacagaacaggaccaugucuuaaaauauauauauuuauuucuacauaauagucaaugcucauugagcauuuaugugugaggcauuguucuaaacagauaggaggaugccugauuacauccuucuaacuacauggugaggaaaauacuaucuccacuucugcugcaucacagagaggccaaauaaccugcccaggguuacacagucagaagagguggauggagcuggaauaaaagucuagcagucugguuccauagcucaugcuuuccaccgcuuugcugcaacccucacugaaggaacuucaugaaguuaucuagucuaagccaauggcacagagguauuggaaggagugucagaugcucagguagaaugaaucuaucaacucuggcacuucuguguacuucugagucugccauguaaaauggaaauaggaacauguacaucugccaauccugcuaaagaaaauuaagaaaacccaacagaacauauuugaaaggcaauuccccauuggcaggucuacccagucucuacugacugcacuccuucugccuucucaguggggccacuguucaucauuauuugagguucuagcucaaccucagucccuagaauuaacucuaaucuuagacucaaaagauuuccagagccccagcuaagccugucagguucuacauugagccaucucugcuacaaagggagauccaucuaaguuguaauaacucaggcuucugccucauacuucugugccugaggcccugucuugauagccagcuuagcauccucugagucccauccugcucaccaguucucacuacucacagacaccagcaucauggcaucuguaggcagacacuggcaguaccacccauuuuaccaccuccuccuggauucucuaucauuucacucuuucugacccgugucucccaccccacuuuguacagaaucuucuauuaaaauggagaaauaacaacaggagagaaucagguucuugucuuauacugagccuucaaugaggacaugacccuguuguucuccauuguaacagaugcugacucaggaaccuggucuauacucucaaguuaacuuggcaaccacaaccccacugcuauggggggagacuugcccagagugacuccuaaucuagaucccaagugcugacugcugcagcugaccucauagacuggacucgcucccaaguccuucagggugucuggcauucucccccgugccugcccuacugcccacguuauggcucuuccagugcccugucauagccugcugugagcugggaugccuuggcugagacagccuuguuuucugguaaacucuuuccaucccacuuuauaagaaacaccacagugcauucuuguaguggaauauucccguauuauugauucccguauuauuggcugaaaauaaggagggcuauggguuuauccucaguucaccacaauguugucggcuggaguaacagaaucuuugccaaaacaaaggaccaauaaauaauuccagcacuuuuuaaaccugaugaacuaugucagcauaagccuagcucccugaagcaugcagacauccuuggagguccguuccucuggaucucuuggcugacaggaaagaggcaccgcacugggguugugguugccgaguuaacuugagccuagaccagguuccugagucaguccucaauagguuauaacuaaggacaaggucaugucuucauccauuaggacccaauguaagacaagaacgugaucaucucccaucauuucuccauuuuaggaagauucuguacaaaaugccuggcauaccccaccaaagcaggaaguaauugucaacauguuuugauuuauaaauacuaaugcuuagccuucuuauucaguacuuuccagcaucaaaauuucaccauggcacauuccagcaaagauuaguguguucacauggacaucaagagcuuaccacccugcuaggcauuaaaagaaaaaaaaaaaaucucagcucaaaaguugacuugcaaacuuggacaggauauauuauccuaccuaaaauugagaagaaagugucccuaauuacucaauacugauuuaaaauguaugucacugacaggauuaguuccauaauuugcaauccccagugcaaaaugaaaauguggagcccaugguucaaagcaaagcguuaaaccaagcauggggcucuucugagcacagggccccauucacugaacuuggcuucccaaaacauuuuuaaaauacauuucuaaaaccauuucacgacucauucucuaugacuuguaagcuuuucuccuauuauaguaaguaaagaacacaguauccuucuuaagacauuuucuauuucgcccucacccucuuaaacugccugacucucuuaacagaggaucuggaacuaauuuacucauuuaaucaaggggaagagcgguuuuccuuaaaggaacagucccuucagcuucacugcacagcccucugcccagagccuccucaacucgccaaaaggacccgugaaguggaaggacaggaagcauuuuuggaucguguuuuaugaccccacaaaacaaccaaccaaccaacaacaacaaaaaacagcugacucacacuuaaagcuuaaagcucaaacaacuggugggggguggcacugcugguugagaagucaccgagggacagaggcuccaauuacucacugggaaagacaccccaguucugcauccucgcccugggaagucgcaccacacccacaucagguguggacagcugcgcuguuucacaugaauuccaacaacuaucguucccucuggaaaaacugagcaguucuuaggaagauacugcuguguaccaagaggggaaagaaaaaacuuuuggguguuucuuuuuuguuuuucuuuuuuucccuccuauucagguagaaugaacaguacugcuguguguggaugaaguaggguucaaacacaaaggguuuaaaagacacacauugccucuuucaaaguuuggucuaaauuaugaggcagucaugaggccacuguggaacagcagagccaugagggguaagggugugcguacuggagccagugccugaguuugagucccagcucacccaggucacuuacuaugaccaggcaaauuacuucauuucuauaccucagucucaucaucuguaaaaugggauaacaaauaaccccacccccaccccaccauuggguagaggucauuguggggauuaaaugaguuaauucauguaaggugcuuagaacaguacuuggcaccaaguaaaccauccuuugauauuauuauuugacuggggugggagggaaaaucauaaaauucuaaagaaaacaagcaacuugguaccugccaguuugcuuucucugauccuuucuuacucucauuugguaugucucuaggaaaaauauacccagagacacaucuuuuuccuaaaugguuccagaaucugaaugggacuccauagccugggaaauuucacuaacaguugcuuuuacagaucagaugccuacacccaacacagggcugaccuggacauuuaaagguaaagaccauucuccccaguagguuuaaaucucucuuugagaaaucuacuacagcaaucuuucccuuucuaauuuacauguuccucuaaaaucaacucacauuuucauguguucauuugcuaccuuacaauccaauaucugggcaccuaaugccuacauucccaaccaaguuucuuaaaaccaaagcaccucgggauucucauuacaagucacuuucgcauccuagaaaagagucuaguccuuguaccuuaaucuugucauauugcugaagcaacacuucuuuauugagccugcugaggcuuaaggagcccucagcuccaauaacaaagcacagaaccgcguaucacuuacagauucaccucacugaggagcuaacucugggcucaacaguuucaauacaguggcugaauugaggaagaugguuuuuuucuccugguguggcucuuacauucuaggggaaaacaugaccugguuuucagaauuaaaauguccccuugaucugacaaagccacuucccaucuguagaguucccugacuucacaagcucauccucuggcuugcuugaaacauuuuuuaauaauuaagaccuugcuuuuuaggaugguuuuacauuuagagaaaaauggagcagaaaguacgagcucccauauccccccacccaaaaugugcaguuuccccuauuaucaacauugugcauuaguguggugcauuuguuauccccaaucaauacugacacauuauuaacuaaugcccauagucugcaguagggcucacucuugguguuggacaguucuauagacugacaaacgcauaauggccuauaaccaacauuacaauaucauacagaauaguuucacugcccuaaaaaucccauguuccaccuaugcauccuucuccuucuuccuccugaaccacuggcaaccacugaucuuuuuacugucucuauaguguaaccuuuuccagaaugucaugguuagaaugauucuguauguagccuuuucagacuagcugcuuucacagagcaacaugcuuuuaaguuuccugcaugucuuucugugacaugauaugccuagaacauuuuaaaaucagucuucacaggugaggcuaauggucauuaaaauuugagaaccacugcuuacuuugagacggggucuuguuauguggccaacucuggccucaaacuccugggcucaggugauccucccaccucagccuccagaguagcugggauuacagguguaagccacuguacccgaugagaaugguuuuagaguuuuguuucuacuacuauuugcuuccauuuauuuuuauuuuuugagacggagucucacucuguugcacaggcuggaaugcgauggcacaaucuuggcucacugcaaccuccgccuccuggguucaaucaguucuccuguuucagccuccugaguagcugggacuacagacacaugccaccacaccuggcuaaauuuuuuuguguauauauauauauauauauauauguuuuauuuuguagagacaggguuucaccauguuggccaggcuggucuugaacuccugaccucaggugauccacccaccucagccucccaaagugcugggauuacaggcauaagccaguaugccuggccuucaguugagaaguaauucacauaccauacaauucauccguuuaaaguacauaauuaaacaauuucgucuauucaguguuauccaaccgucaccacaaucaauuucagaacauuuucaucacccccaaaauuaacccuguacccuuuagcuauuaacgcccuaugcucucauuaucucuuagcccugggcaaccaugaauaugcuuucuauguauguggauuugccuauuuuggauauuucacauaauuguaaccauucaguaugcuguccuuugucacugacuaccuucacuuaagguuuucagaguucauccauguugcagcauguauccguacuucauuccuuuuuaugguugaauaauauuccaguauaugaauauauuuuuugguguccaucaacugaugggcauguauguugcuuccaccuuuuggcuauuaugaauacugccacuaugaauauacacgaauaaguuuuuguggggaucuauguuuucauuucuuuuggguauauagaaaggaguagaauugcuccauuaaaugguaacuuuguguuucacuuugagaaaccacuauuuuguuuuucacaguagccacaucauuuuauaaucacaccagcaacguaugaggguuccgaauuuuccauguucucgccaacacuuguuauuacccguuuuuugauuauacucgaccacaugauguaaaguaguaucucauugugguuuugauuugcauuucccugaugacuaaugaugcugagcaucuuuacacaugcccauuggguaucuguauaucuuuuuggagagagguccuugcagagcuuuugcccaucuuuuaguuagcuuguuuuuuuauugaguuguaagauacuucguauacucuagaacaaauaucacaugauuuaaaauacugucucccauucuauggcuguguuuucacuuuguuaauaauguccucugaagcacaaacuguuaaaauuuugaugacacccaguuuauuuugcuguugcuugugcuuuuagugucguaccuaagaaaccauuagcaaauucaaagucacaaaaauuuacccauauguuuucuucuaaaaguuuuaacucuuacacuuaggucuguuggcccauuuugaguuggauaugcugugagguaaaagguucaacuucauucuuuuguauguggucacucaguggucccagcaccauaguuaacaauaguuuaaaagacuauucuuucuccauugaauuguuuuggcacuguguuuuuuguuuuguuuugucuuuuaaccaucagaauucuauuauuauuauacuuuaaguuuuaggguacauguuuacaacgugcagguuuguuacauauguguacaugugccauguuggugagcugcacccauuaacucgucauuuagcauuagguauaucuccuaaugcuaucccuccccacucccggcacuguuguugaaaaagcaauugacuuuuaaugugaguauuucuggguucccacuucuguuccuuugaucuuuacauguauccuuacgccaggaccacacugucuugauuacucuagauuucgaguuugagaaauacaagucugacuuuauucuuuuccaagauuguuuuggcuauucuguguucuuugaauuuccauauaaauucuagaaucagcuugccaauuucuucaaagagccagcugagauucugauagggauuauguugaauuaauagaucaauuugggaaguauucacaucuuaacaguauuaagucuuccaauccaugaauguggaacaucuucccauuuaacugggucuuaaauuuuuuuccaaaaauguuuugugggaugcaauguacaaguacugcacuucuuuuuaaaaauuuaucucuuuuugaaacaauuucuuaaucuuuaguuugcucauugcuacuauagagaaauacaauuugguguacugaucuugcauaucuuauaacauugcgaacuuguucuuuaguucuaauaguguuuuagugaauuccugagauuuucuacacaaaaugucaucugagacuaauuuuacuuuguccuuuuccaauuuagauggcuuuuauuuuguguucuugccuaaucacccuggcuagaaauucuaguacugaauugaauaaaaguggcaacagcagacauccuugucuuguuccuaagcuucagggaaaagcauccagucuuucaccauuaaguauaauguucugggaaucauggagggggagguuauacaucaaguucuaugauguuugguuuuuccagauacuagcucuuugcuccaccuuaguuuuggaugaaauucuucucaucuguuuuagcuaaaaugucacuuucuuggggacaucuuuucugaaucuucaaacuagacucacagugcccugcucucaucacacuuguaacaaauacuugucagcaucacucucccuccuaauuccagucugccuuguucacagguauauuccugauuggcacgcacaguuggguauugcuauaaaccagcuucacauacuaugcucuauuuccugacuuuggcagggacacuguucccugcccuaaaacucuuuucugccucuguuuccaacucaagggcaaggaucugcucuauucauccuuauaccuagcacauaacacagcauggcacuagguaacccuuaguaaccucugugaaucauucuaacucuacuuaaaaggaugucauuuuuacccaacaacaaaaaaggaaaccuuaccuuugaccgggccaauuugauuggucacagcaaaucuaagcacucuuucuucgucauuauacaaggcaaagacccgguccacguucagcugcugggugguggggaaggacgggugucugggggcgugccugcacaccugguaagugauguucugguggaugcgguaggaccauguuugguugauugcaccaaaagucagagaguagucucuggaacuuguagaggucacagcugcaacaaacacagugguaauuuuuuaaaaauauuaaauacagagauuuucaugugagguggauuuuucugcaguuuuuuucaucuaauucuuggaguguguucccuugggaaccuccugaguuuauaugaaaaaauguguaaggaaaucccaaaaaccugaguggaugcaaagccacagugcugagagggagaaggcacuacaauuguccauguuauuauacacaaagaauaaguguuacuaagggccagccaugccaacagugcucucuacauacugccucauuuauuccucacaacagccuggugaggugggcacuaaaucaugugaucagaggcucacaaagguuaaguagccuaagaugcaaugcugccacaugguagagcuggaacugaaacucacauugguuugacucuacacccuaaauuuuaaaccaauccaucuucuacauuucacagaagugacgacuuccaacaccucgcacuucaguaaaucugaaggauuccagagaagggaaaggguugucucucaccaucugagucuaggagucaagcucaggucagugauccggacacugaccauuuuguucacagcccaggucucugcuuccccuugucuucccuacaucuccugccaggcugccagcucucagcauaggagcagcaggggucagaggaaaggcacaacucaauccggauugcugugcugcacaacagcagcugugauggaggcagcauccugugcgcagguaguacuuucacagaacacaucacgcuucgcacacauugaucacauaauauagaaaaagcauuuuuaguuccaugugaaagaugagaaaauacauucucagauauuaagaggccuuucccuauagauauuaaauggcaaguccaggauauaaauucuuaucuuuugacuccaaaucuagcauuaguuuuauaauaaauuauagcaucucuguguuuuuugguuuuguuuuugagauggagucuugcuuugucgcccaggcuggaguacaauggcacaaucucggcucacugcaaccuccacuucccagguucagaugauucuccugccucagccucccaaguagcugggaucgcaggagcgugccaccacacccugcuaauuuuuguauuuuuaguagaaacagguuuucaccauguuggccaggcuggucuugaacuccugaccucaggugauccacccaccuuggccucccaaaguggugggauuacaggcaugagccauugcaccuggccucuuucugugauuuuuuuuuuuuuuaaagcagccugaacucaucagcugaaacaagguugagauaaauauaaauuccaauaaucacuauuuuuccauguugcagaaaguaggaugguuaaaaacuguauauaauuauaccaucccuacccaccccauggacaauguugcuauugauuuuauuauuugaaaauacuauguagggauauagauauucuuauguauagcagccauucugcucacuuacacgauauauuucaugguaacaauaagaguaauaacauaauagagcucauuuuauguuccaugcacuguucuaaggacaugccauguaagucauuuaagccuuguaucuaucuugugagaugggcauaauccccauuuuacagaugugaagacugguuauacauacuggagucggaguagugguacagcuccuuguagggagagaugugggcugugaaauuugcugagacguaaggcaccuggccuugaauguuggucuuaaugcucagguaguucucugggucaagucccucagcaguuugagugauacgaaccgucuccucucccggguagaauguaacuuccaugucauggguaaaggcagcaccuggagaugaaaaacauucagcacagggaugaaaagaggucuugcuuaaacaguuaccaguauauacugcccgcucccaauuucuacugcuguuggagaucgugccuaaggagauuaucugauaucugagaguaagcacuaucagcuguugauuccauaaguucccaaacuuuuccauugaagaauaugguuucauccugccuuaccucacccagcuucucuuugaacaagcuuguauucugugagaaauacucuugggaacguccuugacuuuucucuaagguugcuagacuuagcaaaaaacaaacaaacaaauaaaccuaacaacaaaaaaacaaaaacaaauaaacuaccaccuaagacauucaggguuuuguuugaauuucagauaaguaugucucaugaaauauguggguaauacuuauacuagaaaauuguuuaucugaaauacaaauuuauccaggugugccauuuuuuaucuacuuuugacccaagggcuuuauucaaauuuugauuaaagcaagaaccuauuaacagcuaccgagcucugcaguuaaagauggagaaagaacuucucacaaaacuauuuuuaaugcaauaaagauaaaaccucuagcaaacaaguuuucagguuggaaggugagaauccaaaaaguaucuucuaaauccuuguugucaacggguggccuuuccagcaacacugguaccucaccuccuagcuugguagaaaagcaaaaucacggaccccaccccaggccugcugaaccagaauuuacauuuugacaagaccuccaagugaugugugugcagguucaagucuggggugcaccggccuauacuauuauagguuguggagcugggaggagaagagcaccccuuccccaugaaguaaaaucauccccaggugccccaaguaccauuuuugcauuugacagaucugugcauaauuuaaaaagccugacaaauaugcugcaacaaauugggguaagaggacacaaauguucugaauggaaucauccuguuucucagaacagcugggagaacauuuagacgaaaucacugccuuucaaaaaucagugaugugaggucaaaccauucccaacaaccuguggccagaaaacuacacacauguggcucuaguacauuaaacaagugauuccucugucacugcguaaaggccuaaagacagugccccaaggagcaccacugccaaagcaaugcugacuaccggccuucucagaggcccuacucaccugcgaggcugaagccguucucagagccagguuuuucuaaagcaaagagccagccaaacaggccuccaauuggugugagggggaggagggccugggcugcuggcugugggauguggcugauggccguguaggcucugccaucauugcccacgauauacgcaugcagguccacaucagugaagugcacggguguauggcccacguggagguggccacucacuuucccauucacucggugaggugccccuaaaagacagcaaauccaguuaggcuuggacgucauccuggcuagagauggguguacccagguauaauuauuccacugacaacuuccaaaacucacucuuuagcaagucacuuuaaugauuuccuaaccaaccaauuauccaucuaugaaacaguccugccuccagucuguuuucuccccuccuccuucuacuccacuacacuuuggcucuaaugagcuggcagaaggaagcauuucuggauaauccucaaauugggaaucagcccaaaccaguucauuccucacacauuuauugagcaccugcaaguugauagcacucugauuuaaguaguggagauguuugguccauaaagcagagcucacagugguagcuggaaacagguaagcagcaggaauagacacacaggaguuccuggccccagucaauuaccuucaggcagacagugcuucccauuuccauaaaacuuggauuggcaguggcagcagaagccaguggcauaguccgugcagaaggcaugccgggagcauugucugugguuguguucacagguuuccuuguuggcagcauuauacgugaagacugaaaaauaaaacaaacuugccuuaaaaggacuaaaugauuccaaugucacugcugcaucggggacacaacaucugcuccauagaagcaguuuagaucauaacaaacaguuuuugauguuuaagagaccggcauaacauucaacccaagggaauuaaucugcuuugucugcuggcaagaagaauugcuuacugcucccggcugggucccauugcagaguuggugaacuaagaugagacugcacccguggguuugagugcaguaaaaugaaagcaaaccaguaaguacauguuagguugaacuucaugaaaccacuauuuuugugggucaaaaagggcuaaauaucagcacuuuuauaugguucaaccuaaacacauccugagaggaagacauaauagagaagcuaacaaaugucuuaugucuaaccauccuucuuuuagggaacacugaacuuaaaaaagauaauagcuggucucgcuaccaagauuguuuugagggaagggucuuaaagaacacacgcaccuaccucaaagaaaaggcauggggagaaggggacagaggagggcaaaacaacagggauucaagcuauuaaaaugcccuaugcccuuggcaggguuuaacuaugauggguaugguacaagcaugauuuccacgcaguagcagacagcuugggccccacucgcagaucuuccaagaaauuauggaggacuaggauaaauucagugcucuggcagcuguuucuuccauuuccuacuuauucugcccauuaaaagaagagggccaucugugcugcaaagaaauggggaaacuggagcaaaugccauaguucauaaaggaaauagccaaggggguaggguguggcggggguuguggauggacaggagggugcuuucuccggggcacuaggaaauaugccaaucccaagcauggccaccaggaggccaagcggcugcacacaccucugccuccacauccccaggagguggaguuggcuggagacuccaggagcaugcuguugagcagggauggcauggaauucuagugugagacacggaugcuggcaugaaggaggacacccacccuacucuuaggaaaaaccaagugguaguuguguuccaggucuaucuggaaacgaggagacaggaggggaggaagaaauccaaagaucaaucuuuacccaguauucccagggagaacagaaaguaaaggagcuaaugagacauagcauuauagguacaaugucaccaagauaaagaccuccaucagcaaauaaaaauauaacaaaguuaacacuucaaucgcgcuuaacauauacaagcuuuacauuuaacaaccuuuuuuuuuuuuuuuuuuuuugaaacggagucucgcucugucgcccaggcuggagugcaguggcacgaucacagcucacugcaagcuccaccucccagguucacgccauucucuugccucagccuccugaguagcugggacuacaggcacccaccaccacgccugacuaauuuuuuguauuuuuuaguagagacaggguuucaccauguuagccaggaugguccugaucuccugaccucgugauccaccugccucggccucccaaagugcugggauaacaggcgugagccaccccgcccggccaacaacucuuaauuugcacaacaacccuagguagcagggacuuuuuuuuguugcuguuguugagacaggguuuugcucugucacccaagcuggagagcaguggugccaucucggcucacugaaagcucgacuucccaggcucaagugauccuccuauuucagccuuuugaguagccgcagccacaagcaugcaucacaccugccuacuuuauuuuuugguaggguggguuggggggaggggucucccugcguugcccagguuggucucggucucgaacuccugggcucaagugaucuucccaccuaggccucccaaaaugcugggauuacagguaugagccaccacucuggccagggacaauuuuuuaacccguuugcagauaaagcugaggcacaguagacuaaagcaccugaagucgcauaggcagugaguggcaaaggugggaaccgaaccuaggacaucuagcuggagaaucuuaacugcuacucuccacgaccccuucaaugggauccaaguacggagaucaugagcacuagauuaggggucaccacaugucugggguuaaucagcacagacuucaaguauaauucgagucauacuuuauaaacuggguuuaaugguagaagcaagcagggaagauuaucgagaugacuauuacagcauguugaaaaacagcacagguaagaaaugagaguagcagcagcggcauuagcuuuugaacaguacuggagugcugccugcagauccuugggaaagcagcaagcugaggguuggcaggacagacaguguagguucaaguggaaaaucugauuagaacauaguaggaaugaaguuaugacucaagauuuaguauagggccuugaugacuuggcuaagaaauuccaguuugauaaaaauagaaaauuaggcaugacucaacuuuauuuaaacaagaaagugacaagcuuaacuuaaacagaaaagugauauaaaacucaaggcagaaaaaaaaaaaaaaaaaacccaggauggaucaugguaaaauagauggcugugaagaaaacuguaucacugucuauuaguuuaagaaagggaaaaaaacauuuagaguaaaaggaaaugaauguaacuuggaugugucaaaaucucagguuucuccagcucagaaauucacaacuaaguguaaggaagcagcuacaggagggacucacacacucaccagugugcucauggcuuaagggccaucaggacuuucucccagagcucaaggaaugaggggcugcagaaagcgccaagcucuaggacucaaccucagcccucccucgggggcuuuguggaaacuaugcaaacugucuuucagcuuccucaucucuaaaauaaguagaacaccucuuccucaccccugcauugccagaagucgcauuucuucuuaauguacuucugaacaccaaguaaaaaggcaaucugcuauaggucuaaagaacagccauuuggcugggcccggcagcucacaccuguaaucccagcacuuugggaggccgaggcaggcggaucacgaggucaggagacugagaccauccuggcuaacacggugaaaccccgucucuacuaaaaauacaaaaaauuagccaggcgugguggugggcgccuguagucccagcuacucgggaggcugaggcaggagaauggcgugaaucuggcaggcggagcuugcagugagccgagaucgcaccacugcacuccagccugggcgacagagagagacuccaucucaaaaaaaaaaaaaaaaaaaagccguuuucauaauauucagauaaaaaucaauccaaacuuuacaagcuguucugcccacaaauuaaggaaauaacaggcuuggauuguaucuuauuucaguuauuuugugaagccuuauucugcaacccaauucuuauucugaggcugaauuaugaaacaaggagagagaagauggaggagagacagucuagauauggagaguuaaacuagguggagucauagcuuuuaucuaaguaaaaagaggcagggcgaugcagccagcaacuuacaagugcaacugugcaaagguuuauaaauagauuggaagcuguacuacauuuuucuauuacagaaaaagaaguuauaacaaugagcaggcucccaugaaaggcuauuaugagacuuaaacuguaauuacaaugggcuaacuaguuacuguuaagcuaaccugggagucuuuuuaaacaguuuuguggaauauuguauuuuuaggaugguacuuacugagccaagaacacacacugucucuuucagcuucauaacagccacaugaaggaaagaagauggaucagccccuaauccgggggaaggcaagccuccauuuauaaucccucuuccacgccugccuucauacccaagugcacacacagguuugcacacuuaccauuuacaauggcagcuuguuaggugaaagguaaaugcuucuuacaauuuuuguucauucauucacuaauucaacaaguauuuacugagcauucacuauagaccuguaccuagucuagaaacugaggacauggcagggagcaaaagagacaaaaauucacauccugaagcuuacauucuccccagcagcagucaauaaacaaguaaauuacuuagugggguggauguguaagagcugugcaaagaaauacagcagagaaagacaagagggugggagggggcagguguacauggcucuuuuuaauagcauggucagggaagaccucaggagaaggugacugagcagaggccaggaggaggugagggagugaaccccacagaugagggcaggcguggugcugugucaggcaggaggggugugugggcaugugggagggauggugagagaagagguggccugggucauucaugcagggucucagagaucacaggaaggauuugagcuuucaucugagugagaugggaagcacuagaggguuucgagcagaagaguaacaugcuccgacuacaguaaaucagacaggagcuggucccuuggugguaagaagugcugguacaggggauaagaagggcccaggucugggauauucugaagguggaaccgagaggguuugcugguagacuggaugugggaugauguucaguccugaugugggaaaccaaaaggguggagcugccaguuacugagauagggagacugaggaggagcagguuugugggguucaguucugacaacagcaugaggcaucaaggaaauucaccaaggggugaauaacaacuuacacccucagcacagcaccaugcaguccuucacacggagagcugcauuucucccgguggauuccagagaccacugcaucaggaucaccugagauuucuguuaaaaaugcaaauucugagggcccaccuuagaccuaccaguuccacucucugggugcauccuagcaaucuacacuuuagccaccccgccagugauucucacaccaauugguguugauagaaggcuugggauacaacaagccuuggauuucugagcuagguguugcucaucaaugucguuaacaaauuuaaucugaccaauuggcagcuccuggggugggcagaauguuaggaaauuucucgugcucauuucuggccaccugagaagcugagcucagugcuuacggcccauuugggcauccauccacaagaauacaacgugaagauucuuuagugaaaguaauacagacgcacagcagccagauagcccuucccugaagaagggggagaccuggagcuagaacggugcugagcccacgugcagcuauuuauccagggcgagaaaagccagaccuccggccaacgugacugcucaaauuucuaugggaauugcagugaaauucaaagaggcugaacuucuugaaggcugggaaucaagaucuggaucccagcuagaugagaugugcaauaaacccacccgaggaaaaguggcacuuuuucuuuucgguggucauuuucaugucccuaucauggcuuugaguguauuuucaugcacuucuuccuauucuaguuagaagauaucuccauuuuauaaaugagaaaauugaggccuacagagaugaaacaaucuucuggcucuaaaucccaucaaauugagggggcaucagaaucacugaagugcagaggaauauggcagggucagacaagagggugagagagggcaggcacaccuggcucuuugaaauaguauggucagggaagaccucgggagaaggagacauuugggcagaggccuggagguguugaaggagugagguggcuuaaaaaugcaguuucugguucagaagguagaggaggcgcuuggaaaucaguguuuuuaaccaggcucccagcugagugagaggaagguggaugagugcccacacuuugagaaauacaguuucuaguccauggccuccucugggacccacacuaugccaggaagcuccugccacggagagucagaccauaaagaaguuugcugacaccucagggcacagcaggaggguggaggcuggccagguuugaaugaacucauuuugucauggauuuguuaacugagguuugauaguugcuaaaggauucuuaacaugaagauuuuuuaaaucucuuuuuuuucuauuuaauguuuuuuuuguuuguuuuuaacuuuucucauguccuuaauagaaagaaaaaugggguggggagauaucagaggaaagaaagaaaugcccugccaaaggacuugagacuuguccuaacuaggaguucguaacaaaaauggaaaauucuccucugcacuuguucugagccaucuuucaaucuucauuuucccagaaacacuuaagcaccugucugcagcccuuggccggccugcccuucuucacagaaggcccugggccagacacaggggagguuccauggugucgacuggguucacugggccaacacagagggacacaggaggcuucgugcacagggcugcuucaggacagcuggagcaacuacuaacaauuuuuacugcuaccucaaaaaaaaaaaaagucauuuucaccgcaggaaaaauucuucuaaguuuucccaucucucagaaugacagacuaguuagaaaaaccauauccaacuuuauaacaaacaguggaaugcuuuuucguccaguuuucauguuuguuuaauuuugauguguguggcauguaaugaugcugguggcagugaucacgacccuggggguggccuuuuacaacugcuggcaugacacuaacaggcucucuccacuucuggugaagggagaggggcccuaccauggaaucuccucauauaggugucuucacaggcaucggggggcggcggcuccuggucacagacccucugcaaccuggaggugcacccaggggauggucuuuggcaccuggaggguugcacuggcagcagaaccugcuuaaauucuucucaggguggaaguugagcuugcaacacacuccugcagccuuucacaaggccaaaaguggagugggacuacaugagguuucugaaagccagguguccuuccuccuaacucaucaugcagauugagauuaaauuaagcugcguauagcacugccucagcaggcuuaagaauaacuaagaccccuaucaguaaaccucauuccuuucuacucacaacacaggcagucccauggucccaggcagcugaagcccucacuggcaacucucucaccccacugccuuaaucaaccuuugucucugucucucucccuccuuuccucccuccucauucccaucucugcaacuccgcucuugucacuucucuguucauaauguuuucacacauucucccucucagacuuugaccccaggccuggcucaagccccuccuuccucacaaagacuuccccaacagcagugacacuccuggacagugccuuugacucucugucacccuacagcuuucucuaauuucuucaugacuuuguugcagucuuugcccuugcuagacaagucacuaaguauuuccaagcucaguuuccaucucuguaaaaugggaaggaugauuguaccuacccuacaggacaacuuuuuuuuucagacaauauuucucucuguugcucaggcuaugcagugguacaaucauggcucacuguagccuggaacucuugggcucaagugauccucccaccucagucucccgaguagcuaggaccacaggugagcaccaccacacccggcuaauuuuuaaaauuguuuauagaggcaaggucucccuauguugcccaggcuggucucgaacuccccacagggcaauucugaggacuaacugugauaaugcaaucuaaugccaaguucucacuuuagagcagcaggcugcacuuagcaaaugccagccaaaacuuccacuagcaccgagucagagacagguacacggcaggugcuuggguaacuuuuugacuugacaacaaaacgaccagagcucccuggaaacaagacuccucagagaaagcaugcuugcacauccaucuacugcuguucuguggccuaggaagacagagcucgaguguggccaggacauuccugccugguguagauaugaucugaaaaucuaaauuucugaacaaaaagaaaggucuguaaaaugagucccuaaggggaaaaaaauguaaaaaggagugauauuuucugggccuuuaacuaaaucuuaauuucuugguuuagcaagaugacuacccuaaagcuucaaagggaaacuaaaauguauugggcagggugcuucccaagcucaauuucaguucuugcaaguauaugacgaggucuucauuaacucuguuuuagagcugaggagagccaagggucaaacagacuacaugucuugccccaaaccacauagcagagcugggagucaaggucaaguccaaccagcaccaaaaccaugugcuuucuauuccaucagcagaaaaagccaggcagaugccacauggcuggguacuuaguaccggacaauguucugugucucugccacucccaccccacagcuucccggaggaagcccacacuuaccagacagaccucugagccuccaauguuuuaugugaaagaaacagucacugcauccccucaaaaguauuuaacaauugcaugcuucuauacuucauacauccccguaaauucuuuuaaaacaaaaacuggauuuuuuuugucuaaguuucaaacacuucuagauuucuuccuccaaaaugcguauuaaccagcuuuuucacaggcguuuuuugccauuaccaggaugucuauaguagacugcauccggcagcugauaaauaucauaguucaugccccacaaggguuauagcugugccucuguucuacucuauggcugguuccugaagccuccugcacuuuacuccagugaucucaagcucucagagcccaaagcagggugugcagucccuucuuaacccuuuaauacaugacuccauagaucugcuuuuuaauauucccacgcucuucccagggaaggaaaucacaacccacaaaugagaaggccauucaggaaugcgucuuuaccucaaaucccuuugugaaaaucuuugauacuuggccuuaaaauguauuuagaggaaacucauacuguaaauucuggagauucucagaaggaucugaagguucuaaagacuuccaauaaaauuuacaucuucaacuucauggaaauguggucccuuaggcacaaauuaaugugaaacucuuuaauaagcacauucuucauucucuacccauccuccaccccauucccacuguuuuaaaucuucuaaaauuaguaacagcagccacuauuuauuaagaaccagugagugcagacacgaagccaagaacuucacauacgcugucucauugaauccucccaaguaauuccugagaaaucagaggcuuauggguuacauaaguuacuucaggucacccagcaagcuuggcagccaggauucaaacucgaagccgacaccaauguacucccucgaauccuuacacaaugccacauuagucagaaaauauuuucuucccuccugaaauuaguaccucuccaugcaauagccugcagauaauaccagagcagaacccagaaggcccucucugcuaggucagccauguuuuugccacaacagugacaggaaacagaaaagguggaaaaacauggagauucagaacaaagcagucaccucugaccucuuucuuccuaucagaggucagaugagcagucccuggaacaaacaaucuggagucaguuucccauucacaucuuuccaugucugauggggaagaaacagcuggcaugacaagucucaacaaggacuagaagacugacauagaccccauguccaugauaauuaaccaccgccugcuuucgccaucucccuccucgccucucaguccgaucagugggucaugaaaugaggacaaggcuccagggagguucaugccacagcugcauagccaugaaccagaaaugacaacagacacagguguuuagucauuuucuuucccugugggcucuccucucccacacaucacaagcauaucuccccaaccaagggaagcgcuaggcuugucucacaacagaguaugaaucuggcauguucaucugagccagcacaacucaccacuuuaaaaagcacaaacccguccaucacuggaauguguaugaagccgcaaaauguuuuaccuuugcugaacuuucaaacugaaauaguucauuacacuugagagcguagcuggcauaacaaacccaguuuucccccacucacuucaugaggcccauauuuuaaaaaaacauuauuaaugaucaagagauuccgaacagaaucugccugccaagauuuauuuggcaaaggaaauuuacucuaucucuugaaacacagggauuaaaaauuagauccaaucuucuuuuugcuaaacuuuucaccuacccacuuaagagaaaaaucacaacgcuaugcaaaaccagcaugguuaagaugaaaccuuagcacccaguuuucuaaugcacucacccucgguguuggaaccuauguugucuuccagucccaccucauacgucccucgacuuaaggguguagugugaccugaagcaggguaacuucgaagaacaauuucuucuucaggaugagcugggggaacauccauuuccgaaggcacuggcccuccaucuggguagggcuggaugcuuccguuuucgggguacgguggugggguuucccaggaaggagccagugaaucucugucuaccucugguggagcugggcuucuggucucucucucaucccagggcucaacuuggccuuuuaaaucugggcccccuaccucucccagagauguuccuucuuuggugugaggauccaagguggaagauucuguuucaggauagaauggccaauaaguagguguuggaugcaagggggaggacagaucagaaucuggaggggagauccuacccucuaaaggcuuuguauccacuuuggauuggaaggaaacaucaaugcugcuguggccauucaaugccuccucugguucacccggaagguauucagcuuccuccucauucacaucauaguaauccaaauuguccucauuauagucacuuuccagggcuguagcauggcugaaggaacgucccaggggaacagaagagugggcagcggaaaggucuccaacugcagcuggccugacauuguccaacggggaagugcugccgauauggaaagcccacacuccagggauccccagguugcuuagucuaaauaaaaaggaaacagucauuguaacaaauguaacaaaaguguccauucacccaccuuccuagaaggugaacaacuuauuuuaaaacggaaagacagcugggcaugguggcucacacuuauaaucccagcacuuugcaaggccaaaguaggaggaugacuuaagcccaggaguuugagaccagucuaggcaacauagugagacccugccucuacaaaacccuuuucuaaaaaacuuagccaggcauggugccacaugccugugcuucuagcuacucaguaggcugaggcaggagggucacuugagcccagcaguuccagguuacagugggcuuugguugcaaccacugcaccccagccuguguggcagagugagacccugucucaaaaaaacaaaaaaccugaaaggcuauuaagaucagguucaguuuucacugguauauaaaaccaaauaaaagcagacuuacaugguaacuaaagggaucauacuggacuuuugaugugaacuaccuuuuauuuaacauuauguuucaaagcuguaugccacagaaugccagaucaucaaauuaucaaucugccccauaauccaaaugguuuaucuaaaaucuggcuauuugaaaauaaacaaggaauguaggaauguuucauccuuccucuacuugucuggaaacauaacacauuuuaaaaauguaugcuuaaaacucuaccaaauacugacacccaaaugacuacgacauacuuucaugaauuggugaugccccuucccugugccaaguguuucacauucuucaauacaaucugcaaauagaggugaucauauucaauuuuauagaggggaaaauaggcuuuaaaaggcuaacugaucuucugaaggucacauaacaaacaauuggauccgaauucaguuaacaccaaagcccaugcucuacucaucuauguuauauuaugacagaaaaccauaccacacacugcagucaauaagcaucugaauuaucauuacucuacagaauauuaaagacauuucauuguuuauucacuugaacugauuaauucccuaauccacaaagaauggugagucaauguaaaaaaauucaaauaaauacaaaugccaaaaccuaaaaaauuuguuuuugcacugaaaaaguuaaggagcaaauaagaaaguagcuuagaagucuuuuaaagacuucuggaaacagcucucucguuuucuccaugagaaaagaacaugaacuccauugaguuuccaaauaucccaauaacccauuauuuuagagucaaugguauacccuaaagagaacaacuacauaugauuucuaaaaauaugggaaaacuugagugaacaagagucugguuagguugaauaugccaguuuguauacuccucugauauuuguacaaaacacuaugcucacauucucccaagcaauggaauuuccucaaaagucagucaaugaggaauaacaguccaugccuaauaagauaauaaaaacuucacuaaauuguauaagaacaaaagauuuuccuucauuuggguggguacucaucauguucauguggauuucuauaguaacaauauuuuucaguacaauuugaaaaugucuuucucuuguguguguuuguguguguguguguguaugcauguacauauauguauaugcugugguuacuguugugguaaauuuagggaaaaaagcauagaaagaaaaacugauuuugugugcaauaugcuauacauauuuguuaaguucauaagaauuaauguugguguuuauuggcaagcaaauaaggaaaacuaaagacaguaggagaaaauccugaaguucugaggauauugaguuuauuaucacauuagagguggugcaacuaugaaauuucuucuugaaguuagaaacagaaacuauaaaaucuucaaacaguggaaaaauacagauuauggccaauaaaagcuaaauaaaauaaccuucuaauuauauauaaaucacuaucuggguuuugucauuaugcauaauggaaaaguaaccaauuugaguuuauuuuaaaauccaaggucauuuggaaagcuuaguaauagaaagaacuuaauuuauuucuacaaaggaaaauuggguuacaaaaugggaugacaaugccuuccucccuggguuguuaggagaauuaagugagaaaaccacauuaaaaugccuagcacugaccagguacggugguucaugccugaaaucccagcacuuugggaaaucaaggugggcggaucaccugagguuaggaguucaagaccagccuggccaacauggugaaaccccacuauaaauacaaaaaaaauagucaggugugauggugugugccuguaaucccagcuacucuggaggcuaaggcagaagaaaagcuugaacccaggaggcagagguugcagugaaccgaggucaugccacugcacuccagccuggaugacagaacgagacuccaucucaaaaaaauaaauaaauaaaaugccuaucacuggcccuaaacaucauaaauacuuauuaacuacugucuugucuuccagaagauagaaaaguaugauuucaaaauauacacgugugaauucguauuuaaauuugcagaggaagaguaugacaaacauuaugaacuauauaauuuaugaccuuugagcucacaguugugagacaaauuugaggaagaaaacaauugacuaggaaaauaacuuuacucuuaauuacuuauuuauuuagagguagggucucccucugucacccaggcuggagcauaguggugugauugaucauggcucacuguagccucaacccccugggcucaagugauccucccacuucagccucccaaauagcugggucuacgggugcacaccaccacacccagcuaauuuuuuaaauuuuuaguagagauuaggucucgcuauguugcccaggcuggccuugaaugccugagcucaagcaauccucccaccuuggccucccaaagcgcugggauuagaaccaccuugcccagccuaacuuuacccuuaagagaugcauacuaaggcauuuagcaaugaacuggcaugauguuugugacuuacuuuaaaacauuuaaacaggccggguaugguggcuuacacccauaaucccugcacuuugggaggcugaggcagguggaucaccugaggucaggaguuuuagaccagccuggccaacaugaugaaacccagucucuacgaaaaauacaaaaauuagccgggugugguggugggcgccuguaaucccagcuacugggaggcugaggcaggagaauugcuugaacccaggaggcagagguugcaaugagcacaagaucacaccacuacacuccagccugggcgacaagagcgaaccuccgucucaaaaaaaaaaaaaaaaaaaaaaaagaaaagaaaaaaauguaaacaaacaaaaaaaugaauauggcaaaauguuuacaauguauaaaucuaggugaugggcauuuggguguucaucuaguuauucucuccacuuuucuguauauuuuugaaauuuuaaauaaugaaaagugaaauagaagauuauauugaaggacauuucuauaaauuugauguacagaaguucuuccuaagaauaacaacaagauccaaaaucagaaaggaaaagaccaguaacuuugacaaucugaaauguacaacuuuuaaaucauacacccuuucucagcaauuccacuuuuaagaauuuguuuuagggagaaacgagaaugugagcaauguuuauuaugcuguuuacugcaaugauauuuauaacaagaaaaaucagaaauacaugaaauguucauuaauaagcugucuuuauacauauaugacauaacguuuuguagccuuaaaaugguaguauagacagacaucugacuaaaagaccccuauaagaagugauuaaugugaaaacaccacuuacauagcaaaagaaccauuuugguuuuaaaaguuuuguauauaccuaaauucuagaaggaccauuaacacuuguuaucacuugaaguagugaucauggauaacuuuuacuuuuauuucacauuauucugcauugcuuguacuuuauuauuuguauuaagcauggauuacaauaaagaaaaauacgugagucauuuggccccauaucuuacucugcuuucgccaagcaauucagagauuucugggaaguaucaaagauaaaaaugagggaaggcaugaaaggggguaaguggaaaugcugucuguguguuugugugucacacgugauuguggauguuaguuccaagagaccuuuauggcucugcucagggaacacaacugcuuuuucccacaggucuuuuggccccacugucuccugucuccuguguagaugccagcacuuacccagggcucuguaauuguugaucuauuugucuaucaacccuaauaggguacaagcugcugaugugcaggaccagugucuuagaaaucuuuguauuccaugugcuuggccauugugaccucucuauaauaauaaaucuauggaauaauaaaucuaugagcucccaaguagaagagaggguggaaccagaggagggagaguaaggaacugaguuugcuccagaguccagacuaagcggcagccuagauggagcccuaaagaugcccaauguggaucauaaggaugggaaaggaaacaaggacucagcauaagauaaaauaaguaguucagcacuccagacuugagcuuggauuuuggcuuugccacuuaacuuugagaucauaggcaauuuacuuaacuucccuaagcuccucuguaaaacugggaaaauaguaguacuaaccuacaauucuugugaguuuuaauuaagauaacaucuggaaaguguuuagcaugaugcuuggcaaguaguaaguuuucaauaaaugucagcucugaguaagcaaaccuggcuauaguggucucuuucugguagccgagcagaguggauggcaugcuaaaaguguaagguguuucuauaccuacccaggauugauuuaaugaagucaagaagcaguuaaaggaggccaggaaguaaccaauguauucuaucuggcuucuauauucaggaaacgaauaaaagcgagggcaccccuaccuccccucacacaccccccaaaaaacccugaagucaauaaauauccuacuggcacuaucuguacuggcaaaaugcagaagagcuuauuauugcacuagcuaaguaagcccucuggaucauucauucauucacccaucuauuuauuaaaugcccauuaugggcagacacugaugagucuaaggaauggguucaauucauuuuagguaaugaagccagagagacauccucagacuucuggaaaccuauaaaucuuaguuauuuuuccugcaaauuacauugcucaauuuaauguuuaacaguaucuguccaaaagacuaaaucacaauguuuccuccugugaaaugauuaaucuggaaaaccucaaacugggcaguuuaugacuggauauuuuuaugugguuccaagagcaauguuuuucauagcaagccucaguggcucuacaaauacacacacauacuguucuguuuccaguaucuauacccaauagagcaggaaaaauaaaggaccuuuuauguuuuggugaacuugauccuuccaggguugaaucuaguuccuugguuuugacuugaugccuuacuuagaagccaccaauauauuauguaauggucuuauggucacuuguguucagguacuuccuaaaaguccuuauauucaaauaggaaagggcuucagcucaauguuacuuacugauagagauuuuucacagacuguucagugcuagucaagcugaaauaugguccuucugacuucagaucaucagccuccccucggcagaagcccacccgagcuggaagcugaagcuggacauuguaagacucuuuggggcggguuccaaggaacugcaggccguuggcaggauaaagaaagagggcguagcuaucagacccaucagaugccaaaacugccuggaaaguguucagcugugaggaaaaaaaaaaaaaaagagagagagagagagagaaacauccuguaaaaaacaaauaaaagaagaaagaaacagaaugcaagcaaagcaucauaacgugcaaagaacuuccccuuuuucaggauuccuccaaauuguuuuuaaacauaaccuucuuuaaaauuuccucuucaaguuaacaauauaauuucauaagcaauauuauuuauuauugcaaauaccauuugucaauuuagauuaauaguugaaauacgcauugguaaaacauagguuaaaaaauauauacuuuguaagguuucaaacuucucucauguaaacucuuucagagcuaagagcaaucagcaaaauuaacuuguccauccugcagucacugcccuaguuuauaacccuaggcacucagcaucucucauuugcaucauucauucauucauucauucauccauuuauuaaaugaccacuaugggcaggcacuguguuaggcacuaguuggucaaaaggccuccuuacugucucacagcaucacucucuuuccucuuccaucuacccuuucauacgagcaucaggguuauccucauuucacagaugagaaaaagacacaggggcuaacaggucuuccucaggucagguggcaaguaugugguggugggccagccagcucuagagcccacacccuaggacacccuaaccccuccucaacauggcauucaaggugaguuguaaccuggcugcauacgucccucccaggcucaguuccacugcaucuuugucagacuauuuaauaguccccauuuguaccauguccuuggaugcuucuacacuuuguucgugguucccugugccuagaaagccuccuaaccuucaaaugcugccacucagagguguuugugauucccuauagaauaauuucuguucucugaaccucuguaacaccuuuaugggcaucucuagugagcauucaccucauuaugcuugguuaguuguuuauauguuuguaaacaccauucauuuauucauucauacacuaauucaaacagccaagugucuacuuaagcaccagacguuaugcuugaugcugaggaugugaaggagcaaaagacaggcuuugcccaggagagucucacgguguaggacugggaaacagccaugguugaaaugguaggagagucacuggagaaggugguagaggccaagagccgggguguguguccaggaucucaggguggagguugggaggugucacagaggcagcuggugaauguuauaaacacugcaggagccaacacagaccagagagggaccaggagccugaaucagcugccaauucaacacccagguccuuauaggaucacuccuuaacauucuguuuacccucauauuuucaacaagaugagauuuuugccuuuaccuucauucagcgaccgcuccuccuaaagaucugugaacagugcuugauucucaaaaagcuguuauguuuaggcuucugaaacugucucucucucacuaaaucacacuacuuuuacaauuuaguaaggaacugggaagguauuuuuaaaacacaacuuacuucacaaauaaugugacucuuagaaauauuauuuacugguaaguaucauuaccuuuccauucugcuagacagacaaacucgggcacagagaagaacaucacauuucacugaaggaaacagcaaggaaggaaugggcucuucccuuuguucuaagucuacucccacaguuguucuagcucuuuucuaauguuaauuuuuccuuucaauguuuaauuucaaaguaagguuuugagguuuugcuaauaggauaaagaaauauagauguaacacacuuuucaagagaaaauaaaauacaaucagcaguucuuuuaguucucuaacccagaaaaaacaacaucuugcuuugcuuuuuucauucauucaauucacaaaguaacaggugccuaguuuauuuguuauuguuccaguuguugauuguucaucagcaaagcuugacuuuuccaaaaacaaaaagcaagaaauguuuuuagagcuucucaauacuaggaagccacaacuacugccaaauauaaacaaaggcuguucugccucaugucuauccauaagauagucgacaucaucaacuaauguggacucaauaacuucagaguuauacauuagucagaauaaagaaaaaucaacuagggaaagaaaaguacuagaggaaggagaaaaaaccccauuucaaaaagcuaagcuuucaaagcuccuggcauugaucugccauaauaaaugugagauaggagagaauccugguucuaaauuuagagaaauuccauaagauaaggagguuguagagacugugaagaauugaaggggauggggaaggggggaagagaguaguaaacagagcugugaagaggagagucugacuuuuugcugugaacucugggcauuuagcacuuuauuuuauucauucauucauucaaccagccaacaaauucauuucaauuaaaauuuauucaacaucuucuauauacuguucuugagaugagcacucauuauggguggcaaguauuuaauuucuuugucuccaccaaaauaggcaaauaucagaggaaggaaacaacuuccuuuuaaguagaauuuaugaucccaaaguacacgccaaaagaguuuggcuguuuaaaagccacccacacacuaaaugaucacuuguaaaguucuuggucaguucuacaaaauucuacaucuaauugcuaaagagcccacuucaugaagucuugaagggcucccccucucaaaaaacuccuugacuggcuuccaaacaggaaagguccucacauuccuagauacaagcuuuugcaagagccgcacaggcucugucuccaaagagaagcccucagaugggcugccaaaccugacaaacgagucacugguucccagcucccccaggaucccagagaggagagaggggccuccacagggagaggagcagcacagagaggaucagggugaguggcugcaggcccuguuaucagaaagagagaaaagccagagcccucugcagaaaccagagccugacucucccucccagguacaggacaucccaaucaauguugaagugacacucaucagagccaggcugaugcaugcaacauacaccccucuaagaguuucuaauuuuuucaauucauuuaauuaacugcagcuaucuggacaaaaaucagaauagugacauccuuuucuucaaggggcuugccuauagaggcuuaucaaaaugaaaaugaaaauggaaaugaagaauuagggugacucuuauaggggucacaaaguucucuuugucaucuuccucaggaccacauguccucuagagcucuaggaucauugggucuggccuccaguguuugcugugaacacuaaccuccauuccuuaguguaguucuucaucucccacugccuguaggacacugucacaugggggacugucccucauuuauuuuacugcacuaaauccuacagauccugccaaaaauucaaagacaaaugcugagugcuaucacaucccuaauacuauauccuuccugauacucuucagcaaaacgucagcauuucuaauuuccauauaugguucagcauuaaccaauuuccauauaugucucuauucucuucaucuucacagugauaucucagacucagucugaacucucuuggaugggcuguagaccaccccucuucuaaaccuugucuccagaagucaaaaagcuacaauaaaguccugcuuuuaccucucauuuucucugugaaauccaaccaccuccaucaaugacuaucaaccuuugaaccaagucaacaugucucagucuccacccagauggaggccuccauugggcagugucuuaauuugucuucuguuguuuacaacaaaauacuugaaauuggguaauucacaaagaaaaggaauuuacuucuuacaauuauggaggcugagaaguccaaaguugagaggucacaucuggugagggccuucuggcuaguggugacugcagagugccaggguacuuacgguaucacauggcgacaaagcugagugugcuaaugugcuagcucaggucucaauuccucuucuuauaaagcaaccaggcccacuccaugauaauccaguaauccaugaaugaauaaauuaauccauuccugagggcagagcccucaugacccagucaccuuucaaaggccccaccucucaauacugucacauugaggauuaaguuucaacaugauuuucagaggggacaaauauucaaccauagcgggcaaccuugcacucaucugucuuauguuacugccugugacuccuucauccauuucucuggccccuuugcuaauagguugcucucucaaccuucuccugggucauguuuuugcucagaacaaucucucuugauaccucauucucaauauccauucuuuuuagcccuuucaaccugacuuaaauuccagauaaacaaaacauuccccacauuacagagaucuauauaacucagcugucucuaaccccaucccuaaaaugacaaaaacaaaacacuccucuuuccccacaaaaagcacagcuaaacauuaguccucuaugucucccaucaauaaguauuucaaaggucuacaccauaacuuuuuugcucugugaacuaccuaugagaguucaagaaaucucagauuaacugaauugacaaacacuauuuguucacauuuuuuuuucagauacaauuacaccuugacauuccugcaauaucaggugcaacaucuggucacaccugacaggaauauccauggagaaaaagggcaccaacugcaauuguuuuuaauggcaaagaugccauugcuuugaaucuuccaguuuccaguaacuuugcaauauaaaguuaguaagccaaacuuuaagaacgccauguagaacucaguccuucaagcaaauuagauuacuguuugccaaagucuaucuccaaagaacuauuaaaacaagaacucaagucccagagcucuuuaaaauauuggaagaaacuucaauguggguaauugaaagaacauccccuauccaaacagaauccuccuuucuuuuuuuuuuuuuuuccccuuucuuuuuuauuuauuuauuuauuuauuuauuuauuuuuuauuauacucuaaguuuuaggguacaugugcacauugugcagguuaguuacauauguauacaugugccaugcuggugcgcugcacccacuaacgugucaucuagcauuagguauaucucccaaugcuaucccuccccccucccccaaccccaccacaguccccagagugugauauuccccuuccuguguccaugugaucucauuguucaauucccaccuaugagugagaauaugcaguguuugguuuuuuguucuugcgauaguuuacugagaaugaugguuuccaauuucauccaugucccuacaaaggacaugaacucaucauuuuuuaaggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucaaaugguauuucuaguuuucuuaaugaaacauucugaagccaacuagcaaaugguaaugucugcagguggauuuuaauuagaaaaguaaaagagagauggaauuuacaaaucucuucuacccuaaaccucccccaccccagaaaaggaccagacaaaaguuuuaauuccaaaaaccuugcauuuaaagaguccuuaugcaacauagagaguaacaggaugguuaccagaggcugggaaggguaguaggggucaggggaagguggacacaguuaacggguaccaaaaaaaaaaaaauagaaggaaugaauaagaccuaccauuugauagcacaacagggugacuauaaccugugauaacagguuauuauagucaauaauaacuuaauuguacauuuuuaaauaacuaagaguguaauuagauuguguguaauacaaaggauaaaugcuuggggggauggauaccccauucuccaagaugugauuauuacguauugcaugccuguaccaaaacaucccauguaccccauaaauauauacaccuacuauguacccucaaaaauuaaaaaauaaagaguccccauacaaaagauauaagucacagcauccuuacaagauagagaucagugacaugggcaagcaaccucaccucuuacagggggcauguaccauccuucuauagugaagaagcauuuccguaaguuaaaauugagaugaaucauaugguuucagccccuagaguaugguauuuuagauucaggucuaauuccauagaaggaagcccuuacuuucuucaggaaugaggcaguuugccauuuaccaagcacgcuggccccacucauauccauuuggaggacuucaaauguugaugacaagacuaaagaccaggagccuggaauuuuuuacuuuccgcagguagagacuguaaagcacauugacggcagacuccuauaaacuaagaaacuuguaaacugguaccuggaaggcaauuaggcagaaguuaucaagaacuuuaucaaaagugcauccucucugaccuaccaauugcacuuccuggaaugucaacuaagaacaugugcaaagauuuagcuuuuuaaaaagugauucacgcuauuauuuauaauaaugaaaaaccagaaaaagccuuaauggcccaacacugguugagcauacugugguacacccacuauuauacaggauaauagcaggauacaguaguaugcaucauuauaaaugauguagaaauacauuuauugacauugaaacauauuuacaauacacuauucugugaaaaaagcaaguuauaaaacaguaugugcaguguaaacucaucauuguuaauagacagcaauaaagauaugcagaagaaaaaacucugaaaauguacgcagaaaaauguuuaucaguggugggaaaaugagugguuguuuucuuuuuuaaaauuaucuguauuuucugauuuuuuccccuucaaugaacauauaauuagaaauacuuguauacuuagagaugguucuaaaaauaagcaaccaaacaguaaauugccuuauguucaaaggggcucccacaucugcacucccgcucucauauccgcuaagcauuuuuuuccucaagggagugaccaccugccagggccucagaagaugccuagagacaacgucuuuccucacucccaagccacuccagcccugcugccuccaaggucagguucagcgcaagaguaggcucagaaacaacuccgagccagucccugggucgcugccccagaauuuaagcccauccuucaauuuccucagcagucaaauaucccuggucacuuaccucucccgagggcagcgccccgcgcuugaccuccucguaagcgccuaccugcucccagguggccaggaaggcguggguggggguaaagcgcgcagagcgcgggaagccagcgcgcacauagcgggcggccaggcccagcacugcgggggagguguccucucgguacaggacucggccucugccguggcucgugucgauguccgccagaaaaggggcgauggccgggaagucgguggggaaaucauaguccacauacugcguuucccuggggaaguccugaguggagaugaugccguuggugcccaccugggagaggagagggacaaaaaggugacagucgcucaagcccaaggacgcuacccuuucgcgcagggagggaagggaacugacuuaggcaaaaagccucucucuccuuccccacuggccagggagucuggauucagggaaacaagcgcaacuuuugcgacugucccagcuccgcgcugcaguagguccaggggcccuaaaacucguucaccuaucuucucacuccccucacaaccccggagccccauguccucggagaggaagccuccaggucugaagagggaacaccccagcuccgcagacgggcacagccuucucgcgguccuaacugcaaagcccgcuggccgcccuagcaacgccaccuuuucugccugggacgcguacguggcugcgaacaauucuugcucuccccuccaggucauucuugcuccccuacagcagcggggcaggcagcggcaucgcucucuggccggguaccaccgcaagggugcuggggggcuccaggaguggggucuguuuccuccccucuggaggcaggguuuccgugagaccgaccccagggaagaagcugcgggaaaagugccaggagggggcugaacuuacguagagguugcugaaucgggcuucguagaagugcaggggauucgccagcuucaccacggcugagcuuucgucgucgccuuccugcaggagcugguccccccacgacuccccgugugggaagagcucgucugggugcagcgccgcggcccgcaacauuagcaacggcagcagcaguagcacugguaacgacgacagcaccggccgcccggccacccggucccccuccaugcucgcucggccgugcgcuuacccgcugcacaacgcgucccgccccggccuccagcccacucuccgcgccgcgccagccucgaaccuggaucuccgcgggcgccugggcgg

SEQ ID NO: 17450 - RNA, 15989 nt, Homo sapiens
cacaggaagaaaguaaguacaguaauguaaaggaagacuuggaguuuacaaucagaaccuggacccuaaagaacagugacugcaaaggcaaagaaaguaaaaaaggaauuggccauuagacguuccugagcauccaagaugaacauuuuguagugcaaaaagacuuuugugaaaagcugauaccucaaucuuuacuacuguauuuuuaaaaaugaagguuguuauugcaaguuuaaaaagguaacagaauuuuaacuguugcuuauuaaagcaacuucuuguaaacauuuaucauuaauauuuaaaagaucaaauucauucaacuaagaauuagaguuuaagacucuaaaccugauuuuugccauggauuccuucuggccaagaaauuaaagcacaugugaucaauauaacaauauaauccuaaaccuugacaguuggagaagccaaugcagaacugaugggaaaggaccaauuauuuauaguuucccaacaaaaguucuaagauuuuuuaccucugcaucagugcauuucuauuuauaucaaaaggugcuaaaaugauucaauuugcauuuucugauccuguagugccucuauagaaguacccacagaaaguaaaguaucacauuuauaaauaccaaagauguaacaauuuuaaaauuuucuagauuacuccaauaaaguguuuuaaguuuuccuaugacuuaaggaucuauauugucucuaggacaaagcuggggguuggcauauaugccuuaaccacaaaggagaaaggugauuuaugcaaacauacaguacauaauaaaaauucuacuuuccuaaacuuuauuaaagaaaaaagcaauaagcaauggugguaaaucucuagaacauacccaauuuucugggcuuccucccccgagaaugugacauuuugauuuccaaacaugccagaaguguaugguucccaacuguacuaaguaggugagaagcugaaguccucaaguguucaucuuccaacuuuucccagucuguggucugucuuuggaucagcaauaauugccugaacagcuacuauggcuucguugauuuuugucuguagcucucugagcuccucuaugugcagcaaucgcagaauuugagcagcuucauuaagaacugcaucuguuuuaugagaaaagaacacugcuucaauacauaauuuuuacauuuaaggccauuuauuuccucccaaguauucagucuguaaaaaaaauaguuugaauuuaaacaaaaucacuuaccuccugugucaaaaccaagaauauguuugucuaaagcaacagguaagcccuuuaaaaaaagaaagacaaaaugagaguauuuaugguuaagaauagcauccuuuccucaacugaaacugaaaagcaccuagcuauucuggugucuuaacucuuuuagcugcaugggcaagggaacuaggaauuuuguuuauauuugcuuugugaugauugugauuagcgaguuuucccuauuucaaccgguuagggggaaaaguuaaccuuuaaauguaccaggaagcucuauagcucauccaauccuuuagcccaggcauacaaaacaauauauccuuauugcagcagugccuugucauuacugcuauggaaggcaaguugagccaggcuguuacugucuuauuuuggcgacaguaagcaacaguauaaacggcaaaaauaguaccuuauauuccauuucugagcacauuaauuugucuuuacaaauuguacgaaccuuucagccagcaugguguuugccaagauuauguauaauuauguauaauuuaacuuucaagacuugacuuggaaguuacuuugaaacaaacagucuaggaaaaugaaaaacuaaaccacucagcaccuauggacauacuaaagauggugacuauggugaugccaaacuucacagaaacaaauucuaaaaugaggacagucuguacuuccugcugauuauauaaaaucacugccaagaaaaacacacuacccguacuuucaaucuuucaauguuacaaccuguuacuauucaaaugcuuuagucacugcucaauucuugccuuaucuaguaauguaaaucuacguaggcucugucugcuuuaaaacagcuaacacauguaagucugaagaaaccaauggguacgaaagcacaagugagcaaaauuaaagagcagaauuguacugaguggcuuuauauguucaucuaguaccagaggcuccacuuuuuuuuccuuugccaacaggccaccaagcuaccccugaaaacuaccauaugccucaaauaguaguuauaaaugcuuauaaguacacuagacuguaagaacuccacuaaauuguuauaggcugguaucuuuugagaugacaccaaaauuaaaauugggagcauuaaaaauaaaacuaaauuuuacuuuacaaacaagagcaaagagauuuggcuaagccuuuacuuacacugccuuccaaagcauaguuuugcugaaggaaugaaugaaugaaugauugacuuuauuacaccagaacaauuuacugucuguucuauagggagggugaaauaagcugaucuuuaacccaacuuccaguggcucgauucauauacaacgagccaguaagaaccuuuaaaagaaaacagugucuuucagagauacugcccuggcauuaguaaccuuuuaacacugcuuggccugccuaaaggggcuggaggacaaaaggcauugggagaugggggaagggcgcagggaggacaaacaacauaguugugcccaaggcauucacuacaacaucauugcugcaggaggcagguguuaucagacacugcugcugcugaccugaggacagucucuccaccgcugcacagccagugaaacuuuaggcaucuuuggauuucugauauaaucuaaaaauguuccauauuuucucuuuaaggggaagguagucaugggauauagcuuuucucagccuacaagguaggacugaaagauaccauuucagucaccuguaccuugaaccuuacacuccaacagaacccccugucccuucaccugggcagacugacaagcucaugcagacauccacgcauggacccuucuccccaccuaccguaagagcacaggcucucaagucagacugccugagcucagucacuuaccaacuaggugaccuuagccaaauuacuuucucauguuuuaugccaggaaauugaauaaaacaagaauuuacucugaagaaauaagagcaaggauagaauuuagauagaaaaagaaaacuaauuuguagugagguguguuccuucuucuccagcaugagucaaaauaauccaguaaguuucauauggguaacucauuuuaaauaaacuucaacgggccacaagcaugauuuguggacugugcaugagcuauuuguggcuuuuuuaagguacaaagugagaggaacaugaaguuuuucacucaaaaaugacccccuagccacugaauacauucaauuugcuuuaggaagcacugaaguaagcuauccuuucucuaaguuguagaacguagaauggauaucuuaaacagauacaugcaaaguuuaaaaucacggccauaccagaagaaauguucauuaacaacuuauuuaggauuuauagaaacguaccucuuuuguuugauuugccuuagcaacugcauccugugucaggcgcuccugaaccaaaauccgaauugccuaagaaacccaaaaauauuuuuacuuuuuauaggcuguguaccugucauccuuucuucuaugagcccagagaauaaggaugcucauuuugaugaagucagaauuaccuaaguucauuaauaaacuccccauuaaauuaaaaauaaaaaaaacccacuaauauaacguaaccuuucacacuucuaguauuuuaauaauguugaauggugcuugcaacaauuaaaaccauuuuuugaauagguaaugcacgugacugguaaaaaacaacuuuaaauacagcaagacacaugguaaaaaguaggucuccuuccuaccugagccuugcgauccccuacagauuccuuacccucacuaaaacugcgaaaugacgagcaugcuuagcacgaauacacauuuuugacacaaaggguagcagaucauacauacugucuuacacuuugcuuuuaucacuucacucuaguaaaauauuuucaaaccuuucaaaggacaccguuggugguuuuaaucaccaaggcauuucauuaugguaggcaugcaugcaaguauccauacacacuuaaaaaucaaauuuuaaaaaaauggaauuuuaauuaggaagaugacaauuacaacucaaaaauaagugugaaaacuuaaacuauaauuuuuaaauaaaaaaccaaaugcuaucuuugaaaaaccgaauucaaacaauguuuaacaguuauugcagauguuauuaaauagucugguugccaaacaguuaauauacugaugcuuguacuuggcaaacguacuaagauguuuuccauauuauguuauuguuugaaugccucuuaaaauaacucaaaagggacaaaugugcagcaggacuagaauuuuauagcauuuuguuguaguugauuuauacuuuauccccuuggguuuugaagucuaacaaaagcaucccaaauacgcuaugcauugucugacucuccucucacuuacuuuaugauuaaagcugacaugaucacuauagaacaguuccaaggcaauuuacauaauugucggaauaaagaacaagccuuugaaauagcuaaauuucacuaaaaacauuuuugucuuuuggcaugcaaucuggauugagaaaauccaaguuaacauucagauucaguauagaaaauuuuaauaacuuaggaauacaacagucuuguuaaaacugacauuuaauaauaaaaaucuaaaaagcaugguaaguuauggcuuaaucucuucuggguagagugauauuuaucacaaaguaguuuacaugcacaaggucuaguuaaaagcuuuuaaucucuuauaaaauuuccaagucugguaucuuaaguaccacuccccugauccacaccacuguacuuucacgauuacuaggaauaaaucuucugaaguuuaugauuucucucagaaacaagagaccucuuucagauuacugggauuccugaaguauaguuaugaacugaguggccuaucuagcaucggggacagaaagauucauuucucaaagagauuuugggguuauauauuuuugaccaaauucaccauuacucauuuggcauuuucgaccaucuuaacaaaugcagacuaugaaucauuaaaaagacuaacuaaacagaaguaggguaaugugggaaaaacaauggaccacaggguuauagugcuuaaaauccuggcucugucauuuucugugucaucuuagacauuauccucauugagucucaguuucuucauaugauauauauuuuuaaaaagauauuagcagcugucucuaggauuguuggcaggauugaaugagaacaucuuugcaaaggauuuagcauagugcaggcagaaaacagaauccaaaucagauaaaaccaugaaaucuacuuuauguuucauauucuucuguguauuuuagucauucaaccauaauuuuaauaucaauaguuaauauuuagaaaauaaagacauuuuucuaugugcacaguuucugucaagaaucaagaacaugaagcugaccuuaagcauuaccagguaaucaucaugacgcugaaucugaagcagguuagccaaagccaucacaccagccuuaaaaucaggauuauuuacuauaaaagauuaaaaacaaacaaaaacuuacaacccugcaaacguauaauuacaaacauauuugugaacauacaaaaacauuuuuaacuuuucgguagcaacaaaucucuuaguuuuuaaaacugcuacucacaagagaaaaaagaaagcccuguagacuaucaacaauuaaauaaauugguaagauaaaaugguuuuccuauuacuguaugagacgguccccaacuuaggaugguuagacuuguaauuuuuugaccuuacaaugaguucagugggauguaacccuagugcaagaugaggaaaaucugaacuuacagugguuccaacuacaauuuuucagcuuuacaaugggucuuccgggguauuaaaugcauuuuugacuuaugauauuuucgacuuugggacaugaucucauccuaagucaaggaguaucuguauuucaucagccaaacugaauaauccaauaaaugacuaauuuaacucacauuauauuuguccuguaacuuuuucugcaaggcuaaauuauacagcacuuuuaauuaacauuucuucccaaggccauuaauuuuaguacauagauccccuccauggauaguuuucccaaaaccuucucucuaagcagcagcucuggaguguccaagaggcucacucauucaaaaggguuaacuccuaaauuauaggucacaaugaauuagccagugaacaaauauuuuacacaucauaauuuagguaauuagauucuucauauuuuuaaaaagggaaauuacuaaaagauauccaggacuuaaaauaauggaaaauuuuaccacuugucugauagagucauuggauuaaaagaaauuuacacauucaaaaaggcaaacaaugacccccaugauuaaauacaaaucaaaacuccaaauuacuagaagcaaaucaaaucaacauucagauauucaaaugcaaggggaaggagaaagcacaucauaaaaacauuauagagaauaaaauguuaacauaaaugcugucugcauggauccuucuaaauuuacuaaaaccaaguaaaccuggacuucauucuucaaagaaaaaaacauuuaaaaaaccaaaaauguugauguucaauguuaugcauuuauauacucaccauccaaauugaucaaugguucugcauuuuuaguugcauugucagcaguuuuugaauuaucagguacuaaauccuuguauuuuucagcuauaaaaacaggcaaaaauauaauuuguacaacugcaacucaagguaaaaugacuacugcuauuuaccaaauuuaacugagccaaaaugauuacagguugaguuucccuuacuggaaaugccaauaauuuccaauuuuaaauuuuuucagacuucggauuaucugcauauauaaaaugggauauuuuggggaugggacugaagucuaaacacaaaauucauuuuuauguucaauguacaacuuauacacauagccugaagguaauuucauauaauauuuuuaauaauuuugugcaugaaauaaaguuuguguuaagugcuuauguguggaaauuucuacuuguguccucaugucagugcucaaaaaguuuuggauuuuggagcauuuaggauuucagauucucggauuagggaugcuuaaccuguauaagcauaaaacaauucauucaaucaagcuuaauuuuugcuauagaaaauguaaaaagacaauguaacuaucuuuuugauuaagcuaaagcaauuacuggacuaugugacacaaauaucuuuucauuaacauuucuaaaggcaaucauuucaaacauguaaauuuuaggaagguaaaaaucugcuuuuacagcuuccucugaaaucugggguagaagaaugggaggaggguuaaguauagguuacguaagauuaaauacaaacucauuaaaaaguacgcuuccccccaucuucuuuugaaugcuguacauaaaauccaaaaaccuugcuuuccccaaaaaaaucaauacaucaaauacaccaucauauacaaaccucaaacuuauuucauggaaacuugaaauucagaauuccaaagguagauuuuauuauuuucauuugaaaaacaauacuucaaaggaauucaaaaauaaaaacacuuauuaauaauucacuaaacuuaauguucaaaauggcaucuuaggcuauacagugcuuaugggaucuguuaaugaaacgaggaaaaaauaaaagcauaaaauuuaagucagaguuaaaaaggcuuccacuggccaaaucuggaacaguaucaacagcaaaauacgugaugacagaaaggauuauaauccauugaauaaaauaaaaauccauguaucuauacugauuuaaacaaguaaauuagagaugggaaaacuuacaagagaaagccaacaaauaaauguagaaaaaaugaugaaauuagagaacaccuuuugucgauuaacauaauaaaugacugaggcaagaaucaucauaugguugcuaaaacuagugggggaaacuugaggcgcaaaaacauaauugauacagucucaaaguaccuccccacaagauauauuuauuacaaagaggaaaauaguaacuuuacaguggagaaaccauaaccuagugaucaaaguaacauaacuaguaaugggacauaucgcuaucacguaucuccuaauaugaugcacuaaaaagaacacaucacuucuguguuacuccuaacaaaaguauaaaccccaaaucuaaucaugaggaaacaucauauaaauccaaauugagggacacucuacaaaauaaaugucagggucaugaagcacaaauaaagacaggaacuguuccagauuuuaagauacuaagacagauguaacaacuaaugcggugcauaauccaggauugcucuggguuauuuuuuucuuucgagagaagugggggguuugguaaaaugugaauaaauaauaguauaucaaagauaacuuccugauuuugaucacuguacugugguuauauaagacaaaguuguuuuuaggaaaugcacuuuaaaguguuuaagaguaaaaaggaaucaucuauaauuuacuaucaaaugguuuggaaaaaaauggugugugccucuguguagagagaaggaugaagcaaaugagguaacacgcuacauuuguagacuugagguauaugaaaaucuuuguacuauuuuguaauuuuucuauacaucugaaauuauacauuuaaaaaauuucaguuauugaucauguugacaagcuaccaaaaggcuucaaaaaauaguagagcgcaaauaauaaaaacucacaaugguuucagcaaauuuuaaaauaaguaacuuaaaagucaaggaggcaacauaucaauguaaaaccacaaaagaacaucagcgccuccuaccgauuagagacaguauuauuugaccaauuuucaagucuguuuuugcaauucugaauuuuaauaaacaaaacuuguuuucuagcuuagacuuuuaauauacuuuugauaccauucaccuucaaguauauguugacuuccuuuuucaauauugaaaaauuuacauuccacacacaagcuucuuuuauucacuaaaagaacaugcuauuacugagaaauacauguacuuacuaaagucaacugcagguauacaugaccauaugcaucuaccauugaagguuaacggguuauaaaaauggaacaaauagaauaaaacaaauaaacugagauguaagaauuugggaauaaaugaaaaacaguuuugauaagcuacaaauuggcucauauacaauuccuaccaauccagagcaggguagauaaaaagaccuuguuaaaggcccuaaaaucaauacuacacuaaagccauaaggcuuaugaauacauguauuuucuaaagaaagaaaaguuuuuuuuuuuuaaauuaaauggaaaaguaaacgaagucucaaauugagcuuuccuuaagauuuuugccauaaggcuucugaaauuuaagucugaggcaucagcaaaaaauuggcugaugcuccaaaucaguguauguaaacacucacauauacugcauucgccacacauuacugaaauugauaagcaccuguugugugcaagaaacuaugucagguacugugacagacacaauauugaccuguaccccccaagauguccauguccugaucccuggaaccuguguauguguuaccuuacauggcaagauuugcaaauaugauaaaauuaaggaucuugagauaggggauuauccuggauuauccaggugggcucaggaggaucagagccagagacaaaguuaugacaauggaagcagaaucagauaagagacuggaaaaugcuaugcugcuagacuugaagaaggaagaaggggccagagucaaggaauucaggcagccucuagaaguuaaaaaaggaaagaaacagauucccccgagagccuccaaaaggaaccugccuugcugacaacuugacaugaacccagugaggcuaauguuggccuucucauucuaaaauaauaaauuguguuuucagucacugaguuuguaguaauuuguuacagcaucaauuggaagcuaagagagguaccauguaggaaucaaagcugaguaucaguuuacaaauuacugggacgaauaagacauagaagcaaaauggaaagugguuaaugacuuaaaauguauaggguuaaaagcuauggaaguucagagggaaauuauacugcugcuaagacauaagacagcauaugagauggaucuuaaaaagauggguaggauuuagauguguagauagaaugaaaugguauauuagccaagggaaaagugugaacaaagaaacagagggggaaaugggauauaaacaggaagcacuauuauucuaauuuagcugggaugucaagaugugaauacagguuggauaucagucaucauuaacuaccaugcuaaggagcuuaaaauucuuuuuauagaaaaugggaaauuaguguuuauggauauguauguuuauuaauaugaauauguaacuggaacuguucuuuggaaacaaggaguaaguugcauccuaaaauagauuaacguuucagaaaguuagcuugguuggccaugcaguuaagaacagaaggugacacuaaugggagauauuauaauacuccuggcagaaagugacaagagccugaauuaggauuaugccaaugggaaugaagauacaacaaacaugagaaaaagucaguguaggugggaugaagggaaagggauaagccaagauauaaaaaggcuuccaaaguaaauaauuaagaagacuguaacuaaccgaaaaacacaaaaugcaggggaugcagauaagauaaucaaaucuugcauuuagauguuggcaggccuuucaaaaugaaauggucuaauaagagaaaacacccguuuaaagaaaaauuguuuuuacuauagguacuaacauucagaagcuuccaaccauagaaguaucugugcuaagacaguaaacauaaguaauauauucuggccuauagaguauuaauguauauuggcauuagacauguuucagucuuuugagaaauuaccuacugcaacaacacuucaaagucccaucaauucugggacacuaaaaacaauuuaauuugaaaggcuaaggugcagaccauauuaucaaaguaguguuacucugugagaagacagucaauuagccuucuccagagggcaccauuuccaaauucuaacagaaauauauaaacaccaaugaaagacaauaaaagugcuuuuaacuugugauaagaauaaaccaaagguaaaauaguacuagacaaaacaaacugcaaaguucccuacauuuucacacucccuuucccaucuuuccucucucuuuaaaauacacauuccccacaaaacguaccauuaucuccauauucaagucuaacagcuaaaccaagaagccagucaauagcuucuugucgaucuugaaucuugaaaggacaguuaacaucucugagauacugugagggggaagaaaagaaaaccaccaguuucauuauuaccauaaagucacagaaaaaagaaugggagaguugaaagagaccuuaguuuggaucucuaacaauuuuuuaauaacauuacuacacuuuugaugcaauuauauaacccaacagaagggaacauuuaaguguaucaucuuaagaaaaaaaauagaauacgacaacuuccucauuuuauagaugagaaagcugaggccuagagauugacacuugccaaggguuacacaacuuacaccugggacuagaaucuaagcuuucugauuccuagucucaauacacauagagcaauuaacuaaaaagaauaacuuuaaaaaggauauacaauaaaucauuaucuaucuaaaccuuaacuuucauauuauggaaaugccacugaaaagaguagccauguaacauacauguaggguguaaccaaguaauuuaaauaaaugucagaagcuguauauucaaauaaauguugcauauaauaguauuauauguaacauuaauuauauguaauauaagauuauaauaaaaucaacuugaaggauaauaacuguuuagguucugauauguugaaauuauucuuacugucauuccagguguuucacaucagaaauacguguguguauauguacauauauacacacacauacauacauauuucuuuuuuuugagacagagucuuguucuguugcccaggcuggagugcaauggcacaaucuuggcucacugcaaccuccgccuccugaguucaaaugauucuccuggcucagcccccugggcagcugagauuacacacaugcgccaccacaccuggcuaauuuuguguuuuuaguagagacgggguuucgccacguuggcccggcuggucucgaaccccugaccucaggugauccacccaucuuggcuucccaaacugcuuggauuauaggcaugagccaccgugcccagccuagacaauuuuuuauauucuccagauaccuuucuacaugcagaauucuguacugucuuguacacaugaauagaccauaaaauguaauauaaacaaacauaaaauccuaaaaauauauuucaaaguuuuaagaaguccacugaaaauuuuaaaaauauuuucuaagagcaaaggaaaagaauacaguaguauuaauaguaguaguauagaggcauuggcaguaauaagcuuaucacacuugcuaugcgccagggacuucugugaacaauuacucauuaaaaacaaagccacacuuaugagauagguaucauuguuacccucacuuauugaugaaaaaauugagacacggaaagguuaauaacaaugauguaauuuauacaaucccuaauuuauaaaaucacugauucuagggagaaagugccuaaucacacugcucucgcaaaugaaaaacuuagccuuuuucaagaaaaauaucucacucaucaaauauaacugaugaaaauguuuaauguaagaaaugacacuaaaagcauuuuuauucuaaucugagaauucuuuuuuaugcaaaaguguuacuaaaacuaaaucaaugggaaaaugauucaaggcacaaaaauaugauauaccagagaucauuuaaggacuauuucccuagcauacaacaagggauaucuguuuacauuaaauauaagcauaaacacgacagucuugguuuucaagcaucucaauaaugucuuuuuuugagacaaggugucacucugucgcccaggcuggagaaccucagccucccaauuagcugacacuacagacacaggccagcacacccagauaacuuucuauuuucuuguagagacaggguuucaucauguugcccaggcugcugucagaacuccugagcucaaaugaucugccaccucagccucccaaagugcuggcauuauagguguuagccaucacaccuagccaaugucuucuuuuaauauaagaaauaguacuguguuuaacaaaaauucugauuugggccauaaagggaaagcgaaauauuuacaucauuauuuauuuaagaaacuucauguuucuagagaaaacuauuucuaccuaauacugaaagcuugguaggaagacauaaaauaauuugcucuaaaagcaaaagacacaucuaagaaaaaagcaaaaucccugaaauccagcuuuccuaacacugaucauuaucauuuuuuucuuaaaagaagaaaguaauuuuaagcucaucuucaugauuuuucagacaaacucucuguauuuuuacuuuacuuccuaauucauuaccuuuucaaagaacuugggccagucgcugcuguggauguuucuuaaauucccucugucuucaaucuuguagugccugauuuucuggucuucaagccaaacgaugaaguuucuaaauucuguuucaucugcaauaaaaaauaucacauaaauaacuagaagcacuacauaaaauaccuccuucucagguauauguucagauauauguucuuguggaauuuucuuaacuucaaaauacuaaauuaauugaaccaaaagagggaguugaaaguacagauucuggaguugaaaguacagauuaacaaugaucuguucaaauccuggguccagauacuuacugguugugugaacuugggauaaucacccacauuuucugugccucagacucuucagcuacaaaaugagggugcuaauagaacuuaccucauagaguuaugaagauuaaaagaaguuguuuuauuuaagaaguuucuuaaauaaaauaaauacggauaaaaacagugccuggcacauaguuuugcuauuuaaguguuacauauuaauauuccaguuccuuugcggacagaaaggggaaggagggcaagguuaaauuuauagcaaaguaauaaaguaaaauauacaacaaaauaauaaguaaaagaaauuaaaugacaaaaaagacacugugacaacuguugucauggaauguuaacugcacauuaagugcauaauuguuucguuuaauccuccccauaccucuuuugagguagguaauaucccauuuuacagauaagaacauugagacucaaagauuccaauccagaacaaggcucuauugucacugauacuuuuuuguuaaaguagaaaaacaauagauuauaauuugauaugcuucuacaggcgaucaacaaaacacugucauccugcuuagaaauuauuuucaauuugugagucaaauucaagcuuccauuauaaggucuugagaauuacacaguggucugaguaucacaaguuauacuugaucacuuucaaacuuaccagucuaucacaggccacaacuauacaaaggaaacgaguagugguggguagcaguuuaguuacagugaguagcaacguuauuacuuuuuaaaauucuaaugcuguaaaaucccaaauaccuuuguauucacaauucaaccuucccacucaucugcuauuaacuuuuuugcaacaccacauaacacaacuagcccguuacuacacgcgcuuacccucccacugugaucgguccugauuucauuguguacugucucaaacugcucaguggguucugauugcuuccaccccucgucccuuuagcuccuggcaggcagugaacuagucuucaaguuacucagcaccuuccucagaauccagcaccgcgcuggcccauaauuagcaggugcucaagguaucgccuaauuacccagggaaccauggaguugaauagugagugagaaagacgaaugcucucccuuuuauguacagagaagguaguuacgugaugcuuggaguuaagcaagugcagaaaguaacaugccgagacaggaguaggugagagggcuuuaaaggcgggaaggggcggcgaagagccgagguacguggcgacccagaggagaggggcccggaggcugccggcggaaaccaggccgccgagggucccgacggggagguggggugcgggcacugaggcugggaccuccgcccaggucagggacacgcggccgggcugaggccgccgccucaccuuugcaguugaagccggcgggguugugguagucgagagccgucaacuugcgucggaacaugguccccgcuucucgcucuggucccccgggccucggccgggagagaagaagcgagguggagcgggaggcgcaggcaccggcgacgcggcgagagggcgggcaggcgcugagucgcuccgaaaugacg

SEQ ID NO: 17451 - RNA, 40541 nt, Homo sapiens
gcugguuaaagaggcgugcggaggcgggcgcggcgcauacugcuaguggcgcgcggaggagcgacgcguggagaagcggcccacgugucugcccagagucaaguccuguguucuucccgcuccuuacgcauccgcgguccagggcgcccuuucagccccgcugguguucgcccaccccgggccgcgugaguggggccccacgcagcuccccgcacuccgugggccaacuuggccaagcaacucuguccggggagcggugcuugcggggggugaguaccgggcacugcgcaugcggagcuccaaauucaaacagcuguuuucagaggcuggagggcgggcggacugguagcagcuggggcuaggagaggcuuucucuaggaggcggccgcucgggagccaugguggaccggggcccucugcucaccucggccaucaucuucuaccuggccaucggggcggcgaucuucgaagugcuggaggagccacacuggaaggaggccaagaaaaacuacuacacacagaagcugcaucugcucaaggaguucccgugccugggucaggagggccuggacaagauccuagaggucagucgccgccuguacccccauauacaucugaagcuggcuugagcuuuagggggcgcugaaaggaagaccccuucacagcuuugggugacccucagucccuguggaagguccagggggugaugagagagcgugucucaucaugggucaggcuucgaggaucugucgcucacccgagggacacaggggucccccaggcgcggagacucuuuggaacuuaguuuggccggagacaaauuggaguugauucccgggugaacuaggcuccacgguguuucagugugggugugacgguaccucccuccuugggaagaggcugugggacggauaaaggcguuuaucuuucccuggagacgcucccggagucugggagccaagccuggugccauccccucgugucuccaccuccccgcuccagggccagugccacgccugccaggcuuuucuuaaggaacgugaacccggcagaguggcgggagggucccucagcccgagccugggcaaaaucuuccgcccccagcagaguuccggagaggagcuggaggcucuguggggcccgaacccacgggaugagggcuggugccuggaaugcuggggacgcgcucaggcuuccgggaaggcuuaucucgcggagacauccuucaagggcuuggaguaaaacuuugugaaaguagcagguugcacaaacgaauaauacccgcguagucccuuuaugaugggggaggagagugugugcggaauuggggugggugggggacuucccuccgugcugacauugggaaccgcuuauuuucuggugcacagcccgauggguggcauugaccucacuuuggauaaacgggcugccuauccuggcugagaccuuggggcccauuuggggaccgaggcccucuaccccaguuucucgagggcucagcuucaaccaucaacucuucuuggccugcucccccaguggaaugaccaggaccugggugaaaguucuagauugcagcagguagggaguagggguagauuguccaggguguuaccuugcucucagggugaaagaugccagaaaggaggucugaugagaagcaacguuuagucuacagcagcaccucaauacuuuaugccuaucuagucgucgcucauuuuccagccuccguuuccccaugugagaaacgggaaugagcccauccucauuccuuauuucugccacggacuguuagguuggaagcauuuggaaaacaucaaaaucuuguccccagauugauggacaucacacagauaagcauauacguauuugcuggcagccguguguggggagacuuguccuccaagggguccuguagaaggggagguuuagucuagcaggcuuaguguuggauuuuaguggagagucucuugcccuguagcaguuucccggguagaggcagaugggaggugaugguggggaggauaagcuucaguagaugguugguugguuuaccuccuaacagcaagaguccuggcaugaagagucuacauggcuuccuucugaugggcgucuacccugggggguguguuguggggaggggguugcuuuaugauuucccuugaggaaacaauuccucuagagaacaaguuuuuguuuaguuuguuccagggcuuuguuuagagggggaagagggcaggcaaggaugauaaagccuugagcugcccucgaaguguuucccucuaagcuguugcuccaacacugcaggggaaggaaggaaagaauucaaggcuaaaugugggaaaauaaacuucaaaacacaaggcaaagggaaaggcuggcggggcauacggcggggggggcgggguccagggguuaggcagccgggugcagcugguggucauagcuuuggaggcuagacggcuucuuaagguauuugaacaaacaaaaugccucuuauuuagcaguccuguuaaaucugucaacauuuaccccccuaccaaaaaaaaguaaugggcagguaauuuuuagaaaaaggacuugggcaucaagccagucugcuuuggaggcuauuauagauaaguucuugaacaaggacagcccuguccucauccccggccaaagaaacucccaaaccaaccccaacugggcgagucccuucccgucauaggaaaaaccccaagaaaugaaaauggacaaguagaagcauuugcugacaucaguuuuaaucugcagaaaucugccuugcucugcuuucuugugacuugggguacugccucaggccucaggauauugguuuaaggaaaaaugaaaacucaaaaaucuucuuucccaucuggcugcuugggcauuuuccaccugacgcucuguguuuuagcugguucugaaucaccuuggaaucaugaaggagccccuagcuaggaauuccugggguacaaccaggggugggacaaagauuguuggaagagauggggugcagucugaguugggguuucucuuacccugaaaguugugugugcucuuucaaaugugugagaaagggaguuaagucaacuuucuuuagaaauaccccccgaauugucagauacuuccuucccuccgcugugguugaagugaggugcaggcugacuuucaagugcucagugacccgccagccugggaccacgugaucguccucuuuccugucuucagaaccaucuugaacccuugcucucaagcaagaucuuuggugacucauucucccaaccucuuccuaaauugcagacucacacaagggaaguuaacauuuacagcacaccuacucuguguugggcauugugggugcuauuauccucauuuuaugagagagggcacaggcugguuuugccaucuggcucggccauuuacccaucaagccauguaacuuaacuuugccuuccuuuccucaucugcaaaaugaguguuuggugaggcuccaauagaguagaaacauuaggcaagaugucuauaaaaagugaacaggucuccugaccuuagcauuuauugaggaaggcagcuuuaccuaccugccuuauuucagguacucuuuacaguauguauucaaguaagcaagcugaagcccagagaagauagaauggccacagggacaccacaggaggcacagccuauggggcgggacggggaggggcaaugaccaggcagucugccccaggagcuugcaccucccucuugggccugugaagauuguugcucuguaacugagcuuaggaaauugguucagcuggacccugaucugcuggaaaauucuauuuucuauuuccccuagcacagguaauggcauacaggcgucuccuguguuguugccuggcugacccagcaccucuguuacugaaguaauacaucaguccaccccucugcgcuucucauuuuggaaguccccaaccccugucccaccaaaaacagugggggugugauugaaggggaggaaggacagcccuucucaaccuucugccucuggugggcagugaucagaaacaggaaggauuugagagcccaccgugcaccagaccacuuugaauaagcacuuuauauacauucuuauuuuaauuuaaucuugcaggccaccucauaaaugaggaaaauuaggggaaaagccaguguaacuugucugggaucacauagagcggagucaguuuucacaucuaaguuucauguuucaaaguacauggaaauuagcaagcauuuauuaaguauccaccaugugccagacacugggcaagacucucaggauacaaagaauuaggcuacacuccgagcugcuggagaaaaggauacauaaacccacugggaacaagacagugggugugggcuacagaagagguuuucaggaggucgcuuaacgagggucugguccagccugaggggucagggagggcucucaggagaugaccucaagccagaguggggucuuggauuagaaagaacagcugggaaccugggaggucaaagcugcaguuagccuggauugcgccacugcacuccagccugggcaacagagcaagagcuugucucaaaaaaagaaaaaaaagauuaaagaaaaaaaaaaaccuaacugguaaaggaagggagaagagacuccuaacagaagauggagaguggcccuuucuccuagccuggggaaggcagacugcagguuucuugcuguggcucuagagagucccuugucuccugaggguggagcaggguugcccuagguccugcccucugucuagcaucccagaccaaaguccagguuuugcuugacugcucauauagcugaccuguucccggaagccucuuggaucccacuggccuccuuccuuccuaagcuccaaagugcuuucuuguguucuaagguuuuccauauguaccuccuuucauuuucuggacccuuuggacuggucuauacacacuccaguccaaaguaguaaggcuaguuccaauuuugagguucuggcacucuuuuaacaccaauccugcuccccagauuugaaaaauaaaaccaugaaauauaugacaaaauuacauguggccaaaaugcuuagaaugggguacauugaauuuuuuggaaaguugaggguuaauauaaacacccucuuugucucaggccuuguuggaaauugugaaaugcacugguccacuuaaccgccuuuguaaguaaaaggaacacaauagcucuuuugguuauggaggaucuuggaggccuccacagccuuggguccgagcuugaguucuuacuggcuaggacugcagaaguggaaaguggauaagcugguuuuuugagaggaaauugaagaggucccuuccuaauggcuuguuucuuauuuauguuccacucaaaaguugaggguagccaaaaaaaaaaaaaagccuuagucugccuuaguuaacugcucugguuagaguuuuuuaacagugaaaguaaauguuuauuacauugcuuugagcguuugacuagaacccuuaggaugauuacagauggcacaguaauagagaauuauugaggguagaaauuagcaaguguugaaaguuuccagugggggugggggaugcaaaggaggugaugauuguugcuuuuaaauauuuuccugggguuuugcccuauuuauagucuggcguuuagaagaaacaaaaucccccgguuuuggaugcugugcuuggcuggcccugaccucgggccaaaggcuuucaucuugaacuuggcuguuugcuggcagauugggcucagccucugaacugugugugugguuggugguggugggaggagggagagaagugcaagguuuuggggagcagaggagccaggccccugaguggagccuccaagacagucuuuguccaaauugggaugcuguauuugcauggugcugcaagaaccaguuggccagaacuggggugguacagagaagugagguaggagaccauaggaaagcacaugaaauagguuugccuccuuccaauauuccuuguagggaguggagaagauggaagcgaaucucuuugagauuucauugaguccccagggaccucuggaauaacgcagaggaacccuugccuguucaguucuucccaaguauggcuguacauagagagaggaugugcugcccucaguagggaucuuuguccagcugccacugcggggccuuggugguguugcugaaggaaucaccaaccaagcaguaugucugaugguugugggaguggccucugaagccacaccauaguuugcuuagaauaguguauggcacaucguaaaugcucacuaaguguuagcugccauuucugcuaugcccagauauuccuaugcugcaauggagcggucccugcacagguguggugggaaucuaauugguauuacaaagaaucaggaaggucuuccuagaacagagagaacgucaacugaauuuuuuaaacgcaaaaaacacagaaacauauaauuuaccauuuuagccacguuuaaaagcccagcucaguaguguuaaguauauuuaccauuaugaaacagaucuccagagcuuuuucauuuugcaaaacugaaauuauacccccuucaacaacaauucuucucccucucuacccagccccugggaaccaccauucuccuuucuguuucugugaacuuaacuacuuuagaugucuccuaaguggagucauauaguauuucuuuugcuuuguacagugguacaaccacugugaaaaauaguauggaguuuccucaauuaaaaauagaacuacugagugaugcagugcuccuacuucuggguguguaucaaccaaacuucuaaagaacuagaaaagggauggggaugguggcugucucuugcccauagcccuuggggagguguucugcaggauggacccaacaggcuguagccacaggccagggaggugagagucacaugacuaagcucuucuggguugccaaggaauuugaacuccaucaaauuuuugcaauuuucaaguaggggagggaacaacauuucagaaaguuuccuccacagccauuuacagcuuaaaagaaguggaacauucuacucuaaaauaacgacauuucugugggcugaucccuucacucuguggguguucugauaaggacacccccuccuuccuuucuccugcugaugugauguaguguggguuuucccagaaagcucauauugccuacagcccccagaaaaacccacugaccuucacacucuaguucuuuuccuacuacgagccccuuagguccaggucugggucccuggcccagccaaagacauuccgucucccguuuggugaccuucccagauugcaucuucgcuaucccuuuauguagaaguggggguggugugcuccaguuguagcucuguucagcugccuaaggccucuaggcuucuggugagcaguuaucccaaucucugaaccucagagaccuggauacaguggaguuggaaacacagaacgggcccucccuacuggcuauccuuucugugcuugaugaaaccucagauauuggagagucuuuaacccucuggagaucagugcagcugaggaaagauaauugggccgcaguggugaaaugagaggaaauacaguccaaagugcucagugguggguuguagauggaagaggcuggagagaugggcaaauguugaaggggcuggggggauucauuuucuguuuucugaggccuguagccaaacuccuuggccuguggaagaccuggcuccaaacaaaacacagccccugcccucagggggccccuaaccuggaggaagaauaguaaggagcugcuaccagauugauguugguaagugcaccuggggacuccaggugugcaccagggcgagagaugaauuuuuacuucugcgcuuagaagaaggcaggcuuggagggugaguggcaugggcaguagcccugugagcauucuguggagugccuaccaggugccagacauugggcugggauguuaccugugucuccuugaaccaguuuugugggcuagguauugcuauucccauuggacaggaaaccagaggccaggugacuugccuaggucuacacuguuggauagaggacugagauugaaucccucuuguugacuuggaagcuucggucuuguccauaaguggagguggagucgggggcugggagugacaggcuugggcaaccaauaguuacaagcacuuacuuggccacaggcugugggggccacaggcugugggagccacugaugugcaucaucucacugaaucauggcagccacccucugcaguaaauucugugaucagcucgaccucacaguagaagcaacagaauggaccauagagauugaauaacuugucugaggcuauguagcuaggaaguggaaggaugagguuuugaacccagagcucacacugugaacuauucucuucuaugugaggcuaccuugaagguggggcaaagcagggagcaaagcauagaggcgagaaagugcagggcauaugugguguccucagagucuuagggugcauggggcuaagaguucaggauacugagcugugugacuucauugagcuagucaucucaucugcaaaaugggauaauaguacgguauguccgucaugcccauagggucuauguuaacauguuaguguguuuggcacauguaacaggugacuggcuacguauuaacugcuguuccuguacccaguuccucuguguacucugucccugacaccacccugcaggacccaucaugcagugagcuccuaaucuggagauggggacaagggaacaugauaaaacccaucaaguuucuccuacuggagucagucacccacuguuuucuguguccugcaaauuaaccaccuaaaacaguugauggucaacaccuaaaaauagggacgguuuccuucuuucucucuucuagcagggcucugcucaguccuggcuugucccaggccuugguuaaaaauuuucuggagaauuccugcguccagauggucucauggguauucuccugggaugaugguuacccagggucugggaucagagcugggcccucacucgaggcagacaccacccaccuccccucucaucuuugauuggcuuugaaaugugcauucuuuuuccucuccuccaucuaaauauuuggguuuccugcugaaauauuuaggcagggcuguguacuucuggcuguugucaccucccgugccccacuguaaucuggcugcagcugcuuagcugggccccugcuaugagcggggaugcuugcccccugagucugggagagaagcugugcagcugguagcaggacccccuuuguucaacgguguagucuccaguccugcagggcugccaggggccuuguuggccacacuggguggggaggacacagcagagcccccuuccauuugucugagugcuucugugcuuggggcuagggaugaggaacccucaucugaacuacuguguagcagaaaacugauucuaaccuguguucuacuuuuaccuguacuccgguuuaugcugugugccccuggccauauuuucccucucuggacucguccauucauucagaaaggcuuggagugcuaguuagguccagcuagaccauuugcaaccuucgugggcaguggccaugucuucccagcccugggccuguguugccaggccuagcucucaggaugcucagugaguguguggauuucagucuugcucaguuuguuguguccgucuguccagcacugugcucagcucagggggaugccaaaagcuguguggcccuuuugguuggaagucuagucagugcagccaagccucuugcaaggucacagcagagugaaugaagccaggugccccaggcccagacucugguccuuggucucacaggcucuaagucauggaagggguaggggugccauuauuuuauuuuuauuauuauuauuuuuugaaacagagucucacucuguugcccaggcuggaguggaaccugguuaaggacagguauucaagucacaccugggauuuaauaccaccucucugccuuuacaaauugugaggccuugagcacauugcaucaucugaaaauggaacuaauuauaccccccucgcaagaggaaaugccuguaaagcucacucagugcagcuuccagcucgaggcagccuucaagaccagcuuauuguuauccucuccccuuugagggagggacuuuacagaauaaacugcucucccugccugagucuguuuaucuccaggagcccccucuucuucuuccccuaucccccaucccuuguuccaucaacuuuucccgaauuccuuuccccugugaaauaaggcccaggcagcagaggucagcaagaguacacugagcaggucugcccuuggugcuggagggcagccgugguuuuugcuuucaaggaacuugagacagagcaaaccauccagcuccucauucagcagauauuuuacuaagcacauacuguguguccagaccuguucaaggacugcugcaagagaaucagcccuggucccugccucucuguggaaaccaagagggcaaguuggacgagcuggggcaggagaaaaacauccccuugacccuuccuugugaagacuucuuuaauuuucagaggcuucugagaagugcaguuggcggggaggcccacacuguuugcaguggagaagggcaguucccuagcugggggcaccuuuggcaugacuggagccugcaccacuccagggggaaggagcagaaguauuugcaggguguugccagcagcaccagguacaccacccaguccucuaagaggcuugcagcuacacagacugugcucgugugcaucccaaccugcccuuaccaugggucucugcggacccauucuucugagaccucccuucuaugacuuuugugggccugacucugggaggucuggcagccaaauggaugccaucccauucacuagauggggacaccaaggccuggugaggauuagcugggggcagaacagucucuagaaccaaguucagauuacucuaacaacacggccuacccagauccaggccuuucuucucugggucauucucacuuuauuucuaaucccuuuuaaaauggcccauaggcugggcgugguggcucaugcuuauaaucccaccacuucgggaggccuaggcggguggaucacaaggucaggaguucaagaccagccuggccaacacagugaaacccucucucuacuaaaaauacaaaaauuagcuggacgugguggugggcaccuguacucccagcuacucaggaggcugaggcaggagaaucgcuugaaccugggaggcggagguggcagugagccaaaaucgcgccucuacacuccagcuugggugacaaagcuagacuccaucucaaaaaaaaaaaaaaaaaaggccuguaagucaaaaaagcucuugaugguauuuuggggugcagacuccuucuacuuacacuaaacugaccuaccugauuuccuaaccugccccaacacacccguuccugugaucuugagcaccagcuucuccucccacuaguuuuccagauaagaggcaaaaguugaaauuguguugaaccccaggcugggaaaggaggauguuuuucugggccagccagggccucaggcagaaaggauccgaugccucccugcuccccagggagucucuccagcccuggacuuugcuccuccugcgucugcgcccaaggagcuguuggcugguuucuccagccugucuuggagguuggcaggggguggcucacgcucugggcauuucucguggcggcaaaucauaaaaugugaggcuggagggagcuuagugguuauuuaacuggccuccagccuccugagucaaggcccagaccuuuggagguuauguaacuugcccaagguuacucugcucaccaggggugggggaaguacaauaaaagagcaauuagagcuaagugggggcaauuagggaaggcuucuuggaagcagugccccaaagaagagaugagcugaaaggggauugccacguguccuaguagggcucccaucagaucacugcuccagcagucaaggauccugacagugagaucgugaucucaaaacucagaagacccgccagcaucuccuccuuugcccuuagacuaagccaaagcccuggcuguggcccugagugauuuggacucugcugcuugugugaucucgccuuucuggaccccugccguugaucccagucagccacacuacagacaggaaacuccaggggccagcuccuaacagaggagaggcauuccacaccccugcacacuaauagccaguuucuuuuucuuuucuuucuuuuuuuuuuuuuuuuuuuuuuuuugauggaguuuugcucuuguugcccaggcuggagagcaauggcaugaucucggcucacugcaaccuccgccucccggauucaagcgauucucccaccucagccuccgaguagcugggauuacaggcaugugccaccacacccagcuaaguuuguauuuuuaguagagacgggguuucuccauguuggucaggcgguucucgaacucuugaccucaggugaucugcccgccucagccucccaaagugcugggauuaggggugugagccaccaccgcgcccggcagugaguuucaacuuuuacaaagaacucaacguucguauccacugaugacagaaaggacuuugggaggugguagcaaggauagucacaccagccccgcaugacagccguaacgggagcugccguggccuacaucaugucgacuucccaacaaugauaagugacaggcacuguggggaaccuaauuuugcaaggcaacugaggcagaggguaaguaacuuaguggaggucacauagcuaguuaguggccugaacccaggcccucugaguccagagccagagcucugcagcugcaguagaggcugccguauccuaaauugcugccagucuuucgaaucuugcuaggcuacaagcugcuccuugagacuggguuuuccacacacaccccaucacucccagcacccaagaagugccccgugcgcguguuagcuggccccuuugcugcccagcucugcacuguucagucuuccagguucugacaccaaaguacugcuguuuucugaccacauugaccauauauaguuuuuuuguuuuuguuuuguuuaguuuuguuuugagauggagucucacucugucgcccaggcuggggugcagugguacgaucucagcucacugcaaccuccaccucccagguucaagcgauucuccaguuucagccuccugaguagcugggauuacaggcaugcaccaccacacccugcaaauuuuuuuguauuuuuaguagagacaggguuucgccauguuagccaggccggucuccaacuccugaccucaggugaucugcccgccuuggccucccaagguacugggauuacaggcgugagccaccacgcccggccccauauauaguuuuguuugacauuuuggcuauauaaguggcugccacagcucagaggugggguuguuaacucaauccccagccccucccccuacgacuauccugacagcccuaagaggccccugacuuuuguuuacugcuucuaacgccugcugcuugacagguuuguggucaggggacccugagacuaaaacccccaaggaggaaucacguaagggagauagaauugccucuuagcuguguuucugucugaccugccagucagcuaaacccaugcugugucacauccacucauuugguuucccuaggguuaaccucuagcuggacuguggucugcaccuugggaggguaucgcuuuagucuugcccacauggcuuggaacagguuauucuguagcaugccaaggaccucagggcggggcccuuuauggauguuuauuuuggcuuggguacccuuugugucuaaugcaagguuccugcuccucucaugcccccagugcgggauggagguaggcaccuauucacagacucucuggaggagaaagacguccauccccuaccuucccuaucacuccuguucaaauaaaauucucaccucccgggcaguggaaugcauccugacaguguuagcuuuggaagggugcccuucucuucucagcaucccugcccccuucagagcagcgaguggaagggcugccucucgccaaggggauaagugcugagugggcgaaguggggugagccgaggcaguagugucuugucagcaccccccggguuagcaggaaaagggaggguguccugauuaacagcuuuucaacaccucaccucccccaucuuccagacucuagccucagcccugcaauccacccaaaugcauggcccagagaguuggacucacccacaguugggagacuagaagacagcugaguccugggccagcucugcugacuugcuguguguuuaggccaggucacugcaccucucugagcuaagcacuuguucaauaaggccaauuaaacacuuagugcccgcuguaugcccagugcuggauuaaggguugugggaaugaaguacuggacaucauuucugccuuugggguuggugggaagguaucaccaugcaaugcauauuaugaauugagugggguuggggcauauugugagggccugugugcuucaagguagaaaaguuccuguaggcuugggcuguuuagguggcuccccugacccuggccuggggguugccuccuuucuagcugcauugcucucuaggcuccccugccccgugucagaggacauugcacggggacuauugccuggucugcacccuucucugcccucccucccuacaagcccucgguuuuuaccugauuggauccgaaaccuagcaccaagcaugaggguaauuauuaaugaauguccugaaccaugaagccguguuucucucucuccuuuguccugucucccaacagcccccaagcccagaggcagcaccaacagagcccuccucugccccucagcugggcccaccuccugggaaacaaucuggaaaacugucacuagccccugcaguggguguccugccgggccagauucucccccaagccagcagaugugcuggugcugaccauaccccucugcccgucauccaugcagugcccuccuagcuggggacacucugcucuguuuggacaggucaguagguugccuggugaaagcaugugucagcaucacucugggagcaugucuaucuaaacccagggcaggcucccacagccgaggcagguacuuuuggguccuguucuagaagguuccugucaccaccaaccacacuggaaauucagaguucacagaacucaguuuuggcacagccucucuuuuuggaaugcucugagacugagagcugcugcauauggucaaacccuccaucuccaccuacccaccguugggguuauuguguacacaucuuuuuuuuuuugagacagagucucacaccaucacccaggcuggagugcaguggugcgaucucggcucacugcaaccuccaccuccuggguucacgcaauucuccugccucagucuccugaguagcugggauuacaggcccacaccaccacacccggcuaauuuuuuguguuuuuaguagaaacgggguuucacuauguuggccaggcuggucuggaaaaugggguuucacuauguugaccagacuggucuggaacuucuaaccucaugauccgcccaccucagccucccaaaaugcugggauuauaggugugagccaccacacccagccuguguacacaucuuaaaauuuucccuagacucuaagcugccugaggccggcuucccacccguguauacacauucuuacaccccucuuccccacugcucugcacacaauuuaaucugugcuuauugaacuggugggcucuggccuguggcaugggagacccuuagacaggcuggaauagggaccuggugcuuccauuugguguuucucaaagugggccugaggcaugaaccagacuucaaguuauacaaaaucaagaugaggagggugaggaaagcaggaagaugcaaguuaaagugugugguucucuccguuaauauugcgucauagaaacucaauuuaaaaacagaagccaggcagggccgaguuggggagacaggauuauugaugacuuuuucuuucucugccucucacauuuucuguaaugugguuguauugcuuuuauaacaaauaacucaauuuuuuaagggauaaaauacaugcauguaccauuacccacuuccacacugguuauuuuuaaugugugagguauacaaacaucugguuuuagcagaacauacucugaaaaccaguaucacuuuuguaaucacuaacaguguauaguugacccuucguaucugugggcuccaaaggacugacugugggacuugagcacugcagaucuggguauccacagggggucuuggaaccaaucccccuccaaggauaccaaccuggauugguucccggggacuguauugaacaccugacugggagaugcucugguccuaguucauucaugucuuucgagccuaguucguucuugucuuuugagucuuuaaauuuagcuagcagacugcuagcuuccuuggcagcagugcuguggaaugcuuugaggagaaggacaagagaaacuaggugagccuuuggucugcagaccaaguuggagguaguauaccaggacagagagucaccaagaagagaguguggcagggccagggacacccauccggcuguuuccaguguugauccauuucccacacaaaggugguggggguguggucugggaggggaguccugcagaggcccauggacaagugcagccuuggacccacugugcucucagcuccacccggucccgugggggcccaagacuugcccuguccuucagaugaacgaaaaacacaagcacaggcaagacuugaaacagcacaggacuguuuguaauccaaagucaggaaugugcuauggacaguggcccauggcaugggucauccugaggguccaggggaggcaggcucugccaaaggaggcugcagguaggaugugcuugauacagucuugguacuaguaugguagucacuacccacaugccgcuaugcaauuuuaccuuuuugacuugauauuacuaaucauuacgccugcuuacuuauuuauuuuuugagacagaaucucucucugucacccaggcuggagugcaguggugccaucuuggcacacugcuaccucugcuuccuggguucaagccauuauccugccucaagccuccugaguagcugggauuacaggcaugcacgaccacaccuggcuaauuuuuguauguuuuguagagacgggguuucaccauguuggcuaggcuggucuugaacuccugacuuccaagugaucugccuaccucagccucccaaagugcugggauuacaggccugagccgccgugccuggccugccugcuuaauuuaauuuuuucuuuucuuuuuuucuuuuugagacagaguuuugcucuuguuguccaggcuggaaugcaaugguacgaucucagcucacugcaaccuccgucuccuggguucaagagauucucuugccucaaccuccagaguagcugggacuauaggcauucaccaccaugcccagcuaauuuuuguauuuuuaguagagacgggguuucaccauguuggucaggcuggucuugaacuccugaccucaugugaucuacccacguuggccucccaaagugcugggauuauaggcaugagccaccgcacccagccugccugcuuaauuuaaaauuaaaacuaauaaaauucaauuuuaguucuccagucacuggcuacauuucuagugcuccguagccaguggggacugcgcaaauacagagcauuuccaucaucggagaguucucuugggcaguacuagaguauugggccagaacccgagguuucuaaugccacaucuggccucccucugcgccucgucagcuuucauuucugcucugguccuauccacuggaaaacuuguaagcacagccgaggcgagcgcacccccuggaccagcugacagaaagcauguguuugugcaagccgugugauugccuugccaggucaguccucguggacucagauuguucagcaguggcucccuuggagguggaccaggcuguagaaagagaauccuuuuucauugaucucugacuuguugcucauagucuccagauuccuucuaauggccugcuccagcccagccuccccacucugcggggaagcaccaaguaucccucagcucuuaugguucauaauguacacugaucaggugauuuuaccagcuaagcagguauuucucuucuuagggugaaaacuaucuucccaccacaaaucuagaaggaauggaagaaggggacggcuaaaauuuucaguuuuccagguuuuuuuagggcccauggugggggucccgggccaggaaagguggaguaggggaaggggaggaggggcgggcacuguuuuuaggauggguggaacaccugacugggaaauugcucugguccuuguucauucaugucuuuugagccucaguuccccaucuguguuuuggcuucuugcucugcuucaugcuccauugcuugggcuugaaggagcauggagugagccccugggacuguccuggccucgcuguugguuuguuggcugcuuucucugccaucuucugcugucaugucccucuuucccgacuccugccugucucuuguuaaacuaugagauccuccugagcagggucugugucuugcacuuccuuuauuuugcccagugccugggcacaugguugguguucagcaaacacuugaugaaucagucgacccugguuugagcuucauugagcaacagaaguuuguccaugacucuggccccaucguuguuggguuaauagguuggguggguugcccugugcaugggucggggagcuggugccuggcuagaucuggcauuuauagcaggugugcccagcuacauuuuugugccuccaaagaggggcauggcccaggggucccuagggggagugaaggugacgagaacccccuguucuaccaccuugcccuccuguuccccuacucuuccugggaaguagccaggagccuaauuuuacacauggggagagggccaagggacuguguccuggcaguccacugcuuggucaguuguuuagcucucagcagcccgggaugaagggcucugcuucagcaggcuugaggggagacggaccucccugggcaagucugacaaguggcugccccuguuaccacucacugaaaacaguucacagggggacaggaugcagcugugugaggcauagggccugcuccccugccugacuuagaaaccuggcacauuacuuucccuucuuucauuauauccucccggccacauacaaagcacucuuaccccacaacccuggacguuuguaaacaaguucaugcaucgggagcaucucuaacuugccuaugcaccagccuuccugcucucuaucgagccuuuugauccauaaccuugagaauugaugaggagguggcaucguucccguuuuacaggugaagaaagcgcagucaugacuccaggcuagggaguagccaaugcuauacaggcucaucugucaaauguucuuucacuccaccaggaaggcugaggccuugccagagccugguuggguguuagggguuaaacaggcuuggaaacgucugugcuuaaaaucccagcccuuguggaggagagaaaggaugugugugugucugaggcauggcccucguuccuucugccucucgcauuucacaauggggcuaugucucagagugaagaauuuccauuuccuguugccuggccucucauccugggccccagguuaggggaguuggagguuuuuccaacccccaccccaucccucaccucagccuagccucucuguacuaggagggccuggcaguauuuuuccauaccuucagcacaaaauggcucuguuucuuaaucccagucacgucccacgccccaguuggcuggggauggauggugggcgggggcaaugcauacagggcagaagaggcaggacagcugugccuggcuggccugucugcuuccuggcauaccuggauggugagggcagggguagugcauggucaggggauagcagccacauguauaggcucccucuucuuuccuacacuauuuggggaucgucuuugaauugcaacccugugguuuccaaaugggggccuuggugaccagagccccugggguaacugauguguggccugagaucugagucagggagccugaacuuuaggguaauacuccuaaauacuccuuuugcuuuuuuuuuugagacugaaucucucucugucacccaggcuggaguacaguggugugaucucagcucacugcaaccuccaucucccggguuccagcacuucucccugcuucagccuccugaguagcugggaccacaggcaugcaccaccaugcccagcuaauuuuugcauuuuuaguagagaugggguuucaccauguuggucaggcuggucucaaacuccugaccucagaugaucugccaguuucggccucccaaagugcugggauuauaggcaugagccacugugcccagccuccuuuugcaucuugcccagugauuuugagguuguugggcaucgagaucuugcucuugucucuaauugugacucagucuucuggugggguuugcguucaggaucugggggucaucauggcagaaagcccccucccccccugcacagaaugccauccaucccaagaugucugugcugguuugcugguaguuucuuauacaauuuauuccagagaggauggaggccagcuguugucugucucagacgcagacugaaccaaaggaaaugggcuuggacugcagccggagggauuuagguuagagucagacaauaaggaaggauuucgggacaggugguuggcucucaggaggauccugcagggggcuuugagaagaaagaugggggcaagaucaugcucagaggccguggguggaugagaaaaccagcuccuugaaugagcucccugggggcccgguuugggugggaaggggaauguuguguauuaagcaggcagggagcuuacuucauagggguagagaaacccaguggccccaccccugguacaggauuaaucccauccugguuccucauaggcuuuucuuuuuuaauuaaugaagagguuuacaguuuaaccacuugauaaucuuaaacaaacuguaauaaauggguaggcuuaauaaucucuuaucagaaccucagcccucaaggauggcaguuacuuauuacccuaagcugccagccacaggcacagggggagagggaggagggaagagcaggugaggaggccccuggguuggggaauuugcuagguugucaggggcauucugagaggcaagagguaggguagugucagccccaacuguguucaaggauacagguguaaccuagagagacaaauguggcacaagggucaggagccagcuuccucccagggagguaggagucuggcgguauuggcgguggugagacuuguccuuagagcccccggcaagggggcccagggcaggcagauguguccaggagaacaggacuggcagccacaaggacuaaagagccucauggaucagagcauccuuccuucccacugcuggaagggcaggaaaucagcagcaaugcauggggagagcuggggccaucaggccuucaaacacccugguaucccucagcuccuaccccccacccccgccacccaccugccugcuuccucuggaauccugaugguuccagaguccgcaggggaacugacucaccagggcuagaaccucugggggcuuugggcuugcaaacagguaggguagggaggagaccccggggccuggaaacagucaucaacccgcacugugccugcaccugucugggcucccugccuucuccaguggagcuagagcccaccguccagccuuggaaggcacacgucuuggagacucagucauucauuggcaaauacuugagcacauacuagagcuagguucuguucugugauuaagggauccaugagucucuccuuguagggcucaugaucuauuuaggguagauaacuaggaagccagagaaacagaugccuaguagaaugucagguagugaugagugcagugaggugaggagcgggagcgggacggaggcuuaauauuccagguggcauggccucuuucaggaggggacauucaggugaaaccugauugaaguaagagugagcugcaggaaggcaccugcaaaggcacaggggggugaacugcugagccggagggacuggcccaugcccaggaggugguaaauggaaggagggcauugcugucaacaccuagcccagcuccccagcucuggaggccacaugcagcagacacagacccucagaauggagguguccuccccaagccccuuguucuauucacagagcaauaauagucacauuuauuuuccuucccagugcucguuucuggaacacgccccaugugcccagcacugagcuguucaucauuuuuuuguaaucgacgcgccaacacagugaagccaugacucuuguuuuccagauacggaguguuaagcucagagaggugauaagacaugccccagguaacccgcuaguggaugcuggagucaggauuuugaacccagauguggccuuuccccucugcccucuccccugugcugcucagagagggccccacacuugauauuuguguuggagagacuggccagcccagcuugugugccagugcagagcuggguuugggaggacaggaagcaggccagcacgcgaggggcagcugggcggcccgggaacugcaccucccucaggucauuggcccgggaugggaaggugaugagucagcaguucccacagccaccuuucuggccugcuccaaggacuguuuuuagaaaccuugaguggcugguggcuuccuguagcugauccuugaccccaccccaaggucaagguaaaucugaggcaucugcaggggaaugggguagggagcguaggcacgcgcuuacccuaacucauauagucaggucagauccguggguaugaccgcacagcacagcccuuuaucucugcuaugucaccagugucuaccugcacauucccugcugugcuuugguugguguuucucagcccaguuccggguggcaaguggagggcugguuguucuguggacagggccucaccugcucugcugggucaccagcuugcuguuuggcuucaccaucuuucuguuuggcuucaccaucuuucuagccucucuauagauuccucaucuacagaaugggaauaguguauccauuuugucugguuucccuucagggucuuaggucucagauuagacgguggaagaggaguuaugggugugagaggugcuugaugaaugugggguuuugguggggaaaugcuaacucaggcccuuauuaaccaagucggggaggaaugagccaggccugagagcacugcuggcuucccuggaaaggacaaugugccaggggcccaauccaagugcaggggcuugggcuagagcucucuaaccccaccuuagaaguaaggccucuuccuagugacccacagccuuauggaggaauggaggaggcugcucugcccagcuggacaggcucaagggaucccagcuaaaacuguuuccugucccuacugacacuguugucccacuaauugggagacaccccuuggcaucgcucagggcagagaggugucagacaccccugggaucugaacucugggggcagagaaggggacaaagucacaaauccaggccucagugucccagauagggcagagacaccagcacaggaccauggaccugggccauagccacccugggcagggcagugguugugaauugggguagagaagcuauagguaaaugaaggaugucccucuugucauuuaagccucccuggacacaucccaccuucccugagaagaugaggcagggguagauuuugagagcauggccucagagggucaucugguauguguguuugagagggagggggcucuuuccugcuccccaggcccacuucucaggcacacagcagugcugugggaccaggaaggggcccucgagguccccugugucugcccgcacagggauuuccagugucagucacugaucagcucagcccuccaggugccugagagcucacgcugacauuccauccugagcuugggccccaccagcccuucacugcuugccuuagccaaaccugcaaccucaggucagcucugcccugggcuuguucucacaggagggaugcccagcugccccccugcccugggggauuaccgucccagccugagaacaaugcgggcagggucaccugccuuguuuucuuuguuccucccagugaggacagggcucccaggccugugaaagucagaagcccaggguuucugcugaaaaccugcucccaucuggcaggggcuugcccuccugagcgugagaccuagcagugccucugggcucugcagagacugcugagagauggcccaggagggcaggcugggggaagcccaaagguggacaagaggacaguucugccugugugcaugcacagccugccccgugcuaaugucagggguggggcugcgcucaagucccuaaugagggagaauggauuggaucuagggcagugcguuugaaacuuggcugaacauaagauuagaaucaccugggggagcuuugcagcauccugguucgcaguucaagccccagacuauuucucuuggcaucucuaggggcaggacccgggcaggaguauuuuuccaagcucucucagaugaucucaguuuguaguccagguuaagaaguaguauggugacugaugagcuaaguccugaggauagaaaugcauuuucuugaaugugcuauggagaggagguaggggagguaucaccugcccaggcagggggacuccaguagucauaguccaaccuccucauuguacagagaagcaggcaggcaaagcaaucaaagauucuucgaggaucucaagacaguacuggcagagcugagcugagccuggguuuuuaggcccugcgccgacguccuagcacaccaaagccuccagccauugauuuggccugccugccuucuucucaaaugugauccauacuccagauagauaucagagcaaaucugagaaaagagauaagcaaccacaaguuaacaaaguccgcuuugcaacagcccagcucuggucuucgaggagacggguguggcccugcugccuuucguccaguaucugcuccuucccugggagagacaaagcucaggcgagcuggguuggcugcuggugcagguaucaggguggcaccacugggcccuugccaauaccuugcucguaaacuacagcugcccuccgagccacacccuggucaccugacccggggggagaggcagugaggaaaauaccaagaauuccuucucucugcccugcauacuccuuuuuagacaggaagauggagaaggccugagccucccucccccugucagcuuccacuagggcagccccugcauauuagaaucacuucuggagcuuuuuaaaaguugugccaggucaacagaauaucugcaguuggggaccaggcauagcauuuauuuaaccuccaaggggaucuacugggcagccuguaccgagagccacugcccauugucuugcuucauguucacgcugggugggggcugggagggaguuggacuagaguucagagaagcugccaucuaacaccuccuggccucagccucaccuggggagguacuggcggcugccaggggugaugggggggaaguggugaagacaggaugggaccagugguggcauuucuuucccucagcagcccugcccaacuugcuugguuggacgagaaacuggccaggguggcugugagccucugaggggcagaggccaggagagauggggccucugagggauggggugaggcaucuugggcuugcccguuucccucugccccugacucccagccaucagguggccagggaacaucucuggaaccacagucccuuccuccauguggccugagggagcugauggaucaggcugaaaaucgacaguuuucucuguuaaaauggggaaaugggaagaguuggcaguugugaagaagguuagggacaguguucucacccuuuccugucuuccaggcacagggcuugaaaucccuaguccuucucuacugcuuguccaggacaugccagcccaucugcuucagcuuugggggugagcagcuuugcuccugggucucagaucucugcagggucuuguuccugacggacacacgugugaaucacaauauugauugcagauacauuuauccagugcuuacugaguccuagguucuuuucaugugugcagaguagguguuauuuuacagacagagaaaguaaggcugagaggcugaguuauuuacccagaggcuugcugccagccaucgagagaccccucugauucaaauccagguugguuccaccuuuuccaugagcacaggucugcauuuggaagauggcccuguggcuuccuagauagagcuaaaccugagcugcagaggcccugcugccaaugggauugauugagugcccucagagaggaggggcuuugggauucaguaaggaaaguggucagcuggaaguagaugugcaauuucuauugacucuucuguuccuuugccugcucucgguacauuuacugcccucguggaguuucccaaggggacaggccucccugcaggaaggacagucccagucaccugagggaccucucccacuccacugcugauuacucucccaucuugaacccucuccucugggcucuugucugccucccucaccuugccccuuccccagcuccugcccccugcccucuccucucaaccuggugauccccaccucugcaacccaagaccaguuggaggcuggugguuucagcagccccugugagccccgccgccgcuggggucugugccucuccuuccugcccucuugcucuucaggcuuccaccuuguuuaacugaugaauuuagugaaaagccaacugcagaacgaugcuggaagugguuggggauggaggggcacuagaggacaaguuaguugaggccagggaauauacccuuauuuauuuaaauguauuuauucacucauucaguaaauauuuguugaauagcuacugugugcuaggcaguguucuaaguuuggggaauacaucagugaaaaacaaaacaaaaggcccuguccccaugaagcuggcacucuaggggagucucugcaugucuguggauauugccugguaggccguuucacuugcaccuagaagcucaccugcaugccuuucacccccgucucuagauagugcagagguuagaagccaccugggcccucaucccagcuccacaacuaacuagcucugugaccuugggcaaaugcuucuguaagauggggguaguaauacuuuaaacuaaaauacaguaaacuuuagaggguacuggcauuuugugagauaaguaaagugcuuggauuuaggugcuugucuucauaagugcuuaaauaucaauguauuauuuaugaaauaagaaugaauagccaugcccacaccccuuacaagguugcugggaagggaggugagaggaaugauaaguuucuuucuguacuaccaagcacacgcacauaagagggucagcucuauuuucccuuccagggcccaauuuuaccaucccuccgcagggccaagugagcuuugacacagugaauuaagaauugauugcugggagugguggcucaugccuguaaucccagcacuuugggagcccgaggcagguggaucaccggaggucaggaguuugagaccagccugaccgacauggagaaaccccgucucuacuaaaaauacaaaauuagcugggcaugguggcaccugccuguaaucccagcuacucgggaggcuaaggcaggagaauugcuuaaacccgggaggcugagguugcagugagcugagaucacgccacuguacucuagccugggcaacagagugagacucucaucgcaaaaaaaaaaaaaaagaagaaaaaagaauugaugcagcugggaaugguaaaggaggguuggcccaugaacccauuaacccauuaacccauuaacccaugaaccacugacaauccaggagucuagcagaggcuggaauggaggaagacuguuaaggcuguauccugcagagcaagaaagaguccugugauccuaaagugauggcggcuguggagcuggaggcagggccgggaguagcucuaugggugccagauagcugugaucccaacaggcuaacaucuugacuuugguuucccuuaccccaccccguaaaggggaagcccccaccuugcccugccugcccaugucugaagguggguggcaugucccaaagccccaaucuagaucccucucuccaggaaggggaugccccaccacugccaagggaagccucagauccuugggggaugaggggaugucugggagucaagauuacucagucagcacagugagcaccugggaaggugggguuggggcagcuggacaucugaagcucugggcaagggcacacauggcuguuuccucacuggagcaacagcaugagagcuggucagaguggcuggacugguuuuagggcacuguuuuuucagcuggugggaagugggugggaguaugcacaggccucuuuccuguggccuuuauggggacaggagauaggagaacagcaauuaggacccagaugggccuggguucuagucuuggcuucacuguuuuuagcacuuucuuaaccucuguaagccucaaauccucaguugcaaaauggaaaaaaauuauaguaucuucccagcaagaaucuguccucucuaaaugagcuaaaggcacauaaaaugcuuuacccaacucuuggcacauaggaagcccuccguaaaucacagcugcuuuauggugacggugauggagacagggaacucuacuccguucccaaacaagagcugggccugagcuuugugcaggcuccccuuuucccauuacucuccaggcuuguauggaaaaugaaaauauugucucgugugaauuugggagccaaguuaaagaauccagccagugaacaggggccgccuccucccgcgaaagcuguuucccuaaccccgaggacgggacgccuugucugacaggguguuuaccuggcucucccaugucccuuccccuaacccagugauggccuuaguccugggucagcuuuucuguucugggagaccaauuaaagcccccuccucuuccugcauaaucccagccaugaucagugagguauccacagauacacacagugggaauagggagcuagcaccccaaauucacauccagaccucagcucccugagccuggcuuuccuccucugccaagugaugccuggcagaaugacaggaagagccaguuagguaacguguguaaaagccccggcgaggggugucugacauacagcagcacuagcacagcuucucuccaccagcacuuggguggagcugagcugauucccaggccagcugcuugggaaccacagcagaggaggcaaccgcaaggggcaguggggcagcccaggggcaggcagacccaggcagauggaggcagggaggcuugaacuugcagacuugaaaccagacagucuacaaccuagcccaguucugccagguaaccaaccucucuccgcccaguggguguaauugccaccacugggucuuugcaaggaaugaguagugcuugcagccccggggaguuaggggcucucuccagugccuccuuugcccgccccuuguugggcaaccacagagggauacuagaagucauggggaaagcacauaaugcuguggcugccugauaagccagggccugaggcugccagcugguccccaaagggcacaccaucaguggggugaaggguagaaagcccagcucuuccaccucuccccacucccaaacuuaaugccuucuucaguuacccuguuuugccaguucuuuuguuugaugucuccuuagcacuuacuaaaugauucccaaaucacagguuaccuuuggcacuagcauuucccagggggagcauuuuuggccuugugggugugguuguccugugaauugcagggcauuuagcaucucuagccccuugccuucucaaugccagagcaucucccaucacccauuagaauaaacauaagaggagggcagggauuccguccguucacugcaguauacucacugccuagaacagugccugguacaugcaacauuccuccuuagaaagcauuuccagacacuuccaaaaggcacuaccaccccaguggagaaccccuguuccagacauaccuuccacaacacccuugauggaugcuggcuacccuggucuaaauacuuugcauuaucagaaauugauuacuacaaggaguagcccuuuguagacucauuauccaaaacagccaccccaucucccccuuggacuuuggccuguugguuagcauaucaugugaagucugacacccagaaugaaacaaggugccccauauauggccugacccugcaagcaacagugggcuuguuaccucccagcccuggauagaccuggaguugacauagccugagauugcauuuacuuuucuugugacagcaggacaguaggauuacuguuuguugauccauggucagcuaauauccagggacuuuucccuucaauccucuaccagucuuuuccaauccaaaguauaagacuuaaacauuuaaguggauacuuguauguuguugauuuuggccccuauauccagccagaugauuuugaaucuugauacugccauugcuauguguuagcuaucuucccaucccauccuuauccccaauuuugcauccacugcacauuggauuaguaaaccaucucuguccucacugugcugugguuuaaaauauugaagaaaaccaggccuuaagcaugaugguggagacucagucuggguugauaaugaucaauaccuccuaggguuguuugucugccuuugaauggacccaauuaauccuggcuccacugacauuucugugucuuguccacaugaauuucuuuaaucccaucuguuagcugccuugcugauaucuagauggauuacauuccacagaacuucaaggcuuugcaacccuuugaaaaggagaugcacuuagcugagcaugacuuguucugggugaaucugugcuaguuucuagugcccacuacuuccucuucugcauguuccaaacauucuccucuccccauuuugaaguuugcaagaguucagguuuguuuucugaauuucuagaauccacucuuuuccuuuuugugaaaaaugggaacagcuugucuucugacaucuuuccuguuccccaugauuccauggggaugaccagagguggugcugcagccucaccugugaucagugauucaauuaucauuucaagauguucuuguauguucuuauauacucuuuucuuguaggccggucccauucaagaucgauaucugagguagcaaagguagaugccaaaggagagcugggugguuccgcuuucucugccaucuguuuaacauuaacguggcccugguacuuccucauucucuugcuccaaacagauuugauguuuucagaaacccauuggaugguccuuaguauuuguuuuagcucuccuguuggccuguuaguaucuaaauguccuuuagccauuucacauugaaauggucuggccagcuagacagagagcucucugagggcaggggcugccuuggccagaguuugaugcgaugguccccacuuuccacuuugaugcugcacagccuucguagccucggagaugcugugaaaugccggaggaggcagcgcagugagcugugugguuugauggucugacagacaagcgugccaucauggaaaauucuuugcagagugugcagauccauuuacgcaggccggcugcugcuucugcaaauuacacuuuccuucagaacaacccacccaugcccuuuuuuucccaccaaaccucagucaugcucuggguagguuagaaacaagguuuuuuuugucucccucuguuuccaucccucacucuucugucucuucucucucaguccuugucuugguuuuuauaggcaauuuggcugaaugccuagcuucuggucuggauggccuacccaucugcaggcgcuccuuggggacaggacuugagccccagauuuagagucccuucuuaugugacuucugggguccaggcccugccagcugauaaagccccacagauagguuggagccaguggugauagcagaauuggggccuagucagauggaaacagguuugcagcugucaguauuguaggaguagauaaguuccccacaccucugccccaccgcuccucgcacucuccagggggacaucccauccccagguggccucucaccugcuauccacaguuacuggaagcucuuuggggauugauagcacaguuaugagucacccugaaauguacucacccucugaucugucccuucccagacagcugcucagcccagggcagagagagaaagggcuacagggaagggagggaagugagaucccacaggggagaggguacauuagaguccuaggcugggggaaaggaggaccugcugauuugcaugcccuccgaggacaagucaacagggcacugagcugaccugagcagguauccuacaguaggcugaaggguauauggggggccccuccccagccaacccugaacaaggaccuggucucugcagguagaacacccuccauggagggcugggugaggcacaggggaccuccuugugugugucugccucacaugugcuuuuuuugagaggcagaauuaaucuagugcagugguucucaaaguguggucccuguccacagcaucaccugggaacauguuuagaaauguuccuucuagaccuccuaaaucagaaacucggaguaguaggggccagcagucuguugaacaagauuuccaggugauccuggugcaugcuaguaaguuggagaagcauugacucagugaaagaaugaacuuuggagccagauugccuggguucauaucuuuaccuuggguaaaucagguaaccucucugauccucuauacaauguuucaucuguaacauggagacacugccaccuucuucuugugaugacuaaaugaaaaugcuuacaaggaguuuagugcaguucugucaaucagcaucuguuaaguguggccucagcucugaccuuuacuguuucucauuuuaggugguaucugaugcugcaggacaggguguggccaucacagggaaccagaccuucaacaacuggaacuggcccaaugcaaugauuuuugcagcgaccgucauuaccaccauugguaagucuucugggaccuguaggacacccacauccaugcccuagcuccucagaaccuuucuagaaacccagcucuggucacucagcccuguuggggguacaaucagaucaguugcaggcuauucuuuugauacuuucuuagggauuuguuaaguccuugguagcugaucaugccugggaagguuuccuugagucuugaccugggcucuuugagcagaaacaaugacacagccucauggccagagccaugcaagagauuaaccagacugcucauugcagaaacccagaucaugacuacuuaccaagcugggugucuguuucaguucucaggcugcauagccaaccaguccagaaguuuggcucagaacgcagcuucuucucuuucaccauucugucagcuugacugggcucagcuggcugguucuugcuugggcucccaaugcaguggcagucgaacaauggcugggcuggagucuucugaaagccaaacucaucugauggcccagauggcuccucccaucacagauuugacaguugaugcuggcuguuggcugggagcucagcuggggaugaaaacacaaggccuccgcauguguuugggaaccaaggcgaaaagcagcaggcuucuuagaccucaccuguccagcgucucuuccgcugccuagacugcuucuguugucaagccacuaaagcccagauuccaagggaagaggauuagaugacaccuugaugugagcaguugcauaagaagggagggaauggaggauggcuaucuuuggagaccaucuaccacagugcuucuggggaaucuacacagagagcaugucuuauaacuugcacagugguaccauauagacuaguggaagaccuguugaccaggcuuagucccugccuucagggagcuccuuguaugauggaggagauacagcucaugucaucauaauugcuuuaucaaugaucaugaucagaguaugaucaagggaaauaucauuacuuaaguacugacaauagaucaauaucaauuuaucuuagagaacgggcuguguguguguuggaagcaaggcccacugguuugaccaccccuccuguucuuggccucacucucuccuuccucaggauauggcaauguggcucccaagacccccgccggucgccucuucuguguuuucuauggucucuucggggugccgcucugccugacguggaucagugcccugggcaaguucuucgggggacgugccaagagacuagggcaguuccuuaccaagagaggugugagucugguauguccccuacccuggguguugggcagagaugggggaaccaugacaggugaggggaggacaggaggccucuaggaauuggaccaaggguguaaggacagauggcaagaggauaguuucagagcuccuugcccucccgggucaggcuggguacccagcuagcuucuccucuagcugccucccuggcccucugggugccuuugcuggguuuccaagucuccacuauucucugacuuggccuccugcuccccaucagcggaaggcgcagaucacgugcacagucaucuucaucguguggggcguccuaguccaccuggugaucccacccuucguauucauggugacugagggguggaacuacaucgagggccucuacuacuccuucaucaccaucuccaccaucggcuucggugacuuuguggccggugagucccugccucugccucccaccucuuuuucugcuucuuugguuucagugcaacagaccuauguugggggugcccuagguaggguuccauguucugggcacuucucuuacccagugggauucucaacccacucugccauuugcaagaggaaacuaagacccagaguaaugacaaaaaacucuuuucucucugguucccuuucucagacauggccuuuuuccuccuccuuuccucucugcucagucucugaucuccucucccucaguucucccaugacuccugagcuuggcuucaugggggacuugcaaguagggccuucugccugcacgguugguaccugcuacccagggagccccugagcccaccagcacccacuccacgcccucagcagccuuucaucuuucacaagaguggagggagguguccugaaggcauggcucagaggccuggggcuuuguuccugcuguagcagcuuaaagacaagggaggccuucuccccagcugcccugcccccagcccugacacucccuccuacuccuccccugcuuaauccagggaagugaugagguucuuuggccccuuugucugaaggccuguuaccagcuggccccagccacacauguacuuguguuuguggccugcacagcaucuugguucuuaaucuucuugacacccuguuugacccuguugacccaccaccccagugaccucaacuucugcuccagaggccucuguucuguacccccucccuuuugcccagagggcagugggaggccacuagccuugugcuugauguauguggcaucugggagcaguuggcugaguugggggaggaacaggaaagagaggcacaaacacuccccugacccugccaaguccgggccugcuguccugggcaguacauguggacaaggcacaacccugccauuguccagcccuugaggcccagagcaggcuaaggaggugccucugguauuagggaaauacagauguacacuuagccauacuuucucagcaccagcaagacaccaaacccugccucagcuuucucuucuguaaaauuaguaaaaauaauaauuacuauucaugaguguuaaggguagggccuggcuauaucagugugugcccucauuacugucaucaugaaacucugcuugugauugagagccuugagcaggauuaacaggaccacucagggcaccugcuaucugagcccggucgugggaggagaacugaccgggcuacagcaccuggaggaaccucuagucugaugagagagguagcccccuuccuccaggucccuucuguaaguugcucuuguaucuagucgagggggcaaauggaauacaggucaacaugccuguacauguagucgucaacgacauuucaaauaauccuggaguguagggggaaccuucagagcuguaggggguaagccaagaaggcucccugcagcaggagggggauguggagcagacagagcccuccuccaggucaagggagagcugaucugaggaagucagggaggcagaccagaccuucaaugaaaauaaaaaugguucagcguuucuugccacggugggugcuuccugggucaucucaaccuaaccaccagccuuguuuguaauccaccagugugagucuagccccagcuuggagggugcugggggcucccuuguguaauauccauccauuccguuuuuaagugaacuguaucauauacgcagaacagcuggggaugguagaagaauuaacagaaaggcaaauacucaugaacuguuucuugaccugugugucgguuacauugccagucccccaaagccccuuuagcuuccuucaaagagucacugucuugacuuuuuuuuuuuuuuuuuuuuuuuuugagacggagucucugucugcugcccaggcuagaguggcaguggugugaucuuggcucacugcaaccucugccucccggguucaagcaguucuccugcuucagccuccugaguagcuggcccgccaccauaccuggcuaauuuuuguauuguuaguggagcugggguuuuaccauguuggucagacugguuucgaacuccugaccucaagugauccaccugccuugaccucccaaagugcugggauugcagacgugagccaccaugccuggccugucuugacguuucuaguugaggaaaccgagacucagagacaggcuggagacugggauggggucaugaaugauggcaggcccaagcccuugaggaagaugggauaguccagggucuagaacaggccccuuucuaucccacugcacccccguccugugcucuggccugaccccugcucagaucacacagcauuggccauugcacauuucccgggcccugcuaacucuuccugaccucuggacugccuguccgcucaggugugaaccccagcgccaacuaccacgcccuguaccgcuacuucguggagcucuggaucuacuuggggcuggccuggcugucccuuuuugucaacuggaaggugagcauguuuguggaaguccacaaagccauuaagaagcggcggcggcgacggaaggaguccuuugagagcuccccacacucccggaaggcccugcaggugaaggggagcacagccuccaaggacgucaacaucuucagcuuucuuuccaagaaggaagagaccuacaacgaccucaucaagcagaucgggaagaaggccaugaagacaagcggggguggggagacgggcccgggcccagggcuggggccucaaggcggugggcucccagcacugcccccuucccuggugccccugguagucuacuccaagaaccgggugcccaccuuggaagaggugucacagacacugaggagcaaaggccacguaucaagguccccagaugaggaggcuguggcacgggccccugaagacagcuccccugcccccgagguguucaugaaccagcuggaccgcaucagcgaggaaugcgagccaugggacgcccaggacuaccacccacucaucuuccaggacgccagcaucaccuucgugaacacggaggcuggccucucagacgaggagaccuccaaguccucgcuagaggacaacuuggcaggggaggagagcccccagcagggggcugaagccaaggcgccccugaacaugggcgaguuccccuccuccuccgaguccaccuucaccagcacugagucugagcucucugugccuuacgaacagcugaugaaugaguacaacaaggcuaacagccccaagggcacaugaggcagggccggcuccccaccccaccuuugauggccucuuccccccucacccuagggugucccgagaugaccgggacgccuggccccuggugggggggcagccucggaacugggaguggggggccaggggccuuccuaaccuuccaucauccucagcuagauguaugcccgggacagggccucuguucuccagcugaaccauacccuggcugugggggcaucuguccugagcuuggcugguguaucucacaaugcaaagacaugcuggcuggcgggacaggugggcaggacugacccugaggaggccuugccugcagggucuuugucucaccauuugguggaguaucacacgguucucugaggucuggggccucagcuguuuaaguuuaccgguauuacugagcucggcauuuggagagggagcucugaagugucuggggagguaccgcugugcguggggucagguguuuccguaccacagcaggagcagggcccgcccgcaucccagcugugggccugccggucaggucgggcaccuacuacaaaccguagugggguggaggcugcuggaggugggagugaggagaugagggcagggucucaaacaguccugacucacagggccuggaaacaaguccuaugugggccuggggccugggguccucauccuccuuguuggucuacucaggcccagcccagagcuguguucccugucucaggucaagcaguggcagacgcaaggcuuucugugggcccccaagugguaggagggagaguagcagagcauggguuacuggaagccgggacugcuagggcugguggccagggagcugcaagagugaggcucagcucuggcugguucugcccuuaccccuccugcccgccugagaacugcacacccugcccgcuggccccaggaccugcacucccaauccugcugucuucuccuucccugugcccugaacaaggaccucacugcccgccuuccccucccaccagcccccuugggccaggcagggugaggccaaauugcucuuggcccacaaaugggugauggucagauaugugaaucaagcuccuuucucuagcuaguguuugaugugcacgugugugugcacagugcgugugugcacacgcacaccugugcacucguguguguuuaagaaaggaaaggauuugggcuggggagcaaaagauaaugugaaacuguugguggacucucuggugaggggugggcagaacuugcugcuacuagaguucuuggguucuccaugauguucacccuggggcuggcccacuguguccugaauguuuuuguuauuuuuuguuuuauuuuuuaaacaaacugcuguuuuuauauaccuggaaucuguuguuggcuucagagccagugguuaaagagcagggucccaaggauugggagaucuagugucugcccuccugcccugcaacucaauugggccuuuuucggugaccucauccaaggccaugaugucaagggccauguccccaagcagagguggagaaggggacacugaggugagcaaaagcaggaaggggcauccacugcgggugacuggaggccgggcaggaagcaagucaucagagccgcucagcuccguucacucucugccuucugccccacuacuguggggcaguggggccagagcccaccuccccaacaugugaagacagugaugggcacgugcccacacccccacuucucuagccguuugcagaggccgccacccagcaggggccugaaaaggagcagccucguauuuuucugugaaauguuuuaaugaaccauguuguugcugguuguccuggcaucgcgcacacuguauguacauacuggcaacgaugucaaauguaauuuauuuuaacauuuuuacaauaaaacaugagguggacaggccagc

SEQ ID NO: 17452 - RNA, 759 nt, Homo sapiens
gucuuuuucuguccugugaauugagaaaauuuuacaaggugagaauuuggggguaggggaaaggaucccuauuggugacaauuaaacauuuaaguccagguuucaagucaguguaacaacugaagcaaugugcaggaggaauguuagaggucuugcugaaaagaggaaauaaucauaucuucagaagauucuagggacuuauuugugauuaaagacaaaagcuccagagacccuaagguuauuuacaugucaaagucccauaggacuaagucccaaagucccauagcacuaaagagauucuaaaacuagaaaaguuaaagcacugaauuuccuuuugaucucaaaaggucauugcucucuccacugccagcaaaccaucauugcuuuggggaaaucaaagugccuucaucaggaaauguugagggauaauaugugaugggacuugauugucuuguuagauuggcagcuugccuuuaccugggcugaacccagcaugcagaagggaaaagcacucacaaaagagagguccugagauuucuucauaucuugcaguuagaagaaaacaguucaggguccauguguauuaccaucucccaaucuuuucuaucucuauguggguguguuugugagcgcauguguacacauccccaaucugaaaauacugauagaaaggggagugugcggaauuccugguuaugaguuucccaaacuuaccauggaguaacuguuuguuuuuugauuaauguguuuuuggaaaag

SEQ ID NO: 17453 - RNA, 5369 nt, Homo sapiens
caugaaugcagcaacaguuuuaacuauggcuuacauuuauuuuaaauuucacuaaauacaaaucuugauugucaugccaguuuuagaucuuauuaauuuucagaauggauaaauucaaauaaucauaaauuacgguaacuuuuuauuauaccaagguguucuaaugccaucauaugaagacagaugcuucaaacaaccugcauuaaauuauauuuuuaauaaaauuaaaaucuauuuuuaaccuauuuguagucacaaaccgaaaacgugucgucuuuaccuuagagcuaaaggcuuacuuuaugcauacgguauauuuaauagucuacaaaucaaagauuuaaacagucccuuaaaaauuccauauauucucauaccaacucaucuacauagaaaugaaaaucucuauuguucucacaaaccauuaccaugaguucacuauaacaacuggaucaauauggcuugccuuucaaaguuaaagaaucagaaaggggccuguaagaagucauuuagcccaauucccucacccuguguguuuucccucaaagccagugcaauuuuuuuuuaaccaaaaaacuggacauguuuaauacauacaguuugacaaauuuggauuucacucuuuguuuugauguaguaacucuuuuauaaaagggaacagauucagacaagcucaguggcccaacugaagacauucagcaauuaauggcaggacuucaguaaucaguggcaggacuacaacauacaucucuucaugcuagggaaaccaggcucucuauuauaaagcugaccagggcuauuguuuuccccuuuucucucauccuaaacaccauucauauuuuuccuaggucacauuuuagugggaucauuuacaaagcccccagaacuuaaucaucauguuuuaccuuuuuuauugaauuauauacaccucuuacaaaaaugcuugaaguaauuuaacaccuguacaucaguacaaaaccuggcugaguaaaaugaagagaggaucuauucaagaucauuaagaccaaauguaaacugggaaguauguggaagauagcuguccagcaagugucuggaagguguucuagcuggguagagagccuauucuaacagacacgcacaucgcagaaagcagcaugaacagaaccacauccuagauaagaguucuguguacagaagauccauggaggcaagugcugucaggaaggacacugccucccuccacccucccaaaugucaccaccaaguuccuucaggugagaccucacacaaugucaagugcuuucuaggaaauacuaagaucagguugagagauucugcuuggucuagucaaucugaaaaauucaggcuggaaagacaccuuuucucaagagcugaauugacuuuugccuucaaauccugccugcaccuugccuacgauggcaucaauuuacaccuaaggaccuuugaagagaaaaauuccauuauuucuuuucuuucuugagagcagauuuuuucccuccuccuuuggaagauuugcaguacuuugcuuccaucugagccagaaaauuguccauuuccuuuugccgauccuuuugucugcucuguuugagaaguuaaaacacaagcuuucacaacauuauccauagacagaaaguaccuagugguugccaggggcuggaaaaguggaauaacuacuaauggguauggaguuuuuuuggaauggugaaaauguccuacaauugguguuaauaauuguaaaacuuuguaaauacacuuaaaaccaccaaauuguacacuuuaaaaggacaaauagaagguaugcgguuaugucuuaaaagaagaaaacaaaauacaacauuccaaagaaaauauuagcaguaggaaucagaucauuaaagauguggcaacaaacugccaaguuuaccugaauggcugccuucaggcuauccacgccuucaucaagccccaacuccuuucugcucauuucugcuucuuuggccucuuccugagccugaaacaggaacucacaugagacucagggccaccaggaaaugcuuaaaauacauacucuuucccaaaagcaaaucuauaauucuguuucaauuuuaugaauauaugaauagacaaaaugaaucgaauuacauaacuaugucauucauuaaauggcaacaaugcugacagcaagcaguagauccucugauuccaauuaccauuuguuuuuuacccaauucuauuugcuagagguaguaaguacucuggcacucauaaaucacaugaugauaaaaaggaacaugaggccggguaugguggcucacaacuguaauccccauaccuugggaggccaaggugggaggaucacuugaacucaggaguucaagaccugccuggguaacauagugagaccucaguucuauaaaaaagaaaagaaaugagccuggugugguggcaugugcuuguagucccagcuacuagggaggcugaggugggaagauggcuucagucugagaguucaggcugcaauaagcugugaucaugccucugcacuccagccugggugauggagaugccaucucuuagaaaaaagagaaaaaaaaaaaaaaaaggcaaaugaugcaauugccaggauacagguauuuccaauuucucuccuggaaacccaauuuacuccaugggacugguggugccuugugaacaaccccaguuuaaaaugacuucuccccaguagucagaagaaccaacaucaauaaacucaguuuuaacaucuauuuaccuaauuucaaagcagccuuccuuugccaaguguuccuagagcauuguuuacaaaauaucacaagaacaccuuagggcaacaacuauaagaggccccaacaccccuugugaauuuucuaaguagcaauuaaugcuauuaauacugaggaugaugauacauuaggacccccuaucccaauaagacaccguuuccuuguauucaaauucucucuuuaaauucagcaucccccuaagguuuguugaacagucuaucaaaacuaugccauuuucuccucaaauucuagggaaguuucucaagcuaacagucuacugugaaugcagcugugcucaguuucaucucaggaaaugaugaacgacuuaagauaauugucagcuugagucuuagcagauguagccuaugaaccaaaauggucuugauauacacuccaccguuccccucaagcucaccagaaagggugcagccucuuaucuaggcaaaacaggcccuucaaauuuucaccggaaacaaaaaggucagcuuucucucugccagcgucucuuauguaaaagcugcagaaaaguuccugagggcacucaggaaggcagcagugguccuaaaaguugugugcuccuuaagagaaucuaacgcccgaugaucuaagguuucauccugaaccacccccccaacucuccucacccccacugucacuggaaaaacugucuuccacaaaacagguaccugguaucaaaaaggcuggggaccgcuaagcuaaaguuuuucuuuaaaaaaaaaaaaaagaaaagaaaaauucuguauccaacucaagaaucaaauucggggcaaaggcccaaacaucugcacuuuuaacaagacggugucugccauucucuucuuacccccucaaccgaguaaggaucacugcccauccuguguacccggguuccacuaacuuuaucuccugaggaaugccucaggaaugcuacaagaauuggccuacaugaaaaaauauuucagugcuacuuuacuaugguaauauuuaaacaaucuaugcaauaaaaaucaucuugagcacaacaugcuagaaaaaguuucucuugaugaacugguaugcccauuuuauuagaucgaaacuauagaccaaguuaacccuaguccuuauuucuggaguuuuauguuuacuucuacugcuguaaauacucucaaauccuuuuuggaagcagucaaaauauaaauccacaguauucaaaaucuuacccuccuuuuccuugcauucaucuuuuguuucgauucuuugacaaaggcauuauaggaugggaccucuccggcgucaauagcuugcugaaugauauuccuuauccuggguuccucuguguacugcacgcaaagcacagacuccaugaucugauccaugucacccuugaaguccagauaggccugcuuaauaucagccagcucuucuuccgaaccuuuguaugucuuuucaaaagcuugaauguccucuaaagauaucugaugauaaaggagauuugcuuuaacuuugggaauuuuacuuuaaauaaaacguacguuaguaaaacuagaguuggguguugaauugcugcaauacaacaguugcuugaguugaaauuauugaaccagauuuucuaugccuaagcuucuccggaguccuccuuuuuaaauccaaucuucauuaacugcuaacuagggaccagggaagggaaauuuaagugaaauuuccaagagugagaggugauccggaaucaggacuuacauuuggauauguaaaauaaagcgcauccggcaaaaaaaauaaaucggcccuuuucagugcaacaaucacauuaacaggaaauuuaaagcccguuucaguaagcgugcguguaucuguauuucaaggccaaacucaaaauuccuaauuccuacaaaauuaacacaaaauacaagaucuuagaggcagucaauaaagguuuguugauugaaugaugguaacagucacaaagaaaccuccagaguccuuuaccuuuuuaaagaguagccgccaauacgccucccagucucggucuugggugagcacaggagaguccucguccacuguucccugcucaucguacacugcucucuguucucugucacugagaacggaauagacuuuucccaggaucugagggcaaagaguauccguaaaucaccccugcuccucccaccgaaacggcggcgcgagaaauaaagaucagaaggcgccaagcggagcucagcgcgcucccccggggcggggcccgguagccaaaaggcuagggggaggcccgcgcagccggucggcuucggggcgggacccugcauaccuggaagcggcggguggcguccuccuugucgcccucacccacccgguccggguguaccugcagggacaccuugugguagccucgucggaccucgccgucggaggccucgcgucgcacgcccagcacccgguaaaggucggcggugccgaacacuuccucgcaaagguccagcagccccaugccgggcggagauacgaccccggaggaagcagccgcucccagcugcgccggguacaacccaggacugcuucuuuuucgcgcccaaaaagcccagggcgccugcgucacaagcacug

SEQ ID NO: 17454 - RNA, 5369 nt, Homo sapiens
cagugcuugugacgcaggcgcccugggcuuuuugggcgcgaaaaagaagcaguccuggguuguacccggcgcagcugggagcggcugcuuccuccggggucguaucuccgcccggcauggggcugcuggaccuuugcgaggaaguguucggcaccgccgaccuuuaccgggugcugggcgugcgacgcgaggccuccgacggcgagguccgacgaggcuaccacaaggugucccugcagguacacccggaccgggugggugagggcgacaaggaggacgccacccgccgcuuccagguaugcagggucccgccccgaagccgaccggcugcgcgggccucccccuagccuuuuggcuaccgggccccgccccgggggagcgcgcugagcuccgcuuggcgccuucugaucuuuauuucucgcgccgccguuucggugggaggagcaggggugauuuacggauacucuuugcccucagauccugggaaaagucuauuccguucucagugacagagaacagagagcaguguacgaugagcagggaacaguggacgaggacucuccugugcucacccaagaccgagacugggaggcguauuggcggcuacucuuuaaaaagguaaaggacucuggagguuucuuugugacuguuaccaucauucaaucaacaaaccuuuauugacugccucuaagaucuuguauuuuguguuaauuuuguaggaauuaggaauuuugaguuuggccuugaaauacagauacacgcacgcuuacugaaacgggcuuuaaauuuccuguuaaugugauuguugcacugaaaagggccgauuuauuuuuuuugccggaugcgcuuuauuuuacauauccaaauguaaguccugauuccggaucaccucucacucuuggaaauuucacuuaaauuucccuucccuggucccuaguuagcaguuaaugaagauuggauuuaaaaaggaggacuccggagaagcuuaggcauagaaaaucugguucaauaauuucaacucaagcaacuguuguauugcagcaauucaacacccaacucuaguuuuacuaacguacguuuuauuuaaaguaaaauucccaaaguuaaagcaaaucuccuuuaucaucagauaucuuuagaggacauucaagcuuuugaaaagacauacaaagguucggaagaagagcuggcugauauuaagcaggccuaucuggacuucaagggugacauggaucagaucauggagucugugcuuugcgugcaguacacagaggaacccaggauaaggaauaucauucagcaagcuauugacgccggagaggucccauccuauaaugccuuugucaaagaaucgaaacaaaagaugaaugcaaggaaaaggaggguaagauuuugaauacuguggauuuauauuuugacugcuuccaaaaaggauuugagaguauuuacagcaguagaaguaaacauaaaacuccagaaauaaggacuaggguuaacuuggucuauaguuucgaucuaauaaaaugggcauaccaguucaucaagagaaacuuuuucuagcauguugugcucaagaugauuuuuauugcauagauuguuuaaauauuaccauaguaaaguagcacugaaauauuuuuucauguaggccaauucuuguagcauuccugaggcauuccucaggagauaaaguuaguggaacccggguacacaggaugggcagugauccuuacucgguugaggggguaagaagagaauggcagacaccgucuuguuaaaagugcagauguuugggccuuugccccgaauuugauucuugaguuggauacagaauuuuucuuuucuuuuuuuuuuuuuuaaagaaaaacuuuagcuuagcgguccccagccuuuuugauaccagguaccuguuuuguggaagacaguuuuuccagugacagugggggugaggagaguugggggggugguucaggaugaaaccuuagaucaucgggcguuagauucucuuaaggagcacacaacuuuuaggaccacugcugccuuccugagugcccucaggaacuuuucugcagcuuuuacauaagagacgcuggcagagagaaagcugaccuuuuuguuuccggugaaaauuugaagggccuguuuugccuagauaagaggcugcacccuuucuggugagcuugaggggaacgguggaguguauaucaagaccauuuugguucauaggcuacaucugcuaagacucaagcugacaauuaucuuaagucguucaucauuuccugagaugaaacugagcacagcugcauucacaguagacuguuagcuugagaaacuucccuagaauuugaggagaaaauggcauaguuuugauagacuguucaacaaaccuuagggggaugcugaauuuaaagagagaauuugaauacaaggaaacggugucuuauugggauaggggguccuaauguaucaucauccucaguauuaauagcauuaauugcuacuuagaaaauucacaagggguguuggggccucuuauaguuguugcccuaagguguucuugugauauuuuguaaacaaugcucuaggaacacuuggcaaaggaaggcugcuuugaaauuagguaaauagauguuaaaacugaguuuauugauguugguucuucugacuacuggggagaagucauuuuaaacugggguuguucacaaggcaccaccagucccauggaguaaauuggguuuccaggagagaaauuggaaauaccuguauccuggcaauugcaucauuugccuuuuuuuuuuuuuuuucucuuuuuucuaagagauggcaucuccaucacccaggcuggagugcagaggcaugaucacagcuuauugcagccugaacucucagacugaagccaucuucccaccucagccucccuaguagcugggacuacaagcacaugccaccacaccaggcucauuucuuuucuuuuuuauagaacugaggucucacuauguuacccaggcaggucuugaacuccugaguucaagugauccucccaccuuggccucccaagguauggggauuacaguugugagccaccauacccggccucauguuccuuuuuaucaucaugugauuuaugagugccagaguacuuacuaccucuagcaaauagaauuggguaaaaaacaaaugguaauuggaaucagaggaucuacugcuugcugucagcauuguugccauuuaaugaaugacauaguuauguaauucgauucauuuugucuauucauauauucauaaaauugaaacagaauuauagauuugcuuuugggaaagaguauguauuuuaagcauuuccugguggcccugagucucaugugaguuccuguuucaggcucaggaagaggccaaagaagcagaaaugagcagaaaggaguuggggcuugaugaaggcguggauagccugaaggcagccauucagguaaacuuggcaguuuguugccacaucuuuaaugaucugauuccuacugcuaauauuuucuuuggaauguuguauuuuguuuucuucuuuuaagacauaaccgcauaccuucuauuuguccuuuuaaaguguacaauuuggugguuuuaaguguauuuacaaaguuuuacaauuauuaacaccaauuguaggacauuuucaccauuccaaaaaaacuccauacccauuaguaguuauuccacuuuuccagccccuggcaaccacuagguacuuucugucuauggauaauguugugaaagcuuguguuuuaacuucucaaacagagcagacaaaaggaucggcaaaaggaaauggacaauuuucuggcucagauggaagcaaaguacugcaaaucuuccaaaggaggagggaaaaaaucugcucucaagaaagaaaagaaauaauggaauuuuucucuucaaagguccuuagguguaaauugaugccaucguaggcaaggugcaggcaggauuugaaggcaaaagucaauucagcucuugagaaaaggugucuuuccagccugaauuuuucagauugacuagaccaagcagaaucucucaaccugaucuuaguauuuccuagaaagcacuugacauugugugaggucucaccugaaggaacuugguggugacauuugggaggguggagggaggcaguguccuuccugacagcacuugccuccauggaucuucuguacacagaacucuuaucuaggaugugguucuguucaugcugcuuucugcgaugugcgugucuguuagaauaggcucucuacccagcuagaacaccuuccagacacuugcuggacagcuaucuuccacauacuucccaguuuacauuuggucuuaaugaucuugaauagauccucucuucauuuuacucagccagguuuuguacugauguacagguguuaaauuacuucaagcauuuuuguaagagguguauauaauucaauaaaaaagguaaaacaugaugauuaaguucugggggcuuuguaaaugaucccacuaaaaugugaccuaggaaaaauaugaaugguguuuaggaugagagaaaaggggaaaacaauagcccuggucagcuuuauaauagagagccugguuucccuagcaugaagagauguauguuguaguccugccacugauuacugaaguccugccauuaauugcugaaugucuucaguugggccacugagcuugucugaaucuguucccuuuuauaaaagaguuacuacaucaaaacaaagagugaaauccaaauuugucaaacuguauguauuaaacauguccaguuuuuugguuaaaaaaaaauugcacuggcuuugagggaaaacacacagggugagggaauugggcuaaaugacuucuuacaggccccuuucugauucuuuaacuuugaaaggcaagccauauugauccaguuguuauagugaacucaugguaaugguuugugagaacaauagagauuuucauuucuauguagaugaguugguaugagaauauauggaauuuuuaagggacuguuuaaaucuuugauuuguagacuauuaaauauaccguaugcauaaaguaagccuuuagcucuaagguaaagacgacacguuuucgguuugugacuacaaauagguuaaaaauagauuuuaauuuuauuaaaaauauaauuuaaugcagguuguuugaagcaucugucuucauaugauggcauuagaacaccuugguauaauaaaaaguuaccguaauuuaugauuauuugaauuuauccauucugaaaauuaauaagaucuaaaacuggcaugacaaucaagauuuguauuuagugaaauuuaaaauaaauguaagccauaguuaaaacuguugcugcauucaug

SEQ ID NO: 17455 - RNA, 6353 nt, Homo sapiens
cgcagccccggagcccgggccaggguccaccuguccccgcagcgccggcucgcgcccuccugccgcagccaccggugagugccgcgguccugagauccccgggccggaugcgcggcggccccagcucccgagcgucugccucccccgcccugggcugcccgggcucccugggcuccccggcggcugcacggagucaaggcgccccgucccgggcgucccccgcgggugccgauccaggcugcccggaguccggagcccagagaggagagagacagcuggggagccuggucaccgcgggcaucuccccugcgcugcagucgcccgccuggccugccuucccguuccuccgccucuugcccugacuucuccuuccuuugcagagccgccgucuagcgccccgaccucgccaccaugagagcccugcuggcgcgccugcuucucugcguccuggucgugagcgacuccaaagugagugcgcucuugcuuugacugaugcugcccaaggaccucugaucagcaccaggggagaggaggggcugcucagggagcugggguccuccggauuccauccacagcagggccagacucuccccaggaaaugggacaggguggcagcggaggcuugagaaccacggggguuggcacuggcuggcaagggaggaagaggccgccgggacugccccagccugcgggcaucugguagaugaagcuugcuugggucaauccauuucuccuggcuggaaacccauggucuuccauuugagaacuagauacgaacagggugaggcgagagggagagggaagaguggguuuugggauuggggccaguuuacccucacccuggagucccuggagcaugggaccuuugaugaagccuccucccgaaucucuuccagggcagcaaugaacuucaucaaguuccaugugaguauccaccccuacaacaguuggcugcacagacaaguugggaaggcuucaggggacauccccucccugcccucugcugcagggcugcgccaccccuuaccacuuccacucccccucgcuuaccccaccuuuguucucuccagcgaacugugacugucuaaauggaggaacauguguguccaacaaguacuucuccaacauucacuggugcaacugcccaaagaaauucggagggcagcacugugaaauagguauggggaucuccacugcaacugggagagaaauuuggggacagggagggaugggugggaggcaagagcaggcaggaguuaggagcuggagguagggugggugacaucuucaucccuaugugacaagcauaaacacacacacacgcucacgaaacaguggccacacaaaugugaggugggguuggaaggagacccuguccagucuucuggcaggucugaaacgacaucuuuaaaauguccguuggcagccgggcaugguggcucacgcuuguaaucccagcauuuugagaggucaaggugaguggaucauuugaggucaggaguucaagaccagccuggacaacaugguguaacccugccucuacuaaaaaugcaaaaaucagccuggcaugguaguggaugccuguagucccagcuacuugggaggcugaggcaggagaauugcuugaaccugggaggcagagaucucagugagcugagaucacaccacugcacuccaacugggcgacagagcaagacuccaucucaaaaaaaaaaaauaaaaguuaguuggaauguucuucucuuucucauauucucucauccuccuguccccuuguagauaagucaaaaaccugcuaugaggggaauggucacuuuuaccgaggaaaggccagcacugacaccaugggccggcccugccugcccuggaacucugccacuguccuucagcaaacguaccaugcccacagaucugaugcucuucagcugggccuggggaaacauaauuacugcaggugaggugggggcaacaaggaccaaaagcccucccuacagcuucccagaaaccuuguuaccauccccuucucccagagggcuggccauagcacaagagaagugcggccucugguugagucuucccugaggggaggaggcagggaaggcccucuggguuggaaugacauccccuaucuuucuguguugccaggaacccagacaaccggaggcgacccuggugcuaugugcaggugggccuaaagcugcuuguccaagagugcauggugcaugacugcgcagauggugagcaucacugaccugcugaugacagugggguggaaggggacaaacuuacauguccccuuauuccaucacaggaggacugaggagguggggggugcccgagagggaugcuuucuccuaccugccucccuaagacaucccucuguuuguccuccaggaaaaaagcccuccucuccuccagaagaauuaaaauuucaguguggccaaaagacucugaggccccgcuuuaagauuauugggggagaauucaccaccaucgagaaccagcccugguuugcggccaucuacaggaggcaccgggggggcucugucaccuacguguguggaggcagccucaucagcccuugcugggugaucagcgccacacacugcuucauguacggcccuggguuucuccucuucgacucuucugccccaccccaagcacaucccuuucuccuucccagcaaaguguuccgccucauuucucccucaucugccccuguccaugcagcccauggccuuggggacaagucgugcuuugaggccucuagggagggaaggaagaaguggcagauuucaugggacuaagcuguuugauggguaucuucucccacagugauuacccaaagaaggaggacuacaucgucuaccugggucgcucaaggcuuaacuccaacacgcaaggggagaugaaguuugagguggaaaaccucauccuacacaaggacuacagcgcugacacgcuugcucaccacaacgacauuggugagggggaaccccgcgacuacuguggccauaauggcuuggggagagugggacccagggagagacuggagcugagguugaagcugcccgguggggcagggguggggcgagggaccuugaagccucgauauacaugacaaagggaguggcagggaagaguuccaugaagucugaggggccuggugcuccucuggagagacccugaauuuccccaacaaguagccucuugcgaguggaaacagcccuguggguauauggcuugggcugggaaggcccuguuuauaugaauuagaaaaagacacaccuuccuuugugggaugcagccucugucugugcuaggauauagaacuuggagaauggagccuugggauggauuccagccuaacuaccucagcugggaguuuuugcagaaacgaccuguacagcuguaugcaguggcucuggccauccaagccuuuuucaacaccuggaacaaagcccuuggggcauggggcaggggagguuuccaggugauaagcgaccagcagaccucccuggaugacugaccuagggauaggcauagcuacuuccucggcacuuggaggggacagauggggaccgccuaaccaguagugaucuuucuccucugacccucuguccucccccagccuugcugaagauccguuccaaggagggcaggugugcgcagccaucccggacuauacagaccaucugccugcccucgauguauaacgauccccaguuuggcacaagcugugagaucacuggcuuuggaaaagagaauucuaguaagugacaauugcgacugacuuagaagguccugaggaguguuuugaccugaaaaugagcccagcgugaucaagggaagacugcagaguuagaggugggagcacugaggcgguggcagauggguccagggauggaugaagaguguuguuuagggagcgaugggcugcaaagguaaauagaugguaggggcuauagguggaguaaaggcucagauuugcauggaagagaauaagggccuucccugguagagauacuuuaugguuccccucucuggcagacucccaguggacagauaaaucuugaugcaaacgccucccuguuuucuccaccuagccgacuaucucuauccggagcagcugaaaaugacuguugugaagcugauuucccaccgggagugucagcagccccacuacuacggcucugaagucaccaccaaaaugcugugugcugcugacccacaguggaaaacagauuccugccaggugaguguuccaagcaucucucuccaccucuuccauaucuccccagagcuccugggcuuguuccagccagcuuaagggugucucucucuagccaaagcccuaaguagccagaaucaggagcucaggucuuugaggguuuaaaccaguccuuauguguuugccagacauuaccaaaaaaaucccagcucugcgcuagucacuucagacugggggcacgagauccuagaaagaggaaacaguaaaagacaauguaacucagugcccaggguguguugugaacuauaaaugaucagguguucaggagagggaggugagugccaaccugagggucagggaggggaggcuuuaaaggaaaugugacuugauaggcauuugaagaggcagagggaagaaaggaagguguuucaguugaaagauacaaaacugagaaggaggcuggcauauuccggguggggaggagaacuagggucugggaguguggauggaauaguggcagaugacagggcuuuuaaagccaagcaggggauuuuaaacuugaugugguagaaaauggggcugcgucaggcacaguggcucaugccuguaaucccagcacuuugggaggccgagguggauggaucacuugaggccaggaguuugagaccggccuggccaacauggugaaacccugugucuacuaaaaaugcaaaaaaaaauuagccaggugugguggugccugccuguaaucccagcuaaucaggaggcugagacaugggaaucgcuugagcacaggaggcaaguuugcagugagcugagaucacgucauugcacgccagccugggcgacagagcgagauucuguccuccccccgaaaaaaagaaagaaaaugggaagucgcuaaggacuuugacugggaaacucuucccucucucugguaugguugggugaugggaucagaaauccccuccucacuucucuagggcucaucuuuuguaucuuuggcgucacagggagacucagggggaccccucgucuguucccuccaaggccgcaugacuuugacuggaauugugagcuggggccguggaugugcccugaaggacaagccaggcgucuacacgagagucucacacuucuuacccuggauccgcagucacaccaaggaagagaauggccuggcccucugaggguccccagggaggaaacgggcaccacccgcuuucuugcugguugucauuuuugcaguagagucaucuccaucagcuguaagaagagacugggaagauaggcucugcacagauggauuugccugugccacccaccagggcgaacgacaauagcuuuacccucaggcauaggccugggugcuggcugcccagaccccucuggccaggauggaggggugguccugacucaacauguuacugaccagcaacuugucuuuuucuggacugaagccugcaggaguuaaaaagggcagggcaucuccugugcaugggugaagggagagccagcucccccgacggugggcauuugugaggcccaugguugagaaaugaauaauuucccaauuaggaaguguaacagcugaggucucuugagggagcuuagccaaugugggagcagcgguuuggggagcagagacacuaacgacuucagggcagggcucugauauuccaugaauguaucaggaaauauauauguguguguauguuugcacacuugugugugggcugugaguguaagugugaguaagagcuggugucugauuguuaagucuaaauauuuccuuaaacuguguggacugugaugccacacagaguggucuuucuggagagguuauaggucacuccuggggccucuugggucccccacgugacagugccugggaauguauuauucugcagcaugaccugugaccagcacugucucaguuucacuuucacauagaugucccuuucuuggccaguuaucccuuccuuuuagccuaguucauccaauccucacuggguggggugaggaccacuccuguacacugaauauuuauauuucacuauuuuuauuuauauuuuuguaauuuuaaauaaaagugaucaauaaaaugugauuuuucugauga

SEQ ID NO: 17456 - RNA, 125806 nt, Homo sapiens
gggggcggggagcccgugaggcugguuacgccgagggaagccccgacuccguagucgcugcacagucugucucuucgccgguucccggccccguggauccuacuucucugucgcccgcgguucgccgccccgcucgccgccgcgaugccaguguuucauacgcgcacgaucgagagcauccuggagccgguggcacagcagaucucccaccuggugauaaugcacgaggagggcgagguggacggcaaagccauuccugaccucaccgcgcccguggccgccgugcaggcggccgucagcaaccucguccgggugagcgcgcagggccuggcgcgggagcgggcgcgggagguauccccggggccccggcccgcgucgcggcugccuguggccggcucgcuggccguggcuuuccgcguggguuccggagccaggcgccgaggguucgaauggccucuucuccgcccugugaccuugagcgaguccugagccucuccgggccucaguguccucaucuauaaaaugggagcagucaugaaaaaggcugccuugcgggcuugucgugaagauauggcgagguauuauucguggagugccucgcgcggcguguggcccacagcagacacccaauaaaugagaguugcugggauguccgagggucccugccccgcgcaggcuucgcccccacguugacuuccucgcucucagcgccuuuuaggccuccucgaucuggcugugcgggggagggagagcgggccuucccacggaucccuugccuucucuucuagggauccuuauuugagccacguuguccuccuuucuaauacuucugccccucacccugagacccgccucgcccacccccgcuccccagagcucccuguauuccgcccuuuuauucacuugccucacucucugucgccuccuccucccuccugggcauuuuacuuaugcucacuccucuggcacucucacaccuuuaugcagucauucgugaccacaagcccgguuuuuccuuccgcucagcccugcugcccuuccuuucauucccuccuguggacauuuucaccuggcguuaccugcugucaaacggccuccucccacuggggccuuucuagacucgggggcccuccuuggccccuccuccuggcaggaagcaagauggagcuguugggagaggccuguggaaucugggaucugccgccccugccggagagaaggcuggggcauccgcuccccauccacaacuuuccugguggcucugcagaccccuguaacccacagcugugacucauaaccgaggugauuccuggaggagguggagcccacgucugaaaugggaaaaaagaggugcugagaccagucucccaagacuccccuggcuaaugucacacuuuucuuucccacccugggugggugacucagacugguccugcuugugaggaacaauuuuggaaaaaguucauacugcucccccacugagcuguguaaauagugugugucagggcaguugggcggcaacugugggucugucuggguggggcuuggguuacuuuucugauuugagcacuuuagugcacuuagaggcucuuuagcagcugaaagucuuccucagucuucaggggucccuggacugucucaagcaauuuaggagacugguagcuaggaagacagggugacaccaccgaccaaauuccugaucuuucuucucuauagcuuuaguaagaaucuauucauucaguaagaaugcuguauucauucacaaugucuacuuguacauuguucuucuuuuuauaacuaauuugaacagaacacuccagaguacauucuuauguaguguugucuaacauggcugcauuccaggccuccauuuuucaacaaauaggaaacaauguaaagagacaagguaauagugucucuccauguaguacuucaggaaaugaaaucuuaaaaccacauguugcacuuggaacagagcuaguguagucuagggguugauaucugguuaggcuauuuagagaaaaguuauuuaugggcuuccaugccaugaauuaauaagcauugaaugucugcuauauggaaaacacugcaauaaaucagugcuucucagcuuaagaguguucaugaaaaucaucagugaggcuuuuuagaaauuaagauguccagcucccacgggucaaggccuuuguauuuugcuuuuuuuuuuuuuuuuuuuugagacagggucucgcucugucacgcaggcgcuggagugcaauggcgugaucauagcucacugcagccuccaucuccuggacugagaaaaauccucccaccucagccucccaaguagcugaaggccuuuguuuguuuguuuguuuguuuguuuuugagauggagucuuccucugucacgaggcuggagugcagugacacgaucugggcccacugcaacguccuccucccagguucaagugauucuccugccuuagccucccgaguagcugggacuacagguucgcaccaccguggccagcuaauuuuuguauuuuuaguagaggcgggguuucaccauguuggccaggaugaucuccaucucuugaccuugugauuugcccgccucggccucccaaagugcugagauuacaggcaugugccacugugcccggccaggccuucguauuuuuuaggaagcuccauaggugauugugauauacggccuuaguuaggaaacacuguaauacacacugugagacaaauacaaaagaaauaagguuauaagaugaaaacaaugauauguaguuaaguuauauacuuuccaacacauacaaaagaggggacuugagauuggugguagcuauggguuagcagagacaaaguagggaggauugugcugauaaauaguuaaucaugaacaaagguacuugugaguaagucacuuccagguuacagcaaguagauuaucuugauugcagcucaggagacaaguuggagagaaauuggagaugaaguuagugcgugacauaugggcaguguaacauaggccuuauccaaaaggaugaacaaagagagcaggaggggaaggaggaugagaauagugugugagaaagacugcgugagaauggcgugugagaauaguauaguguguuuuggggaggccagaggaccuacccauugcuucacauucuuggugccaacugugaccguuaaauauguggauucuguacaugcuucaagauuguuccuggaggucaagccuugucugauauuccucucuuuuuaaaaaauuuuauuuugguuuuaaauagagacagggucuuguuauguugcccaggcuggucucgaaucccugggcucaagcaauccucccgccuuggccucucaaagugcuggauuacaguugugagcuacugugccuggucugauauuucuuuauaugguccucaguuccugcccucaaaauuggcacauaggaucacucaauaaauauuguugaaggaacuaugggaagggagacaaauugggaagcuuuuaaaauugguugguuaugaagaaaaugaaggccuggacuugcgaguggcagggaaaauggagaaggaauuaaucagaaauauauuagaagaagaaauaauagaacuggauaauugaacucugaauuugcuagaaaagaaacauaguauuacgguaaaauaaugaaacugauuuuagaacaaaucuucuggaauuuauguaaucugggugaguauuucuugggaguuacuuugggagguuauauccuuauucuagugcuuuucuuugggaauuucuuucagauuauuuacauacguaugccaaauuagucuuauuuuggucaagaaaguguacauuuugacugaaguaggcauucuugagcucaacuacuucauuuacuguucuugagccuaaaugacuuuuggauauuuccauaauuaaaauuuacuagaugaagaugaaauuuucaauuguuguaauagucauucacuuaucaagcagguguuuauugagaccccuuccaaugucaaagcaauaagugugaugccugucacaaucaguaugauacugaauuggaagucuuuuuuuucugagauggaguuacgcucuuauugcccagguuggagugcaguggcaugaucuuggcucaccgcaaccucugucucccagguucaagugauucuccugccucagccucccuaguagcugggauuacaggcaugugccaccacgcccggcuaauuuuggauuuuuaguagagacgggguuucuccauguugguuaggcuggucuugaacuccugaccucagguuauccgcccgccucggccucccaaagugcugggauuacaggcgugagccaccacgcccggcugaauuggaaaucuuaaguggcacugaggaaacagaguaugauggaaagucagaggaagacgagauuacuuuugauuggagaaucagggaaggcuucacagaggauauaacauugaguugggucuuaaagacagauaggauuugaauauuuagagaugugguaagaaagguauuacuuggccaaguaugguggcucaugccuguaaucccagcacuuugggaggccgaggcgggcugaucacgaggucaagagauggagaccauccuggccaacagggugaaaccccgucucuacuaaaaauacaaaaauuaacugggcaugguggcacgcgccuguagucccagcuacucgggaggcugaggcgggagaaucgcuugaauccgggagguggagguugcacugagcugagaucuugccacugcauuccagccuggugacaaaggaagacucugucucaaaaaaaaaaaaaaaaagaaagacauuacuuacuuuuaugggggcagaacucauuaggauuuguaauuucauguauauuugcuaagcaaaguagucuggucacugauauauauauauaaauauauauauaaaauuugcaacugggucaucacuuuuacuccacaauuagggaggggguagggugggaguauuuauuuauuuauuuaucuugagauagagucucacuguguaguccaagcuggagugcaguggcgugaccucagcucacugcaacuucugccucccggguucaagugauucuccugccucagccucccagguagcagggauuacaggcauguaccacuuaaaacucuauuuaaggcaguuuuaaacacagagagugaguccaauucaauaaugaaacaaggaagaggagguagucaagggaagggugggaaaggaaaaauaggagaagggcacaagaaauucuaagaaggcuuggauucagcaggcagugugaaaaagucacaagucuuagacugaguacuuuguagcaugguauauaaauuuuucuuuuuuucauuaaaauggcccauagaaaugugucagucugugaugugacauuauagucaugccaguuuuguuaauggggcuucagauacuuugcuuucuccagugcaucugagagcauguguuguaaguacuccuugggcucaugaaauauuuauuuugggaguuuuuuguggccuugacuuuuaugggccucacuuguauaucauauguucuugggaccagcucugggacaaauagcaguauuaucuucacuuuacacugauaaaugggaaagacugcucugcucuuguuuuguuguuguuuagagauggagucgcucugucgcccaggcuggagugcaguggugugaucauagcucacugcagccucgaacuccugggcccaacagauccucccaccucagccuccuuaguagcugggacuacaggggugcaccuccaugccuggcuaauuuaaaauuuuuuuuauagagauaggguuucacuauauuuccaaggcuggucuugaacuccuggccucaaacaauacugcugccucagccucccaaagugcugggauuauaggcaugauccacuguguccagccuacucugaucuuaaaaggagaucagcaguuaauuuugucauuuguaauuaucaguauuaacaucugaaaauauuuuugcuuuaaaauuugguugauauuagacuuuauuucaguuaaguaaauaacaguguuugggugggugauuuuuuucuucuuaauauauuucuguauuuuccaauuuuugaaaauuaauauauaauuccuaugcuaaggaaaaaauagaguaaauaaaaagaauauuuaugugaucauuuauagcucauaaaauacuuuuauauuuauaaucucauagcagucuauggguagguauagugguggucuccguuuuacagaugagggaggauacuguaguucagauaaauuaaguaaccugcccacaguggcacagcugguuaaccuggacuugaacuguggucuguuguuccagauccucugcuuuuuuucacaccaccauuccacaucuacuuagagcaaaguuguuaaauaucaguggagguuucccaccuagaaucagaagcaacaggaaugcuguuagucauagagguuccauuuguccugggucuggcaacaguaucuguuuagagccuggcuuuagcauagccugcaugaauggccuauaugagaagaaugaugugaagguaagcuuguuucauagccacacccaauuucauagcauuucuuuucuuuucuuuuuuuuuuuuugagacggagucucacucucuugcccaggcuggagugcaguggugcgaucucagcucaccgcaaccuccgccuccuggguucaagcgauucuccugccucagccucccgaguagcugggauuacaggcaugcaccaccaugccuggcuaauuuuuguauuuuuaguggacacuagguuucaccauguuggccaggguggucuugauuuccugaccucaggccauccacccuccucggccucccaaagugcugcggucacagacaugagccaccacgccugauccacagcauuucuuuuuugagaaauuagaguagauacagaucagcacaaaaguaugccugcaaaacagaugaagaguuuuugugguauaugugccugcuuagcuugaagccuguuagaaugaaaucguauguaaaauaacuuuguagauuacuuggggaaucaugaaguuucauuuguaaagcuguugcuacaucaaaagagauguaagaacgagacagauaucuauaucuauagauagauauauguauuuuucuuuuuuuucuuuuuugagaugcagucucgcccuguugcccaggcuggagugcaguggugcgaucuuggcucacugcaaccucugccucccagguucaagcgauuuuccugucucagccuccugaguagcugggauuacagucgugugccaccacgccuggcuaauuuuuuguauuuuuaguagagaugggguuucaccauguuggccaggcuggucucaaacuccugaccucaugugauccacccgccuuggccucccaaagugcugggauuacaggugugagccauugcacccagccagagacagagauauauuuuguuccaaucauuuuuaacauuuacucaugugacugagagaacagaagauuuuuggagaugggcaguuauccgucgguauccaugggggauugguugcaggaaccccccucggauaccaaaaucugcagauacucaaguuacuuacauaaaguggcaugguauuugcauauaaccuaugcacauccuccuguauacuuugucaucucuagauuacuuauacuguaauaccuaauaugauguaaauguuauaaauaguuauacuguuuuuuuaauuuuuauuuuuauuguuguauuguuuuuuauuuuuauuuuuauuuauuuauuuuuuugagacagagucucgcuguuucacccaggcuggagugcaauugcacgaucucagcucacugcaaccucugccucccagauucaagagauucucccaccucagccuccugaguaguugggauuacaggcacccaccauaaugccuggcuaauuuuuguauuuuuaguagagacagcguuucaccuuguuagccaggcugcucuugaacuccugaccucaggugauccgcucgccucggccucccaaagugcugggauuacaggugugagccacugugcccggccuauuuuuauuuguauuuguauauuuuugaucuccaguugguugaauccauagauguggaacucaaggauaugcagggcuauagcuauguuuaaauuuuaauggaaccacaacuuaaauguuuguuuacauccacacaguggaaaauugggcuuuucuaaagcuguuuuauaaauagagcugguauaacucuaaauggacaaaguaagagggcaaaaguccucugguaucagcaacaguagcuuagauuggguccuccuguuacaguccuggaguaaggacaacaguaggacaaacuacuuuuauaggacucauuugaauuuuacuauuucuuagauauuuguuuaaaaacaaacuagccugguuauuucauacacagguugaguaucucuaaucugaaaaucugaaaucugaaaugcuccaaaaucugacuuuuugaguauugacgugaugccacuuguggaaaauuccacaucugaccucaugauagguagaagucaaaacuuuguuucaugcacaaauuauuacaacuauuauguaaaauuaccuucaugcuauguguauaugaaacauaaaugaauuuuguguuuaaccuuugguccuaucuccaauauagcucaugauauauaugcaaaaauucccaaauccaaaaaaaucugaaauaugagauacuucugaucugaagcauuucagauaagggauauuuaaccuguacuuauuuaauuacucaucauuuauauaguuaugaaguguuuauguuuuauauauagucauuuuauuuuuauuuauuuauuuauuuugagacaggaucuugcucugcugcucaggcuggagugcaguggcacaaucugggcucacuguagcgucgaccuacugggcauugauccucccaccgcagccucccgaguaguugggacuacaggcuuacaccaucaugcccaacuauuuuuguauuuuuaguaguauuuaaacaaauauccaaaugggguuuugccauguugcccaggcuguucuugaacuccugggcucaagugauccaccugccuuggccucccaaagugcugugauuacagaugugagccagugugccuggccaggauuguaacuuuaagagccuucugacaacuucccagucuuucacugcacccuuugaaauggguaggauaggaauauccucauuauccacagccuguaguucagcauagcauggagaugcucuguuauuacacucauacuuguucaguguuugucaucucacuaaguuguagguuccucaguggcagggacaauaugccucuccggguuauagguaugcaauauacuuuuuuuugagacggaguuucgcucuguugcucaggcugcagugcagugggacaaucuuggcuuacugcaaccucugccucccggguucaagugauucuccugccucagccuccugaguaccugggauuacaggcacgugccaccacacccagcuaauuuuuguauuuuuaguagagacaggguuuuaccauguuggucagguuggucucgaacuccugaccucaagugauccaccugccuuggccucccgaaguacugggauuacaggcaugagccgcugcgcucagccuaaauuuuuuuuuccuuuuuuuuugagauggaguuucauucuuguugcccaggcuggagcgcaguggcacaaucuccgcucacugcaaccucugccuccuggguucaagugauucuccugccucagccucccaaguagcuggaauuacaggcacccaccaccauggacggcuaauuuuugguauuuuuaguagagauggggauucaccauguuggccagucuggucucgaaguccugaccugaggugaucuacccaccuuagcuucccaaagugcugggauuauaggcaugagccaccgcgcccggccuaaauuuuuaaauuaagugaacauaugcauagcauuuauuuuuauuuauaacauauaauauuaggaauuaucguacagugaauauuucccauccccagcugucaaauaucugguauagucaaauuugagccaucucauggaauuuauaaugggcuuugacugaaacaagugaaauauauacuaagaggaaugaauggcuaacugcccauuguuugagauaacaaaaguguucaggcuauuuuggguugugguuuuucuguuucagagucauuucagcuaugcagaucacuuacuaaauucauaaugugagaguauguuaccuucuaucugaaaguggcguugggauuuugcauucucuucuugggagugccuuuuuaaaauuuaaugauuuagaccagauguugauauauuauuuggagcccugcugguuacaauguagucucauacuaugagucagaauuccucauuaaaggaucuuuauuucccugaaccauauggcaagagacaaagauaucacaaaguugaucugcugcuuuuuugcuuucuggcugauuugggcccagccuuuucauuaaaccuuuaggucaugguuccgacagcgggguguauuuuuacauaauaaaccagcauuagggcaguaucaaaagaaguagcagucuuuaaugagcaaauaucagagauuagcugcuuucuuuguagauguuucuuucuagaauaugcuguuuggucagaauucuugaugaggaagguccauucagucaguucuuguugcucucaggcaggucaacccuuaaaccuuuccauacagauaggacuagaauaaaaaacaaacuucugccuuggcauuuuuaagcuucaacaacuuucagugcuauauaauguaaauccuuaagaguuagcuuuugggggggaaaauucaagucuguaauaagacugaaagauagagaagaaauuugauauauuggaggaaggacgucccauugaaagcuuucaugugucuuucuuuucccuguaccuuggaucuguagaagucuugcaguauauguuugaauauagugggccacauaaguucaggugaaauaauuuucaaauugucuagguggcugcugcuuuccccccccccccccgagccauuuuaguauuuaauucuguuuuuuauuuuuauuuuuuuuugagacggagucucgcucuauugcccaggcuggagugcaguggcgccaucucggcucacugcaagcuccacuucccggguucacgccauucucccaccucagccucccgaguagcugggacuacaggcgccugccaccacgcccggcuaauuuuuuuguauuuuuaguagagauggaguuucaccauguuagccaggauggucucgaucugcugaccucgugaucugccugccucagccucccaaagugcugggauuacaggcaugagccaccgcgcccggcuuuaauucuguuucuauugggaauuguuauggaaaggaaagcugucuuaccuuauuuauuaauuauuauuauuauuuugagacagagucucacucuguugcccaggcuauggcaugaucuugacucacugcaaccuccaccucacggguucaagcaguucuccuguuucagccucccaaguagcugggacuacaggcaugcgucaccacaccuggcuaauuuuuguauuuuuaguagagacgggguuucaccuauuggccaggcuggucuugaacuccugaccucaaaugaaccacccccucggccucccaaaguguugggauuacaggcaugaaccacugcggccagccaccuuuuucuuuuuuuuauuuuucuuuacuuuuuugagauggagucuugcucuguugcccaggcuggagugcaguggugagaucucagcucacugcaaccucugccuccuggguucaagugauccucccucuucagccucccaaguagccgagauuacaagcaugcgccacacacccagcuaauuuuuuguauuuuuaguagagacagaguuuuaccauguuggccaagcuggucucaaacuccugacuucaagugauccauccgccucggauucccaaaguguugggauuacaggcugugagccacugcaccagccuaccuuuuucuucuuaacaaguuacaaaaagauuuauuagggaaggaaguugagaauauguaaguagggaauuuuguucuuuuguauuuuuaucaaaguauuuuaguuuucauauugcauuaaaaaauaauacuauugaacaguauacuauuaguaaucacuuuuuaucaugcugugucuucauauagucugaaagaauaauuuuucuuguuacaaaauaaugcauuuuuauuguugaaaauuuagaaaaucuaucuuuauuugcaaucuucugucaguauuucucagccuuuuucauuucugucuacuugaacuugauuugcaucauuuuuucuuguuacuccaaaccaauuuauguuucucuggguauaaauacaaauuuaacuauauauagaugcaccagcucuuauccuuuucaccguuuaaaaaaaaaaacaaacaaaaacaaaacccaucucuaguucacuuuccugcuuaugaauuuucaaagcaaggugaggaaacccacugucuuaaaauaccccaagacuuucucugccaucuggggagcugugcuguagacaggaaacugcugcuucagaaaauaugaaaugaaauaacuucaagauaaugagccucauccugaaagaacuucuggucccaacauacuuauuaagacaugggggcugggcaugguggcucaugccuguaagcccagcacucuggggugcugaggcagguggaucaccugaggucaggaguucgagaccagccuggccaacauggcgaaaccccaucucuacuaaaaauucaaaaaauuggcugggcaugguggcaggugccuguaaucccagguacaugggaggcugaggcaggagaaucguuugaacccaggaggcagagguugcaguuagcugcgccauugcacuccagcgugggcaacaagagugaaacucuaucucaaaaaaaaaaaaaaaaaaaaaaaaaagacacgggaucaaauaaccauugauuaaauuaaguaugugcauugcauguaugcaaagagguagagugggauagaguguuagguaaaaaggaacuuguauaauuagacguaggaaauggggaacucacugccuucuuucaagucccuugguaaauguagauuuuauguccucauauacuggaucaucaguccuuggaugauggauuucauaucgaauuuucuucccccucuccucccuacucuccuagggugucucccuuuagacuguugguuucugaagggcaaggaguggguuuuauucuucauauuauugguucuguguuuaccauaguccccugcucaugguaguucuucaauuaaguguguuauguucugauauuuaauauaccagcuagucauuuuagguuauuuuaugauaauaaggauagcugauuaucucuugccuccacuggaaggcaugauguuucucuuuuccugcccucaaauguugcuauguaccaaauauuuauacagucucaaagagaaacaaagauucauaaacgauauuauauuguguuggguacauauuuugaacuuuuagauuccaaaaaauuccaugucacuucuaucagaaguuagcacacuggauuggcauaagugugggguguguguauagaggagagagguggugaaucuuagaacucgaaauguuuuacaaauguuguuaagcugcagaaaauagagucuuuggcccuuagagaauuucccacugauaaaauuuccaguugaaugacuuuuaaggggaaaguggcugaauuucacugcacuucuuaccacagcuggccaccauccaagucaaagucauuccuucuuuugaaauaagcuuaaguuauucccaugaguaagcuuucugugaagaaagaaauggcacaguuguuagaguugagaguugagggaccuuuguuauauagcuuucuuguguuuccagccuucucuuuguccucucuccaucccuggagaacuggcucaucuuuuaucuaccagguggauaacauguuuuuauucuugcaauuaaaauagauaaggguauaugaauaggcuaguaaaucucauaagaaaaaauguagaucagcaacacuuaaauuucucauucuacaauucuccccaaauaguaaaguuacuugucaaacuccagcuaugcacauugcuagguguugggauauauaagauauggucucuggccucaaguugccuaaaacacagaugaaaucaauaaucuuauaaaaaagauuuauucacauccucuccaccaauauaauuguugcagaauuuauauuauucuucuuaaagaguuguguguuaacuacuacaaauacagugguuuuucuucuuuggagucauggagaagaugugaagugguagggacgugggggaagagugacacacacacaguaggccagcagcagaucgagacugguaugguaugagaggagugaggagauggugggccaccuaguuaggaagagaccuuugagcauuggccucagcugcuuucugcuuguggcugcccaaacucacuggguuuuuguuuccuccaaaguacagugcuuccuguuggccuuccuucugccugauguacucuucuguaguucuuuacuuggauaauuucuacuaauucucaguuuucauaguaaauguccauuuuucagggacacuuucccugacuaccucuaagcuagguuaggcccuucuaucauguacuuucuauauuuuuuccuuauuaugcuuaucacaauuguaauuaauuauuugugugauuauucacuguuuaacauaucuccccaccagagccucaggggcaaauauuggcucugcuguguuugucucugaauuuuuaguauccaucauagugcuuggcauauaguaggaucuugccuuguggaguaaaguauuuguucaauaaacaaauaggaaggccauuuucugcugcgaucaaaaacuguuuuaagcuucuuuggagaaauauauaucaggcugugguugaaucuuggugaaauuuaacugccaauuaggaaaguagcuguaaauaauugcuuaacacagggcauugcaugcaaaaggaccaucuaauuuguguucucugagugaaaaaaauuuaggcacagaguccuggggugcagauggggauaauccugcacagcccagcacaggauuauacagaauauguaagugugaauaaaaaaauaaacauggauguagaauucucuauuaguuuugaucuuuugcaaaugagcagaauagccaucuuuggcaaaaugugguaguaugaguuagcaaauaccaaagucacacuuuagauauagauacuagauaaaucagcauaugauaaucagcacaugauaaaaauuuugggaagcaguacaguaguauaaucguuaagcauuaaacuccuuauuuuaaaaucccauuguugacaccuucgagauagguaacauuggggaaguuauuuaaucuccauuucucuugauccuccuauguaaaacaaagguaaagauaguaccuggcugauaauguuguuguuguguggguuaaauuaguucauuaaaauguuuauaacuauuccugacacagagcuaagagcuuuaugaguguuagauuuuaucauuacuauauuuucccaugauuuuaagucauauuuuaaacguuagucuaaugaaaaggcaguguugauuuaaaaaaaaaaugucuaagcauagcuucuaacuuuuauucaacaaggcaaaaugccaaugaaagcuuucaguagaauuccauauguuguggaauauacaguuuuaccaacuguggggaaaauaucacaguuuuaggugcuugaaccuuugauugccaguuucccaugauuaaagauagacaucuaaauuuuuaauuuauauuuauuuuguuagaagcaauagugagggaaaaaguauauauauauuuuccaauuugaagcaagaauuaggguuuaggauuuaggguuuuaacucaagcauuaauugucuuuucucuuuucuuuucuuucuuuucuguucuuuuuuuggagacagggucucacucugucacccaggcuggagugcaauggcucaaucucggcucacugcagccucaaccuccugaguucaggugauucucccacaucagccuccccaguagcuaggacuacaagcauguacagccaugccuggcuaauuuuuuuuguauuuuuagcagagacgggguuuucccauguugcccaggcuggucuugaacuccuggacuuaagcaguccacccgccucagccucccaaauugcugggauuacaggcaugagccacuaugcccggccaguguccuauuuucuuaaaaaaaaaaaaaaagaaaaaaagcaaaacgaaaaucccaaagagguacccaggccauucacugaaguaauaagauagaaccagcuuuccagguagaguugagaaauauuaugcauuugugaaauacaauucaucauauucuggaacagccaauuuaguuuugagacagggucucacucuguuguucaggcugaagugcaguggugugaucucagcccacugcaaccuccaccucccaggcucaagcuugcauuagucuccugaguaguugggacuacaugcgugcacuaccauaccuggcuaauuuuuguauuuuuuguagagaugggguuucugccauguugcccaagcuggucuugaacuccugggcucaagcgauucucccacuucagccucccagagugcugggauuacaggugugucaccaugcccagcagcuuaucaaauauuuaaugaguacauucuauuccggauacuagacuaacuuaauuucucuugucugaaaaaagggauagaaucgcuuucagauuccuaccaaauauaggaguaauagaguugaaaagugagauuaggagaccuuaacuacuaguuuagagguuauacucaguauuucuagucuuucaagaaguuuuuugcuaugcauauuuaauuucaaagucuuaaauuaauuagcauuucuacuauucuccugaguaauaaaaggauauuaaaacaauuuuuggccaggcccuguggcucacgccuguaaucccagcacuuuggggggcccaggcggguggaucgcuugaggucaggaguuugagaccaaccuggccaacauggugaaaccccaucucuacuaaaaacacgaaaaauuagccgggcgugguggcuugcgccuguaaucccagcuacucgggagacugaggcaggagaaucgcuggaaugcgggagguggagguugcagugccacugcacuccagccugggugacagagggaaacucugucuccaaaaaaaaaaaguuuauauuucccacuugguaauuucuuuaguucuuccaguuugcuaauucuuguguaguaguuucuaauaugccauuuaauccauucacugcauuuuuaauuuaaaugacagucuuuuccuuuuuuucuuucuuuuucuuuuuuuuuuugagaggaagucucacucuguugcccaggcuagagugcaguggugcgaucuuggcucacugcaaccuccgccucccagguucaagcgauucuccugccucagccucccaaguaucugggauuacagucauccaccaccacaucaggcuaauuuuuguaguuuuaguagagacaggguuuuaccauguuggucaggcugaucuugaacuccugaccucaagugaccugcccaccucagcuucccaauguguugggauuauaggcaugagccacuacgcucagccuuuuuucuuuuuauuuauuugcuuuuguaaauaauggggucucccuguguuucccaggcuggucuugaacucuugagcucaagggauccuccugccugggccucccaaagucuugggauuacaggcaugagccaccacauccagccuaaaugacagucuuuuucccuucuauaauucccuuuggaucuuuuucaaaaucugcuucaguuuugauagucucuuguucuuuuauuauacuuaaaauugucauuucuuguuguucguguuguuuuccuuggaguauagaaacuauaagagcuuaauaccagagagagaauagcaaggcacuuuuaaaaucuggugaaggcuggguaagguggcucaugccuguaaucccagcacuuugggaggcugaggcaggcagauugcuugaguguagaaguccgagaccagccugggcaacaugacaaaacuccuucucuacaaaaaguauaaaaauuaacuaggcauggugguguaugccuguagucccagcuacuugggaggcugaggugggaggauugcuugagcuggagaucgugccacugcccucuagccugggcaacagagcgagacucugucucaaaaagaaaaaaaaaucuggugaaaugugaggauaaucuuauuguuuugaggcugcaagagucucucacucuuuuuuaauuuugguaaaauguacauaauauuagcuuuacaauuuuaaccauuuuuaaguguauagaucuguggcauuaaguacauucacauuguugugcaaccauuaccaucacauaccuccagaaccuuuuuauuuuccccaacuaaacucccuauuucucauuccuccuagcccagcaaccaccauucuuucugucucugugaauuugacuacucuauguaaguggaaucauacaguguuuguauauacuguauaacauauaguauaugauaugcucuauauaagugaaaucauauaguauuuguccuuuugugauuggcuuauuucacuuagaauaaugucuucaagguucauccaaguuguagcauaugucagaauuuccuuccuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuccuuccuuuuuaaggcugaauuauauuccauuguaugugcauaccacauuuguuuacccauucauccauugauggacauuuggauugcuuccaccuuuuggcuauugugaauaaugcugcuauuucaucauauguuuaauaucuuaagaggccugaacucugucucugaaggguguaagcugcugcugcugcuuuuucuuucuuucuuucuuuuuuuuuuuuugagacagggucugguuuuguugcccaggcuggagugcagugguaugaucucagcucacuacaaccucaaccucccaggcucaagccauccucccaccucagccucccaaguagcugggacuacuacaggugcaugccaccaugucuggcuaauuuuuguguguauguguauauauuauacacauacaauuuuauuauacuuaaaauugucauuucuuguuguucuuguuguuuuucuuggaguauagaaacuauaagagcuuaauaccagagcgagaauagcaaggcaccuuuaaaaucuggugaaggcuggguaagguggcucaugccuguaaucccagcacuuugggaggcugaggcaggcagauugcuugagcguagaaguccgagaccagccugggcaacaugacgaaacuccuucucuacaaaaaguauaaaaauuaacuaggcguggugguguaugccuguagucccagcuacuugggaggcugaggugggaggauugcuugagcuggagaucgugccacugcccucuagccugggcaacagagcgagacucugucucaaaaagaaaaaaaaaucugguaaaaugugaggauauauauaggauauauauauauauauauauauauaaauacauauauauauguguauuauuuuauuuuauuuuauagaaugggguuuuaccauguugcucaggcuggucuugaacuccugggcucaugugaucuaccugccuuggccucccaaagugcuaggauuacagguguaagccaccgugcccagcuggaauguaagcuucugacggacuugggcuaggacugugaacuuagccucugaugccaaggagcaaacauggaaugaaagcaggccaaaggcccuuuugcauaauauggcaguaaggcaggaagggaaguucauuccacuuuagagaggcaguguuugaagcaugaggaaguuugccagccagagaaaaugggaauaccuucugugcagagugaauacaaagauacaagggugugaaugugcaguuagggaauggggaagcuuuaguaaugagacuguuaagguggauugugucccuugugaagggacucagacgacauaaaucaguuaaaaaaaacaaaacuaacuucaguuuuugaauagguauaggauucaccugguucaaaauuuaaaagguaaagguauacagugaaaagucucccuuucccccuugaacuccagccacccaguuucccuccucauaggaaaccgaugcacuuaagaaacccaaugucuuggauaugcuucuagagauaguuugugcacaaucuggcaguaacuaguccccuuucauacaaaugaagaccuguuauacugucuuguccuguuucuugauuuuuuuuucauccuuugcauguuuuggggaacauuucuugcuuguaucuacagaacuuucucuucuuuugacaguuaaauaauagucccuugaugguuguagauaauuuauuaaacuagacccuuauggaagguuauuugugaucuguugcuguuucagacaacauggcaaagaaugacacaaauaugucaguuuacguaugugcaaguacauuuacaggauaauuucuagaagaggaacauacuaagcauuggauguuagaaaacagagaaaucuuguauuauuauuauuuuuacuuuauuuuacuuuaaguucugggauacacaugcagaacaugcagguuuguuacauagguauacaugugccauggugguuugcuacaccuaucaacucaucaucuagguuuuaagccccgcaugcauuagguauuuguccuaaugcucucccuccccuugucccccaucccccuacaggccccagugugugauguuccccucccgaaacagagguguuuaagcugauguauaaaauuuugguaaaauaauccugguaguauugaggaagauagauuggagcgcuggugagacacugggguuggagagccauccauucaagcaagagguaguaagagcugccuucaggcagugguaggagugcagauagagaaaagacacaucugcagcauguguagaguacaagagggagagggaggaaaaagaaaagauaaauucuagagauagacucauuauuacuuaauuuauauuuggauucauaguguucucgauuuugaaaaugaaucaguaaaguaaauguuuuaaaaauaacuaauuggcccggugugauggcucacgccucuaaucccugcacuuuaggagguugagauggucagaucaccugaggucaggaguuugagaccagccuggccaaaauggugaaacccuuucucuacuaaaaauacaaaaauuagccgggcgugguggcgggcgccuguaaucccagcuacucaggaggcugaggcuggagaauugcuugaacccaggacuuggagguugcagugcgccgagaucgcgacauugcacuccaaccugggcaacaagagugaaacuccgucucaaaaaaaaaaaaagaaaaaaauuacuaauuuauuuucaggggagcacuaugugguuauuaucucuauuuuacagguaaggaaacuaaggcugaaagcauuugaguaacuugucccgagccaguaauugguggugucggagugcaaauauuuuuauuaugcaaaugagcuuacuuugagaugcagggcagaaaaccuagaauucuuauuaaaucuaaaagaucucaucaaugauuuuauugaagcugaauaugaaagaagucaugccuuaaccuuuuugaucucacuuggaaaaagaaaaacuaaauacaauagcugguagcauggauccaccuagagagaugcugcaagaaaacacaaucuaguugaagugagagcucaaaggauggcgcauaaggaaagggcuugaauucaggaaugccaguguuuuuuaaugacucugauauguauuccaagcugggagggacagauaucuaugcuaguaagaaaaaacagggucaaucacuugguggcucaugccuguaaucccaacaccuugggagaccgagguggguggaccacuugagcucaggaguuugagagcagccugggcaacauggcgaaacccugucucuacaaaaaauacaaaaauuaggugggcaugguggugcacaccuguagucccagcuacucaggaggcugaggcagaagggucacuugagcccuggagguugaggcugcagugaaccaugaucgccccacugcauucuggccugggcaacagagcaagaccuugucucaaaaaaaaaaaaaaaaaaaaagagagcgagagauaaaacaguaggguaaucuguuuaugauguauguguggaagagugcauacuaaaaugguggcgggauugaaugguaggauuucagguuaaauaauuguuuuaaugaaaaacuuuuucugaccauaguuugugcuuuuacccuaacaaugaacaugugccacuuuggaaauaagagaaauaaguuccguauuuccccuccaucuuuucguuauuguuuguacucuucccacugccuggaguugcccuuccucucucauuagaaugggcccagugcagaugucacucucuucaugaagcucuucccaggcugcucagcaaagggaagcucucucccuuugcuguguuacuaaaauauuugacuaugguuguuaucaugaauuagaacuaauuguguucgugucuguuuccaccccuccuuucucugaccccccuacccagcuuccaaauuugaguccguagaaugagaguaguuacagacuucaauguugaauugguugcauuuucagcacugcaguuuuuuuuuuucccugucagaacaagaaaagauagauaaaaauucugagucauagaagaaugacuuaaaacuuccgaaggcaaugauauaucuauguaagccauaugaauacucuugccuaauuugggaacucucuggaguaaacagggccauaaauaaauaaaccaucucuggaacuaccauaccuauuacaucuguaaaaccaaaacaugauugccacauuucaacugacauauaccagaagacucugucucugaacuggaagcuccaacuugggcuguucuaaagcuucuguaaaaaggcaaauuccucaguuagucugcugaaguuauauacuauaaugauagcacuagagaaugagaaugcaaaaaucuccuuuuuucuccuucuugucuagagauugaaccuuuuacuuauucuugccagauaaauaaaccauuccucuucuuuuuuuuuccaacaaauguuccguugaucuuuccuuuuacaucuuuuuucuucuuuuuuuccucaaagcaaccagucuggauuaggcugauuguuaucuucuaaucucuccuuccuuuccauuacugccaaguaaaucuuucuuaaguauagcucugaucucaaaagguucuugcucagaaaccuaugccuuguccccagucuuccagauuaauuuaaauuccuuauucuagcucuucagggcuaucacaucccuaaccccuuucugauuguauuauuucucuauggagagcagaagucagcaaacuauagccuguguuuuuaacuguccaggagcuaagaauaguguuugcauuuaaaaauauuuugggaaaaaaacagaagaugaauauuuugagacacaagaaguuauucaaaauuaaaacuucaggccaggcacgguggcucaugccuguaaucccagcacuuugggaggcugagguggguggaucaccugaggucaggaguucaagaccagccuggucaacauggugaaaccccaucucuacuaaaaauacaaaaauuagccgggcaugauggcacgcaccuguaguuacagcuacuccggaggcuaaggcaggagaauugcuugaacccaggaggcagcaguugcagugagccaagauugcgccauugaacuccagcuugggugacagagcgagacuccgucucaagaaaaaauaaaauacaauaagaauaaagauaaauaaauaaauaaauaaauaaauaaauaaauaaguaaauaaaacuucaguguccguaaugucuuuuuuuuuuuuugagacggaguuucguucuuguugcccaggcuggagugcaaugacacgaucucggcucacugcaaccuccgccuuccagguucaagcaauucuccugccucagccucccuaguagcugggauuacaggugcgugccaccacacccggcuaaauuuuuuuuguauuuuuaguagagaagggguuucgccauguuggccaggcuggucuuaaacuccugaccccaggugauccaccugccucggccucccaaagugcugggauuacagaugugagccacugugccuggcccacauugucucuagaucuccagggacucucugcuguuauauaucucccaccuaaacucuuaguuucagaugguuuucauuuaugaaccaaauauagacuuguguuguucuuuaaugaaucauuagaagugaacuugauauuuauugaggaaugaagauaaaaggauuguagcuuaguguguacgugcuuugccugcacugucuuuaaugcaguuguggguaaugagguuucaacaaaaggcugcauaugugaugaugguaccauaagauaauaauauauuuucacuguaccuuuucuauguuuagauacaccaauacuuacaaucguguuacaguugccuacaguauucagaacaguaacaugcuauacagguuuguagccuaggagcaguggcuaugccauaaagccucggcauguaguaggcuauaccgucuagguuuguguaaguauacucuaugauguucacacaaugacaaaauugucuaaaagcacauuucucagaauauaucccugucauuaagcaauguaugacuguacuuaaaacagugacaaacuggauaaaccaaugaacucucuaguauacuguaauucucucaauucugacuaauucugauuauuccuuuugccuaacugggaauaaguuaucugagaugguauagccuaauuuacuaaugaguuugguuguccguggcaacuguucaauaucuaggcugcaguauugauguuuuauauugguaagcaagugaaacaaaaggaaaugaaguuaacauuucuauaaaagucuuuuucuuguuuuagaccaaaggcugugucuaaucuauuaauguucuaugaagagcagugaugaaauacaaucugcaaaaggcacaaacacaaauaguauugcuggagcugguuuacagcuuauuuucuaucaauacaucucagccagcaugcucuggaagugcuguagcuguucucuucuuucacuuuucagcaacuucagaacugaguccaugcccagcucauauguagucacacuaaauuguguuugcaguaguugaaaaggaaaaaacauuaagaaaaaaaagccuaaagguguaacuuuggaaguacagauaucauaaagguuacucuuuucuaugagcauuuuaauuggaggucuugccauuugacacaugaauauuauaaaacuuauaauauucugccuguggcugccugugagaaauguguuuguagcuugagcaaaggaauagagugauuuugcuuguagccuuaauuuaaugggucagaauguuuauuauggccuggagccaaauucaauuacuauauuguaaaagugacugaauaaucuccaauuagcaagcagaauggucaacguuaguaaaugcauuuaaagacuuuuugccggcugggcgcaguggcucaugccuguaaucccagcauuuugggaggccaaggugggaggaucaccugaggucggggguucgagaccagccuggccaacguggugaaacccugucucuacuaaaaauacaaaaauuagccgggcaugguggcaggcgccuguaguaccagguacucgggagacugaggcaggagaauugcuugaacucgggaggcagagguugcagugagcugagauugcaccauugcacucuaggcaacaagagcaacgugacacuccaucucaaaaaaaaaaaaaagacuuuugccauuguguuaccauuucaaguuuucaucacaccuguaauuuaaaaaauggggggucuacaguguuggucaguacugguucaauuuuaaaaguuacuuaaggccaggcugacucagcugaucaugccuaagcaaauaacaguuaaggagcugaagcccuaguuaagccuaacugaucuuggcuguggaaaccuuccagcuucugggaagaaccaggacaaugggacaucaguugguuagacugcaucuugaugguuuauaugugcccauuguguacuugaaguuuuucuuguccuucuugccaucugauagugcuguagaguuacagaaucacacaauauaacagccaaaaauauuagacauaauugaaucccacucucauuuuauuuuauuuuauuuuauuacuuuuuugagacaaagucuugcucugucacccaggcauggcacgaucucagcucacugcaaccucugccuccuggguucaagcgauucuccugucucagccucccaacuagcugggauuacaggugugcaccaccaugccuggcuaauuuuuuguauuuucaguagagacggggauucaccauguuggccuggcugguucaaacuccugaccucaggugauccacccaccucagcaucccaaaaugcugggaauacaggcguagccauggugccuggccccacucuucuuauuuuaaaaagacacaguauggcugggugugguggcucacacuuugggaggcggaggugggaggauugcuugaggccaggaguuugagaccagccuaggcaacaugaugaaaccccaccucuacugaaaauacaaaaauuagcugagugugguggugugcgucuauaguuccagcuacucgggaggcugaagugggaggauugauugagcucggaaggucaagguugcagugagcugagauugccccacugcaguccagccugggugacagagcaaaacccugucaaaaaaaagaaagggaaggggaggggagggggaaagaaagaagggagggagaaagggaggcagggagggagagagggagggagggaggaaggaagggagggagggagggaggagggagguuuaggauuagaguguaggugugcugagaucaucauuacuauuugagugauaauugaagcaaugucacuuaucuuggguaauacccgagguucauugcuggaaaucaaggaugugaacacaccagagugagguuaagaguggaaguuuaauaggcaaaagaaagagaagagcucucagcccagagagggauccuggagaaaaauggguuaccaguuccaugaugaaaugcacggaguuuuauaaaugagcuugaggaggcagugucugauuuacauagggcccaaaagauugguuggaccaggugugucauuuacauagcaugcaaagaagcuaauguuuuauuaugcagaugguucucuaccuggccugcaucauauugccuguuucuuuauuguacacaugguugaaaaagaaaagggaagauggagccuccauguugaacaugccuggcccccagguagccuuuuccuauuggcauagcugcuggcauucacccaugcaaguuuuagcaugcuuuucuaugucugcagcucgauuuuucaggguggucuuuguuagaaaagaaaugauuugggggcugcuuuuuauuaaaagggaaaccuugcugagaacucuuuuacccucaccaacugccuaaauaauuucuuucuagcuucugcaucaauauuaggcaaauugacaaacuucucugugacucuguuccucaucuguggcaugggauaguaaauggaacccaccgcaugggggaguuguaaagauuuaaugagaucauaaagagcuccugacuuacagcaugugcuaaaugaaaaauaauuuuuuuuuugaaggagaaaacugaaaucacaaacgaauauugcaauggcagagaaggaaaaagggacuaauguuuauuuagcccuuguuaucuaccaggcccuauucuaggugauuuacauauguauuacaucauuuaucucugagagagauguuacuuuuuccauuuuacugauaaggagacugaggcucaaagagauuaaguaacuugccagaggacacagaucugguaacagcacagugaggugagauucagauugcugcauuccaaagccccaguucuuuuuccacuauuccauuaccuuccaagaugaggaguaggaccucauuuuccuaacaugaaaauggguugcauuucaaaaauucguuuacaaguugguuguuuggaguuacuuuuccauggagacaauguuacaugguuacaugcccaggcuuaucugcaaaagcuauaauguaacugaaauucugcacauuugugaacugaaacuauuaaggaaaaaaaugcauuugcaguucuagcuauaagcagaaaagaaaaaauaaggaugcauuuuaaauucuguggaaugagaaaagcacguucgguuagagggcagugagggagaagauggggacuguuuuuauucugguggggcucugggauacuuucaugguauucacacauauuuccuuuuaaaaaauaauuacauaugcaagagauaggacaggugguagcguugaccuaauuucuguuggcaauauuuagcuuuccguuuuaaauauauuuacccauuuuuuuuuuuuuguaaugacaugugggagcccagcuagucacccucauauagucauagaguauuaaaguuuauagaugucaugccuguaaucccagcacuuugggaggccgagguaggugaaucauuugaggucaggaguucaagacuagccuggccaacauggugaaaccccgccucuacuaaaaauacaaaaauuagccaggugugguggcgggcaccuguagucccagcuacucaggaggcugaggcaggagaaucgcuugaacccggggggcggauguugcagccauugcgcuccagccugggugacagagcgagacugucucaaaaaaaaaaaaaaaaaaaaaaaaaugaaguuuauggauguguugaagaaagaaugaagauaaaaagaauguuuuccugagugaauuguauaagaauuugaaggaauugaggagcuaaagagcaugugcgcacagauaugaaaaugauaaaauuaaauuuucauuucaucuuaaaucuucaucauuuuacuucaguuggcauuuaauuucugagcauaugcuaugugccagucaccaugugucauggcuaugagggaaaaaaacagucacagacccuuagucacaaauuugcaaaagaauuugcuuuguacuugaagcaucuacuagagauuauauucagaucauccagugauguuuuccucuuuaucgguauuuaugaauauguaaagguuacuuaauuauaacuagugggaauaagacugaggguuuuuuuguuuguuuuuguuuuuuaagacaggaucucccccuguugcccaggccagagugcaguggugcaaucauagcuuacuacagccucgaucuucucagcucaagugauucuccuggaucacccucccaaguagcuaggacuacaggcaagagccaccacaccuaguuaauuuuuuauuuuuuuuauuuuuuguagagacagggucuugcuauguugcccaggcuggucucaaacuccuggcuucaagugaucuuccagccuuggcuucccaaaaugcuggaauuauaggugugagccacugcucccagccuuaaguaaucuuuuuuuuuuuuuuuuuuuugagacaggguuucgcucuugucacccagguuggagugcaauggcgugaucuuggcucacugcaaccucugccucccggguucaagcaauucuccugccucagccucccaaguagcugggauuacaagcauccaccaccaugcccaacuaauuuuuguauuuuuaauagagacgggguuuuaccacguuggccaggcuggucucgaacuccugaccucaggugauccacucaccuuggccucccaaagugcugggauuacaggcgugagcuauggcgccuggcaaguaaucuuuuuaauaacuaagaacacuggaaaaacuagaggagauuauuaguaaaagguguucauuuuauuuucccauaauuauugcuugauuuccugucacuagucaggacuaaaaggugggagaugugggaccuuugaguucuguuacauagcauuugcuuauguauguuugcaacuaaaauggaaacuuuaggcugggcacaguggcucaugccuguaaucccagcauuuugggaggccccuggaguaguugggacuacagcuaggugccaccaugcccagccgauuuuuguauuuugaguagagaugggguuucaccauguuggcuagguuggucucaaacucuuggccucaagugauccacccacuucggccucccaaagugcugggauuacaggcgugccuccauacagaagaauuuuuuuuuuuuuugagauggagucucgcucuaucacccaggcuggagugcaguggcgugaucucggcucacugcaagcuccgccuccuggguucaugccauucuccugccucagccucccuaguagcugggacuacaggcgcccaccaucaugcccggcuaauuuuuuguauuuuuaguagagacgggguuucacuguguuagccaggauggucucgaucuucugaccucaugaucccccugccucagccucccaaagugcugggauuacaggcgugagccacugcgccuggccagaagaaucuugaguugagggggaggaugaaguguuugcacauuagaagcuuagucaugguaucuucauaaauggggaucuggugagcaagguugcucugcuaacauuuauguagccuuaacugacagacugagucucauauuggguuagaauaaacagcugcugccaaggaagcuuaacauugguucuaaggaaacuauguggcaucagauaagcuugcuugacaucagaacuugccacugacaugguucaucugcugccuagccuaugugauuguguucucauugaugcacauuuaaauuaauauuuugggcaauugguuaaaauuuugaccuuuaggcccuagagguuucucaugacuuuauuuaugaagaauauuguugaugcauuuuagaauuuaauuuguguuuuuuucugauuaugaaggcaauacauaguugauuuaaaaaaaauacucuggaaaaaguauagaaaaggauuaagaagaaaauaaaaaucaccugaaauucuacuucccaugguauguuugcuuccaguuauuuuuucaauguggauauauauuugggagagagugggauguuuccuuauuagugaaauagcugaggcuucaguaaaauuucacuuaacacucaugauauugagauguuugccuaaugcacugugcuaauuaagguuguuuguuuaaucaggugguacaaauucugaugccuuaggagccaaauaggcaaugagugaaucaggccaguuauaagcacuggggagugauggcaacugugguuaacuggaaaaugccggcccuaacugaagaaguuacuaccaucuucaacuuacuguugucacauggaaacaggggcuaauguuaccaaaucuuccuaauugucaagaaagucccagaagucuguuucuuuuuaaugugaaauuucucauguuaaaaaauacugugcaggucaaacaaaauagucuguguguugcacuuggcccauacacuggcauuuuuugucacuccugacauaaaugcuucucaaucuuucucauagcucuuacaagaagagcacauuuauuaaagaaaauguugggagaggaguuuaugcauaaggaguuucugagaauggcuucaggaacuuuuccgucugagaggguugcuuaguauagaaaugauaaacucaguuacaggaaucagguggugacauaaaugaguaaaaugaauugggauuaagauuaugaguguggacaugguacaaaugcgcuguuugggacauuuggguuccaguaauguuuuuccuugauggaaugcagauccaaauugcugccagaccuucuaagauuuaagagaugucagaaauuuggaucuuugugaaauuucuugauuuucaacucauuuaugcauaguguuccauuauuggaacgcuaagcuugugggaguuauuuauauccuacugcucaaggucaucgccaaggucugauuuuucacacaaaaaaauugcaaccucuggcacaaauggguuaaaaauacuauguggaccaaacaaaaaccauccuugccccaaauucuacacaaaauccacuaauuugcagcucuuggccuagaucacuguuuccuacauauguccuagaaauccuaauucugucauauauuaauaggugcuaagaaauaaggaauucuuggucacaugaauuuggaaaaugauggauuaaacaaaacugaacacauuuccugacugaagguuaucauagauccucaauuaugcuaaugugccuuguaaauuccuaagaagauauagcccauuaccccacaguuacaguuaggucaccaucuccacuugcuucccccaccaccccccuugucuaggguaagaguggcuuuccuccugguaaagguuagucucuguaucucucuccagauucuuacccugucucuucagggaucugacuucagaagaaaucuauuuccugccucuuguccuguagccuaucaguaugcuugguuuucuccaguuuaaaaaaaaugacgaccuuuucuuauaccauacacaaaaauugacuccaaauggaucacagaccuaacuauaagagcuaaaacuauaaaauucuuagaauaaaacaugggaguaaaucuucaugaucucagguuagaugaagccuucuuaaguguuacaccaaaagcacaaguagcaaaagacaaaacaaaacaacaggaaaaaagcacaagcaaccaaaaucacaaacaacaaaagaagacaagcugggcugcaaucccagcacuuugggaggccccgcaggcagauuacuugagcccagaaguucgagaucagccuggucaccauggugaaacccugucucuacaaaaaauacuaaaaauuagccgaguguggcccggcacgguggcucaugccuguaaucccagcacuuugggaggccgaggcgggcggaucaccuguggucaggaguuccagaccagccugaccaacguggagaaacccagucucugcuaaaaauacaaaauuagccaggcgugguggugcgugccuguaaucccagcuacuugggaggcugaggcaggagaaucacuugaaccugggaggcagagguugcagugaaccaagaucacgccauugcacuccaaccugggcaacaagagcaaaacuccaucucaaaaaaaaaaaaaaaaaaaaaaaaaaaagccgggugugguuguauacaccuguacuuccagcuacucagggggcugaggugggaggaucaccugagccugaagagguagaggcuguggugagcugugaucaugccacugcacucuagucugggcaacagagacucuguuucagaauaaaaaaaaaaaaaaaaaaaagaaaaaggaaaagacaagcuauauuuuagucuuaaauuggccuuuaucaaaauuaaaagcuugugcugcaaaggacacuaucaagaaagggaaagacaacccacagacugggaaaaauauuugcaaaagauaaauaacucaaaauauuggcaaggggccaggcacaguggcucaugccuauaaucccagcacuuugggaggccgaagcaggcagauuaccugaggucaggaguuugagaccagccuggccaacaugaugaaacccugucucuaccaaaaaaauacaaaaauuagccaggcaugguggcucaugccuguagucccagcuacuugggaggcugaagcaggagaaucgcuugaacccgggaggcggagguugcagugagcccagauugcaccacuguacuccggccuggguaacaaaguaagucucggucucaaaaaaaaaaauauauauauauauauauauauuggcaagguaucugaauagacauuucucaaaaguagauauauaaauggucaauacacccauaaaaagaugcucagcaucauuagccaucaggucaaaaccacaaugagauaccgcuucaguaggagggcuguaauuaaaaagauaauaacaaguguugccagggauauugagaaguuggaacccucucauguagcugcugcgaauguuaaaugguuuagccucuuuggaaaauagucuggcauuuccucaaaugguuaaacauagagauaccauaugacccagcaauugaauaccuagguuuauaaccaagagaaaugaaaacauguucauacaaaaccuuguacacuaauguuuauagcagcauuauucauaauagcccaaaaaugaaaacaacucaggugcccaucaacugaugaauggacaaaaugugauguaaccauacaaugaaauaugauuuggcaauaaaaagaaaugaaguacugauacauagcacagaugaaagaagcuagucacuaaagagcacaucuuaugugauucuauuuauaucagauauuuagaauaaguaaaucuguagagagaaaguagauuaguguuuaccuaagauuaggugguggugaggaaggguuagggcuaaaugggggugguguugacugcuaauaguuacuaggucucuuucuggagugaugaaaauguucacaaaucaauugucaugguugcacaacucugugacugucuuaacgacaccauuaaccucucuguggcaguugacacuauugacuguuccugaaauucuucuggcuuuuaugacagaguucuauugaucccccugccccuaucucugauauuuucuuuccagcuuuuuucaccagcuuguucuuccaccagcuacuuaucuguuggugguguugggucgugauuucauucauuauccauggcuuuuagaacgucugaguugccuguuacuugugaaucaauuuuucuagucccgguaagugaacugaggaaccaucuuuucaguugcuuauuggacaacucccucugaauaucccagugcuaauuacuuucccucucagagcugguuuucuuccuauguuaccaauugacccagucacuugagccaggggcugggagccauccuagauuucugucucacccuccacauggagugucauguggcugccuuuuuuacaccugcccucucaucuccauucacacugcugcugcuucugcuacaguuaaucuguaguuuaucuuucacuaagacuguaagcuccaugagaucuggggccauguguguuuucuucaucacugucuguaaugcuugguacauugcauguuauguaaguaauauuuguugauugaauaaaugaauucacaaaugaacuugucuuccgaguuuucuucgcucugauccauucuugcugcugaauuuuucuguuugaaaugcagaccuaacaaugucuuuuacuuagaauaauuaaauaauuccccauugcuuagaggauaagucuauugcauugcauacaaggcccuccaugauguggccccuuucugcuuuuccaauuuccuguccucuccacaucuccucucuacccaguaccccauuuuccagcuauguuuccugagcuggccaugcuuucccauaucuugcccuauuaacuagaaagcccuccuuuuuaccuugaauuccauuacuucuggagaacucuuauucugccuuccuagaguuucucuuccucugugaaacuuccuguaccucaccuacgcagagcagaaacuugguuguaacucuacuagagcaugcauuacacugcauugccuuauuuguuuaagcauuugucaacgaacaacaaggacugagucucacuuuuguauccccaucacacagugacagacacagugccucccacaugggaaguacucauuaagugcuugauuaaaugaauaaguuggaaaucagaguagauuagagaguuuuaguuuuucuggauguggccucuuaaacacugaacucuggcuggccaucugugaaugauguacaaaggauaucagugagggguggauggaucacaaguucaucaccaccccagaaaaacaaucaaaagcauugcugaugaugggucacuuacauuauuauuauccuuguaugacugaggccugguacugggcacagcugcaaucagaaugguuguucaguauaauggauugaucaggcuaacuguuaugccaugacauugauuugagccacaguaaguacaggcaaauggguacacauucuuaagucuggucacaaucaguuggucacaaccuauugucuaaauacauuaagaacaucuuccuaccacauuuuuaauguaauguucuuuaguuacgacuuacauuguacaaauaaguaacacaagucuucucagcuuuguuuugucuuucuguuuucuuguacuuagucuagcuaagggagacaucuacauuaacauauuuuuuagucuagguagugacuugaaccagccaaccuuuuuuuucuuucuuuuuuuuuuuuugcuggaaagaaaccaaaucucucuacauuaccaaaccaaaucgaguagauugugaugaaaggaguaauaauaacaacagcagaagacaaaaggccucucacauagaauuuugaacuaaagucacauauugaacaaaggauauuuaaauuaacuacugaacaaaguaagagcucuucaaaagaaacagagcucccugccaagcccccuaaaaaugcccccaggccucuuauucauucacuaccauuauuucaguuuauaucuaaagauguuuuauuucuuaucucauucucuucccaccaccuaguggacacauaguuggcacuuacugcuuguuuauugaauugaauggaaucuagccccaagaguuaaaagcuauucucugaagaagaaaauaaaagagaaauaauuuugucagugaauagaaauaacaagucugaguuucucucggcaauggaauaaaguuaggaagggauaacacguacaguuggcucucuguaucuguggguuccacacuucugcauuuagccaacugcggauugaaaauauucagaaaacaaggauaguugcaucuguguugaacauguacagauuuuuuccuugucuuuauucccuaaacaauacaguauaacaacuauguacauagcauuuauauuauauuagguauuauaaauaauccagagauaauuuaaaguaugugggaggauguguguaaguuauauucaaauacuaugcuguuuuauauaagagacaagcaucuguggguuuugguauuugaagggggucauggaaccaauucuccauagauaccaagagacaugacuauauuuauuauaaaguuagauuacuccaaaaggguuguuuuuaaauacugacccagagaaagcuaauuagacuauaacuaagaucuguuuguucuuuucucuguuuuuguuuuuguuuuuuguuuuuuuuagacggaguuuugcuuuugucgcccaggcuggagugccauggcacgaucucggcucacugcaaccucugccucccagguucaagugauucuccugucucacccucccgaguagcugggauuacaggcgcccaccaucacgcccggccaauuuuuauauauuuaguagagacaggguuucaccauguuggccagucuggucucaaacuucugaucucaggugauccacccgccuuggccucccaaagugcuggauuacaggcgugagccaccgugcccagccacucuguuuuuuuuuaacccuuuaauccauaggacuuuuuucagaaggaauaagaucuauuuuaaggcauaaaaaaaaugaggcaucagacagaugugguggcaugcacccguauucccagcuacuugggaggcugaggugggaggauuccuugaccccagcaguuugaguccagccugggcaauauagcaagaccccaucuuaaaaaaaaaaaaguaaaaaagaagcauuuguugauucuuacugaccuguuugcaaaguuguagucuacauugggaaucauauuucuccauacuaaguugaccucgaagaauaacauuuucccaccagcuaugaagauuccuguuaguuaacaaaagacauuuugugaauuaaucccuuucuuguuuguucuacuuuuuuucuuuuucuuuuuuuuuuuucuuuugagauggagucucgcucugucacccaggcuggagugcaguggcccgaucuuggcucacugcaagcucugccucccggguucgcgccauucuccugccucagccucccgaguagcugggacuacaggcgcccgccaccacgcccggcuaauuuuuuguauuuuuagucgagacgggguuucaccguguuagccacgauggucuccaucuccugaccuugugaucuacccaccuccugaccuugugaucuacccacuuacgccugggauuacaggcguaagccaccacggcugacuguucuacucuauuuuuauuuggaaaagaugggugcuauggaaauuuucuguuuugauggugacaggagaguacaggaaaaugcauuuucugucaucaauggguuaauggcuuaaaaauuaaagauuugucuuugguucuccuagacaggcuuugccaguuguucucaaauaggacauaccuuucugcuucuguagaucuuuacaaagugguucuuuggaaguucucgacuuguuauuuuggugauagaacacuaaauuguaaagaucuagaacagaggaugacaaucuuugaauaaaugggcaggucaagguaacauaauccucucugccuucacuuagcauacaaaguccugaacuaacugaacuuuccuuucuagccucauuuccucugcugaagccacaccagcgugucuuucuaguccuggccuccuuguacucgcauaucugacugaaccuucuuugccugugcucuucucuuuguuugggcugucugauucuucucuacugggcagcuucuccuuuccaggccuggcuccuuuuuucuaaaagaccacauaggaaaggaauaaaugaagguuauaguagcugugugaagaaugaauuggaagagucuggagcaacaagaccaguuuuaggauacagugagggucucauggaucugugcugccugauaugguagccacuagccguagguggcaauuaaaaugaaauaaagguaaaaauucaguucuucaguuauacuggccacauuucuuuguuucuuuuucuuuucuuuucuuuuuuuuuuuuuuuugagacggagucucgcucugucgccuaggcuggagugcaguggugcgaucucaguucacugcaaccuccuccucccagguucaagcaauuuuccugccucagccucccaaguagcugggauuacaggugccugccacaccccuggcuaauuuuuguauuuuuaguagagacgggguuucgccauguuggccaggguggucucgaauuccugauaucagguguuccacccgccuugaccuuccaaagugcugggauuacaggcaugagcuauugcaccuggccuaugcugggaacauuccaaguggucaauacucacagguggcuaauggguacuguauugggcggcacagauuaaauagaauauuuccaucauaaaagaaaauuauuuggacagcacugccaaaaaucaauuccccaagaaaaaauggcauucauucuauauagucauguuuuauguguuguaccuuaaaaacagugccguucguugucccuaaucuaauucuagccagaguguauugagcaaucauggauacuauugcuucaaguaugaaugcagcuuagaauaacaaaaucacauuuaguguuuaucacuuaaguauucaaaaauagcauuuaaauaaaugcccuugaauauauuuuuaauuauccauuuaucuuuccuuaccuacuccuacucuuacaaagaggcaucaauuaauuacaugccauucaguuuuuaguaauuaccucuacugaggucagaauauaugcuauuuacaaaacuguuuuaauguuuuugccugguguagccaugauugcuuuaucuuuggauaauaacuguuugccauauaucagccuucuagcauugcuaccuuugaaggcuuuuuauuucauugauuuagaagugauuuuuuuuuuuauuuuuuccuuuuuuugagacgguguuuugcucuugucacccaggcuggaguacaguggcgcgaucuuggcucacugcaaccuccgccucccagguucaagcgauucucuugccucagccuccggaguagcugggauuauaggcauccgccaccacgcccagcuaauuuuuguauuuuuaguagagacaggguuucgccauguuggccaggcuggucgcgaacuccugaccucaggugaucugcucuccucggccucccaaagugcugggauuuauaggcaugagccaccacgcccggccacgugguuuuuauuucuuuaccucagucuagucuucaucccccaccccaccccacccaguccaagagcaaguccuaauaauauuucuuccguaaaaagguaacacaauucuauucuuuucuccauuucuguuuucacuacuuaaguagugaaaccuuaagucacuacuaucacucucccggcugacugcaguagccucccugcaaucaucuaggagagugauacugguuacccugcucuccccucaccaccuaaaaauaggcaaaaugaccuuuuaaaaagaaaaucaggccaggcgugguggcucaugacuguaaucccagcaguuagguaggcaaaggcaggaggaucgcuugagcaugggaguuugagaccagccugggaaacauagugagaccccaucucuacaaaauaaaaaaaaaaaauuagcuaggcguggugucucaugccuggaguccuagcugcuccggacggaggaucacuugagcccugaaucacuugagcuaugauugcaccacugcacucaagucugggauauggggccagaucaugucucuuaaaaaagaaaagaaaagaaaagaaaagaaaaagucagauuaaucucuuguuuagaacuccugccuccuauuguacugauaaacgauuccaaauauuucaagcuggccuaaaaggcucuuuaugaucuggcccuugccuucuuacccagccucauuaccacaccauacuucccucccucccugagguucagccacucuggccucuuuccaguuccuaaaauacacccaaucuuuuccugcauuagggccuuuuucuggcugcucccccuagauuguucuugccuagcucuuucaugagugacuccuucuuaguuucaaagucucagcuccaauuuugcuucuuugucuacucuuuccaaaguaagcuccuuuguuuccagcccguacucuuuauuauagcaucauucuuaccauuaucuggaaucauacuuguuuauuuacuugacucucugucucucccuacuagacuguaaguuccgugaaggcaggaaacuuuuuuuuauucucuacuccaucucuacuaccuaaacaguaccuggcucauguuguugugcuaaaagcaauguuuaauaacacugaauaacuuacuauuuucuaaaggaaauauaagaggaacucaccuaguucucccucccacgcuugcucucugugucugugucccuccuuccccccacauauauaaaaggaaucucucugugucuuaaaugugaauaucuuucuaggcccuuuauacugaaugugaacuagugacuuuguggcugaacuucaucuuuuacuucaugaaaucauggccauagcuuuuugaaugguuaguuucaguuggaaaacauagugaacaauacaucuggaaauauucugucauguuuugagcugagaaacucuagagaaccagcugcugauuuaaaagccuuuuauuaugauacagacagucuauugucuauaaaagcauuggcuauuacacagugguagauauguguugcuuuuucuagcuauuaacuugaaagaaaaaacuuguauucauaauuuaugcaugacuuauauucccugagaauaguuuauuguguuauuuucuuuagcugauuuacugagcauuuagagauuuuuugagacagggucuugcccuguuguccaggcuggagugcagugguguaaaacacugcucaccacagccuugaccuccugggcuuaagugauccuuccaccucagccucccaagcagcugggaccauaggugugagccaccacacccgacuaauuuuguguagagacaaggucucacuauguugcccaggcuggucccaaacuccugguuucaaguaauucucucaccuuggucucccaaagugcugggaaugauaagugugcaccacugugccagccaggauuuuucuuacuccauuuuuuuuuccuuuaaacucaaucaaaaguuaaaugguuaaauaguaggacugacauauuuuccauucuggguuuuuuuaauuucacagauuucuacauuaaaauaugguuuauaaauaugauuuaguacucuuagguggcuuuauauuguuaaaaugggugaauuucaccauuuacuauauuaaaguuuacucuuauauuuuauaauacaugaauauaguggaagaaaaauugacauucaagaccugcauagagauaauuuugaagaaagugaauauguguaugauuagugguauaauacacacauaauuugguagugugacauuuaauauuuugauaauuuaaaaaauuucugaccauuacuauuuggaagaucuauauaaaaugacagauaauuguguacugagauuauuagguaggaaauaauuacaacuaaauaacuuaggcugggagugguggcucaugccuguaaucccagcacuuugggaggcaagguggguggaucacuugaggucaggaguucgagaccagccuggccaacauggugaaaccccaucucuacuaaaaauccaaaaaaaaaaaaaagauuagcugggugugguggcacaugccuguagucccagcuacuugggaagcugaggcaugagaaucacuugaaccugggaggccaagguuucagugagcugagacugcgucucugcacuucagccugggcaacagagugagacucuauuucaaaaacacaaacaaaaaauaacaaaacaacuuacaguaacauuuuuguguuuuuaaauuacaaaaauuacuuuaaaauuuacauuucaggaaauuagaaaauaggaaacgcagauacaaauucauucaauuuccuaagcauuaguacaaccaguagaauauuuuaaaaauguucuuucgguguuguugcuuuauuuauacauguggauuuuuuuugguguuguacucauaauguauauuucuucuuuuaagugaaauauaaugucauaaacauuuuccuauaaugccaaguuuuuauaaccauuguuuuaauggcccacauaguacucaaccuaacgauauaucuuaauuuacuuaacuauuccucuuuguuggaggaguuauuuaugaaguguuuuagcuuuuauaacugucaucuuagugaauacuuuugugaauauuguuuuuauuaucacauuuggcauuacugcuuauaagguauauucucauaaguggaauucccagguaugacuuuuuuuauguccgcuaacaaauucuagcaagugauuuuccaaagagaauaugucaguuuauaucaccaccugcaggguguaaaacuaccuauuccauuguugcauucagcauuauauauucuuucuuuuuaacucgcacuauaauuagggaaaaauaucauauuguuuuaauuucaguuuuuuugauuacuagugaaguugcauauuuucauguuugguuucuagugucagaaucauaauagcuucaaauauuuuucccaguuccaauaacuucguuuuuuucuguauagauaguuuugucugucuaacuugauucauguacuucauguaacauuuuagagauguggccuaguuuuuuggcuuaaauacacacacuuauauucucaaugaugaauuucuccuauuaugcucaguaaugcuuucaaauuaguuauucugaagaaggaguaauacaacauuauguuuguauuccauauuguuauucuaguauauugugaaggcauauuaugugaguaauccuaaaaaauuuuuuaaauccagaaaucucccuuaaaucuagaaacuuuaaugauagauuauguuuaaguauauguuucaaauaugcuuaaguaauaguuuuuuaaagucugagaauuuauauuugaauuaugauuuuuuuuccucuuguagguuggaaaagagacuguucaaaccacugaggaucagauuuugaagagagauaugccaccagcauuuauuaagugaguaauugaaauauucuucuguugcuaagcagaauaauacucuuguuaggaagaaaaaguagcugauuucaguaacaacuuuuuuuugguauaaaacuuuuguuuacaauugaaauuucaacuuuuuugucuucuaacuuuuuuaaaaaaacuguucauuuuaguuuuugauauuaggcauuuuugacauaauaauuuuuuuuuuuugagacggaguuucacccucgucacccaguuuggagugcaauggugcgaugucagcucacugcaaccucugccucuuggguucaaaugauuugccugucucagccucuggaauagcuuggauuauaggcgcgugccaccaucccuggcuaaucuuuguauuuuuaguagagaugggguuucaccauguuggccaagcuggucuugaacuuccgaccucaggugauccacccaccuuggccucccaaagugcugggauuauaggcgugagccacuguaccuggccaauuuuugacauaauaauuuuuaauaagaccaugaguuuugaguuuuucuuuccaaaaugaaaaguauucagagacccacugugacuauagcaugcaugaaucuacauuguauacuaggcaccuuugcuuggagauaagggaauaaugguagauauaaacuuuaaaaaauuauuguuuuggccgggcgugguggcucaugccugucaucccagcacuuugggaggccaaggaggguggaucaccucaggucaggagaucgagaccauccuggcuaacauggugaaacccugucucuacuaaaaauauaaaaaaaauuagccaggcgugguggcgggugccuguagucccagcuauuugggaggcugaggcaggagaauggcgugaacucaggagguggagcuugcagugaguggagaucacgccacugcacuccagucugggugacagagcgggacucugucucaaaaaaaaaaaauuauuguuucauauuuucaguuacauuuuaaauuuaaguuauauuuauauaucuccuaguauuccuaaaaauaauuuccaggcuuuuugggcuauucugcauaaaacaagcagacauacuaauuuuugaauacuuaaaacuucuuagguucuuauauugucuuugauuagugguuuuguucuauauggcagucaaguuguaagcaaaaguaaaagcugauguguaggacaaaaaaaauagaacucauagaagucaauaagaauaacauaagacuuuccaaaaagguguuugaaggacuugaauaggcaccucaaaagaggaaauuuaaguggccaauaaauauuuuauuucagucaucagagaagugcaaauuauuuuauuauacaccccaaauuaagaacccugauaauauuaguuguugauaagauguggagcaacuggaauguucuuacacugcuguugggaauguaaauugcugcagccacuuuggaaaacaacaugacaucaguaaaguagaagauaagcaguuccacugucggguauguucccuaaagauacucguccacaugcacaccagcauccauauaaaaaacauuucuaucagcauuguucaugaugaccccacuggucuaucuagaguagaauggauaaaauaaucaugguguaaucagaaauuguaauauuaaucaguaaugaaaaggagugaggaauuuucacuuaaaaaugguuaauuuuaugcuauaugaguuucauuucaauugaaaaaaacaaugaggccaggugcaguggcucacaccuguaaucccagcacuuugggaggccgaggagggaagaucacuugagccuaggaguuugagaccagccugggcaacauggugaaaacucaucucuacaaaacauuagcuccgugugguggugugagccgauagucccagccacccaggaggcugaagugggaggaucaccugagcuggggaaguuaaggcugcagugagcugugacugcaccacugcacuccagccugggugacagggugaaacccuguaucuaaaaauaaauaaauaaauaaaaagacaaaaaaagagaaaugaaugaaucucaaaaauaauugagggaaaugaaaaacagagagacagagagacggauagauagauagauagauagauagauagauagauagauagauauguagguuccacuuauuuaaaguucaaaaauggccagguguggugacucacaccuguaaucccaguacuuugggagaccaaggcagguggaucacuugaggucaggaguucgagaucagccuggccaacauggugaaacccuaucuguacuaacaauauaaaaauuagccaggcgugguggcucacacuuguaaucccagcuacuugggaggcugaggcgggagaaucacuugaauccggguggcggagguugcagugagccaagaucaagccacuguacuccagucugggugacagagugagacucugucucaaaaaaaaaaaaaaaaaaguucaaaaacaugcagaaauaaacuauguuguuuagacaugccuauuuauaugguaaaaagaugaagaugaguaaguaauaauggucaccacagccaggguaguccuaccucugggagggaggaagaggucuauacucaggaagagguacacaggggcaucuaaaagugguaauaauguucuauuuuugauuuaagugaugaguuacaugggcgguuguuuuauauuuaugcauuauauuauacauauguuuauuuucucuauguauguuaaauaucacaacuuuaaauaaagcuaaaaguguuccuuuauuuuuauccuccuuauguucuauuauuuucauugaacagauguaaaauucucacccauauugaaaucuucuuauuucuaccugagugggugcuuuaugcaacuguguuucuguuaauuccauaaaaugucuucaugugucaggaaguaaggugcuagaagcaucuguuuuuuuguacagccuguuuugugggaguaucuuuuuuguccuaccuucauuggacuuggugaucucaagguuucuucgagcucugaucaacaugagccuauuuuguuuacaugccauccgaucagccugguaauauauauauauuuuugagacaggcucucacucugucacccagguugaagugcaguggugcgaucauggcucacugcagccucaauugcccagacuuaagugauccucuugccucaccccgagucgcugggacuacaggugugugccacuaugcccggacaauuuuuaaaucauuuguagagguaaggucucccuguugcccaggcuggucuugaauuccugggcucaagcaauccuccugcauuggccucccaaaguguugggaguaccggcaugagccacugugccccggccuuagccugguaauauuaagaggaaucuuaugcugucaacuaaacauauuauaauuaaacuugcauuuaccuuacauuaaaaacauagcucuagcuuguagcagguugccccucaccccuuggaagauacagagcacggggaaugagugaguacagguuucacuaucggguagguaguuggacuagaagaccuuacaaacaauugcuuccaacccugacauucuagucuaugaauaugauuugauugguaaguggauuuugucaggaaacuuauuuuugcuuauccccagagacauauucugaaauaugcuaugugcuuucacagacuucuuuggggacuuagaaaaauuaaaaaugagcacacccuaguugugauaaaaauuucaaaaaauuuggucacuuuaaaacaaaauaaaacuuuacugaucacccugugugguaacuagggcaucaaccccuuacucuaauaauugguaauuuaaaggaaauuaagcauuuaucuugccuuuccuguacaaaauuuuuagaguagcccaauagcccuaguuguaaggugaauucuaaccaauaaauguggaagacaugacagaauuaaaaaaucauugaucgcugggcaugguggcucacgccuguaaucccagcacuuugggaggccgaggugggaggauugcuuaagcccaggaggucgaggcugcagugagcugucauuaugccacugcacuccagccugggugacagagugagacccuguguaaaacaaaacaaaauaaaacaaaccgugauggauuuuuauguuugcuuuucuuguuuuucuauagaaugcaaaaugaagcagaaaauaguagaugccuugacuuggaaaagacagggacagagaagggggaaacagauggaagcaauuaaugacauccuuggaacuauugaguaggacauucuuuugagcugcuugguugauguuuagaaauuucuagggcaugaccgacugaaacuuccucuguagucuacuuuugcaaggacuucucaagugacugcuuaagcaacacuaaaggcuaaaauauuuaaacauuuauuguuagaucagucuguacuccuagaauguuaagaugucaaggcuagagaaaacagaagauacuuggccuguagauagauuuauaccuaagcuaucugauauauauuuaaagauuuuucagggaaagauaugauacuuuuaggauuuggggaucucaagauccuaucauaggcuauuugugugauuggcaauuagggcauauggaaaaauggguuuaauacauuuaaaaugauacaauugucgaugaggaacuuccagugcucaggcaauuccuuacuguaaaagugagagccauuuuaauauagaacaagauuugcauggucacagccuuucucuuggguggagcuaaaguuauuugaucccuggcugcacuggcagauagagcucacaauuuacuaauuuuacccaagacugcaauaauagccacaguguugcauaagagguguaggguugcauggugauugccaucgaaacugcccagauugucauaaacuucaggagugcagcagcuaugcuguauuguuaaaauguugguuagacuaaccuuauaacccuauaagaaaucauuuguuccuggcugggugcgcuagcucacgccuauaaucccagcacuuugggaggcugaggcagguggaucacuugaggucaagaguucaaaaccagccuggccaacauggugaaaccccaucucuacuaaaaauucaaaacuagccgggcgugguggcacauaccuguaaucccagcuacuugggaggcugagguaggagaaucacuugaacccaggugguggagguugcagugagccgagaucaugccaugcauuccagccugggcaagagcgaaacucugucucaaaaaaaaaaaaaaaagaaaagaaaucauuuguuccuuuugagacugucagcaggggagucagcuacuguacuccauguuuacauuuuguaucacugucaguugucauuuucuucuucgucaucaucaucaucagacugcuguggcaguaauguuuuauauauaauugauuaaugggcuagacaugcuccuugguuaauuauuuacugauugccuucuaugugccuagcaugcugagugcuguuuauagaauaguaguuccuaccaguguguaaugaauagucacuugugagauauauugcaaauaauauauuaacaguaauaaagugccagaggauacuaaugcuuugcuuuaaaagaaaaaauuaauugagaggucaggcgugguggcucaugccuguaaucccagcacuuugggaggccgaggcggggggauugugaggucaggagaucgagaccacggugaaaccccgucucuacuaaaaauacaaaaaauuagccggacgugguggcaggcaccaguagucccagcuacucaggaggcugaggcaggagaaugcgugaacccaggaggcggaguuugcagugagcugagauugcgccacugcacuccagccugggcgacagagcgagacuccaucucaaaaaaacaaacaaacaaacaaacaaacaaaaacuuaauugagcauauuuaaguucacguguauaauaauaucccucucauuccuucucauuauguuuuuuuuuaaacuuucauugaaguauaauaugcuuguuauuauguuuucuuuaaugggagauaaaauaguggaacuacagcuauuguggcugggaauuaugcauaaucccaaguagacccauggggauaugccauaaacuugaguuuuauuuuucuauauaugauggcagagcaaaaguggaaacacuacugcagagaaauuuuguaaaaaagaaauauuuuaagacguuuccaauuaaagagcuauaauacagacugacuuuaugauaggaauucagagagagagcucucucauuauaaguaggaauaguagaaagagcguuuauguaggaaguggggcuugggaggaugguuagauguagggaggaaggaaaauacucuaggugcaaugaauggcaugaccaagucaugagggccuguggggagaggggcacauggugggggugguaggaacuaagcuuagguagguagguugggcaauagugaagguccuugaaagccaggcaaaggaauuuagaauugggcaggagggaagcuuuguaguugcugagcaguaggaugacaauaugaaagcaucuuccagaagauucauaaccaaauacagaaggaauaguaggugcuaauguuguaacagagaauaagcuagaugucaaacugaccagauuuauuuucugucaguguagauuugcuucagauugauuccuuauuauaggugagaaauguuuauagcaaacuauuuuauuugccuuggaaaaauugucauugcuguauacaguggaauuucauucuuauuucugcaauggagcagaaaugaauaaggaaggcaauucuuggaccugauccaaggauguucagaacugaauggaucaaaaagcaucacuucugagguggucuugugauaugaacuugaaaagggcaugguguacauuaucuguuggcaggcaaaugacagcuuucauuucgaacuggacaguguugucacuuucugccuuagugcugcucugacagucugcuugaagucaaaacuuggauugguucaccagcuuggacuauuuuugaagcauacuguaaugucuaggcuuauugaauaaaagaauguucccaaaauaccaugugaaaggauguacuacugcuacaugauugccauuauucacauuucuugggaauucuuuguuuuaacccuuaaacuuuauuaguuaagaacaguuaugguauuuacuuauacaaauuuaccauaauuuauauucaugcacaaagaagaaauuugagaaggauuaaaauaugcuuuauacuuaauuuagaucucuuuugaccuaaaguaaugaugucacauuuuuaggucaucaggccuuguagcuuuuucuuugcuugugaucuugaacacucaaaauaauuugugaugaaauuuguauuuuuaaacacacuugugggugaaagugcccagaauaucuuuuuuuaacaauuaauuacuuaaucauaucacuuaauaccuuuuguuugccuggggcuaaugugugauuuguguguguguguguccugaguuuugugguccuuuccacugcuacaguauuagaagauuuuugucucuuaauguggaugcccaaguucugugauguaaucauugaccucugcccacugccuugcugcauuuuugaccuagagcaagcacucaaacuuuaaauaguucaccuuuggacuugccacauuaagcauaauuuaguacuacuguauuuuuuuuuuuuuuuuuuuuuuuuugagauggaaucucgcucugcuacccaggcuggagugcaauggcaccaucucagcucauugcaaccuccaccucccagguucaagagauucuccugacucagccucccgaguagcugggauuacaggcauaugccaccaugccuggucaauuuuugcauuuuuaguagagauggguuacaccauguuggccaggcuggucucgaacuccuggccucaagugauccauuugccucagccucccaaaaugcuggccuaucacuacuguuuuuuguuuguuuguuuguuuguuuuuuguuuuagacggagucuugcucugucauccaggcuggagugcaguggugugaucucggcucacugcaaccgcugccuccuggguucaagcaauucucccgccucagcuucccgaguagcugggacuacaggcacgcaccaccacgcccagcuaauuuuuguauuuuuaguagagaugggauuucagcauguuggccagccuggucuugagcucugcucaauuucuuaaauaccuuguaugagcuggguauuuuaaguuguguuauuuaguccacuucauuuuucagaugaagagaagcucaguaagguguugaaaguuacucaguucauacauggcagagguaggauucuaacccugaacuguuugauuccaaguaugcucauuccaguaugcuaagguacuuucucauucuucuuuacaauagucucuucuucuaacauaauaguuauugugagguuuaaaugagugaaaugauauaugugaaaauaccuaaaacaaacaaaaagaaacauuuggugauuauguugcaggacaggcaaaccccaaaacugagguuuaucccaagaggguucuuggcuuuuccuaggaaagaauucaagagcuagccagugguguuagcaacuuuuauugaagcagcaguguacagcagcagcagcagcagcagcagaggcauuucugcuggcggagcagggcuacccuagaggcagcgugcccagaguagcagcucagaggcaguucugcauucauauuuauacccacuuuuaauuauauucuaauuaaggggugauuugugcagaaauuucuagaaugcaagugguggcuacuagguuguucaguuguugccauggaaaggggcaguaacgucuggguguugccguggcaaugguaaggugaccuaucacccuggugggugugucuuauggggaggugcuuuuacccuggaccugcuuuagcuaguccucuaugugguccaguguccacgcccugccucuggaauugaguacugacuccuacuucaauuacauauuagcucccuucuauagcuucuuuuuuuuucuucuauagcuucuuaauuuuuguuucuuaauaauuuucuccaaauaaaugauucaauucuucaguuaguuuuuuuuuuuuuuuuuuuugagacggagucucacucuguagcacaaguuggagugcaguagcgugaucucagcucacugcaaccucccccucuagggcucaagcgauucucaugccucagccccgcaaguagcugggacuacaggugugcaccacuacucccagcugauuuuuuguauuuugguagagaggggguuucaccauuuugcccaggguggucucaaacuccugagcgcaggugaucugcucaccuuggccuaccaaagugcugaaauuacaggcgugagccaccgugcuuggcccuucaguuacuuuuuaagcuuuucucagagauauuuuuuaucuaauuuguagucuucuguaguaagacuuuuuuuuuuuugaauuggaccaugauuacuuguuuuuauuuaaugcccuuucuuucuguaucuguugaguggauuacacaauuuuuauccuuuacucuguugagauagucuaugguuuacuacaugaauauagauuugcugauaaugaaccauucuugcauuucuaggauaaacccuaccuggcugugaugaaaaaaaaaaauauauauauauauauauauagugcugaauuuaauuugcuaauauuuuaaaaggauuuugcauuuuugcucaugagggaccuuuaucuguaauuuucuuuucuuuuuauguucuuuucuaguuuggguaucaaaguuauuuuagcuucauaaaauaaggucuuuuucuaguuuuugaaacagguuauguaagauaaagauuaucugcucuugaaaguuuggcaaaacuugcaucuaaaacucccuguaucugguggugucuuugggaggaagagauaugacuaaaaagaaacucgcucaguuuuguuuuauuaucuaaaucagguucuaaauucauugugagucaacuuugguagucugauacuuuucuaagaaauuaccaauuuuauccaaccuuccaauuuauuagcauaaaauucauaauaauuauucuuuuaaaaaucucuguuguaucuaguuauaucacauuuccuauucaguauugcuuauuucugccuuuugucuuuuuuucuuaucgcucuuauuagagauuuaucugucuuaccagcuuuucccacaaagaucuauuucauuaaauucuuuucucauauuuauuauuuacuuuucucaaguuuauuauuugaauaccuuauuuuuaauauuucagucuuuauguucaaucuuucuuuucuuuuuucuuuuuugagauagcgucuugcuuugucaccugggcuguagugcaaugacaugaucucggcucacugcaaccucucccucccggguucaagcgauucuccugccucagccucccaaguggcugggauuacaggugcccgccaccaugccuggcuaauuuuuauauuuuuaguagagacaggguuucacuauguugguaagacuggucucgaacuccugaccucaggugauccacucaccuccaccucccaaagugcugggacuacaggcauguaccacuuuaauuuuuaaauuagagaauuuaaaaauucuuuaaaauuauuuuuuaaaguuuucaaaauucuuuuuaauaucuuuuguuauauuucuaauauaauuguauuguacccaaagacaugguugguaugauaucaauucuuggaaauucuuuuguuacauacagcucaguucuagugaguuuuuaugugugcuugaaaagaaaguauauucucuuuugcuuggguauagaguucuauuuauacuaauuaggucaguauauaaauauuacuaguccaauuuuuuauagccuaauuugucuguuucaacuaucagcuuaugauugauauauguuaaaaaucuccuauacuaauuguagaccugucuguuuuucuuauaauugucaguguuagcucuacauauuucaaagcaauauuguuaggugguuacaaguuugugauucuucuggguucugaauucuguuaauuauuuguugcuaauuaucuuuuuuuagaaugacuguugauagacguuagccugcuguuggcuuguuucuccagacuguguucuucuucuuuuaaucuacauccuaguuuuugccaguuuucuucauaagugaaaaauauccucuuauuguaucuaucacuucauuuuguguuuagguugccacgccuguaacucuuuuauuacauucuacuguagaacagugauugccuacuuuuuuucagcauaaggaccuuuaaguaauaauagugaaauuuuaggcugggcgugguggcucacgccuuuaauccuagcacuucgggaggccagggcaggaggauuacuugaggccaggaguucaagaccaguguagccaacauggugaaaucccgucucuaccaaaaauacaaaaauuagcugggcgugaugcugcacaccuguaggcccagcuacucgggugacugaggcaggagaacugcuugagccugggagguggagguugcagugagcugagaucacgccauugcacuucagccugggugacagagcaagacuaugucucaaaaaaaaacaaaaacagaaaaaccaacaacaaaauaauaauagugagauuuuaaauuauuucuugauuaagaaaugcauaaaaacaaaaagauacaggccgggugcgauggcucacaccuguaaucccagccuuuugggaggcuaaggugggcagaucacuugaggucaggaguucaagaccagucuggcuaacaugguggaaacccgucucuacuaaaaauacagaaauuagcugggcauggugaggagugccuguagucccagcuacuugggaggcugaggugggagaauggcuugaaccugggaggcagagauugcagugaguggagaucaugucacugcacccuagucugagugacaaagugagacucuauuucaaacaaacaaacaaaugauacagugaauuucauaauauuuuauuuuauuuuauauaauuuuuugagacaggaucuugcuaugucaccuaggcuggaauguaguugugugaucacaacucauugcagccucagccuccugggcucaggugauccucucaucucagccucccagguaccugggacuauaggcaugcaugcuaccauaccuggcuaacuaaaagaaaaaaaaaauuuuuuuuuuuuuagagaugggaucucacuauguuguccaggugggucuagaacuccuggguucagucaauccucccagaauacugggauuauaggcguuagccaccacgccuggccaauuuaguaauauuuuaagauaauuuaaaaauuuuauucaucacaacagaaucaacauacauuugaaaacugcuaguaucuguaagacacucuugcuuguauacucagucuauuucugcugcaacccuaguaugagauggaggaaggacuguggagcugauggaccaggagguagcagaguucuugauugaacucugcacacucagaaucugcacugacgcuagauuugacaagagaauaagggaagaagggagaaagaacaggacugguuauucagguuuuaaaggauuuaaagauugugacuuauacacaucuuuaaaauaaacuacuuaccaagacuugaggaacauauagcuugggcagcuguaacguuuguuccucucccauucuuucccaacaugcugcuuccccuucaguuaucaauugacuuggacagaguccuguuuuauuugaagucaaaacuggcugcauacccuccuaaucucaauaaucugaaauaagagaauuuagugagccuguggguuuugugugugugugugcucaugauggguguguguguguguuuaggcuuuguuaucuaguauacauccucuagcaaaggguuugguguuucccuugaaauguuuugaauguuuucaauaugacucauuguggguuauuuuuuaaaauucaguuuuccccuuagcuuuauugagauauaauugacaaauggaaauuguauauauuuaagcugcauccuugugguuuuauuuuuaguuuuggguguacucaugcaguguccuguacuaucacuguuuggccuugauaagaacaagaaguccacuuugcauuauguuguacuuuaagagaguugggacagggaaaggaauacuuuguggaugaggucuguaggaucuuuaaauguaggaguacaggguuggaacagcauguauuaauauuaucacacaguguacacccgugugaguuggugcugcauacuugcuacuugaauuagauuaaagcuugucauuguacucuguguuccugacucccuccuaaaaacuguaacuaugcuuguggccuucagucaggugucuaggugacuaauggcugaggauccuugaccuuucucaaaauggcaacuccaggagcaaagcauaucagcuauuacugauaugccacagaaugcguccaucucuacuguuuuaaaguacaaucugugccaaaugcuucauauuaacauagaaaagaaauuucuucaccuaucuccugagucuuuugaaaucuucacauauauuauuuucuaaauuauuauuauuuaaaauuuucuuaaagauggagucuugcucugucucccaggcuggauagaguacaguggcaugaucuuagcucacuguaaccucagacuucugggaucaaacaauucuccccucagccuccugaauagcuggggcuacagguacaugccaucaugcauggcuaauuuuuuaaaauuuuucguagagauagggucucgcuacguagucuaggcuguucucaaacuccugggcucaagcaauccucccaccucagccucccaaagcgcugggauuauaggugugagucaccaucccuggcucuauuuuuauuauuuaaaaaaaaauuauauguauauauaaauuccagugaauugauagaggcaguacuuccuauuugaagcauacuagaauggcugaacucucaguugcugaugccugaaauuuuauauuggaguucauuccuuagguuaacaauuuaaaucuuaaauaucuaaugaagggauaauuuggggggccuuagcagucauuuucacuuagaucuuugucugaagguagguucuuaauaugcgggaaggcagagagagcuugagggccugccuguaccccaaaccccugucuucucacucaggccuuauauuaugaagggucuggacuuuaauauuaucuucaaauaaggccauguauguagucacaggaaaaaaagaaguuuuaaaagauguuguucauggccaggugugguggcucacguuguaaucccagcacuuugggaggcugagguggccagauugcuugagcccaggaguucaagaccagccugggcaacauggcaaaaccccaucucuauuaaaaauacaaaaaauuaccugggcaugguggcaugcaccuguagucccaguuacucgggaggcuaagguaggaggaucacuugagcccaggaggucaaggcuguggugagccgugaucgugccacugcacuccagcccagacaaaaguugaucaugcaauuaaaauauuaaauguaagcacuuaaauagaccaccauuuuuaugaaccuguuuuggcauuucuucauuuuuaaauaugauggacuucucagacugggaagugaucuaugccuuucuugaugucugaaagacccugacaggaugggaagggaagggaagaucucaacaagggcuaagaaaagaggaagaauagcccugacaauugauuuugccugccacauaauuauacuggggccagacugguuggagaugacagugagggaggugcugggugcaguggccagguggagaaaaccucacugaccagauucucauguucucacuuccuucccuccaccuguuuccuucccaucucccaagugucgucguagccuuguuugaucagauauguuugugggcucugcaacaagcucucucucucuaauacagggaucgugguauguaaacaccuguuuccuugggugugcuccaggaacugcgaccuccaugaaauaaaauuuucaaguguucuguuccauaguacuucacucuuaggcaaacaaugcaucuuuuugacaguauuuauaaccuaaaaggcuauacugucuaagaucaguuuuaauuuuuuuguuuuuauuaaaacagugaaugugauaugaguuacuuccacuccuccccaacuuuuuuuuuuuuuuggugggagugaaaguugaacgugaauguuuucaagugcuuuccaguuuuaauuuauggaccauaugucuaaauagacuuaaucacaccauuuccuuuauauuauuuugucuaaagcucuccuuuccacggccacuaaaccagugagcugacauaggaugacugcuuuuuacagaaguagauugagauuguuuggcuuuagagugagcuaccugcacuuugugaugguagacugcccucccuaguccaacuagaccgauugcaagugcauguuauuucucacagaaagggugugugugugugugugcgugugcacgugcguaugcgugagagagagagagaaagagaucuacuggaaaaagagcucaaagagaugcugcaaagagaaucaucuuuauaaguagugcugaacuucucaaggcaggagcaguguaguuaccuucuccaucgcaacauuccuaaccucuuagguaaaaaugacuccuccaggccaggcacgguggcucacaccuguaaucccagcacuuagggaucaccugagguugggaguucgagaccagucuggccaacauggugaaaccccaucucuauuaaaaauacaaaaacuaguucggcaugguggcgcaugccuauaaucccaacuacugggaggcuaaggcuugagaaucacuugagugugggagaggcagaguuugcagugggcugagaucgcaccacugcacuccagccugggugacagagcaagacuccacuucgaaagaaaaaaaaaaaagaaaagaaaaaaucuccuccugcuuuugcacccauacuuuuuuuuuuuuugagacggagucucgcccugucacgaaggcuguagugcaguggugccaucuuggcucauugcaaccuccaccuccuggguucaagcaauuuuccugucucagcuuccugaguagcugggauuacaggcaugugccaccacgcuuggcuaauuuuuguauuuuuuaaguagagaugggguuucaccauguuggucagauuggucucgaauuccugaccuugugaucugccugccuuggccucccaaaguguugggauuacaggugugagccaccgcguccagccugcuggacauacuucuaaagacugauuuguacuugucuccuccuaccaagguuccucuuagguaaggacuuuuaaaaaauauucccauuucuaggaaucauagcauguaauaguuccucaauauauuagaugaauaaauauaugaaagaauuuaaaggaauuuaagauuagugacucugcugggcacaguggcucacgccuguaauucuggcacuuugugaggcaaggcaggaggaucacuugagcccaggaguucaagaccagucuggacaacauagggagaccuugucuguacaaaacauaaaaaauuagcugggcauggugaugugcaccuauagucucagcuacuuaagaggcugaggugggaggaucacuugagcccaggaguucaagaccagugugggcaacauagugagacccugucucuacaaaaaauauaaaaaauaaaaaauuaucugggcaugguggcaugugccuuuggucucaguuacuugauaggcugaggugggaggaugacuugagucugggagguugaggcuacagugagcugugaugguaccacugcacuccacccuggguaacagagcgagacacugucuagaaaaaaaauuuaguaacucacuuuuucuggauauagucuaaaagaacccuuaaaaaggacuugcaggcagagugugguggcucacaccuguaaucccagcauuuuggaagaccgaaguggguggaucacuugaggucaggaguuggagaccagccugggcaauaugaugaaaccucaucucuacgcaaaauacaaaaaaaauuagcugggcauaguggcgcauuccuguaguuccagcuacuugggaggcugaggcaggaggauugcuugagcccagggaacggagguugcugugagcugagaucgcgccacugcacuccagccugggcaacagaaugagacucugucucaaaaaaaaaaaaaaaaagaaaaagaaaaagaagaaaaaagacuugugguagucuuuuuauaaucucuaaauggauuuuccucuucuuuggcauacauuuaaucuucuugguuagugauaauugaaaucacauggaacugaggaauuugugcucuuuuuuucuuacaaaauaauuacucauacucaaggucuucuccuaaauugucucaaauuagaguaggugguaauucugggaagaauguauuagagggucaugagugagcauauuucgagaucccauaaggcugucauugguccauuugauauauagcauaagauuuuuuuucuagcaauuuagguugaagauucaaagggagagagaaguacuaguugauugauuuaaauuaucuaauuaaauauuauuaguauauaguuaagauauacaauuauuuaggaaacugaccuuaugccuacuuucauucuuuaaauacuuuuuaaaaauucagauuucuauuaaaaugugcaagaucacuuuaagaagcuagggagcuugaauguuuaaauaaaauccaauuuuccauacacaagacagacuucuuccuguuucugacugcugguuagucuuagugggauuuguuuggcuuuuaugaaugccauuaaauuuuaaugugcagaucagaugucuuauuguauaaaaaaaugguucagucucuguuuuggaccuaucauuuuaccacacaagggaaccauuagugauaaucaauuuuauuccuguaaaccuuuucaauuucaucuuuuucaguuuccuuucuccauaauggucauucuugucauuuuuuuuccaaauuugaaaaacuuauacaguaacuggauuucauaaauagauauaucacaagacuuguaguuggugaugcuuuuguuuguuggcuauaauuucauaaauguucaaguuuccuggaaacaauuucuuuaaauauuacccuaccacuaccuucucuccuuuggaaacuuuaauuacacauauauuagguugcuuggaguugucccacaguucacugaugccauuuguuuuucaaaaucuuuuuucacccuguuuuauuuuggauagucuuuauugcuaugacuucaauuucacuauuuuuuccccugcaauaucuaaucugcuaguaauucacaguguauuuuuauaucucagacauaucuuucguaucuaguuguucuauuugggucuuuuucucuaucuuccauuuaucuaacuaggguaaccaaucuacuuuuuuuuuuuuuuuugagacaggaucuugcugggucacucaggauggagugcaaucacggcccacugcagccucaaccuccugggcccaagugauccucccaccucagccucaagaguagcuggggcuacaggcgcacaacaccaugccauuacauuuuuuauuuuuauuuuuugagauggggucuuacucuguugcccaggcuggagugcaguggcacaaucacggcucacugcauccucaacuucccuggguuuaggugauccagccaccucagccuccugaguagcugggacuauaggagugcaccaccacacauggcuaauuuuuuauuuuuuguaaaaaugggguuuugccaugcugcccaggcuggucuugaacuccugagcucaagagauccuccugccucagccucccaaagugcuaggauuacaggugugagccaccaugccuggccugauuuuuuuuuuuuuuuuuuuguagagauggagucuugcuauauugcccaggcuggccuugaacuccuggccucaagcaauccuucugccucagccucccagaccaugguauuaggcacugugcccagcucaaucuuuacuuuuguuuuuugaacauguggaguacaguuaugaccauuuuaauguucuuauauacugauucugucaucuuugucauuucuaggucgguuuuguuuugaaauagggucuuauucugucacccaguaugggaugugguagugcgauaauggcucacugcagccuuggccucuugggcucaagugauucucccacuuuagccuccugaguagcugggaccacagguacuuaccacuguuccuggcuaauuuuuaaauuuuuuguagagacaaggucuuccuuggccgggugcaguggcuuacaccuauaaucccaacacuuugggaggcugaggcggguggaucacuugaggccaggaguucgagaccagccuggccaucaugauaccccgucgcuacuaaaaauauaaaaauuagccagcuguggugugguagcacacacuuguaaucccggcuaccugggaggcugaggcacaagaauccuuugaacccaagagguggagguugcuuugagccgagaucgcaccacugcacuccagccugggcgacacagccagacuuugucuaaaaaaaagaagacagggucucccugaguugcccaggcuggucuugaacuccuggccucaagcaguccuccucucauccucagccuccuaaaguguugggauuacaggcaugagccaugacaccaggcccgagguugguuuugaaugauugacuuuucucuucauuauuggcgguauuuucaugccuucuuguauaccugauaauuuuugacuggaugagaguuuccucuuauugcugugacaagucaccagaaacuuugugguuuaaaacaacacaaauuuauuaucuuacaguucuggaagccagaaguccaaagugagucagcagggccacauucuuucuggaaacucuagaaaagacucuguuucuucaccuuuuccagcuucuagaggcugccugcuuuccuuggcuuguagccccacauuacuccagucucugcuuucauuaucauaccuccuucucuccugcuuccauugccaugucagugaaauaaugcccucaguuugcuaauaaaauaacugucaacuuagaauucuguacugcuauaauagucuuugaagaaugaggacaaaacagacauuaucaaacaaaaacugauacauuuugucaccagcagacuuuuacuagaggaaauccuaaagaauguacuucagacaaguccgcugaucccagauguaagccugaaauacaagagggaaugaugagccaagauacuggacaguuuguugguaaauguagauaaguguugauguauauaauaaugggauguuuuuacucaacgcuucugauaccagauguauggcuuuuuuuuuccacaccaacaaccagucuuccaacucuucagacaccaacuugguauucagcagcgcaauucaauucugacacuaacuauccagaguuagugucagacuccacagguuuaagugcuuagucccauaaaacuauccucacuucagauaccagucacaaguauugggugccugguauacccacacuucugucugacuuuacuacaaaguugggaguuccuacaacuccccgcuuucggguuuguuaauucgcuagaauggcucacauaacucacagaaauacuuuacucaaauaguuaccaguuuauuauaaaggauacaacccaggaacagccaaauggaagagaugcauagggcaagauaugaugaggaagauuucaugcugccugggugcaccaccucccagcacccagauguguucaccaacucagaaacucucugaccaugccuugauguuucuggaaccagcucccguuuugaagcuaucuagggucccccagccacuagucaucuuauuagcauacaaaagacacuuuuuuuuuuuugagacaggauccagcucugucacccacacuggagugcaguggcaugaucauagcucacuacagccuugauauccuggacucaagcacuccuccugccucagccuccugaguagcuaggacuacaggugugagccaccgugccugccuaucuuuuuaaaauuuuuaguagagaugagaucuugcucuguuacccaggcucgucuggaacuccuaagcucaagugauccuccugccuugggcuuccaaaguacugggauuacaggcaugagccacugugccuguccacaaagacacuuuuaagugucaaaagacacuuuuaggaaaaauauuuuuccuaaaauuuggaucacucauucuuuuuaauaacacauagaaaauuuauaaaaauaaaucauauguuaagccaugaagcuagccuaaauauauuuuagugccuuaagaccacauuuucuacacaacucauuugaaugauaaaucaaugaucagaagauaagaggaagaguccuuuauacguagaaguauauuuuaaaauucccaaacaauucauuguuaaauaaaucacagugacaauuaaaaaugaaugacaaaaacacuaccuaucaaaacccauggggccaguaaacagugaaacaaacaaacaaacaauccucaguuuuauuaauaaaagaaaaaugcagggcugggcacaguggcucaaauguauaaucccagcacuuuuuuuuuuuuuuuuucagacugagucucacucugucgcuuaggcugaagugcaguggcgugaucuuggcucaaugcaaccuccgccucccagguucaagcaauucuccugccucagccucccaaguagcugggauuacaggcgcuugucaccaugccuggcuaauuuuuguauucuuaguagagacaguguuucaccaugauggccaggcuggucuccaacuccugaccucuagugauccacuuaccucggccucccagagugcuggguuuacaggugugagccacugugccuggcccccagcacuuuaggagucugacauggaugaauugcuugagcccagaaguucacgaccagccugugcaacauggcaacacuccaucgcuacaaaaaauaaacauaauuagcuggguaugauggucugugccuguagucccagcuacuugagaggcugaggugggaggugaccaggaggucgaggcugcagugagccaugauuauaccacugcaccugccgccugggcaacagaccgagacccugucucaaaaaaaaaaaagaaaaaaaaagcaaguuaaauucacaauaguuuaucguuucacauugaccagauuggcauauuaaaaguucagacgaugaggaucaagucuguauacugcugguagaaguauucaauugauaaaaccauuuuggaaagcaguuugucauucccugguaaaguugaauauauuuauuuucuguaauuuaguauuuccauuacuagauauauaaucuaaacucuguucauguguaccaggagccagaauaaaaauuuucacagcacuauuauucauauuaacacuaauaacagaaacaagaaccuagaacaccucuaacauccagcagagguagaauggguaaaucaauuuugguauauauauauauauuuuuuuuuuuuuuugagauggaguuucgcuuuuguugcccaggcuggagugcaauggcacgaucucagcucaccgcaaccuccgccucccggguucaaguaauucuccugccucagccucccgaguagcugggauuacaggcaugugccaccacgcccagcaaauuuuguauuuuuaauacagacaggguuucuccauguuggucaggcaggucuugaacucccgaccucaggugaucugcccgccucagccucccaaagugcugagauuacaggcgugagccaccacgccuggccaauuuugguauauucucacaggggaauacaacauaguagcuacaguuguuaacaugauggacugaacauuauaauguugaacaaaaagaacagucacagaagcaugcauaacgguaugauuccgcuuaaguuccaauauaggcagaacucaacaaaaaauugcuuagguauguauacauauauaggugguaaaaguauaaagaaaaucaagaaaauaauuaacaacauucagaguaauaauuaucucuggagaauaggaaggaggauuugguuaaggugggguucuaaaguaccugguacuauuuuauaaaaugauuuuuuuuuuuuuuuugagacuaaaucucacucuauugccuaggcuggagugcaguggcaugaucuuggcucacuguaaccucugccuccuggguucuacugauucuccucccucagccuccuguguagcugggauuacaggugcccgccaccaugcccagcuaauuuuuguauuuuuaguagagacgggguuucaccauguuggccaggcugguuucgaacuccugaccucaguccgcccaccuuggccucccaaagugcugggauuacaggcaugagccacugcaccuggcauaaaaugauuauugacuuuuagguagaugguguuuguuugaauuaaaauuuauacaaucuuuuacauguguuauuuuauuuuguaacuuaaaaacuaugaaaauccucaaccucaauggaaauuaacacuauauugaauaaagauaaccuacagacugggaaaaaaacauuugcaaauuguauuucugaugagaguuuaauaacuagcuuaucuaagaaacucuuacaacucagccccaaaagacaaccuaauugaaaaaugggccuaauugaauagacauuucuccauaaaagauguagaaauggacaacaagcacaugaaaagauguucaccaucauugaucauuaaggaauugcaaaucaaagccauaaugagauaccacuucacaccugcuaggguggcuuuuauuuaaaaaaaaaaaaagauaagcauuggugaggauauggagaauuaggagcccuuaugugaaauggcacagugcuggaaaauaguuuugugguuucucaaaaaaucaaacauggaauuacuauauaaacuagcaauuccuccccuagguauauaacuaagagaaaugagaacauuauagcagcauuauucauaauugcuaaaagguguagacagcucaaauguucauaaguagauuaauggguaaacaaacuguggcauauccauacaauggaauauuauuauucagccauaaaaaaagaaugaaguauugauacaggcuacaacuuggaugaaccucaaaaacaugcuaaaugaaaggagccagacguaguguaugaauucuuuuguaugauguuuccacaauaggcaaauccagugagacagaaagcagauuagcgguuaucaggggacgggggaaggagaaaauagggaguuauuacuuaaugaguauugcguguuuuacugagauaaugaagaguuuuggcacuagagagaggcagugguugcacaacacugugaauacacuaaaugcuacugaauuguacacuuugaaaugguuauuuguauguuacaugaauuucaccucaauugaaaagaaacuauguuuggauccaauuuugguuuauuauuggugaagauccaaaauuugaauuggugagaagguaagaacuguuuaguauaacuucugcagauugcaauauggcaacauuuguuaaaaauuauacauaugcauaccuuugacucagcaauuuuauaucuagaauguauccuacagacauacaggguaaaauuacauguauucaaggugauucaucacagcaggcuaauaacuauuagccugggcuauuauguagcuuuauaaaaguaggaggaggcucuuuauguacuuuucuuucuuuuuuucuucuucuucuuuucuuuuuucuuuuuuuggagucuugcucuguugcccaggcuggagugcaguggcaugaucucggcucacugcaaccuccgcuuccuggguucaagugauucuccugccucagccuccccaguagcugggauuacaggccccugccaccaugccuggcuaauuuuuguacuuuugguagagauagaguuucaccauguuggccaggcugaucucgaaauccugaccuaaaguaauccaccugccuuggccucccaaagugcugggauuacacgugugagccaccaugcgcggcccucuuuauguacuuuuaauagaacaacacauaaauguaaaaagcagaaugcagcgagugaccauauaugauccuauuuguguaaaaaaguggggaaauguacauuuuugcuucuuugaggccugaaauguuuuaugaagacauuuacauacagaggaaauacaacauuggaggaaacucaguauugguugcaagugggauggaaugagugcauggaagauagugaagggaaagagauuucucauuguaugcccuuuugguuuuaaauauguguauaugcuuguguaauauguaugaauauauauuauauauuuaaaauaaaauuaaaaagaacaaaauauccaguccuuuaagccugaucaaaagccacaucaaacaggucuugcccuucacugauauuuauuauauacugccuuauguuuuuuuuuuuguuuguuuguucguuuguuuuggagacagagucuaacucugucacccaggcuggagugcaguggcaugaucucggcucacugcaaccuccaccucugauucuccugccucugaguagcugggauuacagauguccaccacuaugccuggcuaauuuuuguauuuuuaguagagacgggcuuucacuauguuggccaggcuggucucgaacucccaaccucaagugaucugcccaccuuggccucucaaagugcugggauuacaggcaugagccaacugcgcccggccauguauuggcuuauucugccaauguuugugucuugccuuaguaaaguaugcuccucgagaguuagaauagugcuuuuuacaucuuuauauacauaccuacaguguccacagcccagugcuuuuuauguaguugaaauucauaaguugguuuaauucuacuuguuaacaauguaauacugcuuuaaacuuguggaguuucuguauuacuucauuuauccucaaaagaaccuggugagauaggcuuuuauuugcaggugacauuuucuauguuuucaaaugagacuguauaauucuggcuaagcauuuuaacuuuaagcaguuuguuccuuaucuuuguaaguuagucagucacaacauaauggcuauauugaauaugagacuagaggagaugaucuauuagguuauuuucaacucuguggggaugaguaauugaaugaaugaaugaauacauuuuauuaguacaaggaaggcaaacugaauacuugguguaugcauuuuggguuccucuuuuaaaugaaucccccgcccagcuccccuuccaccacucaaccuuuggcugaucugguuacuuauauuaauauuaaacuauuaauaacuggcuuaguuacuaauaauagugaccuuuaauuaacaauauauuuucauuuuaauuuuuaaauuuuuguuuuuauuuucuuuuaacaauauauuuucaaaugguccaauggauuuaucaaacaaauuuauuuagcuagaugaaugagugagaaauuuaugcauugccucauacuuuuucuuuguguuucuuccuauuccuuugcuuuguuuaguuauuaaauuucacuuaacaccaugcuuuggcauuuuauuuccagauguuagaucugaaaaugaucuaacauuucagcaaagaacugaaggauuucaguucuuugugcagugucuuuuaauagcaguguguauaggguggggaggaauaaggaaacaaaggcauugcagagauagagcaaccugaagucaaagagcccagauguuuucucgucauuuuuuguugucaggaaauaaagaauaagggcagugcacugaaugaaugugcugcuuuuaccuguaauuuuguaauuuucuuuuugaaacagggucucucaaaaugcugggauuacaggcaugagccacuguguccugccuaaauuguaaaaucuaaaaacguagguucuauuaucaauuggucuuggcuauuuuucauguagggaaaaaaacugugaauuuacaugcauauucucucuuuguauuugcauaugguauucuucugugugguucugccgguguguuaaccuguguucuucccuauaggguugagaaugcuugcaccaagcuuguccaggcagcucagaugcuucagucagacccuuacucagugccugcucgagauuaucuaauugaugggucaaggggcauccucucuggaacaucagaccugcuccuuaccuucgaugaggcugagguaggcaaucugagacaaaaagccuacucuugaagauaauaauggaagauugaugauuguuuagaaugaaaauauguugaaugcugcacaucuguguuaccguguuugcuaguuguccacccaugugauugaauacucugaaauauuuuuucagguccguaaaauuauuagaguuugcaaaggaauuuuggaauaucuuacaguggcagaggugguggagacuauggaagauuuggucacuuacacaaagaaucuugggccagguuaguuuuauccaauuucuauaacauuuuuuaaggauuguccauguuggagccaaaggaaaggguacccucuuccuacuuuuugcagaagauaggugaagaugcauugggcuuucaggugucugcucuguugauggagaugaugcugugcuuugaggugaugucauuaucucugguaucugaaucugcuuucuauauauugccuugucaaaugaauuaaaccaaacauugcaaauacugcuauuggagaauguaggaaauacuuuucuguuacuguaaugcugaaggccauccugcauccugaccucuccauuccacauuacacagcauuccuucacugucugccagcuggccuguaguucuuuaugaccucuuagcuugcuaauuagccugccuacuauuauggauucaugcccucacccaaggcugcauaauauaaucagaccuaggagagaagagcuauugugguuaaaucuuauuuugaaaugauuauucaggcaucugagcauuaaauauucaaaauauauaaacggauaccagcuuuugauguuacagacauauaacaugaacuugagggucuuuaaaguaugaaugagaccaaugacaagauauguuagauguuuaaccugcuuaacuugauuguuaucacuuuauaaaauucauuuguuuuaugugaaauguugauuuuuaauuaacagcauuuuuaugagguuccaguguagguguucuguaaaacuuaauggcaguuaagaauuugagccaucacugaagaucaccuggaaauagguuucucugguggcuuuagaguaguccucuuaaaauuucucauaauacuggcgaaaauuauauuuccccaaauggaaucuuaugcagaauccccaaacaaaaaaagacaaaauggagcuacuuuaggugaagcaggagcagccccaccucugcuucucuuuggucuugauggucugugagacaacuugagaaauccuaggaguaauuugaaaaucaaagcuuuagagaaucacauagcgccuuugaauaacaaccaacauaaacaaaaagugcuagcagagugauuccaaaacaccagaugcuuucaaacacugucaucccuauaauuauuuuuauaauauuucuauuuguuucuaauuauaaaacuaguacaugcuuauuuuggacaaauuggaaaguacagacaaauagaaauaugaaaacaaaacauaucauuguuauucuuagaacuuuuuucagccacuagauucaguacuaggcucaugugagauuuuuagcacagaguucagagacauggcaugaaaccuguaugcauagaagccuggcaaaauguuuuucccuuaccugugaauuucuuuuuaauaaauauauauuuauucauuuagauguuuaauauuugugaauauauuuauaucaaaauaugaaaauguuuaucacauuuaguguuuacauuuaauacauuacuuucauugaaaagaguaauguugcauaaauuagaguucagugauggugucuguuguuuaaauaagugagcaaucgguuugaacuuucauaguauuucauaauggauuuagacugagaaagccagacccgggauuguuucacuacucacccugcacaauuucuucuuugugccccaggaaugacuaagauggccaagaugauugacgagagacagcaggagcucacucaccaggagcaccgagugauguuggugaacucgaugaacaccgugaaagaguugcugccaguucucauuucagguacuuccugccuguacuuuauuuuauaggggggaaaaauguuagcauguucuaaacucugagguucauuuuguuuucuuuuguuuucuuuucuuuuuuuuuuuuuugagaugaagucucacucuguugccaggcuggagugcaguggugcgaucucggcucacugcaaccucugccuccuggguucaagcgauucuccugccucagccuucugaguagcaggcacuacaggugcgcacugccaugcccagcuaauuuuuguauuuucaguagagacgggguuucaccaugugggccaggauggucuugaucucuugaccucgugaucugccugccucagccucccagagugcugggauuacaugcgugagccauggcuccuggccugagguucauuuucuuuuguggcuucacugcauguccuucagccuagguaaaaaugagacccgauugauugguuaucacaugauggcuguagcugauuggcugagaaccagucuucuucucuaaugcuguccuucuccuguucuuuguuugaaauugccuuucuguggccuaauucuguucuccuaaagcucuaacaagccccuuugcugggagguggacucuccucuauaaacucuagccuaggauauuaaauuuucacaccuuuguguuauagaaaaauaauuaggagcuggaauggauauuauagagcaucauaugauaaagacaugaacucagagcccuuuuuaguguguauuaauccaauuuuuccuaaaagauauuuaacuguuguuuacaucaugaguagaucaguucuuuagucaccagcugggacuaccuucccauugaguagugcucugaaaugcaaacaugguagcugcucucucgacuagcaaaagggaguagcacuuauugagugucuaguauaugccagacagcucaugguuuauaugaauuaucuuagucaaguuguggguuaauuaguuauuucucagaaggcaacuuuauuauaaaaaucuggugacucaugucauugugacuuccagcuaccugcuuugguguuucaaguaguagcuaaaaaaggacauaugaguauaagaguucaggaggcugggcacaguggcucacuccuguaaucccagcacuuugggaggccgagguggguggaucaccugaggucaggaguucgagaccagccuggccaacauggcaaaaccccgucucuacuaaaaacaaaacaaaacaaaaauuagccaggauugguggcagacggcuauaaucccagcuacucaggagguugaggcaggagaauugcucaaacccaggaggcggagguugcagugagccgagaucacgccgaaaguguugggauuacaggcgugagccaccaugcccagacauuauuuuuuucuucuuuauguuuggggguuggcaaauccaagcuacauguugagagaaaucucggaugauaaacuugacaucuugggaucuucugcugggaucaggggcagcaggauacgccauucagaguauuacugacaguuuucauauugucccauuagguuuguaguagauggagccagggugagggccaggaugauaacugauuuagaaggauauuagauauuuugugauugcaggucaucagcauaugcagguuaaauuaguuacuuaaucauguugugauggugucuuuguaccuugaguuuucuuuuucuuuuuuuauuuuuacaauaaagguuguuaauguuggaacuuuauugucaaacuuguaguguuuguuuuguauacucauuuuaggaucuuaaaagcccaaaacaucuaaaguguagaacaucuuuugugaauauuguuauacaacaagauuaaauuccaagcuuacuuucugaucuuuuauuuuuacagcuaugaagauuuuuguaacaacuaaaaacucaaaaaaccaaggcauagaggaagcuuuaaaaaaucgcaauuuuacuguagaaaaaaugagugcugaaauuaaugagauaauucguguguuacaacucaccucuugggaugaagaugccugggccagcaagguacguguucuuaguggagaaauaagcaaaauccccaacucucccuggcuggggguuuugauuggcaccugucucauacuuuaucuuguaauuuuuguagcauaagaguacucagauauugugaaaguaauuucuucuucauuucuguuucauagguuacuugcuaucuuugcuaauuuccuuuguucuaagguagaacaaguaaauaggcaugugggguagauacugguuuaaggcugagauuuauagcuuuuccaucaggcuggagucuuauugguuggacugguggaagaguauauucccguggaugggagcucugccuuguauaugggugguucuucccagcugacuaaguaagauacagauaugccuguaauucugaacuuuauggaaaacuuuucuuuaaccaaucuuugauccagagaaaucuacagaggaaacucuuggcauuucuagaugugucccuugaucauuccauuuuccccaaggaagguuuaauuaaaauauuagucuucacauuggucaguuaguuugagggaucccuucacccuuuuucuggaaucucuuuuaggaccccagaggggcuggcagauuccuucuagagccuguuagcagugguuuuguguugcugcugcucuggucugcugcucccuguuuaaugacugugaaccaagcuuucaggucugggggaacagagauacuuggguucauacuuuccuuguaggagcccaagauguaggcaguggggggaacacacuguccccaagaucuagcuuucccaugugugaccccaaugucuccagggccagccagaaggcugguagucaacuaaagaagggauuuuguuguaugacuuccauugggugcucaguagaacgguauguucuccgggaucuguaagguaauguaaaagcuggggccugaaaucaccagcccucucucuuguugcccugaaagcuaauuuaauuauauagaguaaguuagcuuauuuuaacuauggauuuauuuacagagacauuuucucauugaugugaaguucuugaauagauucuaagacuguauuuuaaaucuauaugguaaaaucuuuuuaacucugauauuuuauuuaauuuugcuuuugcauaguugacaacuuucacuucccuguuaugacuucuuuaugcaucuuuuuuuguucuuuuguuuuauucuuuuucucacguuuagaagguaagcuuucucuugcccucuaguuucuuuuucgcuuaaaaagagaaaagcaugucugugagguuuuuuugugcugugugccgugccuuauucuguguauaacacugugcuugaaugugcgucagaaugugauuuaauacgggacucuaggcagugcuggggagacugacuguggcucauauugagugauuucuuugggaaaagcuaaaggaaagacauuacugugggcuaucaggcugccuauauuuggugggugccuucaguucuuuggguaggcuccugggaucuuuuuuggccuggucuuucccauugacuucauuugaggagcaggauuccccagguagcugggagaccccugaguuaccuguggacccugcuguugggaaaggagacuuccagcugaugcuaucucuguaccugccucucccaccagucuucuuugcgggcucugaaauuuugcuuuuggagaugcaucauugagguuuuaagccauaaugaaagaggguaggcuagagagcuuagaugaggcaccuguccuucauaauaauccuagccuucaaaauccaaaggaaaacagaagugaagugugucuaaaggucuuccuaacuucauucuguggcucacugcauguuuugcuguccaaacugaauuagcuguaguucuccaugaccucauguuccccuaacccaagcucuucgcuuauucucuuucuuuugcuucuagcagaugacaaaaaguaauaaggaggaacaggcauuuuaaccuuaauguuucucuauuuucagaagggaaaagcuauccaucauuuagugaauaaauguuauugaacuuuauuuugugcaagugccaucaagagcugcuucucucauuaaaaaaauguagucaguugaguuuucagggcuaggauuaggcacuuggggauacaagugaaauagaccugguacucaccguguacagucuuguagcugcucccaguuuuaugcugaggaaaaccaauuuguuaggaugcuacaaaacuaacuucaucugaaaugaaagaagguaaauuaaauuagcucaacucaaguacacgaugacaucagaaugaacaagagauguuuauguuuuaaucuacugaccauaagaaugaaaaagagaugcuuauuuuuuaaccuaaugacaucagaauaaaaaaagagguuuauuuuuaaccuaauuuugcuuuuguuuuacauuuaugugguucaaauaucaaagugcugcaaaaagauauaccugauaagucuuccuccuaaccugguucccauccacucuaccgcuccucacccucuaagaguaaucauuucuauugguuaucaaaauagaaaaaaauuuuacccugaaaauagaaauugguagcuaggauuuuggcucuuuuucaguuuuguagcauuacgcaucuuucauugcuccacuguaagcagugaauuaaucagaccuuuugucugacugugacugcuggguucccauucuguuuaaugcauacagugucuuucaccucuucucgccccuaccaauaaauaauuaacuuugucuuaccauacuuguuucaugccuccccauuggugcaguauucuucuggaaagugaugauuccucuagaaaagugggggaagaaaguaaguggaaaaaauucuugguaaaagugcgucuugccgaauaaguuaagauuuuaaagaggcaaugcaauaacugauuauuuuaccuuuuauaccuauauucaaauugcacauuuacaaauuuaaaaguaacuuugacuuuaaacacuucacuuauuuuaaaaguaaaaaguuuccuuuucuuaaaucaacaaucauuuuauagugaucauuaaaaauuagguuagcauuuuuuucugaaaauacauuauuuauuaaaagaauuugaguuaaacacaauucuaauucuacccuuuguaaauuuagugcucuacauuuaauuuuuuugguauuuauauuacuuguaucuugaugcaugcugagaauuaagaggaagugagauaaaaaauuaaaaaaaaauuucacugcuaagacuuugaacccuacauaggcacuccugcagcuuugcaccgugaaucauuaaauucuauuauucagaauuaguuccuguggugggucucuccccacugugguccugggcuggugguggguaaaaguaguaagugacucagaugccuuauacagaagauuagcaaacuuaacuaaggcaggaaauguugguuagaacuugugaguguguaauacuacccccuuacuugcagaccacugggauuuaagaguugauuuguuaaauuaaaaaaaggucauuugugggcuuucuaugagcaaguguucuaguguuuuguuuuuagcagcuaauagaaugaaagaucucuaagagcuugagagaaauaguuaauucaggcauuuaugauauuuuaucucccugcuccccaugaggagaaaaucccaaaauaaauugauguuucccuucugaucuaaguuaucuuuggcuaguacaucugaucaugcacucauagguagcauagauuuuuagagccaggaagguauucuuagagaugaggaauugagacccagagaagguaacuugcaugaagucucaggacuagacaacuuucucuuguuuaaauguaguuuguaagauuuuguucuacugcccaaucuauacuuuccagaaacaucuuaaaccagaaacaucugguuuaaaacauugacuugcagguggaaaugagguuagaaaggggauggagugggaagacagguguugguggagggagaagggagaguauggugggcagucauggagagagguucuuauuccccauauuuaaaauuuucaagagccuaggauugcaggacuuuacuuuuuuaaccgaaguuccucuugauuguccauagaaggaggucauuauuauucacagguguucugaggccuaaaucuauguuuaauuuaaggaguguuucaguuccuaggaaagcacguacaaaugguuuagcuugucguuccaucuuuugguaugcagggaagagugccaaggcacuguauuuuuuucauuuaaaacaugaauucauaagaauuuuauguuaagaaggagcauaacauggugggggaggacccagauagauucaggccagcuguccccaaagccacaugacuagaccuggucuuuuuauacuucacucuuucaacacccacaaacccccugaaaaacaaaccaaaaacagauaagaaauugguagagacuuuucuuuuucccaaaguugagcuuuuacagagaagaauacucaaaugaaggugcaguuuuucucucuucuauuucauaucugaauuauacugaccugaaauauacagaccuacaugacaagguuuagcaaaaugguuugugguacaaagcauggcugaccacaaggguuacgauuauuuucacccuuuauaaauauauccccaaauugacuucuguccuaguuguccagugaauuuguuuaugucauauucauuguuuguauacuuacaugcuuaugacagaauucugucaauucuauaauaaauauugccuuucaaaagaaauauauaugaaagucuuaggagaaaaaaauucccuuagacauguuuguuuuuacuagauaugacuaacauaaaaugguuacuuauaaccuacuguuuuccagaaagaauuuaagauggcucuuucaguuauuguuuuaaaucucugaaauugucuaaaauuaaugcuguuaaaaauuuugguaacuuauugaaagucgcaguuauuaaaugcagcuucauucaaaauuggcuauugguuccuuuuaggggaaaaugaacaucucuuaauuuuaacuucuugacggugucacaccucccacugagcaguaaauuacucacuuccugagaauuacauucuuuccuugcaguacuggccauuagagcuuuauuaaggagaaaaaaagaaaugauuuuugaggaugcugaauagacaaaaacuauuuuuuccauuguguuucaaaucauuuuugggcauuggagaauaaaagcagucauuuuuguuaguguagauuaugaauuugauuucuggagcuuauuuucucugcaguauuaaccaaagucaaaacugacaaggcagagauuugcugacuauuguuggagauuaguagaaucuuuagcaacucuccuugguaaaagaaaaaaaaaucuuguuucauuugauaagcaaugagguuuggagucaacaaaccugagaucaaauuagguuuguaggagucaguuccuguuucuuaauuuguaguauuauuuaaaugacauuuaaauuugagauucaaugagguaaggagggggaaaguagcuaaaacagaaccuaacaugcagggaaugcauauuaaauucaaugcaugucaguugaauuuaguuuccuaacuaguagccuuuaauguuagaguagacauaaaaauuucugaccuucguuucccuuugaauuuagauuuuugaaauguaauaaauaccuauugcuuuucucacugaaaauaaaaguguguuaggaaaaugguuuaacagguuuuaagugaaauauuuuuacauugacauaauuauucuccaggauguccacacacuuccuaaguaagaguuugugauuaaaagaaaaccuaugccuagauaacuuguguuagauccugaaggcuacccaguucucugagguuaggaguugccuggccucaagucuuuuaaaaaguuauugauucaggccuugcuaauuuggaauuaagcuaaaguugaccuuugcauuaauuuugaaggcaacguuuucugcacaaauuaauuuaagacaugauaggagagauuugcugauauucaaaccauuugagaaucaaagcacuuaaaaauaccacauaucuucuucuaauuacaaguggauuuugaaauagauccucuuaugauucugccuuuuauugacagcuaccaugguuacauauaacuugauaauaaaaauauuuuguuuucaauuuuuuugguaauuuaguucacuucuuuuucauugcuauagcugagaauuugcuauuuagagccuuagauagccaaggauucaacaggagaaucaucugugucuguuuagaaggggaaggagggauuccgacaguugagagaucugucuuuugaauagggggcuuuggaacaguuguggaccuugagccuaacuaugggugcugccaaugcuuauuugugauagugcuguaucuuuuuuugaauuggaaguggggaugcuccuggugcccccguguggaaaacuaguggugcaacaccuuuaagaaccccaguugugcaggauuggaaacugaaggaagcuaggacauugccuagaauuuuagagguuaacuuugugcuuugauggcuuaacucuguaagagucaguuuccuacagcaaaaaggaggauagauggucuuugaagaugcuaaauagagacuuaagagauggcugguguuauauuguucucuguguuuuuauguguuuaaaaaaauuuacggaaauacuuaaauacauuuaaagugauuagucuguuguuucagcuucuccugguguauccugggagauuuuaugcuaguuuccugauaguccucgugaauccugguuguaaaaaauaagcugagacccauuuauucuauccugcaucuucuuccaggugagggauaguaagggaacuaagaaggaggaauagcagggaaggucagaaaacacuucuaaauuauauuacuuugagggguuuauuuguagaauuaaaauuaaacugcuagauuaacauuuucaauuguuucuuccaaccaguaauuccaaguuuuucagguuaauugaauauagugaaauaucauccagugugugcauuucaaaacaagauguaaaagaacugugauuuguggcaccacauacuaacgaggcuucccugaggugggaagggcuuuggcaaggcugcaguagaugaauguugacuaguggaaaggcugacaaugaggcaugugacaacagggcuuuuuccugcugaagacauuaaacauauucuggcuugagcaauuuuaccaguuuucacaguuuuagcaauagggaacccaauuccacucuguuuagcaacagaguagaauuaacugaauauuugcaugcaagaugcugcauuuugacagaaaugagaauugugguguggugacaauauuuuuaaggccuucguaggacugacuaccuuagcuauguauguuaaugcuguaacuucuucucugucuuacguucuaucaugguaucucaacuuuugcaaagaaaauaauggugggauuucuucccaaaaggacacugaagccaugaagagagcauuggccuccauagacuccaaacugaaccaggccaaagguuggcuccgugacccuagugccuccccagguaacccucuaguucugcuuuucugaucaauacaacgagaagcuaaaaaccaagcaaaugaaagaaagaaauuuucccauaaucucaucaucugagagaacuacuguaacauuauggggcauaccccauuaucugauaguucugaguaacugaagcaaguaguaggccuuacaaggaugaagggaauagauucgaucaccucuaaucacggaggaguaagucauacugagcugggcauucuuugcaaaauuuuugguucuccccuucccugaauccaaaagguaauuauuuugaaugaaaguucuucucuuccaguucccauugagcagacuuccauuuaugucaacagaguucuuaauuaagcagauuaaaucaugaugccaaugagaauuggaaaguugacuguauaaagauaagacccaaauagguuauugaacuaggcuuuauugauuuucuaaucuaauauuuauucuguuuuagauuaauauuugaaugaaugugaaaaaccuaaaguagguuggaggugcuaaauacuauuaaauuguuagagucuguuuucaucauccauauucuuaccacaagcuacuuaguaucuccaaauagauacaguuccaaguaucuuuuuuugcgugucuguuguugaaaccucacccuaugguuuaagggcacugcuuggcuguuagcuaucagauauguugccuucuauucacucgucuuguuuaaaaucauccauuccuuggugaaugaaaugacuuguaaaguauccucucuaaauaaugaaugugucaacaauguaguuauugaauaucucuuuauuuuaggggaugcuggugagcaggccaucagacagaucuuagaugaagcuggaaaaguuggugaacucugugcaggcaaagaacgcagggagauucugggaacuugcaaaaugcuagggcagaugacugaucaaguggcugaccuccgugccagguaaaaguuccucuguccuuacagagcaguaguggguaacucacuccuaacagggugauucagaaaacaagccucugccaguuuugaguuaucucuuuggcuaguagauaacagagauauuauagucuauuaaauucuuuugagauggaggugaacuuucccuuugcugacuuuauuuauuuauuuauuauuuuuugagacagagucucacucuguuacccagacuggagugcgguggugcgaucuuggcucacugcaaccuccaccucccagguucaagagauucuccugccucagccucccggguagcugggauuauaggcgcccgccaucacaccuggcuaauuuuguuuguuuguuuguuuguuuguuugagauggagucuuacucuguugccaggcuggagugcaguggcgcgaucuugggucacugcaaccuccagcuccgugguucaagcaguucucugccucaaccucccgaguagcugggauuauaggcgcccgccaccacgaccagcuaauuuuuguauuuuuaguacagacgggguuucaccaucuuggccaggcuggucuugaacuccugaccucgugauccacccuccuuggccucccaaagugcugggauuacaggagugagccacugugcccggccacaccuggcuaauuuuuguauuuuuaguagagaugggguuuugccagguuggccagguugggcugggauuacaggugugagccaccaugccuggccugacuuuauuuaaaacauguuuuuauuuauuuauuuauuuauuuauuuagagacggagucucgcucugucacccgggcuggcaugcaguggugcaaucucggcucacugcaaccccugccucccaggcucaagcaauucuccugccuuaaccucccaaguagcugggauuacaggcaugggcugccacaccuggcuaauuuuuuauaauuuuaguagagacaggguuuuaccuuguuggccaggcuggucucaaacucucaggugauccaccugccuuggcuuccaaaagugcugggauuacaggcgugagccaccaugaccugccaaauuuuuucuuuuucuuuuucuuuuucuuuuuuauuuuuuugagaugggagauucgcucuuguugcccaggcuggagugcaauggcgcgaucucggcucacugcaaccuucgccuccuggguucaagugauucuccugccucagccuccugaguagcuaggauuacaggaaugcgccaccaugcccggcuaaguuuguauuuuuaguagagacgggguuucuccauguuggucaggcuggucucaaacuuccggccucaggugauccaccugccuuggccucccaaagugcugggauuauaggugugagccaccaugcccggccaaauuuuuuauuuuuaaugacauggccuugcucugucacccaggcucaagugcagugguaugaucauaguucacuguaacuuugaacuccugggcucaagcaauguuccuucuucagccuccugaguagauagaacuauaggcaugugccacuaugcuuggcuaguuuuucaauauuuuguagagauaaggucuugcuauguuuuguggucucaaacuccuggccucaagugauccucucaaaaguguugagauuaaaggcgugagccaccacuccuggcuugaacuuuuaaaauacacaaaugccuaauaguaaaguugaaacuuguuccguaauugaaacugaaacacaaaucuaguuucuaauuuacuagccauaggcuuaugaaaaauaaaggggcaguggugaagucuggcauggguaaauacauuuuacggaggauggggagaaagaaacauagcgugaaaacauuggaauuauuucaccucauaaaaaaaucauuuaacuagguuauccucuaaguugguaauuucugggcuuuuuugaguuuccuuuucaugauuauuuauucggauucauaauuauuuaccuuccuuuuacccuccuaaagccuuggccuuuagagcuuuucuccccauaaacuaaauaaacauaguuugcuauugagaaaacucaauauaauauaaauuuguuuggaauucauacagaugaacucauccauagugauaaugaaguucuaaaagauuuuuauagaauuuuaugguauggacauuacgaaaacuuggaauaggaugagacacucaugaaacaucaugagauaauuaggauacacagggucuacauacaaacagggcucagaaacacuccucuacaugcagugcaccauuauaccuggucuccaauauuagugcaauagacauaagaaugcagaucuuauuuauuuauuuuuauuuuauuuuauuuuauuuuuuugagacaagaguuuugcucuuauugcccaggcuggagugcaauagcaugaucuuggcucacuguaacuuccgccuccuggguucaaggcauucuccugccucagccucuugaguaccugggauuacaggcaugcgccaccaugccuggcuaauuuuuguauuuuaauagagacgggguuucaccauguugaucaggcuggucuugaacuccugaccucaggugauccgccugcugcggccucccaaagugcugggauuacgggugugagccacugugccuggccaagaaugcggaucuuaaaggcgugguucuuaaccuuuuguggaccaagaucacuucuaucaucugaugaaaacauucauccuuaccuaaaaagaugcauauaaacaugcccauacaauauuauguauaauuucuagagguuccuggauucccugcagcccuggaagcuccaggacuuucagguugcgucucuauguugaaggggaaagaaacagcuuaaauaaaugugaucccauugaguucagugaaucuuuucuccugcugagaagcagucuccucugucaugagcaugguaagaacuuugcaaaaaggacaaaaagaaguuuuguucucauucggagaaaugccagugcaguuugauaggauucuuggcucuucugauuucucacuuuugugucuuuugucugcaaccuuuucccagugugguagccaguuuucacuuggaauucucaaauacacaguuguauguguuuagagaaagaugaguaugagcaagagaaugagguaguuauuguagggguuccaccauuaaucuguaaagagaaaaggcuagaacagugaaggguaacuaugguccugcuucacaguggagccugcaauauccuuuccugaugaaagauuagaaaguuaucucccuguaguccuuucuuaaguguacccagcuguuuaauauuuuaguggcugaaaugcgguaacaauuucuucuugauauucuguucagucacacaggguuucuagguugcuaguauauauuuuuacccccaugagacucaauaaaaucuuucuguuuugaaugaaaaaacuguguagcccauaaauaguuuuacuuuuucacaguuggacucuuuuuuaaaaaaaaaauuucuaaauuuccagccucagagaaguuauuauuuuguaauauacaguuggacucuuuuaacaaaaagaucucucaucaugaaguaguagauuugaagaaaaaaagcacauuaaauccuaaagacuauguuuccuaaaagucuuccccucuucugccacauaaaaggaaggccucaacuucaaggaaaaaguguauauauaccuuuuauauacccggcaauaaaugaaugauucauuaccucaaguuuugguauagaugaaaaacagaauaauuuuauuuauuuauuuauuuauuuuuuuuuuuagguuuuucuuuuuuuuuuuuuuuucuuuuuuugagacggagucucgcucugucgcccaggcuggagugcaguggcgugaucucggcucacugcaagcucugccucccggguucacaccauucuccugccucagccuaccgaguagcugggacuacuaggcgccugccaccacgccuggcuaauuuuuuuuuuuuuuuuuuuuggauuuuuaguagagacgggguuucagcguguuagccaggauggucucgaucucgugaccucgugauccgcccaccuuggccucccaaagugcugggauuacaggcgugagccaccgcgccuggccgaaaaccagaagaauuuuaaaaagaggcuagauaggcugggugugguggcucacaccuguaaucccagcacuuugggaggcugaggcugguggaucucuugaggucggaaguucaagaccagccuggccaacagugugaaaccccgucucuacuaaaaauacaaaaauuagccaggcaugguggcacaugccuguaaucucagcuacucgggaggccgaggcaggagaauugcuugaacuacuugagaggcugagguaggagaauuuuggcucauugcaaccacugccucccaagaucgcgccacuucauuccagccuggaaaacagugagacuccgucucaaaaaaaauaaaaaaacccacagaggcuagauagaugaaugacagaucaauacuauuaugaagggaagcaaagguguuuuggaguuuauccuaaaaauagaaguucugauuaggauaaucagccaugccauucuaccaaaugguaaaguuacugccccuaucauugaguuuaccagccugcuuggauuaaaacaaucuggauuguaaaaugagggcaaaucauacuuugugacuuggaaaguaaauaaggaaaacaaguaaauagggaaaguaaauagagaaacaaguuuccaugaacucauaucauuuuuaguaguaauagcauaucauuucugagagaggaaaauagugaaaucaguucuuuaggaacuugaugggaaacagugguuuccuaucaccaugugcucaguauuagcuaguuucgauuauuuauauauuuauagguugccuaggaggaagguaggcauuuaagauuaucauuagguucauuauaaaaaugaugauaauucaguaauaaugauagauuuuuauugccaguguuuucaaguauauuauuuugaugcuugaagccacuccauaagauaaguggggaaaauguauuaccuaccuucauuauauguuaccuucacuauauaaguuagaaaauggaaacccagggagguuaaacaucauaaacaagguuccacagguaccaagagucaagauuugaacacagaucugcuuguucccagucugguacacuuucauuaacacuaugcgugcuuccuccugaaacauuuucaauguauacuugcccauaagaagacaauuuaauggacuauuuauuucagaagcacacauuacuaugguaacaaagcccucccuagcaauaagaucaccagcacauuuucccacugaaguuuagauuggauuauguaaucacuaccaagaggagaauaauuaucaaaauuugcuggccuggucuucaaagugguuaugcaguuccgugaagcuaaugugcauuuuuaaaagaaaaaguacuugauuugggcgucuugcuuuguuuaugucuguuuucuugugcugucccagauuuacugggaaaaaggaaaaagccaagcauguucaugaaaaccacauguacugugcuauugggaauauuuugucauuaaguauuugaggguguacaaugacagcaugugucuguuuugagcagaggacaaggauccucaccgguggccaugcagaaagcucagcagguaucucagggucuggaugugcucacagcaaaaguggaaaaugcagcucgcaagcuggaagccaugaccaacucaaagcagagcauugcaaagaagaucgaugcugcucagguagucacagugauuuucaggaggggugggaaauauuucauaaauauccuaagucauaaauauccuaucuuucuucucugucucuuaucauuuacugugguuggauaaugguuucuaagugaugagugacuuccagcacuuaccaauguuaacaccuccuuuaccaccacagguuuagacaaauguuuaucuauauuuugaaauaaagaucuuaauuuacagcacuucaguuagguaaaaguaagcucucagaguaccaagggaagauugcaguacauuggaacuauuccuugucccagaauucacaacucuugggucauuguaauguuuagggguuaaaguuuuccgauacugcucuacuguaaaaugauuuucaagcauuucacaaacacacauguuugaggaacugaggaacuaauaaggugugguuaauucagagaugagauaaagcuugggaaaauauuuuaugcuaauggguguaaaaaaauugauuuuaaaaagaugagagauugaguuucuuaucuaagaaccuccauacaauaauaaagaucagaauuauaaaaaugauuacugguauauuacuuuugaaauccuucuucuggccuuguuaaguuuaguagaaaggagugugugaguagaucacagcgugcugcuucuccguuucuauguguagaacuggcuugcagauccaaaugguggaccggaaggagaagagcagauucgaggugcuuuggcugaagcucggaaaauagcagaauuaugugaugauccuaaagaaagagaugacauucuacguucccuuggggaaauaucugcucugacuucuaaauuagcagaucuacgaagacaguauguauuuaacccuuacauugccuuuucauaucuuuucuucucuuucucucucccuucccucucccuuucuuucuuucuucccccaagaacauacauauuucaauuccccuagguuaaaugcacuuaugaugcucuuccacuauauucucauuaauucuaggucagauguuaauuugcuguaucagugauguaacugagguuuaaugauuuauugcuggucacauaguuauaaauugauaaauuuaggaugcuaagaacuccuuuuuugagaugcuuuuuaaauuucuaagcuagggcuuucuuugauacaucauguuuaugaccuaucuguuucccauacauaagaggaaaauaauuuuuguggcuagcuaugaaaagacuccuauguguauauggaggggaagaagcguaagaauguacuuuccuccuuccccagcaaugauauuuuguaaguagcaaguauaggagauacuuaaauuacauuuccuggaugauuuuucuuguaacaacagccuccccacagccuccucuccuaaagucucucauggcaccuacuuugaugauauggaaaagggguauuuccucuuuuuuuuuuuauuuuuuauuuuuauuuuuuugagauagggucucacucuaccacccacgcuggagugcagcggcaugacuaugccucacugcagcuuugaacucccaggcucaagccauccuuccaccucagccuccggaguagcugggacuacaggcacgugccaccaugccuggcuaauuuuuuuauuuuuuguagagacgggguguugcuauguugucagggcuggucucaaacucaagggcucaagcuauccucccacuucagcuuuccaaaguuuugggauuacaggcaugagccacugcaccuaacugcuuucuucuuucaauagauauuuuucacuuuuaagaaaaaaaccccugcagcacaugcuaaaauaacacuaaggaaggguuuaaugucaaauguaaaaguugcucucuauacucuuaggaccuaauggaaguccauauacauacuagguacucuuuaauguuucuuaaugaugaagagguaaugaaugguaauggugcuaacagcagaccuucauguguggucauucaugccaucauuacuuaauacuauagcacacacauaaacauacaucuauguaaccucuugccaggaguagccacgaucagaaucauguuaaagacccucuuuguucaccuuuauaaaggagaauguuauaaaaauuuagaaucauaaaggaacucuuaagagaguaucuaagcugggcaugguagcucaggccuguaaucccaacacuuggugaggcugagggcguguggaucacuugaggucaggaauucaagaccagccugccagccuggccaacauggugaaacccugucucuacuaaaaaaaauacaaaaauuagccaggccuggugguggguguguaauccuagcuacucagaggcugaggcaagagaauagcuugaacccaggaaguggagguugcauugagcugagauugugccgcugcacuccagccugggugacagagugagacucugucucagcaaaaaaaaaaaaaaaaaaaaaaagaaaagaaaagaaaaaaaagagagagacagaguaucuaaauuagcuguucuggcgcggaugggcuauuauuuuuauuuauguauguauuuuauuuauuuauuuauuuauuuuugagacggagucuugcucugcugccaggcuggagugcaguggcgugaucuuggcucacugcauccuccgcuugccaaguucaagugauucuccugccucagccucccgaguagcugggacuacaggcgcacaccaccacgcccagcuaaauuuuuguauuuuuaguagagaugggguuucaccauguuguccaggauggucuugaucucuugaccucgugauccacccaccucagccucccaaguccugggauuacaggugugagccaccacaccuggccuauuauuuuuauuuuuacagaugagacagauaaaguuagccugaaaguuaccuuucuauggcugagaggaccugagauggaaaaugagucagauucuuuguauuuuuauaaugguuagaauuugaagucuuuggaauaagguguugggggcaguuuuuuucuuugugauauaauugugguugucuuuuuauuucuguguugauacuugguugagguucuuugguuggaaggaccuggucaaguaaaaaguagaggauuauugaaaauagaggcaccucaucaaacccaauagcuugaauguggccagaucuugggcaacuggaagccccucccuccaccucuuagucgcugugugggauccucuaugucuguuucacccuguguguugacuuaguuuauuuaucuggggguuuugucucuggcugugagcuaccacggcccaggcuuaaucacuuuccagcuccagauaccaucacugguugacuaugcaguguuuuugaaauauggacccaggauuaucugccuaagaaucaucugagaaggucguuaaaaaugcagaccccuugaccccaccgcagacauacuuaauuggaaucgcuuuugaugguggguuuaacaaucuguauuuaaaaauaagaucuccagugacuuuuauccacacuggacuuugagaacccccagaaucuaauugagugccuugccugacuguggguauguuguccuugagguagauaaccacccaguuuaaucaguuauggcaaggacuggggauuaugugauaccaaauguauaguaguuuaugaaugaaggcugggcacgguggcucacgccuguaauccuagcacuuugggaggcugacgugggcacaucacccgaggucaggaguucgagaccagcccggucaacauggugaaaacccguuucuacuaaaaauagagaaauuagcugggugugguggugggcaucuauaauccuagcuacucaggaggcugagacaagagaauggcuugaacccgagaggcagagguugcagugagccgagaucgugccacugcacuccagccugggcaacacagcgagacuccaucucaaaacaaaacaaacaaaaaaaaguguggcgacucugaagucacggugcuggguuugaauccugacucuaucaaaguaaauaaugggacauugggcaaguuauccaaccucauaccuccauuuuguuucuuuaauaaugaggauaauacuguuauuuacaucauaggguuguuguaaggauuaaauaauauaaggcaacugcuuauggcugggugugguaggucaugccuauaaucccagcacaggacucugggaggcccaggugguaggaucacuuaaacccaggaguuaaggaccagcuugggaaacaucgggagaauguuuccuaucuccacgaaauauuuuuuuuuuuaauuagccaggugugguggugcauaccuauagucccagcuaccugaaaggcugaggcaggaggauugcugcagugagcccugggaggucaagccugcugugagccaugaucucaccacugcauuccagccagggugauggagcaaaaccccucucaaaacaaaaaacaaacaacaacaaaaaauugcuuguaacaguaccuggcagaauuaggacucaaaagauaguauuacuacuaguuugacuauaacuguuucagcugcuccuacaacaaacauggcugccugggcccacccaguuccagaggaaacugguguuuucagagguggcaggcagagggugccgcuaaccuagugaugauugauugagcuccgcuaaccaaaugauugaucugagcuuuacugaugcaaacucauauuuaaugucuuaacuaggacaaaauaaucugaauguaaauuauuaauuucuuauguaagggccaaauaaauaaaccacuccuuucaaaccaaauuaauaguaaucaggagcaauuugucauccuauuagcauuugucauuagcagcuaagugaucucaauguaaauaguguuuaugugugacaggauggcugucuuuuucucuguagggggaaaggagauucuccagaggcucgagccuuggccaaacagguggccacggcccugcagaaccugcagaccaaaaccaaccgggcuguggccaacagcagaccggccaaagcagcuguacaccuugagggcaagauugagcaagcacagcgguggauugauaaucccacaguggaugaccguggagucgguaagggcagcagugcacuauaaccucauuaaauuggucucagugcaaauaagcaaguuguugauagggguccuguaacaucuguaauuagguaaggguucuuuagcugcugauaaguaacugugauuccauuuccaaaugcagccaguaaaauuccugugauguaaucaagaagcagaccaggcaugguggcucauguuuguaauccaagugcuuugggaggcuaaggugggaggaucacuugcgcccaggaguuugagaccagccaagcaacauagcaagacccucucuguacaaaaauaaaagaguaaagaauuggcugggcauagugaugcucaccuguagucacaccuuuccagcuacuugggaggcugaggugggaggaucgcuugagaccaggaguuccagucuguagugagcuaugaucacaccacugcauucuaaccucagugacagagagagaccaugucucuuuaaaaacaaaacaaaaaagaacaaaauucuaaguuaguuaugcccaguguugugaggaguuggagaauugggcacauauauaauuuacuggagaaauaaauuaguacaaacuuucuaaauuugguauuagaugucaagagcuuuaaacaaaguucauacccauugacucaggaaauuaaggguuucuucccuaagaaauaauuagagaucuuucuaagaaguugcauacaggaauauaugcauacagcauaaauguuuaauaauaacugacuugugaaauaauuauuguuaauaugauaaaauauuacauagauuuuagaucaugauuuuaaaagauagugaaauaaaaauaaaguguuaaauaaaaagaacuggcugggugcgguggcucaucccuguaaucccagcacuuugggaggccgagguggguggaucgccugaacucagggguuugagaccagccugggcaacauagugagacccugucucucuaaaaaaaaccaauuagccagguaugguggugcacacuuguaguuccagcuacuugagaggcuguggugggagggauugcuugagccggcaggucaaggcugcaaugagcuguuguuccacugcacuccagcuugggugauagagcaagacgccacaucgcaccacagaauggcauugcaauugucuccucugggucuuguaaguuucauuguuuuucucuugguccaggucaggcugccauccgggggcuuguggccgaagggcaucgucuggcuaauguuaugauggggccuuaucggcaagaucuucucgccaagugugaccgaguggaccagcugacagcccagcuggcugaccuggcugccagaggggaaggggagaguccucaggcacgagcacuugcaucucagcuccaagacuccuuaaagguagaagucaggagcacauaucauuuuacuuuuuaugcuuccuauuauugaaagacgagggaaggaagagagaguuuugaaaaauacauaauuucuggggucuagggaaaaugaaaagagugugaccaaagauauaaggaaaucuagagcuuauuaggaaaaagcuugcugguauauaguagcaacuaaauuuguguuuuccaaauuccacucagucaagagcccuuucgugauuuuugcucuauccacauaucaucuguacuuuuauuuagccaauauuuuucuuaaaauggacuuuuuuuuuuuuuuuaaauggacuucuuuuuaaaacuuaaauuuauuuaagagaaaacucugugggccgggcauggugguacaugccuguaaucucagcuacuugggaggcugaggugggagaaucaccugaaccugggaggcagagguugaagaucacgucacugcacuccagccugggugacagagcgagacuccauuucaaauaaauaaauaaauaaauaaaugaaagaaaacuuuguaauccugaaaucuuggguuugauaagcuaguuguauuuuuucuauuauccuuuaaaagaaacacauaauuauuaaaauaaaaacauuugcccauguaacaccuaaaauuaucucagguaucaccagcuaguuuaugcugcccaccuugcaaaacaaugagggugauggagacuucuuuguauauauccagaaaacuuaaauuggauuaaaugugaugacuaugaaaaagagcuuguucauggcuucuaagaauacucuuauuuagacccauguugagaaauugauacagauauuuguuauugaguuuuucuagaaaacuuaauugaaagaaccuggauuaaaaaauucccauucuugauuucuuuccucuuaagacaauaaauugcuuagaauuuggcacuacauccaccaaacaauccuuacaguuacugugaucguuaucaggccccgccagcacuggcaaugguguggaacucuagcccaucucugggccuucuuugggcucaaccucaugauucucaguaucauuucauggaggccaccaaaaaaggaaguaggguuccuugauugaguggaacagucucuagggacaugugggucaugucuuauuucuacuacaccacuaaugucuuacagggcaggauucauaaauuacaccuguucugugcuagcucagugcuuuguacacaguuaacaaauauuuauugaaugaaagacugaauagaugaaugaaugucagugaaguaagggcauuaguagauaugcuuugaggauguaucuggacauuuucauauguaaacaauguuuuuaaggaucuaaaagcucggaugcaggaggccaugacucaggaagugucagauguuuucagcgauaccacaacucccaucaagcuguuggcaguggcagccacggcgccuccugaugcgccuaacagggaagagguggguaucugaggucuuccauuuuucugucagccugugcuauagguauauguaaaggugaaaugugauuacaguggacaucaggaucagugguugggaaacuguagaugaaggguggaagagcagaacagggaaagcccuaccaccucuacuuuuagucuccacguauaucagugaggaauaucuuuaguugcaagcaauagaagaccugaccaucagagaugaaaacaaccggguuuguuuucaucacaaaccaagaaacauggaaguagguggcuuuggcauugguucagcagcuaaauaucaugaaagcuggcauuucuaugauuuucuaggucauuuucucagggugugggauggcaucauguuaaaugcaggaagaaaugaagaauggggguacuccagucacaacugugccuuucgagucaggaugaucuuuuuaaaucaaucgaugucauucuuauacucagacccuuccaaugacuccccgcuaucccagaguaaaaccagagugcuaacaaugaagaaaauugccagcgaugugcugguaagccaacucuccaggaaaacgaaaaaccuugauuuguaauguuuguugauuuccauuauguaaauacucccacgguggcuguuucaacaugaagucacugaaaccugaguugggaagagauggacauguuucgcuccugugagcuggcacgagucgguacagguggcuuuagcacaccacuggaucugguccccauccauuucuuugcucucgugugguaccacucuucccccucaugcuacaucuguauguaccuccuugaauuguauuccuaguguguauuuauauguucuaaucuuggggccuuugcacucguuuguuccagucuucuccagauaaccauaucuauuaguuacugucuuucuucagcuuucuacugaaaugucacuuucgggugaccacuaagauaacaccaccaccccaacuacuauccccauggauuucuucaucuccauauccuacuuuuucacuuagcauuuaucaacauuuaauguauuuacccauuuuucauuuuugguuugucugucucccucccacuaccaugaaagcuccaugcagggagggacuuuauucugucauugccuuauucccccuucuuggaacagugccugccacauuguuggugcugaaugagugaaaauagaggcuuucuuagaaauuguccaggagagcuuugcuaugccucauuggcuugaacucugucucauggccacccuagcugcaaaggaguuuaggaaagcaaguauuugguuuuccagccuuuauaguauuggcagcgaaugagaagggguuugggucagguacccaagacaguguagaacugguagguggagguuuuuguuauuaugugcugauuaccccaguuuucuuucuguaaccugaguuacuaggcaguucagcugauuguucccuuaggcugagaugauuugcuauuuuuuuaauuccagacuucucuuucaggcuaguagauacaucuaggugggccucuccaccuacagucuuccuaguuaccucagcauauguuguccuucuguucucucucagaaauuugugaguugucauugacuuuucccuuccccacacccguucauacaaauaaacaacuaaggcacacucauuuaaucucacauccauuuucuguucauauugccagagcucuaauuauuuuccuaguccccuagucccccuagagcuaugacugcauagcucuaacuggucuucuuugacucuuucacuaggccaucaaucaaauaaaaauacaaccugacucugacauucuccugcuuaaacccuucaguggggccuguacuuucacagaggauaaggccagggcucugugaucuagcucugacacuucccauaccuguuuccuacaaaccccucccucucauuucuggcccuagcuauaccuaguugcuugugguuuccugcacagucugucuuuuccaugucuuuguuuuuucuguguaauuaucuuccccuucuuuuuuggugaauuacuauuuauccuucauccuauuauccuuuguuuccuagagagguuaagugcuuuuucuuuugcuccuaccuauaguaucagugcuuagcucuauuauuguacauagcacacuguauuguaaaucuguuuucgagugcuuuuuucucacugggcugugaguuccuugagaugaggauauuguguuuuacucauuuuuguguccucagcaccugucucagggucuggcacauaguaggugcucaguaaauuuugguugagugacgagaaaagcaaguuaagcaguuaguuaaaucagaaggagcagcagucauggucuggcauugagauggucaaccaaggauauuagguagguaaaagcccaggagauccagagugugggagaccagcuaggguaaaagaacugaggccacgggaaggaggcuaggagaucagggauuuuaggcagagauucucagcauuaaauggcaggaacccauguaguuaaauccaaacaagaggcuggcguggggaagagacuugagaagauagacacagaacacuggcaaugauuuggaaccugcuauugaaccaagagaccuuuagagauugucuagagccagaacugaucuccaaguuaggcagaaguugacaaaaaagaggacgcauuccacuaggcagcuccagacauguucguguaguguauaaaccugacccagugcuguugggaagcaucaguucuaauaaugcaguaaguaaguaacugaaugugaagacuaaauaaaccccauucuccaaagcuuaucuucuaguuugaagaagauaagcuuuugcaagaaucuauucuaacaaaugaccaaagaucucuugcuacuuuaaguuuaauaguccccuccacaguaugcaaccuugcacaguaucccuguuaaaggaaacauuaacuuuuuuagaauuugagagcugaaugaacaauuaaguagaugauuuugcauuugggguuaauaaaagucagucauccuugcccugaggccugagugugagcaccagcuaucauuuuucccuuggaggucaauggcagaguuuuuacaacauuaaugguaaugggauauaugaaggaugcugcucuggggagccuggagcucaauuuaggacuguguggauguucugggcuuuuaauguacccagcugccuacaauagagccuggagugggcuugacugucuucuucaaacuagaagauaagcuuuugagaauggggguuguuuagucuucacauucagcaaauuacugcagaguauauaaugcuccugcuuguaccugguaagcacugguugaacuggaaaugaagguuaugugcgugugugugugaguguguuugugugcauuugcacaugauggugauggcuaaacgucugaggagauccaucaaggccaggauuuggaguuugacuguuguuuuauuaacuaggguuugaugucaucucuaaagucuuugagcaguugcugcccuucuuaaaggaugaaacuuuuucuuaggcugccugacccauuuuauugaaauaaauguucuuaauaucuguuuuuuccucaagguauuugaugagagggcagcuaacuuugaaaaccauucaggaaagcuuggugcuacggccgagaaggcggcugcgguugguacugcuaauaaaucaacaguggaaggcauucaggccucagugaagacggcccgagaacucacaccccagguuggguuuugcucauuccucauacaguguucaguaaagaaaguuaauuacagaacaguuucuauacauuuuugaauacuuaccguaagauggcauaaaaaaacauauacaggccagcacgguagcaccuauaauuccggcacuuugggagggugaggcgggaggacugcuugagccugggaguuugagaccagccugggcaauacagcaagaccccgacucuaccaaaaaaaaaaaaauuagcugggugugguggcgcaugccugugaacacagcuauuugugaggcugaggugggaggauuauuugagcccagaagguugaggcugcaguaagcuuugauugccccacugcccuccagccuggggugacagagcaagacccugucaccgucuuuauacauuuucauaacauuugaauuuuuuuuuacaaggacuauuuauuaguuuuuuuuuuuuuuuuuuuuuuuugagacggagucucgcucugucgcccaggccggacuguggacugcaguggcgcaaucucggcucacugcaagcuccgcuucccggguucacgccauucuccugccucagccucccgaguagcugggacuacaggcgcccgccaccgcgcccggcuaauuuuuuuuguauuuuuaguagagacgggguuucaccuuguuagccaggauggucucgaucuuaguuuugaaaguagaaaaaauuaguaaagcaauccccuugccacauacacacauaacuaggaaaauauuuggauaaucuuuuuuuuuuuuuuuuuugagggacagaguuucgcucuugucacccaggcuggaguccaaugguguaaucucagcucacugcagccuccacuuccuggguucaagugguucuccugacucugccuccugaguagcugggauuacaggcacccgccaccaugcccggcuaauuuuucuauuuuuuaguagagacaggguuucuccauguuggccaggcuggucuugaacuccugaccucaugauccgcccaccucggccucccaaagugcugagauuacaggcaugagcuacugcggccggcuuggauaaucuuaagaggcuacuuuguuuugauuuuggaguuuauaucuuuucuccacaucuuugugagaguuuuuuuuuuuuuuuuaaauugaucuguuucuauaacuuucuuuuuucuacuuauuguguaacaaggcauggcuaguaaguuugggagcaaaggaagauugggaaaaaaaaccaaacuguacaguuauuaaaaguuuacuaugugauagguuuucuuaaaaauauuagcucaacauuauuuagugugauguuugugcaauuuuucuucuauucaaauuauagaaaauucauuauuuuuucauuuauuuauucagacauuuacugagugccuaugauacauucgaaacuaugcuaggcuuuauaaauuugugauacuggcuuaugugugaacuugugaggagauaugggggaaauaaacaugucucugaaucauuaaacuuuugccuguguggcguguuaauaaauuagauccucuuguccaacuuuuuaacuuguccaacuuuuacacaauuuuucauaagcuacaaacaugucuaacacucuuuaaaagcucccauaaaacauggaacauaaaauacaauuucaauaugaaacugagauuccuaaaaaggaggaacaggaaucuaggcuuauaacaccaauuauagauaaaaugaggacucuggagacagauuuggacuugagaccucugugaguuuuuuuuuuuuuccgagacggagucuugcucuguugcccaggcuggagugcaguggcaugaucuuggcucacugcaaccuccgccuccgggguucaagcgauucucuugccucagccuccccaguagcuaagauuacaggcguccaccaccauacccggcuaguuuuuuguauuuuuauuagagaugggguuucaccauauuggccaggcuggucucaaacuccugaccucaagugauccacccgccucggucucccaaagugcugggauuauggguaugagccacugcacccggccgacuccucugugcucuugaugcuuagucucucaucuguaaaauggagcuaacuccuuccuaauggacucuauuuggauuaagaauaugcauguacagccuguaucuuaccagauacguggcaaauguuaauccuuuuuuccccaaaugcuguaacugacuggccaggaccucuugagcagucacuuaaauuuucugagacuugguuuuugcaucucuaaaguagagauauuaacuguccugucucaugggguuguugugaggauuuuuucuucauauuauucauaaaucaguuuugaguacuuuucgguauccuucuuaauggugauuuuuaagauggaagaguugacaucaaguguuuaaacauaugccaguuuuguguauguucuucugaaguaucaaguggacacucauuuacuuugucacuuuauuaccuucuuaaaaucaggcugugaugguaaaaccuuccugugaagggcccauucuggggagcuguuuauugagaccaaaccucauguauucagccugaaaagagacuugccacuuucuggcuuuacagugccaucuguagguaaagaggagaaagcuuggcugaagguuuguaucuggagagcaagggugcucugguguuuaaagguguuuugucauugucagguggucucggcugcucguaucuuacuuaggaacccuggaaaucaagcugcuuaugaacauuuugagaccaugaagaaccaguggaucgauaauguugaaaaaaugacagguagaguuuucuauacaaaucuuguugucuaauccaugaagaaugaguucugagaaauuggagcgggacugguucuguuacucagcuguaauuggauaaagggccggucacgugcugagcaguguacuuggcucugcuuaaggcugcugagcaguggcggcuucucauucaagccuugcaacuuugucagaagagagacucuuugagucucuuuuauuuuaaugcugcccuccuggcgugauguuuauugucaccacuccuaucuucucuuugaauagugucuuugcccaguccgagcccgaguuugguuucagaggcugggaggcgguguuuguggauacaguaagugucccugucauuuucaguggguucacauuucaaggaaccacaauagcuaccauuuaauacaacuugucucaaaguuuccuccaacuuaucaacuacguaguuuuuuuaaaaaggagaaaccaaccaccagcaaaccugugucugugcaauugaaguggcaccucugaaucgucuucauucucuguaaagggagagauaggaaagaaggaaugaggaauguaggcuuuuugcugucccugcagaaccugcugugacugggguccauggcagcccgagaugaaaguggaacuccugaggugucugaagagagguaacaggaauaagaaauaggcuguuaggguuauuggaauccuccgcauggcucaucuugagcacuacaagcugccaacaagcaacagauggcuggggagugagagggacagggagaaaauauuauucacagauaacgugguggugaugcagugaugguuucagacauauuccuuguuuccucccgauguugcauuucugguugucugggguggauacaagaaggcuggcaaccacgguugguauaaaugcugcaaauccagaugggcuuuugggcuauguccucacuguuuuuuuuaacugugguguuuaccuggaagcuuuugauuauguaggaagaguuugagcugaagaagagaauucuggauguuauacuuucucaugagaaguuugaguggauaacaguguuuuggaguuucuguucuucuaaauugaaacuaaauuccauuucuguuuuccuaacagggcugguggacgaagccauugauaccaaaucucuguuggaugcuucagaagaagcaauuaaaaaagaccuggacaagugcaagguagcuauggccaacauucagccucagaugcugguugcuggggcaaccaguauugcucgucgggccaaccggauccugcugguggcuaagagggagguggagaauuccgaggaucccaaguuccgugaggcugugaaagcugccucugaugaauugagcaaaaccaucuccccgauggugauggaugcaaaagcuguggcuggaaacauuuccgacccugguaagcaaugcauggcacuaugucucaccuccacugagagguuaacucaggaaaggucgugagggaauauguaccccacaaccaccacauacaaagucugggggcaaaaacuauagacacuuaguuugagaaugcuagauuaaucuuuuuccauccaagucucugcaguuaucagcaggcuuguuguauguuaguuuuucuggaccaacuucucugugcuuucuuuuuuuuuugagacucucacccaggccagagggcaguggcaugaucucagcucacugaaaccuccaccuucuggguucuagcgauucuccuaccucagccucccgaguagcugggauuacaggugugugccaccaugccuggcuaauuuuuauguuuuuaguagacaggguuuugccauguuggccaggcuggucuugaauuccugaccucaggugauccacccgccuuggccugucaaagugcugggauuacaggugugagccaccgugcccaaccucugcgcuuuuuuagugcugggauuacaggugugagccaccgugcccaaccucugcgcuuuuuuuuuuuuuuuuuuuuuugagacggaguuuugcucuuguugcccaggcuggaguacaauggcacaaucuuggcucacugcaaccuccgcccccgccuggauucaagugauucuccugccccagccuccugaguagcugggauuacaggcucccaccaccacacccagcuaauuuuuuguaguuuuaguagaggcagaguuucaccauguuggccaggcuggucucaaacuccagaccucaguugauccacccgccuuggccucccaaagugcugggauuacaggcauccagccugugcuuucuuaauauggucuggcuaaauagcuccucgccuuguucagucauuauuuuggaaaauuuucaaaagaugcaugauaaccaauuuaccauccauuuaguuuauguaacugguguuaacuucucuugggcuuuucuuaaaaugcuuuuuuuucuuuguaaagcauucucaguuucuaucaaaucuggagggcuuaaguugaucugugggucuccuaggcccuacaccuaaagaaaaucuggguuuucuuuaggugaauuuugaucauauuuuugguacuaccauggcagaucauaauuggagccgcuccuuugguugaaaucaucugaauuccuuccuguuuugaacaucugauguuuucagucuugucuaugaguagaaugcagucaaugcaagagaguaggaaggaggggcuccccuauucaucucugguucaggcagaaucuuucuaauauccaaaacccauuaucacuaaggacaugcuugguuuccuaauuggaguuucuaauaguagaguagauuccugaauuccaggcaacugaacagaguagcgcagcucagcauaaggguuaacauacugaaugccaaggacagcaaaggaguagagagaaaggugagaaguacuucagggaauguauguccaaucugaaacugacaucucccauguucugaguugggcaggcuuaucucuugacugccucaucauaagagaggugauggaugccaccugagcccaaaguguucaugcccagggaucuccuggguacuuuuuaguuguacagccaagaaggcacccugaacacuaaaagaacagcugguuugugaugcuuccaaugcucugcaggccucagggcaucugccuuguccugccuccccccuucuucaaucacugcccgugauauuuacuggcagcuucacauccagcuuuuguucauggaaccaguucugcugcugcacagacagugcuuuggggcacugacccacccagcugaaagugaggaugucuuguguuuaggacugcaaaagagcuuccuggacucaggauaucggauccugggagcuguggccaaggucagagaagccuuccaaccucaggagccugacuucccgccgccuccaccagaccuugaacaacuccgaguaaguaaauucagauaugcagagaauugagcaggaagguguugagacuucagcaagagagagguagauuguguuuuagagccuccaucacuagguggcuucguuuagcuuucauuugaagcuuagugggaggcagaucucgauuuucauuccuaaauccaguggaguuauaaccuagugcuuauaugcauggguuguguguguguguguaguacuggugugugugguaguggcuugcugugauggggagcggcuggagcagaggagcuggcuuugguaaguguggaugugaugagugaugagguagugcauugugguaaaauaaucugcacagcuuggaguaaggagauuugguguguucuuaguugauaaugguagaaccgaggugguugaaaucuuguguugguucuuuccuuuauuugacuuuuuuuuaaguaacaagauacaugcuuuuaaaaaauuuuucccuaacuauaauuuaagaucuuuagauaccuuccccacuaccccccgcaaguacugugaauauauuuuuacaugguguaggaagaagcuagcuaggcaguauguugcagacacaaauuccagaaacagaaauagugauuauuucuagacacuuauuccaacuaacaguauuagaaauaccuugacuuuguaaauaacuuaucaaggcaauaaucugauuuacuuucccauauuuaaugucaguaaaagauguuaaguuuuuaaguugguugaguacaaaauugugucaucgcacacacagcuaaggaacaguguuucccagccuucaacgcaucuuagauucuucccagcugggugcuugguggguguuuagagcugggagagagggcuauuccugggaauggcuucuuaugugagcaacagaguuaugucauuuagaaucuggaucuuagaggucauuuggucuagcuaccccucagugacagaugaggaaccucaggccaaggggagaaguuacuugccuauguagcugcuuucugguagaaccaggaccacaacuuacaucuucuguagggacuuuuugagaauccuucaucugguagcacuguguauacuucccugggaugcaaccaaaacaguagcugcaagccuuuuuuuuuuuucuuuuuuucuuguuuugagauggagucuugcucugucgcccaggcuggagcgcaguggcaugaucucagcucacggcaaccucugccucccggguucaagcaauucuccugccucagcuucuugaguaguugggauuauaggcacaugccaccaugcccggcuaauuuuuguguuuuuaguagagaugggguuucaccauuuugggcaggcuggucucgaacuccugaccucaggugacccaccugccuuggccucccaaagugcugggauuauaggcgugagccacugcgcccggccacugcuagcuuuuuguagagaaaccugcuucuguugagauugaagcaggugguccuuguggcucaguguggguggucuuauguggagucaauauggguggguuuucuagggaugcuuuuuagaagaaaggaaagaauuccaggggggaguaguuuuaggacuuuacuuacaacuuguuuucucuuuuuuagcuaacagaugagcuugcuccucccaaaccaccucugccugaaggugaggucccuccaccuaggccuccaccaccagaggaaaaggaugaagaguucccugagcagaaggccggggaggugauuaaccagccaaugaugauggcugccagacagcuccaugaugaagcucgcaaaugguccagcaagguaaguagugaagcuuuucuuguugagaaaggaugucuucucggaaaggaugaaggaccaugaaagacccagaaagaagagucuauuuggagucacccucucucucuccuuugguuccuguguugccaauagcauauuccucuucuuaccugugcuuuagugagauguuucugacaccugaugguuucuccuucaagcuugcaaaagccagagucagggugccugugauuugagaagaggauuccuguccuuuguccauuagagugccaggugccuugaccuuagcauuuggggucuuuuagaaauugcuuaucuuucuuggaacugcaaauguuuuuagaugcuacauugcuaaugaucagagcuccaaauaugaauugugugggcugugcuaaagcuagaugaaauguuugcauuuucuuuuuuuuuccacagaagcaaguagauugguaucuuagaagccaugugcuuuuguccuuucucagaaucauuucaccugucaacucaagacagcuccaggcugucucuuacucagcaaaucugaagguguaaauauuaaugugguugguaaaaauauggaugcuacagcagucuugcccuaugaauaacuuuugccuauuuuccccuaaaugaugaaaagugagcaguagcuuuucuagauaagaggaauauuauugcuaacccugcagugaaagguagcucuuaguucuaaacuguuucuaauaugacccuagaucuuuuuuuuaauguuuuuaugacccuagaucuuuauucccaccaccuauuugccuuuauucuuuacacauccucaaagcuuucaagcucuugugucgauuguauuuccucagggaccuccugcaccugcagcugaucuuggauuuuuuucaggcugggaaauucacauugguuuuuaacucuguauuuugcugaacuguuagcugugagcccagguucuaagaaggaagggagacuuugcugguguuggaccugaccuguagaauuauuuauaaugguaucucuccaacugcauguggcagagccccacugugcauggggagugggggagggugacagugaagauuuuaaaggaaauuuaaauuucauuacaaugaaccaaaauacacuaugcagaacaaaaaauauacaugaauuauuuaaaaaaacaaacaaacuuaaaagcagacagcauuggcccacauuacuugccccacucugccauuuguggccagaaguccugaggucuaucuccugaagugugcaagaucaggaguuugcugacuuugaguugugugaagucagaagcuacuugaaccauguguguacugggcuggggaggaauaucuguucgugugucugucaaccuaucugucuuuguacacugugggacucugagccuuagcagcagugagcuggcuuuucuucugagcagcagagaugggucuugguugaguuuaggcaaaagaguuuagaugguaucugaaccccuuguuggcccugaauccuccaacaucgucacccuuuggagucagguuucaugugcagguuaagacuuuuaggagugguaacaaccucaaagaaaauuccauauaaacuacuuccucuugaguacagauguuugauguaaagaaccuguauucaucauucuuuguauaaaugguuuggcuucauuguggcaguuuuuaauuuucuuuccauguuagucuauuuucagcaucuggcuuuuauaaucuccaucccugguucuaaauucauguucucuccaucaugauucucauucuuaaaugagcaccauucuucugagcuucugugagcucagcugcagucacuugccaaguucacauauuauucuaucugugaacuagauaagcagaguuuggggugagugagaaccuauuuugcaagcaauuuagguuguacccaaggagaagcuuucugaggugguacuagcaauggaugcaaaaagagaugguagaagcuuugccucagaagaccuugaggggauagagagcuggucugauguguggguguucccugagaugggcggcugacgagguggcuucuugaggcuccuuacagcugggugacagugggguacuuaaguucucuucagucaccauuguguuuguuuuuccugccucuuuccuaguuugguauucguuaccucugauguaucauuuuuaauucugggacuuuuaacucaugaaggaaauaaucuaugucuggcagcugcagagcugacccaaauugccuccugugucccaggaaaauguagaacagugaccauaugauccagcaguguucacuuuguucuguacaaaguaacuuguguggcugcauuuacuuuuucucuccggauuccuuuuaaagguaauuugcuacuaucguuugguuguuuggcuccucagaaauauucucaugugagaaucacucuugucaaguuugacuuuaguaucaaguauauuaaagaaauggaugccacuugcuuucuugguguaaagauuucucuagaagcccuuugccauuggagugagucccuuuucuucucucaccacacaguggcuugggcugaguggcgcuggaggcugagaauucccccuucugugaagcuugguacacaaggcuccuagagaacauguuucuuucucauccuaggcaggcuuugguuacuaaaccagcugaagcccaguuucccaagucguauugcucuuacuaacacuaucccuauuucucauccuucccgccaucgacaaagccgggcaucccagccgcugagguggguauagguguuguagcugaggcagaugcggccgaugcugcuggcuucccuguccccccugacauggaagacgauuacgaaccugagcugcuguuaaugccauccaaucagccggucaaccagcccauucuggccgcggcucaguccuugcaucgggaagcuaccaaguggucuaguaagguacugauaagcacccccaguugggggcugcuccauaugcauccggccaugugcagccuugacacauugcaucacucaugaucugugcugguccugugagucugagcagggcgggcaucugucugucugcaccauguuguuaggacuggcuucacaaguuugauaggucugcuaacgccagauuaauuggacugcauuuauguuuaggggaugaagagagauggggggggucacuuuuggaaaggauuccuuuucuuacugauuuuguggccaucgcuggaaaccccuugggaagccgugaaugcaucucucaaugacuuccaggucaggaaccaugguagaccauuacgaggucaccuggccugaccauugagcuuugccugcucccaacugaccccucacugauggcucagggagaguugaugagggggagaggcagcuuuauagggcagggucucugggggaggacugcuugcugcccugcacuuggcuauguggcagaugcuggccuugaugggaguccacagaaaauggggccucacugacugcuuguccagguaucucagugggagggaaugggagugggaaauggaguacucaaggccacaagacaggccgccauagaacuuuggccuuggggaaugaaccaaagcuaguuuggagaguagggugauuggggugaucacuuuucccuuuaaagguggcaugcugcaagaagaaaggcuuugaagagugauggguagucacuaaccauggcacuaugcuaucuucuaaccaacgugaugggguccuggaaugauccuaggucugcacuagaagagguagacccagaggaccuugucuaacauaccccuugcuucuugacuucuucccauaccugcguucucuccggccucaauuacugccugagauguuacacccuuccagcauaaaugaugaaccgcuucauggugccuguagaggccucuugcagagcacccugcagugguaugguuuguguaugccucacugcacuguagagaaaugaagagcaugaggggaaaaaugaguagggccuggacuuuuagcuaguuuugaacacugcaguugcuaugacuugggguuguuagcagccaaaagaggagcuuucaugagagggcacagaauacauaacuugucuguuucuuuacuaugacccaugaggguuuuaguaaaccaaaaugccaagucuaagauaaacugccauuccuuggagugaggguuccauuuacagccugaaucacgacuuuuauuuuccuaaugccuucucuugcauccucuuagcugaagguuccuuuaacuggagucuucacuuagcugaggggacugaagaauugauucuuuacccuuuuacgugggaaaaauuaaagcaacauguucguucaggcugacaggacaaauaagaggcaguagagggauagccagagcaggcuagaucagaaaauaucuuuuuuuuuuuuuucccucacccagcugagaauaguuacuuggguuugaaauucuaguuaaguagcaagaacgcuuggcugcuauuugcaacaaggguaagcaugaagagggugauuucagcaucuggaaaggcuccucuguauuuuuccccucaggccagcucuacugcuuucucccuauagaaaugaaagugccuguuuaaccagcuccuuggcccuguccccaguuuauugauaugauuaaccuggagaugccaaagugcuuguucagugcugugccuggggugcacaucuugcccuuucagacuaauaucugggucuuccuuuuuuuuagucaggaaaugucucucucccucuccuuucccccuccucucuccucucucuuuguuucucacacugagugcuugggcgagugcccugucucauucuuuuuuuuucuuccagugcuauccguaucacucaagaacggcccuuuucuccucuucucacccuuccggagggaugcuaagguggcaagcucccuccucuucucugugcuucuccuuccuuccuuaacauggccagagcgugggcagagcucacacuguaucuuugcuucccucuagggcaaugacaucauugcagcagccaagcgcauggcucugcugauggcugagaugucucggcugguaagagggggcagugguaccaagcgggcacucauucagugugccaaggacaucgccaaggccucagaugaggugacucgguuggccaaggagguugccaagcagugcacagauaaacggauuagaaccaaccucuuacagguacucggggaaagaggcugcgugugugugugugugugugugugugugugcguguguguguguguuggaggggaggguaugagagggagaaaagcaggagagaaaaacuagguaagggagaaagaggcacuucaccggggacagaaauagcagaaagggaaaaaaacaaauguacugggaaagacagauucaggaaagguuacuuccuaaucaaaugaaugcuuccauuucuggagaaauggauuguacugacccuaggggaaaaaacaaguggaauucugcugcuuauuuaucgagugccuuuucugugccagccacugggaauacagagguagguaagucuugccuucaaggagcuugugggcaaggcaaacagagaaacauaccaaauuaaacuuucucuuuagguaugugagcgaaucccaaccauaagcacccagcucaaaauccuguccacagugaaggccaccaugcugggccggaccaacaucagugaugaggagucugagcagguauguggcagcuguuuuugguuucuggcuggcagcuucugugccguuuugcaguaauuuaacucugcuuuggggaaauuuuaccccuuaauugaguaucgaguauucaguaugugggaugcacucagacugucucaggaggggaaagucuguguuggauagauacaucagaaauuuggaauuggggccaggugcaguggcacaugcagguaaucccagcacuuugggaggcugaggcgggagaauugcuuaagcccagaaggucaaggcaguaagcugugauugcaccacugcacugcagccugggugacagagugagacucuugucuugaaaaaacaaaacaaaacaccaggaauugggagccaggugugguggugugcaccuguagucccagcuacucaggaggcugaggcaguaggaucauuugaaaccaggaguugaagacuagcuugggcaaaauagcaagaccccaucucaaaauaaauagauaaauaaauaaauaaauaaauaaauaaauaaguaaauaaaaggaaucuggaauugcucuugggcaacuuuugucauuuuacagauaggaaacugaggucuagagagguuaagugucugaaauaacacuauggaucaguggcaguuaggacucuacucaguuccuuacccuuggaauaaguuuggcucuuuugaggccuccagugccuguucauuucaacucacuguauguuucuggcuggagagaagguccgcuuuccagcucucuguguguuagugccucagggaggaugaauagugcaggcuuuuccggggcaugagguaguuaggccugugcugaaacugaaaugacagcucaaaggaggugcuucucuuauauucucuuuagguuucucugauagagauagaaauaaggaugcugagaagguucucuuaaccacugcuuccugcauauaccuuggcagucacccaaguuuguccuccuucccaaaaucuuggcccaggucuuucaggaaacccucauuugagcaccccuuacucuccuuauuuccccuccgggaggcccugcucuaagcaagauucccacauggacugcccacacagggcuccucacacaugggguacauaguuuuguuggacuagccacacgaggcucaucacacaugggcuaaggugaagcacuguauuagguguuaagggaguuuaaaaaauuaagagacacaauuccccccacccaacguggggaacucaaaaauagucugaaagaacaacuguuucugaucucuaggccaggagauagggcacuggggcacuuuagaggaaauaaggcggccauucuucuuggugccauuauuguugcuucugcuaccauauucuaauccaacaacucucacccuaauccucucuucucccaaaccaugggaacuguaucuucacaccuaacuuccacauauucuaugaaggguuugcacacuucgcuguuucuaugucaugugaucucuucuguccaaagaaagguggaaaaaaauggggaaggaaggguaagacugagauucaggccuaaucagagacuuaaucaauuaaccacuaaaaauaugccuugagaauaucuauuauguuccauuaaauauuccaguuuuaaaaaggguagaaauugacaguaugguagaauggaaaaaacacaggacuguuugggaggcugaggcaggagaaucgcuugaaccugggaggcggaaauugcagugagccgagaucgugccauugcacuccagccuaguuaacaagagugaaacuccgucucaaaaaaaaaaaauaauaauaaaauaaaauaaaauaaacaacaacaaaaaacaaaacccauaggacuauaagucagaaauccugaguccuaauucucacucuaugaaugucucugggccugagucccuuugcugaccaagugaaaagaacaacugaugaggaauuccagcccacaguuacacuuaucagagccugugaaacugaguguacaaauuuuaugcaggugugcauuuuuucugggggagaauucaccgccuucauuaaauccucaaaugauguaugacuuaaaaauagccaagaauuacugagcugaugaauugccaagauccuuccuugacuuucuaugguagaguaccaaugugauuucagucuuauaaguuugugcguuuguuugaaagauuaacguauuuagauuuucauggguuuaaagugguugguugcuugguuuguucauuugguuguuuuuaaaauucauuaauuaaauauuuaugaaauaccuccugugugccaggcaccauccuaaauacuggggguaugacagugcacaaaauugacaaaaaucuacucuguauaacuuaaauguuaguaugaagacagaaaaaacccucaaaacucccaaacaaccuagguaaaauacguaguguaucaguucgugaugauagguucaauggaaaaaauaaggccaagcgcgguggcucacgccuacuguauguagucuuagcacuuugggaggcugaggugggcagaucacuugagcccaggaguacgaguccaaccugggcaacauggcggaaccccaucuguacaaaaaauuaaaaaauuacccagauguggcagcauguaccuauugucccagcugcucaaaggcugaggcaggaggauccuugagcccagggggcagaggcugcaguggccgagaucacaccacugcacuccagccuggaugaaagagaaagaccccaucucaaaaaaagaaugagcagggaaauccucaccaaggugacaagugagcaaagaucugaaggugaggggaucccugggaucccuggggaaagagcaguccagguacaggaaacagcaaguccugagggagaagcauguuugaagaccaagaaagaggacaugcuguaagcuaucugaagccacaguauacaaucagcgauggccaguuuuggguucuuuuuggugaucugggaaaaccccuagugaugcaagcaaauaugggggaugccagguaccagugggguuagcugcaucccacuccuggcugaaaccuauuuuagagacaggccugcaucagggacccuggguaacggaaaguaccuuuuuccuugcaggccacagagaugcugguucacaaugcccagaaccucaugcagucugugaaggagacugugcgggaagcugaagcugcuucaaucaaaauucgaacagaugcuggauuuacacugcgcuggguuagaaagacucccugguaccaguaggcaccuggcugagccuggcuggcacagaaaccucuacuaaaaagaaggaaaaugaucugagucccaggagcugcccagaguugcugggagcugaaaaaucacauccuggccuggcacaucagaaaggaaugggggccucuucaaauuagaagacauuuauacucuuuuuucauggacacuuugaaauguguuucuguauaaagccuguauucucaaacacaguuacacuugugcacccucuaucccaauaggcagacuggguuucuagcccauggacuucacauaagcucagaauccaagugaacacuagccagacacucugcucugcccuuguucccuaggggacacuucccucuguuucucuuuccuuggcucccauucacucuuccagaaucccaagacccagggcccaggcaaaucaguuacuaagaagaaaauugcugugccucccaaaauuguuuugagcuuuccauguugcugccaaccauaccuuccuucccugggcugugcuaccuggguccuuuucagaagugagcuuugcugcuacaggggaagguggccucuguggagccccagcauaugggggccuggauucauuuccugcccuuccucaguuuaauccuucuaguuucccacaauauaaaacuguacuucacugucaggaagaaaucacagaaucauaugauucugcuuuuaccaugccccugagcaaugucugugcuagggaaacuucccgucccauauccugccucagcccgccaagguagccaucccaugaacacacuguguccuggugcucucugccacuggaagggcagaguagccaggguguggcccugccaucuucccagcagggccacucccggcacuccaugcuuagucacugccugcagaggucugugcugaggccuuaucauucauucuuagcucuuaauuguucauuuugagcugaaaugcugcauuuuaauuuuaaccaaaacaugucuccuauccugguuuuuguagccuuccuccacauccuuucuaaacaagauuuuaaagacauguagguguuuguucaucuguaacucuaaaagauccuuuuuaaauucaguccuaagaaagaggagugcuuguccccuaagaguguuuaauggcaaggcagcccugucugaaggacacuuccugccuaagggagagugguauuugcagacuagaauucuagugcugcugaagaugaaucaaugggaaauacuacuccuguaauuccuaccucccugcaaccaacuacaaccaagcucucugcaucuacucccaaguaugggguucaagagaguaauggguuucauauuucuuaucaccacaguaaguuccuacuaggcaaaaugagagggcaguguuuccuuuuugguacuuauuacugcuaaguauuucccagcacaugaaaccuuauuuuuucccaaagccagaaccagaugaguaaaggaguaagaaccuugccugaacauccuuccuucccacccaucgcuguguguuaguucccaacaucgaauguguacaacuuaaguugguccuuuacacucaggcuuucacuauuuccuuuauaaugaggaugauuauuuucaaggcccucagcauauuuguauaguugcuugccugauauaaaugcaauauuaaugccuuuaaaguaugaaucuaugccaaagaucacuuguuguuuuacuaaagaaagauuacuuagaggaaauaagaaaaaucauguuugcucucccgguucuuccagugguuugagacacugguuuacacuuuaugccggaugugcuuuucuccaauaucagugcucgagacacagugaagcaaauuaaaaaaaaaaaaaaaaaaaaucccugaaugaugauuagagacaucaccgcuaaaaaacuacauuuauaagcuaggauuuguuauaugcaaauauuuucugccucuucuuuuguucuguuuaaaacaauaaaaugcauuuguauaaaaaaugcuuuaaaugauggauauguuacuuuagcaagaacuuuuaggucagguuucuccuuuguuuugaugaauagucaaugaaacuaauccucaagaucuggaaacuaaagauuuuuauuuaauccaaauguugcacuggaagaagaaaucaacagugguauauuuacuuaacaaggauguguguaauacaagacaacccuggggauuacacacuugaaggaauggaaguggcaaagguuaacaggcagaaagcagcuggaugaaacaguuuauuuucaucuuagaagauucuagcuaucuguggagaccaccacuguuccccgaaaagcuaaaguuguuaaguuuguaggaguaccacagguccuucccccugcugcaagacagagacuugcucuguugcccaggcugcagugcaguggugcaaucucagcucacugcaaccucugccucccggguucaagcaauucuccugccucagccucccauguagcugggauuacaggugugcgccaccaugccuggcuaauuuuuguauuuuuaguagagauggaguuucaccauguuggccaggcuggucucgaacuccugaccucaagugauccgcccaccuugaccucccaaagugcugggauuacaggugugauccaccacgcccggccacacagguccauuuuucauauuccaaagcccaguauagaauaaauaggguuuucagggauccaccagggcuauaaaacagaguuagcuuuuggggacauaguccucuucuuccuuaaagaaacacugacuaaaauaguaggagcagguuuuuagaguagaguugggacaucacuuuuucccugauuuucuagaucugaaagggguaacaugucauuaaagggugaugauauugauauuuaguguugccaacugcuauuaucacugcuuuaucuuggaaaguugccgacuauaaagacagauuccagccugcuugaguuaagggaaaggccaaggcugcuacugaauuagcaguuucuaaaacugucuuguuuuugccauuuaccauauguucacuggugcugccuuccugcuguaguauaaucauuuucucaaaucaguugccucucaggacaagaucagcauuuuccuaggguccuucuguagcaccacuuaaggaaugaaccuaucacaggaacucccuuugaauaaaaugauggugacucccacacgcaggaaagaaucauuuacuucauuugcucuugauauacucccuuaugaauuuagaacaagugauccaggauuagcuguaacucugugcuugaaaaauauuuuacuacuacuaaguauucagaaaucuuuguuaucaguagguggugguagugauagggaagggagcuuugaucacuaaucucucagacuguggccagaauggugaugcuuaagccaaguaugaauggcuauuaacauacugagguuagggaaggaguacugagaagugcuuugcagcaacacucgcagcuugugugaugaugcagaagaaaaucugaucauguucacccugcuuugacaaugagccuugcccauuggagaauguucaaucaauaguagaccuaaaaaaaaucaacuuguugcuuucaucuuuuuauugauagcacagccagagcuaccaaaaugauuuacuggauucuagcaaauuaauaaauacaguaauuugauuguaaaaggaaacauucuacuuggacauuuuaguagaaauugcuagagggaaggagcuccuggcguacauucuacuuggauagaagagaagauagcacaggaggagaacuggacaguccagguauagauuguugagauuagggauucagcagaaagcaaagcaaauguucucauuguucuuuugagguacgaacucugaagagucaagacauuaaaaauaaaaagcaauugaaccggguagccaaacuuaggcaaaaggaauaaauauuuggcaacauuuugacuuuaacugccaaucugagauuaguuucuucagaaauuuggaagcugcaaaacguugccuuucuuauuccaugaaaggcagggcaggcaaagguaagaaaacugcugagugggcuccuuguaccagcaccaaccagcagcccuugacagcauagaugggaugaguguaagggcuauccuuagcauaagggaaagacgguuauaagcugagaagauugaaagaagaauggagccacaaagagaauagcauaaauaacaagaaggaaacaugaagaacaagcacuuaagauauuaacuuucagucuuucuccauuucuugaugucuaaugaggcaaaauaacugggcaaggaccaccaagaugaagaaguuaaauaaaaugucacaaugaaauugagugcaauaauacaacuguugacugacuuuccaaaaccacggugaucgguagaguaucaucaauguuaccgaggauuuuguuucugccucauuauaacucacuuccauguauuuugucaguauaguacguauauuuaagcacuccagugacaauuaugacaauaguuucuggaagaaaucuaugacuauagcuuugggaagcacacaauaugaaaagggaauuuccccuaaagacaaggaaugcagacaaauucaaacccuuaagaacaacaacaaaaaagauuuaaaaagacugaugacugugaggcaggcacauuuuccuccuuuugcugaacuggggcaugaggcauuuagguuaaccauggcuuaacugguguuggguaagcuuuauauuauaaaacaugaagauggcaaagguuucacuuaaguuuuucuuuuacuacuuuaauuugcuuaaaagcacaaaugcuugugcuugcaguaacuuccuaaaagcagaaguaauguucccuuuuacuaccuuaauaaagcauuugccccuuugauacaaaugauuuuuuuacugugcuaacagcugaaccaguggcacaaaauugagaugguauuuacugcagcaaggucccuguaaaucaaauucuaagcuuuacauaaaaaucuuauuuauaaaaaauacaauaccaaguacagugagaauggagcauggagcagcagugcucccugccagggccauguggaaguggcuuuugcuacagugcuugcuuaauggcacaagugaaaagcugaauaaggcaaacacuugaagaggcaguuuucuguaaacuucuggggguggggggaauuuccucucgggacagauacugguuugggauggcuaagaucagaaggugugauauuuggcugcaccugacacaucacagauuuaagauagcuucugcuggaugagaccaguuaacucuuuuaggagagagguuaucacuacagcuuucugccuuuacuguuacaaugugcagccgccagaugguauccuccuauggaaaaaaaucaccuccaaaaucuuccuaagugaaaagauacaaaauaagcuaagucacuaaaagguuuccuuagcuuaaagcuccuuaagaauccuacauugauaacuaaguaacuuuguuagcgguguguagcuagacacaaaugcuuuaacuagaauauguauucccacucacuugguaccuaauagugauacaucguaaugacacuuggaaaacaaacugguccugaggaauuuuggccucuucucauguccucacuuggaacuuuccagcuuucgugacguauuugacuccuuuaaauggcuu

SEQ ID NO: 17457 - RNA, 125806 nt, Homo sapiens
aagccauuuaaaggagucaaauacgucacgaaagcuggaaaguuccaagugaggacaugagaagaggccaaaauuccucaggaccaguuuguuuuccaagugucauuacgauguaucacuauuagguaccaagugagugggaauacauauucuaguuaaagcauuugugucuagcuacacaccgcuaacaaaguuacuuaguuaucaauguaggauucuuaaggagcuuuaagcuaaggaaaccuuuuagugacuuagcuuauuuuguaucuuuucacuuaggaagauuuuggaggugauuuuuuuccauaggaggauaccaucuggcggcugcacauuguaacaguaaaggcagaaagcuguagugauaaccucucuccuaaaagaguuaacuggucucauccagcagaagcuaucuuaaaucugugaugugucaggugcagccaaauaucacaccuucugaucuuagccaucccaaaccaguaucugucccgagaggaaauuccccccacccccagaaguuuacagaaaacugccucuucaaguguuugccuuauucagcuuuucacuugugccauuaagcaagcacuguagcaaaagccacuuccacauggcccuggcagggagcacugcugcuccaugcuccauucucacuguacuugguauuguauuuuuuauaaauaagauuuuuauguaaagcuuagaauuugauuuacagggaccuugcugcaguaaauaccaucucaauuuugugccacugguucagcuguuagcacaguaaaaaaaucauuuguaucaaaggggcaaaugcuuuauuaagguaguaaaagggaacauuacuucugcuuuuaggaaguuacugcaagcacaagcauuugugcuuuuaagcaaauuaaaguaguaaaagaaaaacuuaagugaaaccuuugccaucuucauguuuuauaauauaaagcuuacccaacaccaguuaagccaugguuaaccuaaaugccucaugccccaguucagcaaaaggaggaaaaugugccugccucacagucaucagucuuuuuaaaucuuuuuuguuguuguucuuaaggguuugaauuugucugcauuccuugucuuuaggggaaauucccuuuucauauugugugcuucccaaagcuauagucauagauuucuuccagaaacuauugucauaauugucacuggagugcuuaaauauacguacuauacugacaaaauacauggaagugaguuauaaugaggcagaaacaaaauccucgguaacauugaugauacucuaccgaucaccgugguuuuggaaagucagucaacaguuguauuauugcacucaauuucauugugacauuuuauuuaacuucuucaucuuggugguccuugcccaguuauuuugccucauuagacaucaagaaauggagaaagacugaaaguuaauaucuuaagugcuuguucuucauguuuccuucuuguuauuuaugcuauucucuuuguggcuccauucuucuuucaaucuucucagcuuauaaccgucuuucccuuaugcuaaggauagcccuuacacucaucccaucuaugcugucaagggcugcugguuggugcugguacaaggagcccacucagcaguuuucuuaccuuugccugcccugccuuucauggaauaagaaaggcaacguuuugcagcuuccaaauuucugaagaaacuaaucucagauuggcaguuaaagucaaaauguugccaaauauuuauuccuuuugccuaaguuuggcuacccgguucaauugcuuuuuauuuuuaaugucuugacucuucagaguucguaccucaaaagaacaaugagaacauuugcuuugcuuucugcugaaucccuaaucucaacaaucuauaccuggacuguccaguucuccuccugugcuaucuucucuucuauccaaguagaauguacgccaggagcuccuucccucuagcaauuucuacuaaaauguccaaguagaauguuuccuuuuacaaucaaauuacuguauuuauuaauuugcuagaauccaguaaaucauuuugguagcucuggcugugcuaucaauaaaaagaugaaagcaacaaguugauuuuuuuuaggucuacuauugauugaacauucuccaaugggcaaggcucauugucaaagcagggugaacaugaucagauuuucuucugcaucaucacacaagcugcgaguguugcugcaaagcacuucucaguacuccuucccuaaccucaguauguuaauagccauucauacuuggcuuaagcaucaccauucuggccacagucugagagauuagugaucaaagcucccuucccuaucacuaccaccaccuacugauaacaaagauuucugaauacuuaguaguaguaaaauauuuuucaagcacagaguuacagcuaauccuggaucacuuguucuaaauucauaagggaguauaucaagagcaaaugaaguaaaugauucuuuccugcgugugggagucaccaucauuuuauucaaagggaguuccugugauagguucauuccuuaaguggugcuacagaaggacccuaggaaaaugcugaucuuguccugagaggcaacugauuugagaaaaugauuauacuacagcaggaaggcagcaccagugaacauaugguaaauggcaaaaacaagacaguuuuagaaacugcuaauucaguagcagccuuggccuuucccuuaacucaagcaggcuggaaucugucuuuauagucggcaacuuuccaagauaaagcagugauaauagcaguuggcaacacuaaauaucaauaucaucacccuuuaaugacauguuaccccuuucagaucuagaaaaucagggaaaaagugaugucccaacucuacucuaaaaaccugcuccuacuauuuuagucaguguuucuuuaaggaagaagaggacuauguccccaaaagcuaacucuguuuuauagcccugguggaucccugaaaacccuauuuauucuauacugggcuuuggaauaugaaaaauggaccuguguggccgggcgugguggaucacaccuguaaucccagcacuuugggaggucaaggugggcggaucacuugaggucaggaguucgagaccagccuggccaacauggugaaacuccaucucuacuaaaaauacaaaaauuagccaggcaugguggcgcacaccuguaaucccagcuacaugggaggcugaggcaggagaauugcuugaacccgggaggcagagguugcagugagcugagauugcaccacugcacugcagccugggcaacagagcaagucucugucuugcagcagggggaaggaccugugguacuccuacaaacuuaacaacuuuagcuuuucggggaacagugguggucuccacagauagcuagaaucuucuaagaugaaaauaaacuguuucauccagcugcuuucugccuguuaaccuuugccacuuccauuccuucaaguguguaauccccaggguugucuuguauuacacacauccuuguuaaguaaauauaccacuguugauuucuucuuccagugcaacauuuggauuaaauaaaaaucuuuaguuuccagaucuugaggauuaguuucauugacuauucaucaaaacaaaggagaaaccugaccuaaaaguucuugcuaaaguaacauauccaucauuuaaagcauuuuuuauacaaaugcauuuuauuguuuuaaacagaacaaaagaagaggcagaaaauauuugcauauaacaaauccuagcuuauaaauguaguuuuuuagcggugaugucucuaaucaucauucagggauuuuuuuuuuuuuuuuuuuuaauuugcuucacugugucucgagcacugauauuggagaaaagcacauccggcauaaaguguaaaccagugucucaaaccacuggaagaaccgggagagcaaacaugauuuuucuuauuuccucuaaguaaucuuucuuuaguaaaacaacaagugaucuuuggcauagauucauacuuuaaaggcauuaauauugcauuuauaucaggcaagcaacuauacaaauaugcugagggccuugaaaauaaucauccucauuauaaaggaaauagugaaagccugaguguaaaggaccaacuuaaguuguacacauucgauguugggaacuaacacacagcgaugggugggaaggaaggauguucaggcaagguucuuacuccuuuacucaucugguucuggcuuugggaaaaaauaagguuucaugugcugggaaauacuuagcaguaauaaguaccaaaaaggaaacacugcccucucauuuugccuaguaggaacuuacuguggugauaagaaauaugaaacccauuacucucuugaaccccauacuugggaguagaugcagagagcuugguuguaguugguugcagggagguaggaauuacaggaguaguauuucccauugauucaucuucagcagcacuagaauucuagucugcaaauaccacucucccuuaggcaggaaguguccuucagacagggcugccuugccauuaaacacucuuaggggacaagcacuccucuuucuuaggacugaauuuaaaaaggaucuuuuagaguuacagaugaacaaacaccuacaugucuuuaaaaucuuguuuagaaaggauguggaggaaggcuacaaaaaccaggauaggagacauguuuugguuaaaauuaaaaugcagcauuucagcucaaaaugaacaauuaagagcuaagaaugaaugauaaggccucagcacagaccucugcaggcagugacuaagcauggagugccgggaguggcccugcugggaagauggcagggccacacccuggcuacucugcccuuccaguggcagagagcaccaggacacaguguguucaugggauggcuaccuuggcgggcugaggcaggauaugggacgggaaguuucccuagcacagacauugcucaggggcaugguaaaagcagaaucauaugauucugugauuucuuccugacagugaaguacaguuuuauauugugggaaacuagaaggauuaaacugaggaagggcaggaaaugaauccaggcccccauaugcuggggcuccacagaggccaccuuccccuguagcagcaaagcucacuucugaaaaggacccagguagcacagcccagggaaggaagguaugguuggcagcaacauggaaagcucaaaacaauuuugggaggcacagcaauuuucuucuuaguaacugauuugccugggcccugggucuugggauucuggaagagugaaugggagccaaggaaagagaaacagagggaaguguccccuagggaacaagggcagagcagagugucuggcuaguguucacuuggauucugagcuuaugugaaguccaugggcuagaaacccagucugccuauugggauagagggugcacaaguguaacuguguuugagaauacaggcuuuauacagaaacacauuucaaaguguccaugaaaaaagaguauaaaugucuucuaauuugaagaggcccccauuccuuucugaugugccaggccaggaugugauuuuucagcucccagcaacucugggcagcuccugggacucagaucauuuuccuucuuuuuaguagagguuucugugccagccaggcucagccaggugccuacugguaccagggagucuuucuaacccagcgcaguguaaauccagcaucuguucgaauuuugauugaagcagcuucagcuucccgcacagucuccuucacagacugcaugagguucugggcauugugaaccagcaucucuguggccugcaaggaaaaagguacuuuccguuacccagggucccugaugcaggccugucucuaaaauagguuucagccaggagugggaugcagcuaaccccacugguaccuggcaucccccauauuugcuugcaucacuagggguuuucccagaucaccaaaaagaacccaaaacuggccaucgcugauuguauacuguggcuucagauagcuuacagcauguccucuuucuuggucuucaaacaugcuucucccucaggacuugcuguuuccuguaccuggacugcucuuuccccagggaucccagggauccccucaccuucagaucuuugcucacuugucaccuuggugaggauuucccugcucauucuuuuuuugagauggggucuuucucuuucauccaggcuggagugcaguggugugaucucggccacugcagccucugcccccugggcucaaggauccuccugccucagccuuugagcagcugggacaauagguacaugcugccacaucuggguaauuuuuuaauuuuuuguacagaugggguuccgccauguugcccagguuggacucguacuccugggcucaagugaucugcccaccucagccucccaaagugcuaagacuacauacaguaggcgugagccaccgcgcuuggccuuauuuuuuccauugaaccuaucaucacgaacugauacacuacguauuuuaccuagguuguuugggaguuuugaggguuuuuucugucuucauacuaacauuuaaguuauacagaguagauuuuugucaauuuugugcacugucauacccccaguauuuaggauggugccuggcacacaggagguauuucauaaauauuuaauuaaugaauuuuaaaaacaaccaaaugaacaaaccaagcaaccaaccacuuuaaacccaugaaaaucuaaauacguuaaucuuucaaacaaacgcacaaacuuauaagacugaaaucacauugguacucuaccauagaaagucaaggaaggaucuuggcaauucaucagcucaguaauucuuggcuauuuuuaagucauacaucauuugaggauuuaaugaaggcggugaauucucccccagaaaaaaugcacaccugcauaaaauuuguacacucaguuucacaggcucugauaaguguaacugugggcuggaauuccucaucaguuguucuuuucacuuggucagcaaagggacucaggcccagagacauucauagagugagaauuaggacucaggauuucugacuuauaguccuauggguuuuguuuuuuguuguuguuuauuuuauuuuauuuuauuauuauuuuuuuuuuuugagacggaguuucacucuuguuaacuaggcuggagugcaauggcacgaucucggcucacugcaauuuccgccucccagguucaagcgauucuccugccucagccucccaaacaguccuguguuuuuuccauucuaccauacugucaauuucuacccuuuuuaaaacuggaauauuuaauggaacauaauagauauucucaaggcauauuuuuagugguuaauugauuaagucucugauuaggccugaaucucagucuuacccuuccuuccccauuuuuuuccaccuuucuuuggacagaagagaucacaugacauagaaacagcgaagugugcaaacccuucauagaauauguggaaguuaggugugaagauacaguucccaugguuugggagaagagaggauuagggugagaguuguuggauuagaauaugguagcagaagcaacaauaauggcaccaagaagaauggccgccuuauuuccucuaaagugccccagugcccuaucuccuggccuagagaucagaaacaguuguucuuucagacuauuuuugaguuccccacguuggguggggggaauugugucucuuaauuuuuuaaacucccuuaacaccuaauacagugcuucaccuuagcccaugugugaugagccucguguggcuaguccaacaaaacuauguaccccaugugugaggagcccugugugggcaguccaugugggaaucuugcuuagagcagggccucccggaggggaaauaaggagaguaaggggugcucaaaugaggguuuccugaaagaccugggccaagauuuugggaaggaggacaaacuugggugacugccaagguauaugcaggaagcagugguuaagagaaccuucucagcauccuuauuucuaucucuaucagagaaaccuaaagagaauauaagagaagcaccuccuuugagcugucauuucaguuucagcacaggccuaacuaccucaugccccggaaaagccugcacuauucauccucccugaggcacuaacacacagagagcuggaaagcggaccuucucuccagccagaaacauacagugaguugaaaugaacaggcacuggaggccucaaaagagccaaacuuauuccaaggguaaggaacugaguagaguccuaacugccacugauccauaguguuauuucagacacuuaaccucucuagaccucaguuuccuaucuguaaaaugacaaaaguugcccaagagcaauuccagauuccuuuuauuuacuuauuuauuuauuuauuuauuuauuuauuuaucuauuuauuuugagauggggucuugcuauuuugcccaagcuagucuucaacuccugguuucaaaugauccuacugccucagccuccugaguagcugggacuacaggugcacaccaccacaccuggcucccaauuccugguguuuuguuuuguuuuuucaagacaagagucucacucugucacccaggcugcagugcaguggugcaaucacagcuuacugccuugaccuucugggcuuaagcaauucucccgccucagccucccaaagugcugggauuaccugcaugugccacugcaccuggccccaauuccaaauuucugauguaucuauccaacacagacuuuccccuccugagacagucugagugcaucccacauacugaauacucgauacucaauuaagggguaaaauuuccccaaagcagaguuaaauuacugcaaaacggcacagaagcugccagccagaaaccaaaaacagcugccacauaccugcucagacuccucaucacugauguugguccggcccagcaugguggccuucacuguggacaggauuuugagcugggugcuuaugguugggauucgcucacauaccuaaagagaaaguuuaauuugguauguuucucuguuugccuugcccacaagcuccuugaaggcaagacuuaccuaccucuguauucccaguggcuggcacagaaaaggcacucgauaaauaagcagcagaauuccacuuguuuuuuccccuagggucaguacaauccauuucuccagaaauggaagcauucauuugauuaggaaguaaccuuuccugaaucugucuuucccaguacauuuguuuuuuucccuuucugcuauuucuguccccggugaagugccucuuucucccuuaccuaguuuuucucuccugcuuuucucccucucauacccuccccuccaacacacacacacacgcacacacacacacacacacacacacacacgcagccucuuuccccgaguaccuguaagagguugguucuaauccguuuaucugugcacugcuuggcaaccuccuuggccaaccgagucaccucaucugaggccuuggcgauguccuuggcacacugaaugagugcccgcuugguaccacugcccccucuuaccagccgagacaucucagccaucagcagagccaugcgcuuggcugcugcaaugaugucauugcccuagagggaagcaaagauacagugugagcucugcccacgcucuggccauguuaaggaaggaaggagaagcacagagaagaggagggagcuugccaccuuagcaucccuccggaagggugagaagaggagaaaagggccguucuugagugauacggauagcacuggaagaaaaaaaaagaaugagacagggcacucgcccaagcacucagugugagaaacaaagagagaggagagaggagggggaaaggagagggagagagacauuuccugacuaaaaaaaaggaagacccagauauuagucugaaagggcaagaugugcaccccaggcacagcacugaacaagcacuuuggcaucuccagguuaaucauaucaauaaacuggggacagggccaaggagcugguuaaacaggcacuuucauuucuauagggagaaagcaguagagcuggccugaggggaaaaauacagaggagccuuuccagaugcugaaaucacccucuucaugcuuacccuuguugcaaauagcagccaagcguucuugcuacuuaacuagaauuucaaacccaaguaacuauucucagcugggugagggaaaaaaaaaaaaaagauauuuucugaucuagccugcucuggcuaucccucuacugccucuuauuuguccugucagccugaacgaacauguugcuuuaauuuuucccacguaaaaggguaaagaaucaauucuucaguccccucagcuaagugaagacuccaguuaaaggaaccuucagcuaagaggaugcaagagaaggcauuaggaaaauaaaagucgugauucaggcuguaaauggaacccucacuccaaggaauggcaguuuaucuuagacuuggcauuuugguuuacuaaaacccucaugggucauaguaaagaaacagacaaguuauguauucugugcccucucaugaaagcuccucuuuuggcugcuaacaaccccaagucauagcaacugcaguguucaaaacuagcuaaaaguccaggcccuacucauuuuuccccucaugcucuucauuucucuacagugcagugaggcauacacaaaccauaccacugcagggugcucugcaagaggccucuacaggcaccaugaagcgguucaucauuuaugcuggaaggguguaacaucucaggcaguaauugaggccggagagaacgcagguaugggaagaagucaagaagcaagggguauguuagacaagguccucugggucuaccucuucuagugcagaccuaggaucauuccaggaccccaucacguugguuagaagauagcauagugccaugguuagugacuacccaucacucuucaaagccuuucuucuugcagcaugccaccuuuaaagggaaaagugaucaccccaaucacccuacucuccaaacuagcuuugguucauuccccaaggccaaaguucuauggcggccugucuuguggccuugaguacuccauuucccacucccauucccucccacugagauaccuggacaagcagucagugaggccccauuuucuguggacucccaucaaggccagcaucugccacauagccaagugcagggcagcaagcaguccucccccagagacccugcccuauaaagcugccucucccccucaucaacucucccugagccaucagugaggggucaguugggagcaggcaaagcucaauggucaggccaggugaccucguaauggucuaccaugguuccugaccuggaagucauugagagaugcauucacggcuucccaagggguuuccagcgauggccacaaaaucaguaagaaaaggaauccuuuccaaaagugaccccccccaucucucuucauccccuaaacauaaaugcaguccaauuaaucuggcguuagcagaccuaucaaacuugugaagccaguccuaacaacauggugcagacagacagaugcccgcccugcucagacucacaggaccagcacagaucaugagugaugcaaugugucaaggcugcacauggccggaugcauauggagcagcccccaacugggggugcuuaucaguaccuuacuagaccacuugguagcuucccgaugcaaggacugagccgcggccagaaugggcugguugaccggcugauuggauggcauuaacagcagcucagguucguaaucgucuuccaugucaggggggacagggaagccagcagcaucggccgcaucugccucagcuacaacaccuauacccaccucagcggcugggaugcccggcuuugucgauggcgggaaggaugagaaauagggauaguguuaguaagagcaauacgacuugggaaacugggcuucagcugguuuaguaaccaaagccugccuaggaugagaaagaaacauguucucuaggagccuuguguaccaagcuucacagaagggggaauucucagccuccagcgccacucagcccaagccacuguguggugagagaagaaaagggacucacuccaauggcaaagggcuucuagagaaaucuuuacaccaagaaagcaaguggcauccauuucuuuaauauacuugauacuaaagucaaacuugacaagagugauucucacaugagaauauuucugaggagccaaacaaccaaacgauaguagcaaauuaccuuuaaaaggaauccggagagaaaaaguaaaugcagccacacaaguuacuuuguacagaacaaagugaacacugcuggaucauauggucacuguucuacauuuuccugggacacaggaggcaauuugggucagcucugcagcugccagacauagauuauuuccuucaugaguuaaaagucccagaauuaaaaaugauacaucagagguaacgaauaccaaacuaggaaagaggcaggaaaaacaaacacaauggugacugaagagaacuuaaguaccccacugucacccagcuguaaggagccucaagaagccaccucgucagccgcccaucucagggaacacccacacaucagaccagcucucuauccccucaaggucuucugaggcaaagcuucuaccaucucuuuuugcauccauugcuaguaccaccucagaaagcuucuccuuggguacaaccuaaauugcuugcaaaauagguucucacucaccccaaacucugcuuaucuaguucacagauagaauaauaugugaacuuggcaagugacugcagcugagcucacagaagcucagaagaauggugcucauuuaagaaugagaaucaugauggagagaacaugaauuuagaaccagggauggagauuauaaaagccagaugcugaaaauagacuaacauggaaagaaaauuaaaaacugccacaaugaagccaaaccauuuauacaaagaaugaugaauacagguucuuuacaucaaacaucuguacucaagaggaaguaguuuauauggaauuuucuuugagguuguuaccacuccuaaaagucuuaaccugcacaugaaaccugacuccaaagggugacgauguuggaggauucagggccaacaagggguucagauaccaucuaaacucuuuugccuaaacucaaccaagacccaucucugcugcucagaagaaaagccagcucacugcugcuaaggcucagagucccacaguguacaaagacagauagguugacagacacacgaacagauauuccuccccagcccaguacacacaugguucaaguagcuucugacuucacacaacucaaagucagcaaacuccugaucuugcacacuucaggagauagaccucaggacuucuggccacaaauggcagaguggggcaaguaaugugggccaaugcugucugcuuuuaaguuuguuuguuuuuuuaaauaauucauguauauuuuuuguucugcauaguguauuuugguucauuguaaugaaauuuaaauuuccuuuaaaaucuucacugucacccucccccacuccccaugcacaguggggcucugccacaugcaguuggagagauaccauuauaaauaauucuacaggucagguccaacaccagcaaagucucccuuccuucuuagaaccugggcucacagcuaacaguucagcaaaauacagaguuaaaaaccaaugugaauuucccagccugaaaaaaauccaagaucagcugcaggugcaggaggucccugaggaaauacaaucgacacaagagcuugaaagcuuugaggauguguaaagaauaaaggcaaauagguggugggaauaaagaucuagggucauaaaaacauuaaaaaaaagaucuagggucauauuagaaacaguuuagaacuaagagcuaccuuucacugcaggguuagcaauaauauuccucuuaucuagaaaagcuacugcucacuuuucaucauuuaggggaaaauaggcaaaaguuauucauagggcaagacugcuguagcauccauauuuuuaccaaccacauuaauauuuacaccuucagauuugcugaguaagagacagccuggagcugucuugaguugacaggugaaaugauucugagaaaggacaaaagcacauggcuucuaagauaccaaucuacuugcuucuguggaaaaaaaaagaaaaugcaaacauuucaucuagcuuuagcacagcccacacaauucauauuuggagcucugaucauuagcaauguagcaucuaaaaacauuugcaguuccaagaaagauaagcaauuucuaaaagaccccaaaugcuaaggucaaggcaccuggcacucuaauggacaaaggacaggaauccucuucucaaaucacaggcacccugacucuggcuuuugcaagcuugaaggagaaaccaucaggugucagaaacaucucacuaaagcacagguaagaagaggaauaugcuauuggcaacacaggaaccaaaggagagagagagggugacuccaaauagacucuucuuucugggucuuucaugguccuucauccuuuccgagaagacauccuuucucaacaagaaaagcuucacuacuuaccuugcuggaccauuugcgagcuucaucauggagcugucuggcagccaucaucauuggcugguuaaucaccuccccggccuucugcucagggaacucuucauccuuuuccucuggugguggaggccuagguggagggaccucaccuucaggcagaggugguuugggaggagcaagcucaucuguuagcuaaaaaagagaaaacaaguuguaaguaaaguccuaaaacuacuccccccuggaauucuuuccuuucuucuaaaaagcaucccuagaaaacccacccauauugacuccacauaagaccacccacacugagccacaaggaccaccugcuucaaucucaacagaagcagguuucucuacaaaaagcuagcaguggccgggcgcaguggcucacgccuauaaucccagcacuuugggaggccaaggcaggugggucaccugaggucaggaguucgagaccagccugcccaaaauggugaaaccccaucucuacuaaaaacacaaaaauuagccgggcaugguggcaugugccuauaaucccaacuacucaagaagcugaggcaggagaauugcuugaacccgggaggcagagguugccgugagcugagaucaugccacugcgcuccagccugggcgacagagcaagacuccaucucaaaacaagaaaaaaagaaaaaaaaaaaaggcuugcagcuacuguuuugguugcaucccagggaaguauacacagugcuaccagaugaaggauucucaaaaagucccuacagaagauguaaguugugguccugguucuaccagaaagcagcuacauaggcaaguaacuucuccccuuggccugagguuccucaucugucacugagggguagcuagaccaaaugaccucuaagauccagauucuaaaugacauaacucuguugcucacauaagaagccauucccaggaauagcccucucucccagcucuaaacacccaccaagcacccagcugggaagaaucuaagaugcguugaaggcugggaaacacuguuccuuagcugugugugcgaugacacaauuuuguacucaaccaacuuaaaaacuuaacaucuuuuacugacauuaaauaugggaaaguaaaucagauuauugccuugauaaguuauuuacaaagucaagguauuucuaauacuguuaguuggaauaagugucuagaaauaaucacuauuucuguuucuggaauuugugucugcaacauacugccuagcuagcuucuuccuacaccauguaaaaauauauucacaguacuugcgggggguaguggggaagguaucuaaagaucuuaaauuauaguuagggaaaaauuuuuuaaaagcauguaucuuguuacuuaaaaaaaagucaaauaaaggaaagaaccaacacaagauuucaaccaccucgguucuaccauuaucaacuaagaacacaccaaaucuccuuacuccaagcugugcagauuauuuuaccacaaugcacuaccucaucacucaucacauccacacuuaccaaagccagcuccucugcuccagccgcuccccaucacagcaagccacuaccacacacaccaguacuacacacacacacacaacccaugcauauaagcacuagguuauaacuccacuggauuuaggaaugaaaaucgagaucugccucccacuaagcuucaaaugaaagcuaaacgaagccaccuagugauggaggcucuaaaacacaaucuaccucucucuugcugaagucucaacaccuuccugcucaauucucugcauaucugaauuuacuuacucggaguuguucaaggucugguggaggcggcgggaagucaggcuccugagguuggaaggcuucucugaccuuggccacagcucccaggauccgauauccugaguccaggaagcucuuuugcaguccuaaacacaagacauccucacuuucagcugggugggucagugccccaaagcacugucugugcagcagcagaacugguuccaugaacaaaagcuggaugugaagcugccaguaaauaucacgggcagugauugaagaaggggggaggcaggacaaggcagaugcccugaggccugcagagcauuggaagcaucacaaaccagcuguucuuuuaguguucagggugccuucuuggcuguacaacuaaaaaguacccaggagaucccugggcaugaacacuuugggcucagguggcauccaucaccucucuuaugaugaggcagucaagagauaagccugcccaacucagaacaugggagaugucaguuucagauuggacauacauucccugaaguacuucucaccuuucucucuacuccuuugcuguccuuggcauucaguauguuaacccuuaugcugagcugcgcuacucuguucaguugccuggaauucaggaaucuacucuacuauuagaaacuccaauuaggaaaccaagcauguccuuagugauaauggguuuuggauauuagaaagauucugccugaaccagagaugaauaggggagccccuccuuccuacucucuugcauugacugcauucuacucauagacaagacugaaaacaucagauguucaaaacaggaaggaauucagaugauuucaaccaaaggagcggcuccaauuaugaucugccaugguaguaccaaaaauaugaucaaaauucaccuaaagaaaacccagauuuucuuuagguguagggccuaggagacccacagaucaacuuaagcccuccagauuugauagaaacugagaaugcuuuacaaagaaaaaaaagcauuuuaagaaaagcccaagagaaguuaacaccaguuacauaaacuaaauggaugguaaauugguuaucaugcaucuuuugaaaauuuuccaaaauaaugacugaacaaggcgaggagcuauuuagccagaccauauuaagaaagcacaggcuggaugccuguaaucccagcacuuugggaggccaaggcggguggaucaacugaggucuggaguuugagaccagccuggccaacauggugaaacucugccucuacuaaaacuacaaaaaauuagcugggugugguggugggagccuguaaucccagcuacucaggaggcuggggcaggagaaucacuugaauccaggcgggggcggagguugcagugagccaagauugugccauuguacuccagccugggcaacaagagcaaaacuccgucucaaaaaaaaaaaaaaaaaaaaaagcgcagagguugggcacgguggcucacaccuguaaucccagcacuaaaaaagcgcagagguugggcacgguggcucacaccuguaaucccagcacuuugacaggccaaggcggguggaucaccugaggucaggaauucaagaccagccuggccaacauggcaaaacccugucuacuaaaaacauaaaaauuagccaggcaugguggcacacaccuguaaucccagcuacucgggaggcugagguaggagaaucgcuagaacccagaagguggagguuucagugagcugagaucaugccacugcccucuggccugggugagagucucaaaaaaaaaagaaagcacagagaaguugguccagaaaaacuaacauacaacaagccugcugauaacugcagagacuuggauggaaaaagauuaaucuagcauucucaaacuaagugucuauaguuuuugcccccagacuuuguauguggugguugugggguacauauucccucacgaccuuuccugaguuaaccucucaguggaggugagacauagugccaugcauugcuuaccagggucggaaauguuuccagccacagcuuuugcauccaucaccaucggggagaugguuuugcucaauucaucagaggcagcuuucacagccucacggaacuugggauccucggaauucuccaccucccucuuagccaccagcaggauccgguuggcccgacgagcaauacugguugccccagcaaccagcaucugaggcugaauguuggccauagcuaccuugcacuuguccaggucuuuuuuaauugcuucuucugaagcauccaacagagauuugguaucaauggcuucguccaccagcccuguuaggaaaacagaaauggaauuuaguuucaauuuagaagaacagaaacuccaaaacacuguuauccacucaaacuucucaugagaaaguauaacauccagaauucucuucuucagcucaaacucuuccuacauaaucaaaagcuuccagguaaacaccacaguuaaaaaaaacagugaggacauagcccaaaagcccaucuggauuugcagcauuuauaccaaccgugguugccagccuucuuguauccaccccagacaaccagaaaugcaacaucgggaggaaacaaggaauaugucugaaaccaucacugcaucaccaccacguuaucugugaauaauauuuucucccugucccucucacuccccagccaucuguugcuuguuggcagcuuguagugcucaagaugagccaugcggaggauuccaauaacccuaacagccuauuucuuauuccuguuaccucucuucagacaccucaggaguuccacuuucaucucgggcugccauggaccccagucacagcagguucugcagggacagcaaaaagccuacauuccucauuccuucuuuccuaucucucccuuuacagagaaugaagacgauucagaggugccacuucaauugcacagacacagguuugcuggugguugguuucuccuuuuuaaaaaaacuacguaguugauaaguuggaggaaacuuugagacaaguuguauuaaaugguagcuauugugguuccuugaaaugugaacccacugaaaaugacagggacacuuacuguauccacaaacaccgccucccagccucugaaaccaaacucgggcucggacugggcaaagacacuauucaaagagaagauaggaguggugacaauaaacaucacgccaggagggcagcauuaaaauaaaagagacucaaagagucucucuucugacaaaguugcaaggcuugaaugagaagccgccacugcucagcagccuuaagcagagccaaguacacugcucagcacgugaccggcccuuuauccaauuacagcugaguaacagaaccagucccgcuccaauuucucagaacucauucuucauggauuagacaacaagauuuguauagaaaacucuaccugucauuuuuucaacauuaucgauccacugguucuucauggucucaaaauguucauaagcagcuugauuuccaggguuccuaaguaagauacgagcagccgagaccaccugacaaugacaaaacaccuuuaaacaccagagcacccuugcucuccagauacaaaccuucagccaagcuuucuccucuuuaccuacagauggcacuguaaagccagaaaguggcaagucucuuuucaggcugaauacaugagguuuggucucaauaaacagcuccccagaaugggcccuucacaggaagguuuuaccaucacagccugauuuuaagaagguaauaaagugacaaaguaaaugaguguccacuugauacuucagaagaacauacacaaaacuggcauauguuuaaacacuugaugucaacucuuccaucuuaaaaaucaccauuaagaaggauaccgaaaaguacucaaaacugauuuaugaauaauaugaagaaaaaauccucacaacaaccccaugagacaggacaguuaauaucucuacuuuagagaugcaaaaaccaagucucagaaaauuuaagugacugcucaagagguccuggccagucaguuacagcauuuggggaaaaaaggauuaacauuugccacguaucugguaagauacaggcuguacaugcauauucuuaauccaaauagaguccauuaggaaggaguuagcuccauuuuacagaugagagacuaagcaucaagagcacagaggagucggccgggugcaguggcucauacccauaaucccagcacuuugggagaccgaggcggguggaucacuugaggucaggaguuugagaccagccuggccaauauggugaaaccccaucucuaauaaaaauacaaaaaacuagccggguauggugguggacgccuguaaucuuagcuacuggggaggcugaggcaagagaaucgcuugaaccccggaggcggagguugcagugagccaagaucaugccacugcacuccagccugggcaacagagcaagacuccgucucggaaaaaaaaaaaaacucacagaggucucaaguccaaaucugucuccagaguccucauuuuaucuauaauugguguuauaagccuagauuccuguuccuccuuuuuaggaaucucaguuucauauugaaauuguauuuuauguuccauguuuuaugggagcuuuuaaagaguguuagacauguuuguagcuuaugaaaaauuguguaaaaguuggacaaguuaaaaaguuggacaagaggaucuaauuuauuaacacgccacacaggcaaaaguuuaaugauucagagacauguuuauuucccccauaucuccucacaaguucacacauaagccaguaucacaaauuuauaaagccuagcauaguuucgaauguaucauaggcacucaguaaaugucugaauaaauaaaugaaaaaauaaugaauuuucuauaauuugaauagaagaaaaauugcacaaacaucacacuaaauaauguugagcuaauauuuuuaagaaaaccuaucacauaguaaacuuuuaauaacuguacaguuugguuuuuuuucccaaucuuccuuugcucccaaacuuacuagccaugccuuguuacacaauaaguagaaaaaagaaaguuauagaaacagaucaauuuaaaaaaaaaaaaaaaacucucacaaagauguggagaaaagauauaaacuccaaaaucaaaacaaaguagccucuuaagauuauccaagccggccgcaguagcucaugccuguaaucucagcacuuugggaggccgaggugggcggaucaugaggucaggaguucaagaccagccuggccaacauggagaaacccugucucuacuaaaaaauagaaaaauuagccgggcaugguggcgggugccuguaaucccagcuacucaggaggcagagucaggagaaccacuugaacccaggaaguggaggcugcagugagcugagauuacaccauuggacuccagccugggugacaagagcgaaacucugucccucaaaaaaaaaaaaaaaaaagauuauccaaauauuuuccuaguuauguguguauguggcaaggggauugcuuuacuaauuuuuucuacuuucaaaacuaagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgagauugcgccacugcaguccacaguccggccugggcgacagagcgagacuccgucucaaaaaaaaaaaaaaaaaaaaaaaacuaauaaauaguccuuguaaaaaaaaauucaaauguuaugaaaauguauaaagacggugacagggucuugcucugucaccccaggcuggagggcaguggggcaaucaaagcuuacugcagccucaaccuucugggcucaaauaauccucccaccucagccucacaaauagcuguguucacaggcaugcgccaccacacccagcuaauuuuuuuuuuuuugguagagucggggucuugcuguauugcccaggcuggucucaaacucccaggcucaagcaguccucccgccucacccucccaaagugccggaauuauaggugcuaccgugcuggccuguauauguuuuuuuaugccaucuuacgguaaguauucaaaaauguauagaaacuguucuguaauuaacuuucuuuacugaacacuguaugaggaaugagcaaaacccaaccuggggugugaguucucgggccgucuucacugaggccugaaugccuuccacuguugauuuauuagcaguaccaaccgcagccgccuucucggccguagcaccaagcuuuccugaaugguuuucaaaguuagcugcccucucaucaaauaccuugaggaaaaaacagauauuaagaacauuuauuucaauaaaaugggucaggcagccuaagaaaaaguuucauccuuuaagaagggcagcaacugcucaaagacuuuagagaugacaucaaacccuaguuaauaaaacaacagucaaacuccaaauccuggccuugauggaucuccucagacguuuagccaucaccaucaugugcaaaugcacacaaacacacucacacacacacgcacauaaccuucauuuccaguucaaccagugcuuaccagguacaagcaggagcauuauauacucugcaguaauuugcugaaugugaagacuaaacaacccccauucucaaaagcuuaucuucuaguuugaagaagacagucaagcccacuccaggcucuauuguaggcagcuggguacauuaaaagcccagaacauccacacaguccuaaauugagcuccaggcuccccagagcagcauccuucauauaucccauuaccauuaauguuguaaaaacucugccauugaccuccaagggaaaaaugauagcuggugcucacacucaggccucagggcaaggaugacugacuuuuauuaaccccaaaugcaaaaucaucuacuuaauuguucauucagcucucaaauucuaaaaaaguuaauguuuccuuuaacagggauacugugcaagguugcauacuguggaggggacuauuaaacuuaaaguagcaagagaucuuuggucauuuguuagaauagauucuugcaaaagcuuaucuucuucaaacuagaagauaagcuuuggagaaugggguuuauuuagucuucacauucaguuacuuacuuacugcauuauuagaacugaugcuucccaacagcacugggucagguuuauacacuacacgaacaugucuggagcugccuaguggaaugcguccucuuuuuugucaacuucugccuaacuuggagaucaguucuggcucuagacaaucucuaaaggucucuugguucaauagcagguuccaaaucauugccaguguucugugucuaucuucucaagucucuuccccacgccagccucuuguuuggauuuaacuacauggguuccugccauuuaaugcugagaaucucugccuaaaaucccugaucuccuagccuccuucccguggccucaguucuuuuacccuagcuggucucccacacucuggaucuccugggcuuuuaccuaccuaauauccuugguugaccaucucaaugccagaccaugacugcugcuccuucugauuuaacuaacugcuuaacuugcuuuucucgucacucaaccaaaauuuacugagcaccuacuaugugccagacccugagacaggugcugaggacacaaaaaugaguaaaacacaauauccucaucucaaggaacucacagcccagugagaaaaaagcacucgaaaacagauuuacaauacagugugcuauguacaauaauagagcuaagcacugauacuauagguaggagcaaaagaaaaagcacuuaaccucucuaggaaacaaaggauaauaggaugaaggauaaauaguaauucaccaaaaaagaaggggaagauaauuacacagaaaaaacaaagacauggaaaagacagacugugcaggaaaccacaagcaacuagguauagcuagggccagaaaugagagggagggguuuguaggaaacagguaugggaagugucagagcuagaucacagagcccuggccuuauccucugugaaaguacaggccccacugaaggguuuaagcaggagaaugucagagucagguuguauuuuuauuugauugauggccuagugaaagagucaaagaagaccaguuagagcuaugcagucauagcucuagggggacuaggggacuaggaaaauaauuagagcucuggcaauaugaacagaaaauggaugugagauuaaaugagugugccuuaguuguuuauuuguaugaacggguguggggaagggaaaagucaaugacaacucacaaauuucugagagagaacagaaggacaacauaugcugagguaacuaggaagacuguagguggagaggcccaccuagauguaucuacuagccugaaagagaagucuggaauuaaaaaaauagcaaaucaucucagccuaagggaacaaucagcugaacugccuaguaacucagguuacagaaagaaaacugggguaaucagcacauaauaacaaaaaccuccaccuaccaguucuacacugucuuggguaccugacccaaaccccuucucauucgcugccaauacuauaaaggcuggaaaaccaaauacuugcuuuccuaaacuccuuugcagcuaggguggccaugagacagaguucaagccaaugaggcauagcaaagcucuccuggacaauuucuaagaaagccucuauuuucacucauucagcaccaacaauguggcaggcacuguuccaagaagggggaauaaggcaaugacagaauaaagucccucccugcauggagcuuucaugguagugggagggagacagacaaaccaaaaaugaaaaauggguaaauacauuaaauguugauaaaugcuaagugaaaaaguaggauauggagaugaagaaauccauggggauaguaguugggguggugguguuaucuuaguggucacccgaaagugacauuucaguagaaagcugaagaaagacaguaacuaauagauaugguuaucuggagaagacuggaacaaacgagugcaaaggccccaagauuagaacauauaaauacacacuaggaauacaauucaaggagguacauacagauguagcaugagggggaagagugguaccacacgagagcaaagaaauggauggggaccagauccaguggugugcuaaagccaccuguaccgacucgugccagcucacaggagcgaaacauguccaucucuucccaacucagguuucagugacuucauguugaaacagccaccgugggaguauuuacauaauggaaaucaacaaacauuacaaaucaagguuuuucguuuuccuggagaguuggcuuaccagcacaucgcuggcaauuuucuucauuguuagcacucugguuuuacucugggauagcggggagucauuggaagggucugaguauaagaaugacaucgauugauuuaaaaagaucauccugacucgaaaggcacaguugugacuggaguacccccauucuucauuucuuccugcauuuaacaugaugccaucccacacccugagaaaaugaccuagaaaaucauagaaaugccagcuuucaugauauuuagcugcugaaccaaugccaaagccaccuacuuccauguuucuugguuugugaugaaaacaaacccgguuguuuucaucucugauggucaggucuucuauugcuugcaacuaaagauauuccucacugauauacguggagacuaaaaguagaggugguagggcuuucccuguucugcucuuccacccuucaucuacaguuucccaaccacugauccugauguccacuguaaucacauuucaccuuuacauauaccuauagcacaggcugacagaaaaauggaagaccucagauacccaccucuucccuguuaggcgcaucaggaggcgccguggcugccacugccaacagcuugaugggaguugugguaucgcugaaaacaucugacacuuccugagucauggccuccugcauccgagcuuuuagauccuuaaaaacauuguuuacauaugaaaauguccagauacauccucaaagcauaucuacuaaugcccuuacuucacugacauucauucaucuauucagucuuucauucaauaaauauuuguuaacuguguacaaagcacugagcuagcacagaacagguguaauuuaugaauccugcccuguaagacauuagugguguaguagaaauaagacaugacccacaugucccuagagacuguuccacucaaucaaggaacccuacuuccuuuuuugguggccuccaugaaaugauacugagaaucaugagguugagcccaaagaaggcccagagaugggcuagaguuccacaccauugccagugcuggcggggccugauaacgaucacaguaacuguaaggauuguuugguggauguagugccaaauucuaagcaauuuauugucuuaagaggaaagaaaucaagaaugggaauuuuuuaauccagguucuuucaauuaaguuuucuagaaaaacucaauaacaaauaucuguaucaauuucucaacaugggucuaaauaagaguauucuuagaagccaugaacaagcucuuuuucauagucaucacauuuaauccaauuuaaguuuucuggauauauacaaagaagucuccaucacccucauuguuuugcaaggugggcagcauaaacuagcuggugauaccugagauaauuuuagguguuacaugggcaaauguuuuuauuuuaauaauuauguguuucuuuuaaaggauaauagaaaaaauacaacuagcuuaucaaacccaagauuucaggauuacaaaguuuucuuucauuuauuuauuuauuuauuuauuugaaauggagucucgcucugucacccaggcuggagugcagugacgugaucuucaaccucugccucccagguucaggugauucucccaccucagccucccaaguagcugagauuacaggcauguaccaccaugcccggcccacagaguuuucucuuaaauaaauuuaaguuuuaaaaagaaguccauuuaaaaaaaaaaaaaaaguccauuuuaagaaaaauauuggcuaaauaaaaguacagaugauauguggauagagcaaaaaucacgaaagggcucuugacugaguggaauuuggaaaacacaaauuuaguugcuacuauauaccagcaagcuuuuuccuaauaagcucuagauuuccuuauaucuuuggucacacucuuuucauuuucccuagaccccagaaauuauguauuuuucaaaacucucucuuccuucccucgucuuucaauaauaggaagcauaaaaaguaaaaugauaugugcuccugacuucuaccuuuaaggagucuuggagcugagaugcaagugcucgugccugaggacucuccccuuccccucuggcagccaggucagccagcugggcugucagcugguccacucggucacacuuggcgagaagaucuugccgauaaggccccaucauaacauuagccagacgaugcccuucggccacaagcccccggauggcagccugaccuggaccaagagaaaaacaaugaaacuuacaagacccagaggagacaauugcaaugccauucuguggugcgauguggcgucuugcucuaucacccaagcuggagugcaguggaacaacagcucauugcagccuugaccugccggcucaagcaaucccucccaccacagccucucaaguagcuggaacuacaagugugcaccaccauaccuggcuaauugguuuuuuuuagagagacagggucucacuauguugcccaggcuggucucaaaccccugaguucaggcgauccacccaccucggccucccaaagugcugggauuacagggaugagccaccgcacccagccaguucuuuuuauuuaacacuuuauuuuuauuucacuaucuuuuaaaaucaugaucuaaaaucuauguaauauuuuaucauauuaacaauaauuauuucacaagucaguuauuauuaaacauuuaugcuguaugcauauauuccuguaugcaacuucuuagaaagaucucuaauuauuucuuagggaagaaacccuuaauuuccugagucaauggguaugaacuuuguuuaaagcucuugacaucuaauaccaaauuuagaaaguuuguacuaauuuauuucuccaguaaauuauauaugugcccaauucuccaacuccucacaacacugggcauaacuaacuuagaauuuuguucuuuuuuguuuuguuuuuaaagagacauggucucucucugucacugagguuagaaugcaguggugugaucauagcucacuacagacuggaacuccuggucucaagcgauccucccaccucagccucccaaguagcuggaaaggugugacuacaggugagcaucacuaugcccagccaauucuuuacucuuuuauuuuuguacagagagggucuugcuauguugcuuggcuggucucaaacuccugggcgcaagugauccucccaccuuagccucccaaagcacuuggauuacaaacaugagccaccaugccuggucugcuucuugauuacaucacaggaauuuuacuggcugcauuuggaaauggaaucacaguuacuuaucagcagcuaaagaacccuuaccuaauuacagauguuacaggaccccuaucaacaacuugcuuauuugcacugagaccaauuuaaugagguuauagugcacugcugcccuuaccgacuccacggucauccacugugggauuaucaauccaccgcugugcuugcucaaucuugcccucaagguguacagcugcuuuggccggucugcuguuggccacagcccgguugguuuuggucugcagguucugcagggccguggccaccuguuuggccaaggcucgagccucuggagaaucuccuuucccccuacagagaaaaagacagccauccugucacacauaaacacuauuuacauugagaucacuuagcugcuaaugacaaaugcuaauaggaugacaaauugcuccugauuacuauuaauuugguuugaaaggagugguuuauuuauuuggcccuuacauaagaaauuaauaauuuacauucagauuauuuuguccuaguuaagacauuaaauaugaguuugcaucaguaaagcucagaucaaucauuugguuagcggagcucaaucaaucaucacuagguuagcggcacccucugccugccaccucugaaaacaccaguuuccucuggaacugggugggcccaggcagccauguuuguuguaggagcagcugaaacaguuauagucaaacuaguaguaauacuaucuuuugaguccuaauucugccagguacuguuacaagcaauuuuuuguuguuguuuguuuuuuguuuugagagggguuuugcuccaucacccuggcuggaaugcaguggugagaucauggcucacagcaggcuugaccucccagggcucacugcagcaauccuccugccucagccuuucagguagcugggacuauagguaugcaccaccacaccuggcuaauuaaaaaaaaaaauauuucguggagauaggaaacauucucccgauguuucccaagcugguccuuaacuccuggguuuaagugauccuaccaccugggccucccagaguccugugcugggauuauaggcaugaccuaccacacccagccauaagcaguugccuuauauuauuuaauccuuacaacaacccuaugauguaaauaacaguauuauccucauuauuaaagaaacaaaauggagguaugagguuggauaacuugcccaaugucccauuauuuacuuugauagagucaggauucaaacccagcaccgugacuucagagucgccacacuuuuuuuuguuuguuuuguuuugagauggagucucgcuguguugcccaggcuggagugcaguggcacgaucucggcucacugcaaccucugccucucggguucaagccauucucuugucucagccuccugaguagcuaggauuauagaugcccaccaccacacccagcuaauuucucuauuuuuaguagaaacggguuuucaccauguugaccgggcuggucucgaacuccugaccucgggugaugugcccacgucagccucccaaagugcuaggauuacaggcgugagccaccgugcccagccuucauucauaaacuacuauacauuugguaucacauaauccccaguccuugccauaacugauuaaacugggugguuaucuaccucaaggacaacauacccacagucaggcaaggcacucaauuagauucuggggguucucaaaguccaguguggauaaaagucacuggagaucuuauuuuuaaauacagauuguuaaacccaccaucaaaagcgauuccaauuaaguaugucugcgguggggucaaggggucugcauuuuuaacgaccuucucagaugauucuuaggcagauaauccuggguccauauuucaaaaacacugcauagucaaccagugaugguaucuggagcuggaaagugauuaagccugggccgugguagcucacagccagagacaaaacccccagauaaauaaacuaagucaacacacagggugaaacagacauagaggaucccacacagcgacuaagagguggagggaggggcuuccaguugcccaagaucuggccacauucaagcuauuggguuugaugaggugccucuauuuucaauaauccucuacuuuuuacuugaccagguccuuccaaccaaagaaccucaaccaaguaucaacacagaaauaaaaagacaaccacaauuauaucacaaagaaaaaaacugcccccaacaccuuauuccaaagacuucaaauucuaaccauuauaaaaauacaaagaaucugacucauuuuccaucucagguccucucagccauagaaagguaacuuucaggcuaacuuuaucugucucaucuguaaaaauaaaaauaauaggccaggugugguggcucacaccuguaaucccaggacuugggaggcugagguggguggaucacgaggucaagagaucaagaccauccuggacaacauggugaaaccccaucucuacuaaaaauacaaaaauuuagcugggcgugguggugugcgccuguagucccagcuacucgggaggcugaggcaggagaaucacuugaacuuggcaagcggaggaugcagugagccaagaucacgccacugcacuccagccuggcagcagagcaagacuccgucucaaaaauaaauaaauaaauaaauaaaauacauacauaaauaaaaauaauagcccauccgcgccagaacagcuaauuuagauacucugucucucucuuuuuuuucuuuucuuuucuuuuuuuuuuuuuuuuuuuuuuugcugagacagagucucacucugucacccaggcuggagugcagcggcacaaucucagcucaaugcaaccuccacuuccuggguucaagcuauucucuugccucagccucugaguagcuaggauuacacacccaccaccaggccuggcuaauuuuuguauuuuuuuuaguagagacaggguuucaccauguuggccaggcuggcaggcuggucuugaauuccugaccucaagugauccacacgcccucagccucaccaaguguugggauuacaggccugagcuaccaugcccagcuuagauacucucuuaagaguuccuuuaugauucuaaauuuuuauaacauucuccuuuauaaaggugaacaaagagggucuuuaacaugauucugaucguggcuacuccuggcaagagguuacauagauguauguuuaugugugugcuauaguauuaaguaaugauggcaugaaugaccacacaugaaggucugcuguuagcaccauuaccauucauuaccucuucaucauuaagaaacauuaaagaguaccuaguauguauauggacuuccauuagguccuaagaguauagagagcaacuuuuacauuugacauuaaacccuuccuuaguguuauuuuagcaugugcugcagggguuuuuuucuuaaaagugaaaaauaucuauugaaagaagaaagcaguuaggugcaguggcucaugccuguaaucccaaaacuuuggaaagcugaagugggaggauagcuugagcccuugaguuugagaccagcccugacaacauagcaacaccccgucucuacaaaaaauaaaaaaauuagccaggcaugguggcacgugccuguagucccagcuacuccggaggcugagguggaaggauggcuugagccugggaguucaaagcugcagugaggcauagucaugccgcugcacuccagcgugggugguagagugagacccuaucucaaaaaaauaaaaauaaaaaauaaaaaaaaaaagaggaaauaccccuuuuccauaucaucaaaguaggugccaugagagacuuuaggagaggaggcuguggggaggcuguuguuacaagaaaaaucauccaggaaauguaauuuaaguaucuccuauacuugcuacuuacaaaauaucauugcuggggaaggaggaaaguacauucuuacgcuucuuccccuccauauacacauaggagucuuuucauagcuagccacaaaaauuauuuuccucuuauguaugggaaacagauaggucauaaacaugauguaucaaagaaagcccuagcuuagaaauuuaaaaagcaucucaaaaaaggaguucuuagcauccuaaauuuaucaauuuauaacuaugugaccagcaauaaaucauuaaaccucaguuacaucacugauacagcaaauuaacaucugaccuagaauuaaugagaauauaguggaagagcaucauaagugcauuuaaccuaggggaauugaaauauguauguucuugggggaagaaagaaagaaagggagagggaagggagagagaaagagaagaaaagauaugaaaaggcaauguaaggguuaaauacauacugucuucguagaucugcuaauuuagaagucagagcagauauuuccccaagggaacguagaaugucaucucuuucuuuaggaucaucacauaauucugcuauuuuccgagcuucagccaaagcaccucgaaucugcucuucuccuuccgguccaccauuuggaucugcaagccaguucuacacauagaaacggagaagcagcacgcugugaucuacucacacacuccuuucuacuaaacuuaacaaggccagaagaaggauuucaaaaguaauauaccaguaaucauuuuuauaauucugaucuuuauuauuguauggagguucuuagauaagaaacucaaucucucaucuuuuuaaaaucaauuuuuuuacacccauuagcauaaaauauuuucccaagcuuuaucucaucucugaauuaaccacaccuuauuaguuccucaguuccucaaacauguguguuugugaaaugcuugaaaaucauuuuacaguagagcaguaucggaaaacuuuaaccccuaaacauuacaaugacccaagaguugugaauucugggacaaggaauaguuccaauguacugcaaucuucccuugguacucugagagcuuacuuuuaccuaacugaagugcuguaaauuaagaucuuuauuucaaaauauagauaaacauuugucuaaaccuguggugguaaaggagguguuaacauugguaagugcuggaagucacucaucacuuagaaaccauuauccaaccacaguaaaugauaagagacagagaagaaagauaggauauuuaugacuuaggauauuuaugaaauauuucccaccccuccugaaaaucacugugacuaccugagcagcaucgaucuucuuugcaaugcucugcuuugaguuggucauggcuuccagcuugcgagcugcauuuuccacuuuugcugugagcacauccagacccugagauaccugcugagcuuucugcauggccaccggugaggauccuuguccucugcucaaaacagacacaugcugucauuguacacccucaaauacuuaaugacaaaauauucccaauagcacaguacaugugguuuucaugaacaugcuuggcuuuuuccuuuuucccaguaaaucugggacagcacaagaaaacagacauaaacaaagcaagacgcccaaaucaaguacuuuuucuuuuaaaaaugcacauuagcuucacggaacugcauaaccacuuugaagaccaggccagcaaauuuugauaauuauucuccucuugguagugauuacauaauccaaucuaaacuucagugggaaaaugugcuggugaucuuauugcuagggagggcuuuguuaccauaguaaugugugcuucugaaauaaauaguccauuaaauugucuucuuaugggcaaguauacauugaaaauguuucaggaggaagcacgcauaguguuaaugaaaguguaccagacugggaacaagcagaucuguguucaaaucuugacucuugguaccuguggaaccuuguuuaugauguuuaaccucccuggguuuccauuuucuaacuuauauagugaagguaacauauaaugaagguagguaauacauuuuccccacuuaucuuauggaguggcuucaagcaucaaaauaauauacuugaaaacacuggcaauaaaaaucuaucauuauuacugaauuaucaucauuuuuauaaugaaccuaaugauaaucuuaaaugccuaccuuccuccuaggcaaccuauaaauauauaaauaaucgaaacuagcuaauacugagcacauggugauaggaaaccacuguuucccaucaaguuccuaaagaacugauuucacuauuuuccucucucagaaaugauaugcuauuacuacuaaaaaugauaugaguucauggaaacuuguuucucuauuuacuuucccuauuuacuuguuuuccuuauuuacuuuccaagucacaaaguaugauuugcccucauuuuacaauccagauuguuuuaauccaagcaggcugguaaacucaaugauaggggcaguaacuuuaccauuugguagaauggcauggcugauuauccuaaucagaacuucuauuuuuaggauaaacuccaaaacaccuuugcuucccuucauaauaguauugaucugucauucaucuaucuagccucuguggguuuuuuuauuuuuuuugagacggagucucacuguuuuccaggcuggaaugaaguggcgcgaucuugggaggcagugguugcaaugagccaaaauucuccuaccucagccucucaaguaguucaagcaauucuccugccucggccucccgaguagcugagauuacaggcaugugccaccaugccuggcuaauuuuuguauuuuuaguagagacgggguuucacacuguuggccaggcuggucuugaacuuccgaccucaagagauccaccagccucagccucccaaagugcugggauuacaggugugagccaccacacccagccuaucuagccucuuuuuaaaauucuucugguuuucggccaggcgcgguggcucacgccuguaaucccagcacuuugggaggccaaggugggcggaucacgaggucacgagaucgagaccauccuggcuaacacgcugaaaccccgucucuacuaaaaauccaaaaaaaaaaaaaaaaaaaauuagccaggcgugguggcaggcgccuaguagucccagcuacucgguaggcugaggcaggagaauggugugaacccgggaggcagagcuugcagugagccgagaucacgccacugcacuccagccugggcgacagagcgagacuccgucucaaaaaaagaaaaaaaaaaaaaaaagaaaaaccuaaaaaaaaaaauaaauaaauaaauaaauaaaauuauucuguuuuucaucuauaccaaaacuugagguaaugaaucauucauuuauugccggguauauaaaagguauauauacacuuuuuccuugaaguugaggccuuccuuuuauguggcagaagaggggaagacuuuuaggaaacauagucuuuaggauuuaaugugcuuuuuuucuucaaaucuacuacuucaugaugagagaucuuuuuguuaaaagaguccaacuguauauuacaaaauaauaacuucucugaggcuggaaauuuagaaauuuuuuuuuuaaaaaagaguccaacugugaaaaaguaaaacuauuuaugggcuacacaguuuuuucauucaaaacagaaagauuuuauugagucucauggggguaaaaauauauacuagcaaccuagaaacccugugugacugaacagaauaucaagaagaaauuguuaccgcauuucagccacuaaaauauuaaacagcuggguacacuuaagaaaggacuacagggagauaacuuucuaaucuuucaucaggaaaggauauugcaggcuccacugugaagcaggaccauaguuacccuucacuguucuagccuuuucucuuuacagauuaaugguggaaccccuacaauaacuaccucauucucuugcucauacucaucuuucucuaaacacauacaacuguguauuugagaauuccaagugaaaacuggcuaccacacugggaaaagguugcagacaaaagacacaaaagugagaaaucagaagagccaagaauccuaucaaacugcacuggcauuucuccgaaugagaacaaaacuucuuuuuguccuuuuugcaaaguucuuaccaugcucaugacagaggagacugcuucucagcaggagaaaagauucacugaacucaaugggaucacauuuauuuaagcuguuucuuuccccuucaacauagagacgcaaccugaaaguccuggagcuuccagggcugcagggaauccaggaaccucuagaaauuauacauaauauuguaugggcauguuuauaugcaucuuuuuagguaaggaugaauguuuucaucagaugauagaagugaucuugguccacaaaagguuaagaaccacgccuuuaagauccgcauucuuggccaggcacaguggcucacacccguaaucccagcacuuugggaggccgcagcaggcggaucaccugaggucaggaguucaagaccagccugaucaacauggugaaaccccgucucuauuaaaauacaaaaauuagccaggcaugguggcgcaugccuguaaucccagguacucaagaggcugaggcaggagaaugccuugaacccaggaggcggaaguuacagugagccaagaucaugcuauugcacuccagccugggcaauaagagcaaaacucuugucucaaaaaaauaaaauaaaauaaaauaaaaauaaauaaauaagaucugcauucuuaugucuauugcacuaauauuggagaccagguauaauggugcacugcauguagaggaguguuucugagcccuguuuguauguagacccuguguauccuaauuaucucaugauguuucaugagugucucauccuauuccaaguuuucguaauguccauaccauaaaauucuauaaaaaucuuuuagaacuucauuaucacuauggaugaguucaucuguaugaauuccaaacaaauuuauauuauauugaguuuucucaauagcaaacuauguuuauuuaguuuauggggagaaaagcucuaaaggccaaggcuuuaggaggguaaaaggaagguaaauaauuaugaauccgaauaaauaaucaugaaaaggaaacucaaaaaagcccagaaauuaccaacuuagaggauaaccuaguuaaaugauuuuuuuaugaggugaaauaauuccaauguuuucacgcuauguuucuuucuccccauccuccguaaaauguauuuacccaugccagacuucaccacugccccuuuauuuuucauaagccuauggcuaguaaauuagaaacuagauuuguguuucaguuucaauuacggaacaaguuucaacuuuacuauuaggcauuuguguauuuuaaaaguucaagccaggagugguggcucacgccuuuaaucucaacacuuuugagaggaucacuugaggccaggaguuugagaccacaaaacauagcaagaccuuaucucuacaaaauauugaaaaacuagccaagcauaguggcacaugccuauaguucuaucuacucaggaggcugaagaaggaacauugcuugagcccaggaguucaaaguuacagugaacuaugaucauaccacugcacuugagccugggugacagagcaaggccaugucauuaaaaauaaaaaauuuggccgggcaugguggcucacaccuauaaucccagcacuuugggaggccaaggcagguggaucaccugaggccggaaguuugagaccagccugaccaacauggagaaaccccgucucuacuaaaaauacaaacuuagccgggcaugguggcgcauuccuguaauccuagcuacucaggaggcugaggcaggagaaucacuugaacccaggaggcgaagguugcagugagccgagaucgcgccauugcacuccagccugggcaacaagagcgaaucucccaucucaaaaaaauaaaaaagaaaaagaaaaagaaaaagaaaaaauuuggcaggucaugguggcucacgccuguaaucccagcacuuuuggaagccaaggcagguggaucaccugagaguuugagaccagccuggccaacaagguaaaacccugucucuacuaaaauuauaaaaaauuagccagguguggcagcccaugccuguaaucccagcuacuugggagguuaaggcaggagaauugcuugagccugggaggcagggguugcagugagccgagauugcaccacugcaugccagcccgggugacagagcgagacuccgucucuaaauaaauaaauaaauaaauaaauaaaaacauguuuuaaauaaagucaggccaggcaugguggcucacaccuguaaucccagcccaaccuggccaaccuggcaaaaccccaucucuacuaaaaauacaaaaauuagccagguguggccgggcacaguggcucacuccuguaaucccagcacuuugggaggccaaggaggguggaucacgaggucaggaguucaagaccagccuggccaagauggugaaaccccgucuguacuaaaaauacaaaaauuagcuggucgugguggcgggcgccuauaaucccagcuacucgggagguugaggcagagaacugcuugaaccacggagcuggagguugcagugacccaagaucgcgccacugcacuccagccuggcaacagaguaagacuccaucucaaacaaacaaacaaacaaacaaacaaaauuagccaggugugauggcgggcgccuauaaucccagcuacccgggaggcugaggcaggagaaucucuugaaccugggagguggagguugcagugagccaagaucgcaccaccgcacuccagucuggguaacagagugagacucugucucaaaaaauaauaaauaaauaaauaaagucagcaaagggaaaguucaccuccaucucaaaagaauuuaauagacuauaauaucucuguuaucuacuagccaaagagauaacucaaaacuggcagaggcuuguuuucugaaucacccuguuaggagugaguuacccacuacugcucuguaaggacagaggaacuuuuaccuggcacggaggucagccacuugaucagucaucugcccuagcauuuugcaaguucccagaaucucccugcguucuuugccugcacagaguucaccaacuuuuccagcuucaucuaagaucugucugauggccugcucaccagcauccccuaaaauaaagagauauucaauaacuacauuguugacacauucauuauuuagagaggauacuuuacaagucauuucauucaccaaggaauggaugauuuuaaacaagacgagugaauagaaggcaacauaucugauagcuaacagccaagcagugcccuuaaaccauagggugagguuucaacaacagacacgcaaaaaaagauacuuggaacuguaucuauuuggagauacuaaguagcuugugguaagaauauggaugaugaaaacagacucuaacaauuuaauaguauuuagcaccuccaaccuacuuuagguuuuucacauucauucaaauauuaaucuaaaacagaauaaauauuagauuagaaaaucaauaaagccuaguucaauaaccuauuugggucuuaucuuuauacagucaacuuuccaauucucauuggcaucaugauuuaaucugcuuaauuaagaacucuguugacauaaauggaagucugcucaaugggaacuggaagagaagaacuuucauucaaaauaauuaccuuuuggauucagggaaggggagaaccaaaaauuuugcaaagaaugcccagcucaguaugacuuacuccuccgugauuagaggugaucgaaucuauucccuucauccuuguaaggccuacuacuugcuucaguuacucagaacuaucagauaaugggguaugccccauaauguuacaguaguucucucagaugaugagauuaugggaaaauuucuuucuuucauuugcuugguuuuuagcuucucguuguauugaucagaaaagcagaacuagaggguuaccuggggaggcacuagggucacggagccaaccuuuggccugguucaguuuggagucuauggaggccaaugcucucuucauggcuucaguguccuuuugggaagaaaucccaccauuauuuucuuugcaaaaguugagauaccaugauagaacguaagacagagaagaaguuacagcauuaacauacauagcuaagguagucaguccuacgaaggccuuaaaaauauugucaccacaccacaauucucauuucugucaaaaugcagcaucuugcaugcaaauauucaguuaauucuacucuguugcuaaacagaguggaauuggguucccuauugcuaaaacugugaaaacugguaaaauugcucaagccagaauauguuuaaugucuucagcaggaaaaagcccuguugucacaugccucauugucagccuuuccacuagucaacauucaucuacugcagccuugccaaagcccuucccaccucagggaagccucguuaguauguggugccacaaaucacaguucuuuuacaucuuguuuugaaaugcacacacuggaugauauuucacuauauucaauuaaccugaaaaacuuggaauuacugguuggaagaaacaauugaaaauguuaaucuagcaguuuaauuuuaauucuacaaauaaaccccucaaaguaauauaauuuagaaguguuuucugaccuucccugcuauuccuccuucuuaguucccuuacuaucccucaccuggaagaagaugcaggauagaauaaaugggucucagcuuauuuuuuacaaccaggauucacgaggacuaucaggaaacuagcauaaaaucucccaggauacaccaggagaagcugaaacaacagacuaaucacuuuaaauguauuuaaguauuuccguaaauuuuuuuaaacacauaaaaacacagagaacaauauaacaccagccaucucuuaagucucuauuuagcaucuucaaagaccaucuauccuccuuuuugcuguaggaaacugacucuuacagaguuaagccaucaaagcacaaaguuaaccucuaaaauucuaggcaauguccuagcuuccuucaguuuccaauccugcacaacugggguucuuaaagguguugcaccacuaguuuuccacacgggggcaccaggagcauccccacuuccaauucaaaaaaagauacagcacuaucacaaauaagcauuggcagcacccauaguuaggcucaagguccacaacuguuccaaagcccccuauucaaaagacagaucucucaacugucggaaucccuccuuccccuucuaaacagacacagaugauucuccuguugaauccuuggcuaucuaaggcucuaaauagcaaauucucagcuauagcaaugaaaaagaagugaacuaaauuaccaaaaaaauugaaaacaaaauauuuuuauuaucaaguuauauguaaccaugguagcugucaauaaaaggcagaaucauaagaggaucuauuucaaaauccacuuguaauuagaagaagauaugugguauuuuuaagugcuuugauucucaaaugguuugaauaucagcaaaucucuccuaucaugucuuaaauuaauuugugcagaaaacguugccuucaaaauuaaugcaaaggucaacuuuagcuuaauuccaaauuagcaaggccugaaucaauaacuuuuuaaaagacuugaggccaggcaacuccuaaccucagagaacuggguagccuucaggaucuaacacaaguuaucuaggcauagguuuucuuuuaaucacaaacucuuacuuaggaaguguguggacauccuggagaauaauuaugucaauguaaaaauauuucacuuaaaaccuguuaaaccauuuuccuaacacacuuuuauuuucagugagaaaagcaauagguauuuauuacauuucaaaaaucuaaauucaaagggaaacgaaggucagaaauuuuuaugucuacucuaacauuaaaggcuacuaguuaggaaacuaaauucaacugacaugcauugaauuuaauaugcauucccugcauguuagguucuguuuuagcuacuuucccccuccuuaccucauugaaucucaaauuuaaaugucauuuaaauaauacuacaaauuaagaaacaggaacugacuccuacaaaccuaauuugaucucagguuuguugacuccaaaccucauugcuuaucaaaugaaacaagauuuuuuuuucuuuuaccaaggagaguugcuaaagauucuacuaaucuccaacaauagucagcaaaucucugccuugucaguuuugacuuugguuaauacugcagagaaaauaagcuccagaaaucaaauucauaaucuacacuaacaaaaaugacugcuuuuauucuccaaugcccaaaaaugauuugaaacacaauggaaaaaauaguuuuugucuauucagcauccucaaaaaucauuucuuuuuuucuccuuaauaaagcucuaauggccaguacugcaaggaaagaauguaauucucaggaagugaguaauuuacugcucagugggaggugugacaccgucaagaaguuaaaauuaagagauguucauuuuccccuaaaaggaaccaauagccaauuuugaaugaagcugcauuuaauaacugcgacuuucaauaaguuaccaaaauuuuuaacagcauuaauuuuagacaauuucagagauuuaaaacaauaacugaaagagccaucuuaaauucuuucuggaaaacaguagguuauaaguaaccauuuuauguuagucauaucuaguaaaaacaaacaugucuaagggaauuuuuuucuccuaagacuuucauauauauuucuuuugaaaggcaauauuuauuauagaauugacagaauucugucauaagcauguaaguauacaaacaaugaauaugacauaaacaaauucacuggacaacuaggacagaagucaauuuggggauauauuuauaaagggugaaaauaaucguaacccuuguggucagccaugcuuuguaccacaaaccauuuugcuaaaccuugucauguaggucuguauauuucaggucaguauaauucagauaugaaauagaagagagaaaaacugcaccuucauuugaguauucuucucuguaaaagcucaacuuugggaaaaagaaaagucucuaccaauuucuuaucuguuuuugguuuguuuuucaggggguuuguggguguugaaagagugaaguauaaaaagaccaggucuagucauguggcuuuggggacagcuggccugaaucuaucuggguccucccccaccauguuaugcuccuucuuaacauaaaauucuuaugaauucauguuuuaaaugaaaaaaauacagugccuuggcacucuucccugcauaccaaaagauggaacgacaagcuaaaccauuuguacgugcuuuccuaggaacugaaacacuccuuaaauuaaacauagauuuaggccucagaacaccugugaauaauaaugaccuccuucuauggacaaucaagaggaacuucgguuaaaaaaguaaaguccugcaauccuaggcucuugaaaauuuuaaauauggggaauaagaaccucucuccaugacugcccaccauacucucccuucucccuccaccaacaccugucuucccacuccauccccuuucuaaccucauuuccaccugcaagucaauguuuuaaaccagauguuucugguuuaagauguuucuggaaaguauagauugggcaguagaacaaaaucuuacaaacuacauuuaaacaagagaaaguugucuaguccugagacuucaugcaaguuaccuucucugggucucaauuccucaucucuaagaauaccuuccuggcucuaaaaaucuaugcuaccuaugagugcaugaucagauguacuagccaaagauaacuuagaucagaagggaaacaucaauuuauuuugggauuuucuccucauggggagcagggagauaaaauaucauaaaugccugaauuaacuauuucucucaagcucuuagagaucuuucauucuauuagcugcuaaaaacaaaacacuagaacacuugcucauagaaagcccacaaaugaccuuuuuuuaauuuaacaaaucaacucuuaaaucccaguggucugcaaguaaggggguaguauuacacacucacaaguucuaaccaacauuuccugccuuaguuaaguuugcuaaucuucuguauaaggcaucugagucacuuacuacuuuuacccaccaccagcccaggaccacaguggggagagacccaccacaggaacuaauucugaauaauagaauuuaaugauucacggugcaaagcugcaggagugccuauguaggguucaaagucuuagcagugaaauuuuuuuuuaauuuuuuaucucacuuccucuuaauucucagcaugcaucaagauacaaguaauauaaauaccaaaaaaauuaaauguagagcacuaaauuuacaaaggguagaauuagaauuguguuuaacucaaauucuuuuaauaaauaauguauuuucagaaaaaaaugcuaaccuaauuuuuaaugaucacuauaaaaugauuguugauuuaagaaaaggaaacuuuuuacuuuuaaaauaagugaaguguuuaaagucaaaguuacuuuuaaauuuguaaaugugcaauuugaauauagguauaaaagguaaaauaaucaguuauugcauugccucuuuaaaaucuuaacuuauucggcaagacgcacuuuuaccaagaauuuuuuccacuuacuuucuucccccacuuuucuagaggaaucaucacuuuccagaagaauacugcaccaauggggaggcaugaaacaaguaugguaagacaaaguuaauuauuuauugguaggggcgagaagaggugaaagacacuguaugcauuaaacagaaugggaacccagcagucacagucagacaaaaggucugauuaauucacugcuuacaguggagcaaugaaagaugcguaaugcuacaaaacugaaaaagagccaaaauccuagcuaccaauuucuauuuucaggguaaaauuuuuuucuauuuugauaaccaauagaaaugauuacucuuagagggugaggagcgguagaguggaugggaaccagguuaggaggaagacuuaucagguauaucuuuuugcagcacuuugauauuugaaccacauaaauguaaaacaaaagcaaaauuagguuaaaaauaaaccucuuuuuuuauucugaugucauuagguuaaaaaauaagcaucucuuuuucauucuuauggucaguagauuaaaacauaaacaucucuuguucauucugaugucaucguguacuugaguugagcuaauuuaauuuaccuucuuucauuucagaugaaguuaguuuuguagcauccuaacaaauugguuuuccucagcauaaaacugggagcagcuacaagacuguacacggugaguaccaggucuauuucacuuguauccccaagugccuaauccuagcccugaaaacucaacugacuacauuuuuuuaaugagagaagcagcucuugauggcacuugcacaaaauaaaguucaauaacauuuauucacuaaaugauggauagcuuuucccuucugaaaauagagaaacauuaagguuaaaaugccuguuccuccuuauuacuuuuugucaucugcuagaagcaaaagaaagagaauaagcgaagagcuuggguuaggggaacaugaggucauggagaacuacagcuaauucaguuuggacagcaaaacaugcagugagccacagaaugaaguuaggaagaccuuuagacacacuucacuucuguuuuccuuuggauuuugaaggcuaggauuauuaugaaggacaggugccucaucuaagcucucuagccuacccucuuucauuauggcuuaaaaccucaaugaugcaucuccaaaagcaaaauuucagagcccgcaaagaagacuggugggagaggcagguacagagauagcaucagcuggaagucuccuuucccaacagcaggguccacagguaacucaggggucucccagcuaccuggggaauccugcuccucaaaugaagucaaugggaaagaccaggccaaaaaagaucccaggagccuacccaaagaacugaaggcacccaccaaauauaggcagccugauagcccacaguaaugucuuuccuuuagcuuuucccaaagaaaucacucaauaugagccacagucagucuccccagcacugccuagagucccguauuaaaucacauucugacgcacauucaagcacaguguuauacacagaauaaggcacggcacacagcacaaaaaaaccucacagacaugcuuuucucuuuuuaagcgaaaaagaaacuagagggcaagagaaagcuuaccuucuaaacgugagaaaaagaauaaaacaaaagaacaaaaaaagaugcauaaagaagucauaacagggaagugaaaguugucaacuaugcaaaagcaaaauuaaauaaaauaucagaguuaaaaagauuuuaccauauagauuuaaaauacagucuuagaaucuauucaagaacuucacaucaaugagaaaaugucucuguaaauaaauccauaguuaaaauaagcuaacuuacucuauauaauuaaauuagcuuucagggcaacaagagagagggcuggugauuucaggccccagcuuuuacauuaccuuacagaucccggagaacauaccguucuacugagcacccaauggaagucauacaacaaaaucccuucuuuaguugacuaccagccuucuggcuggcccuggagacauuggggucacacaugggaaagcuagaucuuggggacaguguguuccccccacugccuacaucuugggcuccuacaaggaaaguaugaacccaaguaucucuguucccccagaccugaaagcuugguucacagucauuaaacagggagcagcagaccagagcagcagcaacacaaaaccacugcuaacaggcucuagaaggaaucugccagccccucugggguccuaaaagagauuccagaaaaagggugaagggaucccucaaacuaacugaccaaugugaagacuaauauuuuaauuaaaccuuccuuggggaaaauggaaugaucaagggacacaucuagaaaugccaagaguuuccucuguagauuucucuggaucaaagauugguuaaagaaaaguuuuccauaaaguucagaauuacaggcauaucuguaucuuacuuagucagcugggaagaaccacccauauacaaggcagagcucccauccacgggaauauacucuuccaccaguccaaccaauaagacuccagccugauggaaaagcuauaaaucucagccuuaaaccaguaucuaccccacaugccuauuuacuuguucuaccuuagaacaaaggaaauuagcaaagauagcaaguaaccuaugaaacagaaaugaagaagaaauuacuuucacaauaucugaguacucuuaugcuacaaaaauuacaagauaaaguaugagacaggugccaaucaaaacccccagccagggagaguuggggauuuugcuuauuucuccacuaagaacacguaccuugcuggcccaggcaucuucaucccaagaggugaguuguaacacacgaauuaucucauuaauuucagcacucauuuuuucuacaguaaaauugcgauuuuuuaaagcuuccucuaugccuugguuuuuugaguuuuuaguuguuacaaaaaucuucauagcuguaaaaauaaaagaucagaaaguaagcuuggaauuuaaucuuguuguauaacaauauucacaaaagauguucuacacuuuagauguuuugggcuuuuaagauccuaaaaugaguauacaaaacaaacacuacaaguuugacaauaaaguuccaacauuaacaaccuuuauuguaaaaauaaaaaaagaaaaagaaaacucaagguacaaagacaccaucacaacaugauuaaguaacuaauuuaaccugcauaugcugaugaccugcaaucacaaaauaucuaauauccuucuaaaucaguuaucauccuggcccucacccuggcuccaucuacuacaaaccuaaugggacaauaugaaaacugucaguaauacucugaauggcguauccugcugccccugaucccagcagaagaucccaagaugucaaguuuaucauccgagauuucucucaacauguagcuuggauuugccaacccccaaacauaaagaagaaaaaaauaaugucugggcaugguggcucacgccuguaaucccaacacuuucggcgugaucucggcucacugcaaccuccgccuccuggguuugagcaauucuccugccucaaccuccugaguagcugggauuauagccgucugccaccaauccuggcuaauuuuuguuuuguuuuguuuuuaguagagacgggguuuugccauguuggccaggcuggucucgaacuccugaccucaggugauccacccaccucggccucccaaagugcugggauuacaggagugagccacugugcccagccuccugaacucuuauacucauauguccuuuuuuagcuacuacuugaaacaccaaagcagguagcuggaagucacaaugacaugagucaccagauuuuuauaauaaaguugccuucugagaaauaacuaauuaacccacaacuugacuaagauaauucauauaaaccaugagcugucuggcauauacuagacacucaauaagugcuacucccuuuugcuagucgagagagcagcuaccauguuugcauuucagagcacuacucaaugggaagguagucccagcuggugacuaaagaacugaucuacucaugauguaaacaacaguuaaauaucuuuuaggaaaaauuggauuaauacacacuaaaaagggcucugaguucaugucuuuaucauaugaugcucuauaauauccauuccagcuccuaauuauuuuucuauaacacaaaggugugaaaauuuaauauccuaggcuagaguuuauagaggagaguccaccucccagcaaaggggcuuguuagagcuuuaggagaacagaauuaggccacagaaaggcaauuucaaacaaagaacaggagaaggacagcauuagagaagaagacugguucucagccaaucagcuacagccaucaugugauaaccaaucaaucgggucucauuuuuaccuaggcugaaggacaugcagugaagccacaaaagaaaaugaaccucaggccaggagccauggcucacgcauguaaucccagcacucugggaggcugaggcaggcagaucacgaggucaagagaucaagaccauccuggcccacauggugaaaccccgucucuacugaaaauacaaaaauuagcugggcauggcagugcgcaccuguagugccugcuacucagaaggcugaggcaggagaaucgcuugaacccaggaggcagagguugcagugagccgagaucgcaccacugcacuccagccuggcaacagagugagacuucaucucaaaaaaaaaaaaaagaaaagaaaacaaaagaaaacaaaaugaaccucagaguuuagaacaugcuaacauuuuuccccccuauaaaauaaaguacaggcaggaaguaccugaaaugagaacuggcagcaacucuuucacgguguucaucgaguucaccaacaucacucggugcuccuggugagugagcuccugcugucucucgucaaucaucuuggccaucuuagucauuccuggggcacaaagaagaaauugugcagggugaguagugaaacaaucccgggucuggcuuucucagucuaaauccauuaugaaauacuaugaaaguucaaaccgauugcucacuuauuuaaacaacagacaccaucacugaacucuaauuuaugcaacauuacucuuuucaaugaaaguaauguauuaaauguaaacacuaaaugugauaaacauuuucauauuuugauauaaauauauucacaaauauuaaacaucuaaaugaauaaauauauauuuauuaaaaagaaauucacagguaagggaaaaacauuuugccaggcuucuaugcauacagguuucaugccaugucucugaacucugugcuaaaaaucucacaugagccuaguacugaaucuaguggcugaaaaaaguucuaagaauaacaaugauauguuuuguuuucauauuucuauuugucuguacuuuccaauuuguccaaaauaagcauguacuaguuuuauaauuagaaacaaauagaaauauuauaaaaauaauuauagggaugacaguguuugaaagcaucugguguuuuggaaucacucugcuagcacuuuuuguuuauguugguuguuauucaaaggcgcuaugugauucucuaaagcuuugauuuucaaauuacuccuaggauuucucaaguugucucacagaccaucaagaccaaagagaagcagagguggggcugcuccugcuucaccuaaaguagcuccauuuugucuuuuuuuguuuggggauucugcauaagauuccauuuggggaaauauaauuuucgccaguauuaugagaaauuuuaagaggacuacucuaaagccaccagagaaaccuauuuccaggugaucuucagugauggcucaaauucuuaacugccauuaaguuuuacagaacaccuacacuggaaccucauaaaaaugcuguuaauuaaaaaucaacauuucacauaaaacaaaugaauuuuauaaagugauaacaaucaaguuaagcagguuaaacaucuaacauaucuugucauuggucucauucauacuuuaaagacccucaaguucauguuauaugucuguaacaucaaaagcugguauccguuuauauauuuugaauauuuaaugcucagaugccugaauaaucauuucaaaauaagauuuaaccacaauagcucuucucuccuaggucugauuauauuaugcagccuugggugagggcaugaauccauaauaguaggcaggcuaauuagcaagcuaagaggucauaaagaacuacaggccagcuggcagacagugaaggaaugcuguguaauguggaauggagaggucaggaugcaggauggccuucagcauuacaguaacagaaaaguauuuccuacauucuccaauagcaguauuugcaauguuugguuuaauucauuugacaaggcaauauauagaaagcagauucagauaccagagauaaugacaucaccucaaagcacagcaucaucuccaucaacagagcagacaccugaaagcccaaugcaucuucaccuaucuucugcaaaaaguaggaagaggguacccuuuccuuuggcuccaacauggacaauccuuaaaaaauguuauagaaauuggauaaaacuaaccuggcccaagauucuuuguguaagugaccaaaucuuccauagucuccaccaccucugccacuguaagauauuccaaaauuccuuugcaaacucuaauaauuuuacggaccugaaaaaauauuucagaguauucaaucacauggguggacaacuagcaaacacgguaacacagaugugcagcauucaacauauuuucauucuaaacaaucaucaaucuuccauuauuaucuucaagaguaggcuuuuugucucagauugccuaccucagccucaucgaagguaaggagcaggucugauguuccagagaggaugccccuugacccaucaauuagauaaucucgagcaggcacugaguaagggucugacugaagcaucugagcugccuggacaagcuuggugcaagcauucucaacccuauagggaagaacacagguuaacacaccggcagaaccacacagaagaauaccauaugcaaauacaaagagagaauaugcauguaaauucacaguuuuuuucccuacaugaaaaauagccaagaccaauugauaauagaaccuacguuuuuagauuuuacaauuuaggcaggacacaguggcucaugccuguaaucccagcauuuugagagacccuguuucaaaaagaaaauuacaaaauuacagguaaaagcagcacauucauucagugcacugcccuuauucuuuauuuccugacaacaaaaaaugacgagaaaacaucugggcucuuugacuucagguugcucuaucucugcaaugccuuuguuuccuuauuccuccccacccuauacacacugcuauuaaaagacacugcacaaagaacugaaauccuucaguucuuugcugaaauguuagaucauuuucagaucuaacaucuggaaauaaaaugccaaagcaugguguuaagugaaauuuaauaacuaaacaaagcaaaggaauaggaagaaacacaaagaaaaaguaugaggcaaugcauaaauuucucacucauucaucuagcuaaauaaauuuguuugauaaauccauuggaccauuugaaaauauauuguuaaaagaaaauaaaaacaaaaauuuaaaaauuaaaaugaaaauauauuguuaauuaaaggucacuauuauuaguaacuaagccaguuauuaauaguuuaauauuaauauaaguaaccagaucagccaaagguugagugguggaaggggagcugggcgggggauucauuuaaaagaggaacccaaaaugcauacaccaaguauucaguuugccuuccuuguacuaauaaaauguauucauucauucauucaauuacucauccccacagaguugaaaauaaccuaauagaucaucuccucuagucucauauucaauauagccauuauguugugacugacuaacuuacaaagauaaggaacaaacugcuuaaaguuaaaaugcuuagccagaauuauacagucucauuugaaaacauagaaaaugucaccugcaaauaaaagccuaucucaccagguucuuuugaggauaaaugaaguaauacagaaacuccacaaguuuaaagcaguauuacauuguuaacaaguagaauuaaaccaacuuaugaauuucaacuacauaaaaagcacugggcuguggacacuguagguauguauauaaagauguaaaaagcacuauucuaacucucgaggagcauacuuuacuaaggcaagacacaaacauuggcagaauaagccaauacauggccgggcgcaguuggcucaugccuguaaucccagcacuuugagaggccaaggugggcagaucacuugagguugggaguucgagaccagccuggccaacauagugaaagcccgucucuacuaaaaauacaaaaauuagccaggcauagugguggacaucuguaaucccagcuacucagaggcaggagaaucagagguggagguugcagugagccgagaucaugccacugcacuccagccugggugacagaguuagacucugucuccaaaacaaacgaacaaacaaacaaaaaaaaaaacauaaggcaguauauaauaaauaucagugaagggcaagaccuguuugauguggcuuuugaucaggcuuaaaggacuggauauuuuguucuuuuuaauuuuauuuuaaauauauaauauauauucauacauauuacacaagcauauacacauauuuaaaaccaaaagggcauacaaugagaaaucucuuucccuucacuaucuuccaugcacucauuccaucccacuugcaaccaauacugaguuuccuccaauguuguauuuccucuguauguaaaugucuucauaaaacauuucaggccucaaagaagcaaaaauguacauuuccccacuuuuuuacacaaauaggaucauauauggucacucgcugcauucugcuuuuuacauuuauguguuguucuauuaaaaguacauaaagagggccgcgcaugguggcucacacguguaaucccagcacuuugggaggccaaggcagguggauuacuuuaggucaggauuucgagaucagccuggccaacauggugaaacucuaucucuaccaaaaguacaaaaauuagccaggcaugguggcaggggccuguaaucccagcuacuggggaggcugaggcaggagaaucacuugaacccaggaagcggagguugcagugagccgagaucaugccacugcacuccagccugggcaacagagcaagacuccaaaaaaagaaaaaagaaaagaagaagaagaaaaaaagaaagaaaaguacauaaagagccuccuccuacuuuuauaaagcuacauaauagcccaggcuaauaguuauuagccugcugugaugaaucaccuugaauacauguaauuuuacccuguaugucuguaggauacauucuagauauaaaauugcugagucaaagguaugcauauguauaauuuuuaacaaauguugccauauugcaaucugcagaaguuauacuaaacaguucuuaccuucucaccaauucaaauuuuggaucuucaccaauaauaaaccaaaauuggauccaaacauaguuucuuuucaauugaggugaaauucauguaacauacaaauaaccauuucaaaguguacaauucaguagcauuuaguguauucacaguguugugcaaccacugccucucucuagugccaaaacucuucauuaucucaguaaaacacgcaauacucauuaaguaauaacucccuauuuucuccuucccccguccccugauaaccgcuaaucugcuuucugucucacuggauuugccuauuguggaaacaucauacaaaagaauucauacacuacgucuggcuccuuucauuuagcauguuuuugagguucauccaaguuguagccuguaucaauacuucauucuuuuuuuauggcugaauaauaauauuccauuguauggauaugccacaguuuguuuacccauuaaucuacuuaugaacauuugagcugucuacaccuuuuagcaauuaugaauaaugcugcuauaauguucucauuucucuuaguuauauaccuaggggaggaauugcuaguuuauauaguaauuccauguuugauuuuuugagaaaccacaaaacuauuuuccagcacugugccauuucacauaagggcuccuaauucuccauauccucaccaaugcuuaucuuuuuuuuuuuuuaaauaaaagccacccuagcaggugugaagugguaucucauuauggcuuugauuugcaauuccuuaaugaucaaugauggugaacaucuuuucaugugcuuguuguccauuucuacaucuuuuauggagaaaugucuauucaauuaggcccauuuuucaauuagguugucuuuuggggcugaguuguaagaguuucuuagauaagcuaguuauuaaacucucaucagaaauacaauuugcaaauguuuuuuucccagucuguagguuaucuuuauucaauauaguguuaauuuccauugagguugaggauuuucauaguuuuuaaguuacaaaauaaaauaacacauguaaaagauuguauaaauuuuaauucaaacaaacaccaucuaccuaaaagucaauaaucauuuuaugccaggugcaguggcucaugccuguaaucccagcacuuugggaggccaaggugggcggacugaggucaggaguucgaaaccagccuggccaacauggugaaaccccgucucuacuaaaaauacaaaaauuagcugggcaugguggcgggcaccuguaaucccagcuacacaggaggcugagggaggagaaucaguagaacccaggaggcagagguuacagugagccaagaucaugccacugcacuccagccuaggcaauagagugagauuuagucucaaaaaaaaaaaaaaaaucauuuuauaaaauaguaccagguacuuuagaaccccaccuuaaccaaauccuccuuccuauucuccagagauaauuauuacucugaauguuguuaauuauuuucuugauuuucuuuauacuuuuaccaccuauauauguauacauaccuaagcaauuuuuuguugaguucugccuauauuggaacuuaagcggaaucauaccguuaugcaugcuucugugacuguucuuuuuguucaacauuauaauguucaguccaucauguuaacaacuguagcuacuauguuguauuccccugugagaauauaccaaaauuggccaggcgugguggcucacgccuguaaucucagcacuuugggaggcugaggcgggcagaucaccugaggucgggaguucaagaccugccugaccaacauggagaaacccugucuguauuaaaaauacaaaauuugcugggcgugguggcacaugccuguaaucccagcuacucgggaggcugaggcaggagaauuacuugaacccgggaggcggagguugcggugagcugagaucgugccauugcacuccagccugggcaacaaaagcgaaacuccaucucaaaaaaaaaaaaaaauauauauauauauaccaaaauugauuuacccauucuaccucugcuggauguuagagguguucuagguucuuguuucuguuauuaguguuaauaugaauaauagugcugugaaaauuuuuauucuggcuccugguacacaugaacagaguuuagauuauauaucuaguaauggaaauacuaaauuacagaaaauaaauauauucaacuuuaccagggaaugacaaacugcuuuccaaaaugguuuuaucaauugaauacuucuaccagcaguauacagacuugauccucaucgucugaacuuuuaauaugccaaucuggucaaugugaaacgauaaacuauugugaauuuaacuugcuuuuuuuuucuuuuuuuuuuuugagacagggucucggucuguugcccaggcggcaggugcagugguauaaucauggcucacugcagccucgaccuccuggucaccucccaccucagccucucaaguagcugggacuacaggcacagaccaucauacccagcuaauuauguuuauuuuuuguagcgauggaguguugccauguugcacaggcuggucgugaacuucugggcucaagcaauucauccaugucagacuccuaaagugcugggggccaggcacaguggcucacaccuguaaacccagcacucugggaggccgagguaaguggaucacuagaggucaggaguuggagaccagccuggccaucauggugaaacacugucucuacuaagaauacaaaaauuagccaggcauggugacaagcgccuguaaucccagcuacuugggaggcugaggcaggagaauugcuugaaccugggaggcggagguugcauugagccaagaucacgccacugcacuucagccuaagcgacagagugagacucagucugaaaaaaaaaaaaaaaaagugcugggauuauacauuugagccacugugcccagcccugcauuuuucuuuuauuaauaaaacugaggauuguuuguuuguuuguuucacuguuuacuggccccauggguuuugauagguaguguuuuugucauucauuuuuaauugucacugugauuuauuuaacaaugaauuguuugggaauuuuaaaauauacuucuacguauaaaggacucuuccucuuaucuucugaucauugauuuaucauucaaaugaguuguguagaaaauguggucuuaaggcacuaaaauauauuuaggcuagcuucauggcuuaacauaugauuuauuuuuauaaauuuucuauguguuauuaaaaagaaugagugauccaaauuuuaggaaaaauauuuuuccuaaaagugucuuuugacacuuaaaagugucuuuguggacaggcacaguggcucaugccuguaaucccaguacuuuggaagcccaaggcaggaggaucacuugagcuuaggaguuccagacgagccuggguaacagagcaagaucucaucucuacuaaaaauuuuaaaaagauaggcaggcacgguggcucacaccuguaguccuagcuacucaggaggcugaggcaggaggagugcuugaguccaggauaucaaggcuguagugagcuaugaucaugccacugcacuccagugugggugacagagcuggauccugucucaaaaaaaaaaaagugucuuuuguaugcuaauaagaugacuaguggcugggggacccuagauagcuucaaaacgggagcugguuccagaaacaucaaggcauggucagagaguuucugaguuggugaacacaucugggugcugggagguggugcacccaggcagcaugaaaucuuccucaucauaucuugcccuaugcaucucuuccauuuggcuguuccuggguuguauccuuuauaauaaacugguaacuauuugaguaaaguauuucugugaguuaugugagccauucuagcgaauuaacaaacccgaaagcggggaguuguaggaacucccaacuuuguaguaaagucagacagaaguguggguauaccaggcacccaauacuugugacugguaucugaagugaggauaguuuuaugggacuaagcacuuaaaccuguggagucugacacuaacucuggauaguuagugucagaauugaauugcgcugcugaauaccaaguuggugucugaagaguuggaagacugguuguugguguggaaaaaaaaagccauacaucugguaucagaagcguugaguaaaaacaucccauuauuauauacaucaacacuuaucuacauuuaccaacaaacuguccaguaucuuggcucaucauucccucuuguauuucaggcuuacaucugggaucagcggacuugucugaaguacauucuuuaggauuuccucuaguaaaagucugcuggugacaaaauguaucaguuuuuguuugauaaugucuguuuuguccucauucuucaaagacuauuauagcaguacagaauucuaaguugacaguuauuuuauuagcaaacugagggcauuauuucacugacauggcaauggaagcaggagagaaggagguaugauaaugaaagcagagacuggaguaauguggggcuacaagccaaggaaagcaggcagccucuagaagcuggaaaaggugaagaaacagagucuuuucuagaguuuccagaaagaauguggcccugcugacucacuuuggacuucuggcuuccagaacuguaagauaauaaauuuguguuguuuuaaaccacaaaguuucuggugacuugucacagcaauaagaggaaacucucauccagucaaaaauuaucagguauacaagaaggcaugaaaauaccgccaauaaugaagagaaaagucaaucauucaaaaccaaccucgggccuggugucauggcucaugccuguaaucccaacacuuuaggaggcugaggaugagaggaggacugcuugaggccaggaguucaagaccagccugggcaacucagggagacccugucuucuuuuuuuuagacaaagucuggcugugucgcccaggcuggagugcaguggugcgaucucggcucaaagcaaccuccaccucuuggguucaaaggauucuugugccucagccucccagguagccgggauuacaagugugugcuaccacaccacagcuggcuaauuuuuauauuuuuaguagcgacgggguaucaugauggccaggcuggucucgaacuccuggccucaagugauccacccgccucagccucccaaaguguugggauuauagguguaagccacugcacccggccaaggaagaccuugucucuacaaaaaauuuaaaaauuagccaggaacagugguaaguaccuguggucccagcuacucaggaggcuaaagugggagaaucacuugagcccaagaggccaaggcugcagugagccauuaucgcacuaccacaucccauacugggugacagaauaagacccuauuucaaaacaaaaccgaccuagaaaugacaaagaugacagaaucaguauauaagaacauuaaaauggucauaacuguacuccacauguucaaaaaacaaaaguaaagauugagcugggcacagugccuaauaccauggucugggaggcugaggcagaaggauugcuugaggccaggaguucaaggccagccugggcaauauagcaagacuccaucucuacaaaaaaaaaaaaaaaaaaaucaggccaggcaugguggcucacaccuguaauccuagcacuuugggaggcugaggcaggaggaucucuugagcucaggaguucaagaccagccugggcagcauggcaaaaccccauuuuuacaaaaaauaaaaaauuagccaugugugguggugcacuccuauagucccagcuacucaggaggcugagguggcuggaucaccuaaacccagggaaguugaggaugcagugagccgugauugugccacugcacuccagccugggcaacagaguaagaccccaucucaaaaaauaaaaauaaaaaauguaauggcaugguguugugcgccuguagccccagcuacucuugaggcugaggugggaggaucacuugggcccaggagguugaggcugcagugggccgugauugcacuccauccugagugacccagcaagauccugucucaaaaaaaaaaaaaaaaguagauugguuacccuaguuagauaaauggaagauagagaaaaagacccaaauagaacaacuagauacgaaagauaugucugagauauaaaaauacacugugaauuacuagcagauuagauauugcaggggaaaaaauagugaaauugaagucauagcaauaaagacuauccaaaauaaaacagggugaaaaaagauuuugaaaaacaaauggcaucagugaacugugggacaacuccaagcaaccuaauauauguguaauuaaaguuuccaaaggagagaagguagugguaggguaauauuuaaagaaauuguuuccaggaaacuugaacauuuaugaaauuauagccaacaaacaaaagcaucaccaacuacaagucuugugauauaucuauuuaugaaauccaguuacuguauaaguuuuucaaauuuggaaaaaaaaugacaagaaugaccauuauggagaaaggaaacugaaaaagaugaaauugaaaagguuuacaggaauaaaauugauuaucacuaaugguucccuugugugguaaaaugauagguccaaaacagagacugaaccauuuuuuuauacaauaagacaucugaucugcacauuaaaauuuaauggcauucauaaaagccaaacaaaucccacuaagacuaaccagcagucagaaacaggaagaagucugucuuguguauggaaaauuggauuuuauuuaaacauucaagcucccuagcuucuuaaagugaucuugcacauuuuaauagaaaucugaauuuuuaaaaaguauuuaaagaaugaaaguaggcauaaggucaguuuccuaaauaauuguauaucuuaacuauauacuaauaauauuuaauuagauaauuuaaaucaaucaacuaguacuucucucucccuuugaaucuucaaccuaaauugcuagaaaaaaaaucuuaugcuauauaucaaauggaccaaugacagccuuaugggaucucgaaauaugcucacucaugacccucuaauacauucuucccagaauuaccaccuacucuaauuugagacaauuuaggagaagaccuugaguaugaguaauuauuuuguaagaaaaaaagagcacaaauuccucaguuccaugugauuucaauuaucacuaaccaagaagauuaaauguaugccaaagaagaggaaaauccauuuagagauuauaaaaagacuaccacaagucuuuuuucuucuuuuucuuuuucuuuuuuuuuuuuuuuuugagacagagucucauucuguugcccaggcuggagugcaguggcgcgaucucagcucacagcaaccuccguucccugggcucaagcaauccuccugccucagccucccaaguagcuggaacuacaggaaugcgccacuaugcccagcuaauuuuuuuuguauuuugcguagagaugagguuucaucauauugcccaggcuggucuccaacuccugaccucaagugauccacccacuucggucuuccaaaaugcugggauuacaggugugagccaccacacucugccugcaaguccuuuuuaaggguucuuuuagacuauauccagaaaaagugaguuacuaaauuuuuuuucuagacagugucucgcucuguuacccaggguggagugcagugguaccaucacagcucacuguagccucaaccucccagacucaagucauccucccaccucagccuaucaaguaacugagaccaaaggcacaugccaccaugcccagauaauuuuuuauuuuuuauauuuuuuguagagacagggucucacuauguugcccacacuggucuugaacuccugggcucaagugauccucccaccucagccucuuaaguagcugagacuauaggugcacaucaccaugcccagcuaauuuuuuauguuuuguacagacaaggucucccuauguuguccagacuggucuugaacuccugggcucaagugauccuccugccuugccucacaaagugccagaauuacaggcgugagccacugugcccagcagagucacuaaucuuaaauuccuuuaaauucuuucauauauuuauucaucuaauauauugaggaacuauuacaugcuaugauuccuagaaaugggaauauuuuuuaaaaguccuuaccuaagaggaaccuugguaggaggagacaaguacaaaucagucuuuagaaguauguccagcaggcuggacgcgguggcucacaccuguaaucccaacacuuugggaggccaaggcaggcagaucacaaggucaggaauucgagaccaaucugaccaacauggugaaaccccaucucuacuuaaaaaauacaaaaauuagccaagcgugguggcacaugccuguaaucccagcuacucaggaagcugagacaggaaaauugcuugaacccaggagguggagguugcaaugagccaagauggcaccacugcacuacagccuucgugacagggcgagacuccgucucaaaaaaaaaaaaaguaugggugcaaaagcaggaggagauuuuuucuuuucuuuuuuuuuuuucuuucgaaguggagucuugcucugucacccaggcuggagugcaguggugcgaucucagcccacugcaaacucugccucucccacacucaagugauucucaagccuuagccucccaguaguugggauuauaggcaugcgccaccaugccgaacuaguuuuuguauuuuuaauagagaugggguuucaccauguuggccagacuggucucgaacucccaaccucaggugaucccuaagugcugggauuacaggugugagccaccgugccuggccuggaggagucauuuuuaccuaagagguuaggaauguugcgauggagaagguaacuacacugcuccugccuugagaaguucagcacuacuuauaaagaugauucucuuugcagcaucucuuugagcucuuuuuccaguagaucucuuucucucucucucucacgcauacgcacgugcacacgcacacacacacacacacccuuucugugagaaauaacaugcacuugcaaucggucuaguuggacuagggagggcagucuaccaucacaaagugcagguagcucacucuaaagccaaacaaucucaaucuacuucuguaaaaagcagucauccuaugucagcucacugguuuaguggccguggaaaggagagcuuuagacaaaauaauauaaaggaaauggugugauuaagucuauuuagacauaugguccauaaauuaaaacuggaaagcacuugaaaacauucacguucaacuuucacucccaccaaaaaaaaaaaaaaguuggggaggaguggaaguaacucauaucacauucacuguuuuaauaaaaacaaaaaaauuaaaacugaucuuagacaguauagccuuuuagguuauaaauacugucaaaaagaugcauuguuugccuaagagugaaguacuauggaacagaacacuugaaaauuuuauuucauggaggucgcaguuccuggagcacacccaaggaaacagguguuuacauaccacgaucccuguauuagagagagagagcuuguugcagagcccacaaacauaucugaucaaacaaggcuacgacgacacuugggagaugggaaggaaacagguggagggaaggaagugagaacaugagaaucuggucagugagguuuucuccaccuggccacugcacccagcaccucccucacugucaucuccaaccagucuggccccaguauaauuauguggcaggcaaaaucaauugucagggcuauucuuccucuuuucuuagcccuuguugagaucuucccuucccuucccauccugucagggucuuucagacaucaagaaaggcauagaucacuucccagucugagaaguccaucauauuuaaaaaugaagaaaugccaaaacagguucauaaaaaugguggucuauuuaagugcuuacauuuaauauuuuaauugcaugaucaacuuuugucugggcuggagugcaguggcacgaucacggcucaccacagccuugaccuccugggcucaagugauccuccuaccuuagccucccgaguaacugggacuacaggugcaugccaccaugcccagguaauuuuuuguauuuuuaauagagaugggguuuugccauguugcccaggcuggucuugaacuccugggcucaagcaaucuggccaccucagccucccaaagugcugggauuacaacgugagccaccacaccuggccaugaacaacaucuuuuaaaacuucuuuuuuuccugugacuacauacauggccuuauuugaagauaauauuaaaguccagacccuucauaauauaaggccugagugagaagacagggguuugggguacaggcaggcccucaagcucucucugccuucccgcauauuaagaaccuaccuucagacaaagaucuaagugaaaaugacugcuaaggccccccaaauuaucccuucauuagauauuuaagauuuaaauuguuaaccuaaggaaugaacuccaauauaaaauuucaggcaucagcaacugagaguucagccauucuaguaugcuucaaauaggaaguacugccucuaucaauucacuggaauuuauauauacauauaauuuuuuuuuaaauaauaaaaauagagccagggauggugacucacaccuauaaucccagcgcuuugggaggcugaggugggaggauugcuugagcccaggaguuugagaacagccuagacuacguagcgagacccuaucucuacgaaaaauuuuaaaaaauuagccaugcaugauggcauguaccuguagccccagcuauucaggaggcugaggggagaauuguuugaucccagaagucugagguuacagugagcuaagaucaugccacuguacucuauccagccugggagacagagcaagacuccaucuuuaagaaaauuuuaaauaauaauaauuuagaaaauaauauaugugaagauuucaaaagacucaggagauaggugaagaaauuucuuuucuauguuaauaugaagcauuuggcacagauuguacuuuaaaacaguagagauggacgcauucuguggcauaucaguaauagcugauaugcuuugcuccuggaguugccauuuugagaaaggucaaggauccucagccauuagucaccuagacaccugacugaaggccacaagcauaguuacaguuuuuaggagggagucaggaacacagaguacaaugacaagcuuuaaucuaauucaaguagcaaguaugcagcaccaacucacacggguguacacugugugauaauauuaauacaugcuguuccaacccuguacuccuacauuuaaagauccuacagaccucauccacaaaguauuccuuucccugucccaacucucuuaaaguacaacauaaugcaaaguggacuucuuguucuuaucaaggccaaacagugauaguacaggacacugcaugaguacacccaaaacuaaaaauaaaaccacaaggaugcagcuuaaauauauacaauuuccauuugucaauuauaucucaauaaagcuaaggggaaaacugaauuuuaaaaaauaacccacaaugagucauauugaaaacauucaaaacauuucaagggaaacaccaaacccuuugcuagaggauguauacuagauaacaaagccuaaacacacacacacacccaucaugagcacacacacacacaaaacccacaggcucacuaaauucucuuauuucagauuauugagauuaggaggguaugcagccaguuuugacuucaaauaaaacaggacucuguccaagucaauugauaacugaaggggaagcagcauguugggaaagaaugggagaggaacaaacguuacagcugcccaagcuauauguuccucaagucuugguaaguaguuuauuuuaaagauguguauaagucacaaucuuuaaauccuuuaaaaccugaauaaccaguccuguucuuucucccuucuucccuuauucucuugucaaaucuagcgucagugcagauucugagugugcagaguucaaucaagaacucugcuaccuccugguccaucagcuccacaguccuuccuccaucucauacuaggguugcagcagaaauagacugaguauacaagcaagagugucuuacagauacuagcaguuuucaaauguauguugauucuguugugaugaauaaaauuuuuaaauuaucuuaaaauauuacuaaauuggccaggcgugguggcuaacgccuauaaucccaguauucugggaggauugacugaacccaggaguucuagacccaccuggacaacauagugagaucccaucucuaaaaaaaaaaaaauuuuuuuuuucuuuuaguuagccagguaugguagcaugcaugccuauagucccagguaccugggaggcugagaugagaggaucaccugagcccaggaggcugaggcugcaaugaguugugaucacacaacuacauuccagccuaggugacauagcaagauccugucucaaaaaauuauauaaaauaaaauaaaauauuaugaaauucacuguaucauuuguuuguuuguuugaaauagagucucacuuugucacucagacuagggugcagugacaugaucuccacucacugcaaucucugccucccagguucaagccauucucccaccucagccucccaaguagcugggacuacaggcacuccucaccaugcccagcuaauuucuguauuuuuaguagagacggguuuccaccauguuagccagacuggucuugaacuccugaccucaagugaucugcccaccuuagccucccaaaaggcugggauuacaggugugagccaucgcacccggccuguaucuuuuuguuuuuaugcauuucuuaaucaagaaauaauuuaaaaucucacuauuauuauuuuguuguugguuuuucuguuuuuguuuuuuuuugagacauagucuugcucugucacccaggcugaagugcaauggcgugaucucagcucacugcaaccuccaccucccaggcucaagcaguucuccugccucagucacccgaguagcugggccuacaggugugcagcaucacgcccagcuaauuuuuguauuuuugguagagacgggauuucaccauguuggcuacacuggucuugaacuccuggccucaaguaauccuccugcccuggccucccgaagugcuaggauuaaaggcgugagccaccacgcccagccuaaaauuucacuauuauuacuuaaagguccuuaugcugaaaaaaaguaggcaaucacuguucuacaguagaauguaauaaaagaguuacaggcguggcaaccuaaacacaaaaugaagugauagauacaauaagaggauauuuuucacuuaugaagaaaacuggcaaaaacuaggauguagauuaaaagaagaagaacacagucuggagaaacaagccaacagcaggcuaacgucuaucaacagucauucuaaaaaaagauaauuagcaacaaauaauuaacagaauucagaacccagaagaaucacaaacuuguaaccaccuaacaauauugcuuugaaauauguagagcuaacacugacaauuauaagaaaaacagacaggucuacaauuaguauaggagauuuuuaacauauaucaaucauaagcugauaguugaaacagacaaauuaggcuauaaaaaauuggacuaguaauauuuauauacugaccuaauuaguauaaauagaacucuauacccaagcaaaagagaauauacuuucuuuucaagcacacauaaaaacucacuagaacugagcuguauguaacaaaagaauuuccaagaauugauaucauaccaaccaugucuuuggguacaauacaauuauauuagaaauauaacaaaagauauuaaaaagaauuuugaaaacuuuaaaaaauaauuuuaaagaauuuuuaaauucucuaauuuaaaaauuaaagugguacaugccuguagucccagcacuuugggagguggaggugaguggaucaccugaggucaggaguucgagaccagucuuaccaacauagugaaacccugucucuacuaaaaauauaaaaauuagccaggcaugguggcgggcaccuguaaucccagccacuugggaggcugaggcaggagaaucgcuugaacccgggagggagagguugcagugagccgagaucaugucauugcacuacagcccaggugacaaagcaagacgcuaucucaaaaaagaaaaaagaaaagaaagauugaacauaaagacugaaauauuaaaaauaagguauucaaauaauaaacuugagaaaaguaaauaauaaauaugagaaaagaauuuaaugaaauagaucuuugugggaaaagcugguaagacagauaaaucucuaauaagagcgauaagaaaaaaagacaaaaggcagaaauaagcaauacugaauaggaaaugugauauaacuagauacaacagagauuuuuaaaagaauaauuauuaugaauuuuaugcuaauaaauuggaagguuggauaaaauugguaauuucuuagaaaaguaucagacuaccaaaguugacucacaaugaauuuagaaccugauuuagauaauaaaacaaaacugagcgaguuucuuuuuagucauaucucuuccucccaaagacaccaccagauacagggaguuuuagaugcaaguuuugccaaacuuucaagagcagauaaucuuuaucuuacauaaccuguuucaaaaacuagaaaaagaccuuauuuuaugaagcuaaaauaacuuugauacccaaacuagaaaagaacauaaaaagaaaagaaaauuacagauaaaggucccucaugagcaaaaaugcaaaauccuuuuaaaauauuagcaaauuaaauucagcacuauauauauauauauauauauuuuuuuuuuucaucacagccagguaggguuuauccuagaaaugcaagaaugguucauuaucagcaaaucuauauucauguaguaaaccauagacuaucucaacagaguaaaggauaaaaauuguguaauccacucaacagauacagaaagaaagggcauuaaauaaaaacaaguaaucaugguccaauucaaaaaaaaaaaagucuuacuacagaagacuacaaauuagauaaaaaauaucucugagaaaagcuuaaaaaguaacugaagggccaagcacgguggcucacgccuguaauuucagcacuuugguaggccaaggugagcagaucaccugcgcucaggaguuugagaccacccugggcaaaauggugaaacccccucucuaccaaaauacaaaaaaucagcugggaguaguggugcacaccuguagucccagcuacuugcggggcugaggcaugagaaucgcuugagcccuagagggggagguugcagugagcugagaucacgcuacugcacuccaacuugugcuacagagugagacuccgucucaaaaaaaaaaaaaaaaaaaacuaacugaagaauugaaucauuuauuuggagaaaauuauuaagaaacaaaaauuaagaagcuauagaagaaaaaaaaagaagcuauagaagggagcuaauauguaauugaaguaggagucaguacucaauuccagaggcagggcguggacacuggaccacauagaggacuagcuaaagcagguccaggguaaaagcaccuccccauaagacacacccaccagggugauaggucaccuuaccauugccacggcaacacccagacguuacugccccuuuccauggcaacaacugaacaaccuaguagccaccacuugcauucuagaaauuucugcacaaaucaccccuuaauuagaauauaauuaaaaguggguauaaauaugaaugcagaacugccucugagcugcuacucugggcacgcugccucuaggguagcccugcuccgccagcagaaaugccucugcugcugcugcugcugcugcuguacacugcugcuucaauaaaaguugcuaacaccacuggcuagcucuugaauucuuuccuaggaaaagccaagaacccucuugggauaaaccucaguuuugggguuugccuguccugcaacauaaucaccaaauguuucuuuuuguuuguuuuagguauuuucacauauaucauuucacucauuuaaaccucacaauaacuauuauguuagaagaagagacuauuguaaagaagaaugagaaaguaccuuagcauacuggaaugagcauacuuggaaucaaacaguucaggguuagaauccuaccucugccauguaugaacugaguaacuuucaacaccuuacugagcuucucuucaucugaaaaaugaaguggacuaaauaacacaacuuaaaauacccagcucauacaagguauuuaagaaauugagcagagcucaagaccaggcuggccaacaugcugaaaucccaucucuacuaaaaauacaaaaauuagcugggcgugguggugcgugccuguagucccagcuacucgggaagcugaggcgggagaauugcuugaacccaggaggcagcgguugcagugagccgagaucacaccacugcacuccagccuggaugacagagcaagacuccgucuaaaacaaaaaacaaacaaacaaacaaacaaaaaacaguagugauaggccagcauuuugggaggcugaggcaaauggaucacuugaggccaggaguucgagaccagccuggccaacaugguguaacccaucucuacuaaaaaugcaaaaauugaccaggcaugguggcauaugccuguaaucccagcuacucgggaggcugagucaggagaaucucuugaaccugggagguggagguugcaaugagcugagauggugccauugcacuccagccuggguagcagagcgagauuccaucucaaaaaaaaaaaaaaaaaaaaaaaaauacaguaguacuaaauuaugcuuaauguggcaaguccaaaggugaacuauuuaaaguuugagugcuugcucuaggucaaaaaugcagcaaggcagugggcagaggucaaugauuacaucacagaacuugggcauccacauuaagagacaaaaaucuucuaauacuguagcaguggaaaggaccacaaaacucaggacacacacacacacaaaucacacauuagccccaggcaaacaaaagguauuaagugauaugauuaaguaauuaauuguuaaaaaaagauauucugggcacuuucacccacaaguguguuuaaaaauacaaauuucaucacaaauuauuuugaguguucaagaucacaagcaaagaaaaagcuacaaggccugaugaccuaaaaaugugacaucauuacuuuaggucaaaagagaucuaaauuaaguauaaagcauauuuuaauccuucucaaauuucuucuuugugcaugaauauaaauuaugguaaauuuguauaaguaaauaccauaacuguucuuaacuaauaaaguuuaaggguuaaaacaaagaauucccaagaaaugugaauaauggcaaucauguagcaguaguacauccuuucacaugguauuuugggaacauucuuuuauucaauaagccuagacauuacaguaugcuucaaaaauaguccaagcuggugaaccaauccaaguuuugacuucaagcagacugucagagcagcacuaaggcagaaagugacaacacuguccaguucgaaaugaaagcugucauuugccugccaacagauaauguacaccaugcccuuuucaaguucauaucacaagaccaccucagaagugaugcuuuuugauccauucaguucugaacauccuuggaucagguccaagaauugccuuccuuauucauuucugcuccauugcagaaauaagaaugaaauuccacuguauacagcaaugacaauuuuuccaaggcaaauaaaauaguuugcuauaaacauuucucaccuauaauaaggaaucaaucugaagcaaaucuacacugacagaaaauaaaucuggucaguuugacaucuagcuuauucucuguuacaacauuagcaccuacuauuccuucuguauuugguuaugaaucuucuggaagaugcuuucauauugucauccuacugcucagcaacuacaaagcuucccuccugcccaauucuaaauuccuuugccuggcuuucaaggaccuucacuauugcccaaccuaccuaccuaagcuuaguuccuaccacccccaccaugugccccucuccccacaggcccucaugacuuggucaugccauucauugcaccuagaguauuuuccuuccucccuacaucuaaccauccucccaagccccacuuccuacauaaacgcucuuucuacuauuccuacuuauaaugagagagcucucucucugaauuccuaucauaaagucagucuguauuauagcucuuuaauuggaaacgucuuaaaauauuucuuuuuuacaaaauuucucugcaguaguguuuccacuuuugcucugccaucauauauagaaaaauaaaacucaaguuuauggcauauccccaugggucuacuugggauuaugcauaauucccagccacaauagcuguaguuccacuauuuuaucucccauuaaagaaaacauaauaacaagcauauuauacuucaaugaaaguuuaaaaaaaaacauaaugagaaggaaugagagggauauuauuauacacgugaacuuaaauaugcucaauuaaguuuuuguuuguuuguuuguuuguuuguuuuuuugagauggagucucgcucugucgcccaggcuggagugcaguggcgcaaucucagcucacugcaaacuccgccuccuggguucacgcauucuccugccucagccuccugaguagcugggacuacuggugccugccaccacguccggcuaauuuuuuguauuuuuaguagagacgggguuucaccguggucucgaucuccugaccucacaauccccccgccucggccucccaaagugcugggauuacaggcaugagccaccacgccugaccucucaauuaauuuuuucuuuuaaagcaaagcauuaguauccucuggcacuuuauuacuguuaauauauuauuugcaauauaucucacaagugacuauucauuacacacugguaggaacuacuauucuauaaacagcacucagcaugcuaggcacauagaaggcaaucaguaaauaauuaaccaaggagcaugucuagcccauuaaucaauuauauauaaaacauuacugccacagcagucugaugaugaugaugacgaagaagaaaaugacaacugacagugauacaaaauguaaacauggaguacaguagcugacuccccugcugacagucucaaaaggaacaaaugauuucuuuucuuuuuuuuuuuuuuuugagacagaguuucgcucuugcccaggcuggaaugcauggcaugaucucggcucacugcaaccuccaccaccuggguucaagugauucuccuaccucagccucccaaguagcugggauuacagguaugugccaccacgcccggcuaguuuugaauuuuuaguagagaugggguuucaccauguuggccaggcugguuuugaacucuugaccucaagugauccaccugccucagccucccaaagugcugggauuauaggcgugagcuagcgcacccagccaggaacaaaugauuucuuauaggguuauaagguuagucuaaccaacauuuuaacaauacagcauagcugcugcacuccugaaguuuaugacaaucugggcaguuucgauggcaaucaccaugcaacccuacaccucuuaugcaacacuguggcuauuauugcagucuuggguaaaauuaguaaauugugagcucuaucugccagugcagccagggaucaaauaacuuuagcuccacccaagagaaaggcugugaccaugcaaaucuuguucuauauuaaaauggcucucacuuuuacaguaaggaauugccugagcacuggaaguuccucaucgacaauuguaucauuuuaaauguauuaaacccauuuuuccauaugcccuaauugccaaucacacaaauagccuaugauaggaucuugagauccccaaauccuaaaaguaucauaucuuucccugaaaaaucuuuaaauauauaucagauagcuuagguauaaaucuaucuacaggccaaguaucuucuguuuucucuagccuugacaucuuaacauucuaggaguacagacugaucuaacaauaaauguuuaaauauuuuagccuuuaguguugcuuaagcagucacuugagaaguccuugcaaaaguagacuacagaggaaguuucagucggucaugcccuagaaauuucuaaacaucaaccaagcagcucaaaagaauguccuacucaauaguuccaaggaugucauuaauugcuuccaucuguuucccccuucucugucccugucuuuuccaagucaaggcaucuacuauuuucugcuucauuuugcauucuauagaaaaacaagaaaagcaaacauaaaaauccaucacgguuuguuuuauuuuguuuuguuuuacacagggucucacucugucacccaggcuggagugcaguggcauaaugacagcucacugcagccucgaccuccugggcuuaagcaauccucccaccucggccucccaaagugcugggauuacaggcgugagccaccaugcccagcgaucaaugauuuuuuaauucugucaugucuuccacauuuauugguuagaauucaccuuacaacuagggcuauugggcuacucuaaaaauuuuguacaggaaaggcaagauaaaugcuuaauuuccuuuaaauuaccaauuauuagaguaagggguugaugcccuaguuaccacacagggugaucaguaaaguuuuauuuuguuuuaaagugaccaaauuuuuugaaauuuuuaucacaacuagggugugcucauuuuuaauuuuucuaaguccccaaagaagucugugaaagcacauagcauauuucagaauaugucucuggggauaagcaaaaauaaguuuccugacaaaauccacuuaccaaucaaaucauauucauagacuagaaugucaggguuggaagcaauuguuuguaaggucuucuaguccaacuaccuacccgauagugaaaccuguacucacucauuccccgugcucuguaucuuccaaggggugaggggcaaccugcuacaagcuagagcuauguuuuuaauguaagguaaaugcaaguuuaauuauaauauguuuaguugacagcauaagauuccucuuaauauuaccaggcuaaggccggggcacaguggcucaugccgguacucccaacacuuugggaggccaaugcaggaggauugcuugagcccaggaauucaagaccagccugggcaacagggagaccuuaccucuacaaaugauuuaaaaauuguccgggcauaguggcacacaccuguagucccagcgacucggggugaggcaagaggaucacuuaagucugggcaauugaggcugcagugagccaugaucgcaccacugcacuucaaccugggugacagagugagagccugucucaaaaauauauauauauuaccaggcugaucggauggcauguaaacaaaauaggcucauguugaucagagcucgaagaaaccuugagaucaccaaguccaaugaagguaggacaaaaaagauacucccacaaaacaggcuguacaaaaaaacagaugcuucuagcaccuuacuuccugacacaugaagacauuuuauggaauuaacagaaacacaguugcauaaagcacccacucagguagaaauaagaagauuucaauaugggugagaauuuuacaucuguucaaugaaaauaauagaacauaaggaggauaaaaauaaaggaacacuuuuagcuuuauuuaaaguugugauauuuaacauacauagagaaaauaaacauauguauaauauaaugcauaaauauaaaacaaccgcccauguaacucaucacuuaaaucaaaaauagaacauuauuaccacuuuuagaugccccuguguaccucuuccugaguauagaccucuuccucccucccagagguaggacuacccuggcuguggugaccauuauuacuuacucaucuucaucuuuuuaccauauaaauaggcaugucuaaacaacauaguuuauuucugcauguuuuugaacuuuuuuuuuuuuuuuuuugagacagagucucacucugucacccagacuggaguacaguggcuugaucuuggcucacugcaaccuccgccacccggauucaagugauucucccgccucagccucccaaguagcugggauuacaagugugagccaccacgccuggcuaauuuuuauauuguuaguacagauaggguuucaccauguuggccaggcugaucucgaacuccugaccucaagugauccaccugccuuggucucccaaaguacugggauuacaggugugagucaccacaccuggccauuuuugaacuuuaaauaaguggaaccuacauaucuaucuaucuaucuaucuaucuaucuaucuaucuaucuauccgucucucugucucucuguuuuucauuucccucaauuauuuuugagauucauucauuucucuuuuuuugucuuuuuauuuauuuauuuauuuuuagauacaggguuucacccugucacccaggcuggagugcaguggugcagucacagcucacugcagccuuaacuuccccagcucaggugauccucccacuucagccuccuggguggcugggacuaucggcucacaccaccacacggagcuaauguuuuguagagaugaguuuucaccauguugcccaggcuggucucaaacuccuaggcucaagugaucuucccuccucggccucccaaagugcugggauuacaggugugagccacugcaccuggccucauuguuuuuuucaauugaaaugaaacucauauagcauaaaauuaaccauuuuuaagugaaaauuccucacuccuuuucauuacugauuaauauuacaauuucugauuacaccaugauuauuuuauccauucuacucuagauagaccaguggggucaucaugaacaaugcugauagaaauguuuuuuauauggaugcuggugugcauguggacgaguaucuuuagggaacauacccgacaguggaacugcuuaucuucuacuuuacugaugucauguuguuuuccaaaguggcugcagcaauuuacauucccaacagcaguguaagaacauuccaguugcuccacaucuuaucaacaacuaauauuaucaggguucuuaauuugggguguauaauaaaauaauuugcacuucucugaugacugaaauaaaauauuuauuggccacuuaaauuuccucuuuugaggugccuauucaaguccuucaaacaccuuuuuggaaagucuuauguuauucuuauugacuucuaugaguucuauuuuuuuuguccuacacaucagcuuuuacuuuugcuuacaacuugacugccauauagaacaaaaccacuaaucaaagacaauauaagaaccuaagaaguuuuaaguauucaaaaauuaguaugucugcuuguuuuaugcagaauagcccaaaaagccuggaaauuauuuuuaggaauacuaggagauauauaaauauaacuuaaauuuaaaauguaacugaaaauaugaaacaauaauuuuuuuuuuuugagacagagucccgcucugucacccagacuggagugcaguggcgugaucuccacucacugcaagcuccaccuccugaguucacgccauucuccugccucagccucccaaauagcugggacuacaggcacccgccaccacgccuggcuaauuuuuuuuauauuuuuaguagagacaggguuucaccauguuagccaggauggucucgaucuccugaccugaggugauccacccuccuuggccucccaaagugcugggaugacaggcaugagccaccacgcccggccaaaacaauaauuuuuuaaaguuuauaucuaccauuauucccuuaucuccaagcaaaggugccuaguauacaauguagauucaugcaugcuauagucacagugggucucugaauacuuuucauuuuggaaagaaaaacucaaaacucauggucuuauuaaaaauuauuaugucaaaaauuggccagguacaguggcucacgccuauaaucccagcacuuugggaggccaagguggguggaucaccugaggucggaaguucaagaccagcuuggccaacauggugaaaccccaucucuacuaaaaauacaaagauuagccagggaugguggcacgcgccuauaauccaagcuauuccagaggcugagacaggcaaaucauuugaacccaagaggcagagguugcagugagcugacaucgcaccauugcacuccaaacugggugacgagggugaaacuccgucucaaaaaaaaaaaauuauuaugucaaaaaugccuaauaucaaaaacuaaaaugaacaguuuuuuuaaaaaaguuagaagacaaaaaaguugaaauuucaauuguaaacaaaaguuuuauaccaaaaaaaaguuguuacugaaaucagcuacuuuuucuuccuaacaagaguauuauucugcuuagcaacagaagaauauuucaauuacucacuuaauaaaugcugguggcauaucucucuucaaaaucugauccucagugguuugaacagucucuuuuccaaccuacaagaggaaaaaaaaucauaauucaaauauaaauucucagacuuuaaaaaacuauuacuuaagcauauuugaaacauauacuuaaacauaaucuaucauuaaaguuucuagauuuaagggagauuucuggauuuaaaaaauuuuuuaggauuacucacauaauaugccuucacaauauacuagaauaacaauauggaauacaaacauaauguuguauuacuccuucuucagaauaacuaauuugaaagcauuacugagcauaauaggagaaauucaucauugagaauauaaguguguguauuuaagccaaaaaacuaggccacaucucuaaaauguuacaugaaguacaugaaucaaguuagacagacaaaacuaucuauacagaaaaaaacgaaguuauuggaacugggaaaaauauuugaagcuauuaugauucugacacuagaaaccaaacaugaaaauaugcaacuucacuaguaaucaaaaaaacugaaauuaaaacaauaugauauuuuucccuaauuauagugcgaguuaaaaagaaagaauauauaaugcugaaugcaacaauggaauagguaguuuuacacccugcagguggugauauaaacugacauauucucuuuggaaaaucacuugcuagaauuuguuagcggacauaaaaaaagucauaccugggaauuccacuuaugagaauauaccuuauaagcaguaaugccaaaugugauaauaaaaacaauauucacaaaaguauucacuaagaugacaguuauaaaagcuaaaacacuucauaaauaacuccuccaacaaagaggaauaguuaaguaaauuaagauauaucguuagguugaguacuaugugggccauuaaaacaaugguuauaaaaacuuggcauuauaggaaaauguuuaugacauuauauuucacuuaaaagaagaaauauacauuaugaguacaacaccaaaaaaaauccacauguauaaauaaagcaacaacaccgaaagaacauuuuuaaaauauucuacugguuguacuaaugcuuaggaaauugaaugaauuuguaucugcguuuccuauuuucuaauuuccugaaauguaaauuuuaaaguaauuuuuguaauuuaaaaacacaaaaauguuacuguaaguuguuuuguuauuuuuuguuuguguuuuugaaauagagucucacucuguugcccaggcugaagugcagagacgcagucucagcucacugaaaccuuggccucccagguucaagugauucucaugccucagcuucccaaguagcugggacuacaggcaugugccaccacacccagcuaaucuuuuuuuuuuuuuuggauuuuuaguagagaugggguuucaccauguuggccaggcuggucucgaacuccugaccucaagugauccacccaccuugccucccaaagugcugggauuacaggcaugagccaccacucccagccuaaguuauuuaguuguaauuauuuccuaccuaauaaucucaguacacaauuaucugucauuuuauauagaucuuccaaauaguaauggucagaaauuuuuuaaauuaucaaaauauuaaaugucacacuaccaaauuauguguguauuauaccacuaaucauacacauauucacuuucuucaaaauuaucucuaugcaggucuugaaugucaauuuuucuuccacuauauucauguauuauaaaauauaagaguaaacuuuaauauaguaaauggugaaauucacccauuuuaacaauauaaagccaccuaagaguacuaaaucauauuuauaaaccauauuuuaauguagaaaucugugaaauuaaaaaaacccagaauggaaaauaugucaguccuacuauuuaaccauuuaacuuuugauugaguuuaaaggaaaaaaaaauggaguaagaaaaauccuggcuggcacaguggugcacacuuaucauucccagcacuuugggagaccaaggugagagaauuacuugaaaccaggaguuugggaccagccugggcaacauagugagaccuugucucuacacaaaauuagucgggugugguggcucacaccuauggucccagcugcuugggaggcugagguggaaggaucacuuaagcccaggaggucaaggcuguggugagcaguguuuuacaccacugcacuccagccuggacaacagggcaagacccugucucaaaaaaucucuaaaugcucaguaaaucagcuaaagaaaauaacacaauaaacuauucucagggaauauaagucaugcauaaauuaugaauacaaguuuuuucuuucaaguuaauagcuagaaaaagcaacacauaucuaccacuguguaauagccaaugcuuuuauagacaauagacugucuguaucauaauaaaaggcuuuuaaaucagcagcugguucucuagaguuucucagcucaaaacaugacagaauauuuccagauguauuguucacuauguuuuccaacugaaacuaaccauucaaaaagcuauggccaugauuucaugaaguaaaagaugaaguucagccacaaagucacuaguucacauucaguauaaagggccuagaaagauauucacauuuaagacacagagagauuccuuuuauauauguggggggaaggagggacacagacacagagagcaagcgugggagggagaacuaggugaguuccucuuauauuuccuuuagaaaauaguaaguuauucaguguuauuaaacauugcuuuuagcacaacaacaugagccagguacuguuuagguaguagagauggaguagagaauaaaaaaaaguuuccugccuucacggaacuuacagucuaguagggagagacagagagucaaguaaauaaacaaguaugauuccagauaaugguaagaaugaugcuauaauaaagaguacgggcuggaaacaaaggagcuuacuuuggaaagaguagacaaagaagcaaaauuggagcugagacuuugaaacuaagaaggagucacucaugaaagagcuaggcaagaacaaucuagggggagcagccagaaaaaggcccuaaugcaggaaaagauuggguguauuuuaggaacuggaaagaggccagaguggcugaaccucagggagggagggaaguauggugugguaaugaggcuggguaagaaggcaagggccagaucauaaagagccuuuuaggccagcuugaaauauuuggaaucguuuaucaguacaauaggaggcaggaguucuaaacaagagauuaaucugacuuuuucuuuucuuuucuuuucuuuucuuuuuuaagagacaugaucuggccccauaucccagacuugagugcaguggugcaaucauagcucaagugauucagggcucaagugauccuccguccggagcagcuaggacuccaggcaugagacaccacgccuagcuaauuuuuuuuuuuuauuuuguagagauggggucucacuauguuucccaggcuggucucaaacucccaugcucaagcgauccuccugccuuugccuaccuaacugcugggauuacagucaugagccaccacgccuggccugauuuucuuuuuaaaaggucauuuugccuauuuuuagguggugaggggagagcaggguaaccaguaucacucuccuagaugauugcagggaggcuacugcagucagccgggagagugauaguagugacuuaagguuucacuacuuaaguagugaaaacagaaauggagaaaagaauagaauuguguuaccuuuuuacggaagaaauauuauuaggacuugcucuuggacugggugggguggggugggggaugaagacuagacugagguaaagaaauaaaaaccacguggccgggcgugguggcucaugccuauaaaucccagcacuuugggaggccgaggagagcagaucaccugaggucaggaguucgcgaccagccuggccaacauggcgaaacccugucucuacuaaaaauacaaaaauuagcugggcgugguggcggaugccuauaaucccagcuacuccggaggcugaggcaagagaaucgcuugaaccugggaggcggagguugcagugagccaagaucgcgccacuguacuccagccugggugacaagagcaaaacaccgucucaaaaaaaggaaaaaauaaaaaaaaaaaucacuucuaaaucaaugaaauaaaaagccuucaaagguagcaaugcuagaaggcugauauauggcaaacaguuauuauccaaagauaaagcaaucauggcuacaccaggcaaaaacauuaaaacaguuuuguaaauagcauauauucugaccucaguagagguaauuacuaaaaacugaauggcauguaauuaauugaugccucuuuguaagaguaggaguagguaaggaaagauaaauggauaauuaaaaauauauucaagggcauuuauuuaaaugcuauuuuugaauacuuaagugauaaacacuaaaugugauuuuguuauucuaagcugcauucauacuugaagcaauaguauccaugauugcucaauacacucuggcuagaauuagauuagggacaacgaacggcacuguuuuuaagguacaacacauaaaacaugacuauauagaaugaaugccauuuuuucuuggggaauugauuuuuggcagugcuguccaaauaauuuucuuuuaugauggaaauauucuauuuaaucugugccgcccaauacaguacccauuagccaccugugaguauugaccacuuggaauguucccagcauaggccaggugcaauagcucaugccuguaaucccagcacuuuggaaggucaaggcggguggaacaccugauaucaggaauucgagaccacccuggccaacauggcgaaaccccgucucuacuaaaaauacaaaaauuagccagggguguggcaggcaccuguaaucccagcuacuugggaggcugaggcaggaaaauugcuugaaccugggaggaggagguugcagugaacugagaucgcaccacugcacuccagccuaggcgacagagcgagacuccgucucaaaaaaaaaaaaaaaagaaaagaaaagaaaaagaaacaaagaaauguggccaguauaacugaagaacugaauuuuuaccuuuauuucauuuuaauugccaccuacggcuaguggcuaccauaucaggcagcacagauccaugagacccucacuguauccuaaaacuggucuuguugcuccagacucuuccaauucauucuucacacagcuacuauaaccuucauuuauuccuuuccuauguggucuuuuagaaaaaaggagccaggccuggaaaggagaagcugcccaguagagaagaaucagacagcccaaacaaagagaagagcacaggcaaagaagguucagucagauaugcgaguacaaggaggccaggacuagaaagacacgcugguguggcuucagcagaggaaaugaggcuagaaaggaaaguucaguuaguucaggacuuuguaugcuaagugaaggcagagaggauuauguuaccuugaccugcccauuuauucaaagauugucauccucuguucuagaucuuuacaauuuaguguucuaucaccaaaauaacaagucgagaacuuccaaagaaccacuuuguaaagaucuacagaagcagaaagguauguccuauuugagaacaacuggcaaagccugucuaggagaaccaaagacaaaucuuuaauuuuuaagccauuaacccauugaugacagaaaaugcauuuuccuguacucuccugucaccaucaaaacagaaaauuuccauagcacccaucuuuuccaaauaaaaauagaguagaacagucagccgugguggcuuacgccuguaaucccaggcguaaguggguagaucacaaggucaggagguggguagaucacaaggucaggagauggagaccaucguggcuaacacggugaaaccccgucucgacuaaaaauacaaaaaauuagccgggcgugguggcgggcgccuguagucccagcuacucgggaggcugaggcaggagaauggcgcgaacccgggaggcagagcuugcagugagccaagaucgggccacugcacuccagccugggugacagagcgagacuccaucucaaaagaaaaaaaaaaaagaaaaagaaaaaaaguagaacaaacaagaaagggauuaauucacaaaaugucuuuuguuaacuaacaggaaucuucauagcuggugggaaaauguuauucuucgaggucaacuuaguauggagaaauaugauucccaauguagacuacaacuuugcaaacaggucaguaagaaucaacaaaugcuucuuuuuuacuuuuuuuuuuuuaagauggggucuugcuauauugcccaggcuggacucaaacugcuggggucaaggaauccucccaccucagccucccaaguagcugggaauacgggugcaugccaccacaucugucugaugccucauuuuuuuuaugccuuaaaauagaucuuauuccuucugaaaaaaguccuauggauuaaaggguuaaaaaaaaacagaguggcugggcacgguggcucacgccuguaauccagcacuuugggaggccaaggcggguggaucaccugagaucagaaguuugagaccagacuggccaacauggugaaacccugucucuacuaaauauauaaaaauuggccgggcgugauggugggcgccuguaaucccagcuacucgggagggugagacaggagaaucacuugaaccugggaggcagagguugcagugagccgagaucgugccauggcacuccagccugggcgacaaaagcaaaacuccgucuaaaaaaaacaaaaaacaaaaacaaaaacagagaaaagaacaaacagaucuuaguuauagucuaauuagcuuucucugggucaguauuuaaaaacaacccuuuuggaguaaucuaacuuuauaauaaauauagucaugucucuugguaucuauggagaauugguuccaugacccccuucaaauaccaaaacccacagaugcuugucucuuauauaaaacagcauaguauuugaauauaacuuacacacauccucccacauacuuuaaauuaucucuggauuauuuauaauaccuaauauaauauaaaugcuauguacauaguuguuauacuguauuguuuagggaauaaagacaaggaaaaaaucuguacauguucaacacagaugcaacuauccuuguuuucugaauauuuucaauccgcaguuggcuaaaugcagaaguguggaacccacagauacagagagccaacuguacguguuaucccuuccuaacuuuauuccauugccgagagaaacucagacuuguuauuucuauucacugacaaaauuauuucucuuuuauuuucuucuucagagaauagcuuuuaacucuuggggcuagauuccauucaauucaauaaacaagcaguaagugccaacuauguguccacuagguggugggaagagaaugagauaagaaauaaaacaucuuuagauauaaacugaaauaaugguagugaaugaauaagaggccugggggcauuuuuagggggcuuggcagggagcucuguuucuuuugaagagcucuuacuuuguucaguaguuaauuuaaauauccuuuguucaauaugugacuuuaguucaaaauucuaugugagaggccuuuugucuucugcuguuguuauuauuacuccuuucaucacaaucuacucgauuugguuugguaauguagagagauuugguuucuuuccagcaaaaaaaaaaaaagaaagaaaaaaaagguuggcugguucaagucacuaccuagacuaaaaaauauguuaauguagaugucucccuuagcuagacuaaguacaagaaaacagaaagacaaaacaaagcugagaagacuuguguuacuuauuuguacaauguaagucguaacuaaagaacauuacauuaaaaaugugguaggaagauguucuuaauguauuuagacaauagguugugaccaacugauugugaccagacuuaagaauguguacccauuugccuguacuuacuguggcucaaaucaaugucauggcauaacaguuagccugaucaauccauuauacugaacaaccauucugauugcagcugugcccaguaccaggccucagucauacaaggauaauaauaauguaagugacccaucaucagcaaugcuuuugauuguuuuucugggguggugaugaacuugugauccauccaccccucacugauauccuuuguacaucauucacagauggccagccagaguucaguguuuaagaggccacauccagaaaaacuaaaacucucuaaucuacucugauuuccaacuuauucauuuaaucaagcacuuaaugaguacuucccaugugggaggcacugugucugucacugugugauggggauacaaaagugagacucaguccuuguuguucguugacaaaugcuuaaacaaauaaggcaaugcaguguaaugcaugcucuaguagaguuacaaccaaguuucugcucugcguaggugagguacaggaaguuucacagaggaagagaaacucuaggaaggcagaauaagaguucuccagaaguaauggaauucaagguaaaaaggagggcuuucuaguuaauagggcaagauaugggaaagcauggccagcucaggaaacauagcuggaaaaugggguacuggguagagaggagauguggagaggacaggaaauuggaaaagcagaaaggggccacaucauggagggccuuguaugcaaugcaauagacuuauccucuaagcaauggggaauuauuuaauuauucuaaguaaaagacauuguuaggucugcauuucaaacagaaaaauucagcagcaagaauggaucagagcgaagaaaacucggaagacaaguucauuugugaauucauuuauucaaucaacaaauauuacuuacauaacaugcaauguaccaagcauuacagacagugaugaagaaaacacacauggccccagaucucauggagcuuacagucuuagugaaagauaaacuacagauuaacuguagcagaagcagcagcagugugaauggagaugagagggcagguguaaaaaaggcagccacaugacacuccauguggagggugagacagaaaucuaggauggcucccagccccuggcucaagugacugggucaauugguaacauaggaagaaaaccagcucugagagggaaaguaauuagcacugggauauucagagggaguuguccaauaagcaacugaaaagaugguuccucaguucacuuaccgggacuagaaaaauugauucacaaguaacaggcaacucagacguucuaaaagccauggauaaugaaugaaaucacgacccaacaccaccaacagauaaguagcugguggaagaacaagcuggugaaaaaagcuggaaagaaaauaucagagauaggggcagggggaucaauagaacucugucauaaaagccagaagaauuucaggaacagucaauagugucaacugccacagagagguuaauggugucguuaagacagucacagaguugugcaaccaugacaauugauuugugaacauuuucaucacuccagaaagagaccuaguaacuauuagcagucaacaccacccccauuuagcccuaacccuuccucaccaccaccuaaucuuagguaaacacuaaucuacuuucucucuacagauuuacuuauucuaaauaucugauauaaauagaaucacauaagaugugcucuuuagugacuagcuucuuucaucugugcuauguaucaguacuucauuucuuuuuauugccaaaucauauuucauuguaugguuacaucacauuuuguccauucaucaguugaugggcaccugaguuguuuucauuuuugggcuauuaugaauaaugcugcuauaaacauuaguguacaagguuuuguaugaacauguuuucauuucucuugguuauaaaccuagguauucaauugcugggucauaugguaucucuauguuuaaccauuugaggaaaugccagacuauuuuccaaagaggcuaaaccauuuaacauucgcagcagcuacaugagaggguuccaacuucucaauaucccuggcaacacuuguuauuaucuuuuuaauuacagcccuccuacugaagcgguaucucauugugguuuugaccugauggcuaaugaugcugagcaucuuuuuauggguguauugaccauuuauauaucuacuuuugagaaaugucuauucagauaccuugccaauauauauauauauauauauauuuuuuuuuuugagaccgagacuuacuuuguuacccaggccggaguacaguggugcaaucugggcucacugcaaccuccgccucccggguucaagcgauucuccugcuucagccucccaaguagcugggacuacaggcaugagccaccaugccuggcuaauuuuuguauuuuuuugguagagacaggguuucaucauguuggccaggcuggucucaaacuccugaccucagguaaucugccugcuucggccucccaaagugcugggauuauaggcaugagccacugugccuggccccuugccaauauuuugaguuauuuaucuuuugcaaauauuuuucccagucuguggguugucuuucccuuucuugauaguguccuuugcagcacaagcuuuuaauuuugauaaaggccaauuuaagacuaaaauauagcuugucuuuuccuuuuucuuuuuuuuuuuuuuuuuuuuauucugaaacagagucucuguugcccagacuagagugcaguggcaugaucacagcucaccacagccucuaccucuucaggcucaggugauccucccaccucagcccccugaguagcuggaaguacagguguauacaaccacacccggcuuuuuuuuuuuuuuuuuuuuuuuuuuuugagauggaguuuugcucuuguugcccagguuggagugcaauggcgugaucuugguucacugcaaccucugccucccagguucaagugauucuccugccucagccucccaaguagcugggauuacaggcacgcaccaccacgccuggcuaauuuuguauuuuuagcagagacuggguuucuccacguuggucaggcuggucuggaacuccugaccacaggugauccgcccgccucggccucccaaagugcugggauuacaggcaugagccaccgugccgggccacacucggcuaauuuuuaguauuuuuuguagagacaggguuucaccauggugaccaggcugaucucgaacuucugggcucaaguaaucugccugcggggccucccaaagugcugggauugcagcccagcuugucuucuuuuguuguuugugauuuugguugcuugugcuuuuuuccuguuguuuuguuuugucuuuugcuacuugugcuuuugguguaacacuuaagaaggcuucaucuaaccugagaucaugaagauuuacucccauguuuuauucuaagaauuuuauaguuuuagcucuuauaguuaggucugugauccauuuggagucaauuuuuguguaugguauaagaaaaggucgucauuuuuuuuaaacuggagaaaaccaagcauacugauaggcuacaggacaagaggcaggaaauagauuucuucugaagucagaucccugaagagacaggguaagaaucuggagagagauacagagacuaaccuuuaccaggaggaaagccacucuuacccuagacaagggggguggugggggaagcaaguggagauggugaccuaacuguaacugugggguaaugggcuauaucuucuuaggaauuuacaaggcacauuagcauaauugaggaucuaugauaaccuucagucaggaaauguguucaguuuuguuuaauccaucauuuuccaaauucaugugaccaagaauuccuuauuucuuagcaccuauuaauauaugacagaauuaggauuucuaggacauauguaggaaacagugaucuaggccaagagcugcaaauuaguggauuuuguguagaauuuggggcaaggaugguuuuuguuugguccacauaguauuuuuaacccauuugugccagagguugcaauuuuuuugugugaaaaaucagaccuuggcgaugaccuugagcaguaggauauaaauaacucccacaagcuuagcguuccaauaauggaacacuaugcauaaaugaguugaaaaucaagaaauuucacaaagauccaaauuucugacaucucuuaaaucuuagaaggucuggcagcaauuuggaucugcauuccaucaaggaaaaacauuacuggaacccaaaugucccaaacagcgcauuuguaccauguccacacucauaaucuuaaucccaauucauuuuacucauuuaugucaccaccugauuccuguaacugaguuuaucauuucuauacuaagcaacccucucagacggaaaaguuccugaagccauucucagaaacuccuuaugcauaaacuccucucccaacauuuucuuuaauaaaugugcucuucuuguaagagcuaugagaaagauugagaagcauuuaugucaggagugacaaaaaaugccaguguaugggccaagugcaacacacagacuauuuuguuugaccugcacaguauuuuuuaacaugagaaauuucacauuaaaaagaaacagacuucugggacuuucuugacaauuaggaagauuugguaacauuagccccuguuuccaugugacaacaguaaguugaagaugguaguaacuucuucaguuagggccggcauuuuccaguuaaccacaguugccaucacuccccagugcuuauaacuggccugauucacucauugccuauuuggcuccuaaggcaucagaauuuguaccaccugauuaaacaaacaaccuuaauuagcacagugcauuaggcaaacaucucaauaucaugaguguuaagugaaauuuuacugaagccucagcuauuucacuaauaaggaaacaucccacucucucccaaauauauauccacauugaaaaaauaacuggaagcaaacauaccaugggaaguagaauuucaggugauuuuuauuuucuucuuaauccuuuucuauacuuuuuccagaguauuuuuuuuaaaucaacuauguauugccuucauaaucagaaaaaaacacaaauuaaauucuaaaaugcaucaacaauauucuucauaaauaaagucaugagaaaccucuagggccuaaaggucaaaauuuuaaccaauugcccaaaauauuaauuuaaaugugcaucaaugagaacacaaucacauaggcuaggcagcagaugaaccaugucaguggcaaguucugaugucaagcaagcuuaucugaugccacauaguuuccuuagaaccaauguuaagcuuccuuggcagcagcuguuuauucuaacccaauaugagacucagucugucaguuaaggcuacauaaauguuagcagagcaaccuugcucaccagauccccauuuaugaagauaccaugacuaagcuucuaaugugcaaacacuucauccucccccucaacucaagauucuucuggccaggcgcaguggcucacgccuguaaucccagcacuuugggaggcugaggcagggggaucaugaggucagaagaucgagaccauccuggcuaacacagugaaaccccgucucuacuaaaaauacaaaaaauuagccgggcaugauggugggcgccuguagucccagcuacuagggaggcugaggcaggagaauggcaugaacccaggaggcggagcuugcagugagccgagaucacgccacugcacuccagccugggugauagagcgagacuccaucucaaaaaaaaaaaaaauucuucuguauggaggcacgccuguaaucccagcacuuugggaggccgaaguggguggaucacuugaggccaagaguuugagaccaaccuagccaacauggugaaaccccaucucuacucaaaauacaaaaaucggcugggcaugguggcaccuagcuguagucccaacuacuccaggggccucccaaaaugcugggauuacaggcaugagccacugugcccagccuaaaguuuccauuuuaguugcaaacauacauaagcaaaugcuauguaacagaacucaaaggucccacaucucccaccuuuuaguccugacuagugacaggaaaucaagcaauaauuaugggaaaauaaaaugaacaccuuuuacuaauaaucuccucuaguuuuuccaguguucuuaguuauuaaaaagauuacuugccaggcgccauagcucacgccuguaaucccagcacuuugggaggccaaggugaguggaucaccugaggucaggaguucgagaccagccuggccaacgugguaaaaccccgucucuauuaaaaauacaaaaauuaguugggcauggugguggaugcuuguaaucccagcuacuugggaggcugaggcaggagaauugcuugaacccgggaggcagagguugcagugagccaagaucacgccauugcacuccaaccugggugacaagagcgaaacccugucucaaaaaaaaaaaaaaaaaaaagauuacuuaaggcugggagcaguggcucacaccuauaauuccagcauuuugggaagccaaggcuggaagaucacuugaagccaggaguuugagaccagccugggcaacauagcaagacccugucucuacaaaaaauaaaaaaaauaaaaaauuaacuaggugugguggcucuugccuguaguccuagcuacuugggagggugauccaggagaaucacuugagcugagaagaucgaggcuguaguaagcuaugauugcaccacugcacucuggccugggcaacagggggagauccugucuuaaaaaacaaaaacaaacaaaaaaacccucagucuuauucccacuaguuauaauuaaguaaccuuuacauauucauaaauaccgauaaagaggaaaacaucacuggaugaucugaauauaaucucuaguagaugcuucaaguacaaagcaaauucuuuugcaaauuugugacuaagggucugugacuguuuuuuucccucauagccaugacacauggugacuggcacauagcauaugcucagaaauuaaaugccaacugaaguaaaaugaugaagauuuaagaugaaaugaaaauuuaauuuuaucauuuucauaucugugcgcacaugcucuuuagcuccucaauuccuucaaauucuuauacaauucacucaggaaaacauucuuuuuaucuucauucuuucuucaacacauccauaaacuucauuuuuuuuuuuuuuuuuuuuuuuuugagacagucucgcucugucacccaggcuggagcgcaauggcugcaacauccgccccccggguucaagcgauucuccugccucagccuccugaguagcugggacuacaggugcccgccaccacaccuggcuaauuuuuguauuuuuaguagaggcgggguuucaccauguuggccaggcuagucuugaacuccugaccucaaaugauucaccuaccucggccucccaaagugcugggauuacaggcaugacaucuauaaacuuuaauacucuaugacuauaugagggugacuagcugggcucccacaugucauuacaaaaaaaaaaaaauggguaaauauauuuaaaacggaaagcuaaauauugccaacagaaauuaggucaacgcuaccaccuguccuaucucuugcauauguaauuauuuuuuaaaaggaaauaugugugaauaccaugaaaguaucccagagccccaccagaauaaaaacaguccccaucuucucccucacugcccucuaaccgaacgugcuuuucucauuccacagaauuuaaaaugcauccuuauuuuuucuuuucugcuuauagcuagaacugcaaaugcauuuuuuuccuuaauaguuucaguucacaaaugugcagaauuucaguuacauuauagcuuuugcagauaagccugggcauguaaccauguaacauugucuccauggaaaaguaacuccaaacaaccaacuuguaaacgaauuuuugaaaugcaacccauuuucauguuaggaaaaugagguccuacuccucaucuuggaagguaauggaauaguggaaaaagaacuggggcuuuggaaugcagcaaucugaaucucaccucacugugcuguuaccagaucuguguccucuggcaaguuacuuaaucucuuugagccucagucuccuuaucaguaaaauggaaaaaguaacaucucucucagagauaaaugauguaauacauauguaaaucaccuagaauagggccugguagauaacaagggcuaaauaaacauuagucccuuuuuccuucucugccauugcaauauucguuugugauuucaguuuucuccuucaaaaaaaaaauuauuuuucauuuagcacaugcuguaagucaggagcucuuuaugaucucauuaaaucuuuacaacucccccaugcgguggguuccauuuacuaucccaugccacagaugaggaacagagucacagagaaguuugucaauuugccuaauauugaugcagaagcuagaaagaaauuauuuaggcaguuggugaggguaaaagaguucucagcaagguuucccuuuuaauaaaaagcagcccccaaaucauuucuuuucuaacaaagaccacccugaaaaaucgagcugcagacauagaaaagcaugcuaaaacuugcaugggugaaugccagcagcuaugccaauaggaaaaggcuaccugggggccaggcauguucaacauggaggcuccaucuucccuuuucuuuuucaaccauguguacaauaaagaaacaggcaauaugaugcaggccagguagagaaccaucugcauaauaaaacauuagcuucuuugcaugcuauguaaaugacacaccugguccaaccaaucuuuugggcccuauguaaaucagacacugccuccucaagcucauuuauaaaacuccgugcauuucaucauggaacugguaacccauuuuucuccaggaucccucucugggcugagagcucuucucuuucuuuugccuauuaaacuuccacucuuaaccucacucugguguguucacauccuugauuuccagcaaugaaccucggguauuacccaagauaagugacauugcuucaauuaucacucaaauaguaaugaugaucucagcacaccuacacucuaauccuaaaccucccuccucccucccucccucccuuccuuccucccucccucccucucucccucccugccucccuuucucccucccuucuuucuuucccccuccccuccccuucccuuucuuuuuuuugacaggguuuugcucugucacccaggcuggacugcaguggggcaaucucagcucacugcaaccuugaccuuccgagcucaaucaauccucccacuucagccucccgaguagcuggaacuauagacgcacaccaccacacucagcuaauuuuuguauuuucaguagaggugggguuucaucauguugccuaggcuggucucaaacuccuggccucaagcaauccucccaccuccgccucccaaagugugagccaccacacccagccauacugugucuuuuuaaaauaagaagaguggggccaggcaccauggcuacgccuguauucccagcauuuugggaugcugagguggguggaucaccugaggucaggaguuugaaccagccaggccaacauggugaauccccgucucuacugaaaauacaaaaaauuagccaggcaugguggugcacaccuguaaucccagcuaguugggaggcugagacaggagaaucgcuugaacccaggaggcagagguugcagugagcugagaucgugccaugccugggugacagagcaagacuuugucucaaaaaaguaauaaaauaaaauaaaauaaaaugagagugggauucaauuaugucuaauauuuuuggcuguuauauugugugauucuguaacucuacagcacuaucagauggcaagaaggacaagaaaaacuucaaguacacaaugggcacauauaaaccaucaagaugcagucuaaccaacugaugucccauuguccugguucuucccagaagcuggaagguuuccacagccaagaucaguuaggcuuaacuagggcuucagcuccuuaacuguuauuugcuuaggcaugaucagcugagucagccuggccuuaaguaacuuuuaaaauugaaccaguacugaccaacacuguagaccccccauuuuuuaaauuacaggugugaugaaaacuugaaaugguaacacaauggcaaaagucuuuuuuuuuuuuuugagauggagugucacguugcucuuguugccuagagugcaauggugcaaucucagcucacugcaaccucugccucccgaguucaagcaauucuccugccucagucucccgaguaccugguacuacaggcgccugccaccaugcccggcuaauuuuuguauuuuuaguagagacaggguuucaccacguuggccaggcuggucucgaacccccgaccucaggugauccucccaccuuggccucccaaaaugcugggauuacaggcaugagccacugcgcccagccggcaaaaagucuuuaaaugcauuuacuaacguugaccauucugcuugcuaauuggagauuauucagucacuuuuacaauauaguaauugaauuuggcuccaggccauaauaaacauucugacccauuaaauuaaggcuacaagcaaaaucacucuauuccuuugcucaagcuacaaacacauuucucacaggcagccacaggcagaauauuauaaguuuuauaauauucaugugucaaauggcaagaccuccaauuaaaaugcucauagaaaagaguaaccuuuaugauaucuguacuuccaaaguuacaccuuuaggcuuuuuuuucuuaauguuuuuuccuuuucaacuacugcaaacacaauuuagugugacuacauaugagcugggcauggacucaguucugaaguugcugaaaagugaaagaagagaacagcuacagcacuuccagagcaugcuggcugagauguauugauagaaaauaagcuguaaaccagcuccagcaauacuauuuguguuugugccuuuugcagauuguauuucaucacugcucuucauagaacauuaauagauuagacacagccuuuggucuaaaacaagaaaaagacuuuuauagaaauguuaacuucauuuccuuuuguuucacuugcuuaccaauauaaaacaucaauacugcagccuagauauugaacaguugccacggacaaccaaacucauuaguaaauuaggcuauaccaucucagauaacuuauucccaguuaggcaaaaggaauaaucagaauuagucagaauugagagaauuacaguauacuagagaguucauugguuuauccaguuugucacuguuuuaaguacagucauacauugcuuaaugacagggauauauucugagaaaugugcuuuuagacaauuuugucauugugugaacaucauagaguauacuuacacaaaccuagacgguauagccuacuacaugccgaggcuuuauggcauagccacugcuccuaggcuacaaaccuguauagcauguuacuguucugaauacuguaggcaacuguaacacgauuguaaguauugguguaucuaaacauagaaaagguacagugaaaauauauuauuaucuuaugguaccaucaucacauaugcagccuuuuguugaaaccucauuacccacaacugcauuaaagacagugcaggcaaagcacguacacacuaagcuacaauccuuuuaucuucauuccucaauaaauaucaaguucacuucuaaugauucauuaaagaacaacacaagucuauauuugguucauaaaugaaaaccaucugaaacuaagaguuuaggugggagauauauaacagcagagagucccuggagaucuagagacaaugugggccaggcacaguggcucacaucuguaaucccagcacuuugggaggccgaggcagguggaucaccuggggucaggaguuuaagaccagccuggccaacauggcgaaaccccuucucuacuaaaaauacaaaaaaaauuuagccgggugugguggcacgcaccuguaaucccagcuacuagggaggcugaggcaggagaauugcuugaaccuggaaggcggagguugcagugagccgagaucgugucauugcacuccagccugggcaacaagaacgaaacuccgucucaaaaaaaaaaaaagacauuacggacacugaaguuuuauuuacuuauuuauuuauuuauuuauuuauuuauuuauuuaucuuuauucuuauuguauuuuauuuuuucuugagacggagucucgcucugucacccaagcuggaguucaauggcgcaaucuuggcucacugcaacugcugccuccuggguucaagcaauucuccugccuuagccuccggaguagcuguaacuacaggugcgugccaucaugcccggcuaauuuuuguauuuuuaguagagaugggguuucaccauguugaccaggcuggucuugaacuccugaccucaggugauccacccaccucagccucccaaagugcugggauuacaggcaugagccaccgugccuggccugaaguuuuaauuuugaauaacuucuugugucucaaaauauucaucuucuguuuuuuucccaaaauauuuuuaaaugcaaacacuauucuuagcuccuggacaguuaaaaacacaggcuauaguuugcugacuucugcucuccauagagaaauaauacaaucagaaagggguuagggaugugauagcccugaagagcuagaauaaggaauuuaaauuaaucuggaagacuggggacaaggcauagguuucugagcaagaaccuuuugagaucagagcuauacuuaagaaagauuuacuuggcaguaauggaaaggaaggagagauuagaagauaacaaucagccuaauccagacugguugcuuugaggaaaaaaagaagaaaaaagauguaaaaggaaagaucaacggaacauuuguuggaaaaaaaaagaagaggaaugguuuauuuaucuggcaagaauaaguaaaagguucaaucucuagacaagaaggagaaaaaaggagauuuuugcauucucauucucuagugcuaucauuauaguauauaacuucagcagacuaacugaggaauuugccuuuuuacagaagcuuuagaacagcccaaguuggagcuuccaguucagagacagagucuucugguauaugucaguugaaauguggcaaucauguuuugguuuuacagauguaauagguaugguaguuccagagaugguuuauuuauuuauggcccuguuuacuccagagaguucccaaauuaggcaagaguauucauauggcuuacauagauauaucauugccuucggaaguuuuaagucauucuucuaugacucagaauuuuuaucuaucuuuucuuguucugacagggaaaaaaaaaaacugcagugcugaaaaugcaaccaauucaacauugaagucuguaacuacucucauucuacggacucaaauuuggaagcuggguaggggggucagagaaaggagggguggaaacagacacgaacacaauuaguucuaauucaugauaacaaccauagucaaauauuuuaguaacacagcaaagggagagagcuucccuuugcugagcagccugggaagagcuucaugaagagagugacaucugcacugggcccauucuaaugagagaggaagggcaacuccaggcagugggaagaguacaaacaauaacgaaaagauggaggggaaauacggaacuuauuucucuuauuuccaaaguggcacauguucauuguuaggguaaaagcacaaacuauggucagaaaaaguuuuucauuaaaacaauuauuuaaccugaaauccuaccauucaaucccgccaccauuuuaguaugcacucuuccacacauacaucauaaacagauuacccuacuguuuuaucucucgcucucuuuuuuuuuuuuuuuuuuuuugagacaaggucuugcucuguugcccaggccagaaugcaguggggcgaucaugguucacugcagccucaaccuccagggcucaagugacccuucugccucagccuccugaguagcugggacuacaggugugcaccaccaugcccaccuaauuuuuguauuuuuuguagagacaggguuucgccauguugcccaggcugcucucaaacuccugagcucaagugguccacccaccucggucucccaagguguugggauuacaggcaugagccaccaagugauugacccuguuuuuucuuacuagcauagauaucugucccucccagcuuggaauacauaucagagucauuaaaaaacacuggcauuccugaauucaagcccuuuccuuaugcgccauccuuugagcucucacuucaacuagauuguguuuucuugcagcaucucucuagguggauccaugcuaccagcuauuguauuuaguuuuucuuuuuccaagugagaucaaaaagguuaaggcaugacuucuuucauauucagcuucaauaaaaucauugaugagaucuuuuagauuuaauaagaauucuagguuuucugcccugcaucucaaaguaagcucauuugcauaauaaaaauauuugcacuccgacaccaccaauuacuggcucgggacaaguuacucaaaugcuuucagccuuaguuuccuuaccuguaaaauagagauaauaaccacauagugcuccccugaaaauaaauuaguaauuuuuuucuuuuuuuuuuuuugagacggaguuucacucuuguugcccagguuggagugcaaugucgcgaucucggcgcacugcaaccuccaaguccuggguucaagcaauucuccagccucagccuccugaguagcugggauuacaggcgcccgccaccacgcccggcuaauuuuuguauuuuuaguagagaaaggguuucaccauuuuggccaggcuggucucaaacuccugaccucaggugaucugaccaucucaaccuccuaaagugcagggauuagaggcgugagccaucacaccgggccaauuaguuauuuuuaaaacauuuacuuuacugauucauuuucaaaaucgagaacacuaugaauccaaauauaaauuaaguaauaaugagucuaucucuagaauuuaucuuuucuuuuuccucccucucccucuuguacucuacacaugcugcagaugugucuuuucucuaucugcacuccuaccacugccugaaggcagcucuuacuaccucuugcuugaauggauggcucuccaaccccagugucucaccagcgcuccaaucuaucuuccucaauacuaccaggauuauuuuaccaaaauuuuauacaucagcuuaaacaccucuguuucgggaggggaacaucacacacuggggccuguagggggaugggggacaaggggagggagagcauuaggacaaauaccuaaugcaugcggggcuuaaaaccuagaugaugaguugauagguguagcaaaccaccauggcacauguauaccuauguaacaaaccugcauguucugcauguguaucccagaacuuaaaguaaaauaaaguaaaaauaauaauaauacaagauuucucuguuuucuaacauccaaugcuuaguauguuccucuucuagaaauuauccuguaaauguacuugcacauacguaaacugacauauuugugucauucuuugccauguugucugaaacagcaacagaucacaaauaaccuuccauaagggucuaguuuaauaaauuaucuacaaccaucaagggacuauuauuuaacugucaaaagaagagaaaguucuguagauacaagcaagaaauguuccccaaaacaugcaaaggaugaaaaaaaaaucaagaaacaggacaagacaguauaacaggucuucauuuguaugaaaggggacuaguuacugccagauugugcacaaacuaucucuagaagcauauccaagacauuggguuucuuaagugcaucgguuuccuaugaggagggaaacuggguggcuggaguucaagggggaaagggagacuuuucacuguauaccuuuaccuuuuaaauuuugaaccaggugaauccuauaccuauucaaaaacugaaguuaguuuuguuuuuuuuaacugauuuaugucgucugagucccuucacaagggacacaauccaccuuaacagucucauuacuaaagcuuccccauucccuaacugcacauucacacccuuguaucuuuguauucacucugcacagaagguauucccauuuucucuggcuggcaaacuuccucaugcuucaaacacugccucucuaaaguggaaugaacuucccuuccugccuuacugccauauuaugcaaaagggccuuuggccugcuuucauuccauguuugcuccuuggcaucagaggcuaaguucacaguccuagcccaaguccgucagaagcuuacauuccagcugggcacgguggcuuacaccuguaauccuagcacuuugggaggccaaggcagguagaucacaugagcccaggaguucaagaccagccugagcaacaugguaaaaccccauucuauaaaauaaaauaaaauaauacacauauauauauguauuuauauauauauauauauauauauauccuauauauauccucacauuuuaccagauuuuuuuuucuuuuugagacagagucucgcucuguugcccaggcuagagggcaguggcacgaucuccagcucaagcaauccucccaccucagccucccaaguagcugggacuacaggcauacaccaccacgccuaguuaauuuuuauacuuuuuguagagaaggaguuucgucauguugcccaggcuggucucggacuucuacgcucaagcaaucugccugccucagccucccaaagugcugggauuacaggcaugagccaccuuacccagccuucaccagauuuuaaaggugccuugcuauucucgcucugguauuaagcucuuauaguuucuauacuccaagaaaaacaacaagaacaacaagaaaugacaauuuuaaguauaauaaaauuguauguguauaauauauacacauacacacaaaaauuagccagacaugguggcaugcaccuguaguagucccagcuacuugggaggcugaggugggaggauggcuugagccugggagguugagguuguagugagcugagaucauaccacugcacuccagccugggcaacaaaaccagacccugucucaaaaaaaaaaaaagaaagaaagaaagaaaaagcagcagcagcagcuuacacccuucagagacagaguucaggccucuuaagauauuaaacauaugaugaaauagcagcauuauucacaauagccaaaagguggaagcaauccaaauguccaucaauggaugaauggguaaacaaaugugguaugcacauacaauggaauauaauucagccuuaaaaaggaaggaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaggaaggaaauucugacauaugcuacaacuuggaugaaccuugaagacauuauucuaagugaaauaagccaaucacaaaaggacaaauacuauaugauuucacuuauauagagcauaucauauacuauauguuauacaguauauacaaacacuguaugauuccacuuacauagaguagucaaauucacagagacagaaagaauggugguugcugggcuaggaggaaugagaaauagggaguuuaguuggggaaaauaaaaagguucuggagguaugugaugguaaugguugcacaacaaugugaauguacuuaaugccacagaucuauacacuuaaaaaugguuaaaauuguaaagcuaauauuauguacauuuuaccaaaauuaaaaaagagugagagacucuugcagccucaaaacaauaagauuauccucacauuucaccagauuuuuuuuucuuuuugagacagagucucgcucuguugcccaggcuagagggcaguggcacgaucuccagcucaagcaauccucccaccucagccucccaaguagcugggacuacaggcauacaccaccaugccuaguuaauuuuuauacuuuuuguagagaaggaguuuugucauguugcccaggcuggucucggacuucuacacucaagcaaucugccugccucagccucccaaagugcugggauuacaggcaugagccaccuuacccagccuucaccagauuuuaaaagugccuugcuauucucucucugguauuaagcucuuauaguuucuauacuccaaggaaaacaacacgaacaacaagaaaugacaauuuuaaguauaauaaaagaacaagagacuaucaaaacugaagcagauuuugaaaaagauccaaagggaauuauagaagggaaaaagacugucauuuaggcuggaugugguggcucaugccuguaaucccaagacuuugggaggcccaggcaggaggaucccuugagcucaagaguucaagaccagccugggaaacacagggagaccccauuauuuacaaaagcaaauaaauaaaaagaaaaaaggcugagcguaguggcucaugccuauaaucccaacacauugggaagcugaggugggcaggucacuugaggucaggaguucaagaucagccugaccaacaugguaaaacccugucucuacuaaaacuacaaaaauuagccugauguggugguggaugacuguaaucccagauacuugggaggcugaggcaggagaaucgcuugaaccugggaggcggagguugcagugagccaagaucgcaccacugcacucuagccugggcaacagagugagacuuccucucaaaaaaaaaaagaaaaagaaagaaaaaaaggaaaagacugucauuuaaauuaaaaaugcagugaauggauuaaauggcauauuagaaacuacuacacaagaauuagcaaacuggaagaacuaaagaaauuaccaagugggaaauauaaacuuuuuuuuuuuggagacagaguuucccucugucacccaggcuggagugcaguggcacugcaaccuccaccucccgcauuccagcgauucuccugccucagucucccgaguagcugggauuacaggcgcaagccaccacgcccggcuaauuuuucguguuuuuaguagagaugggguuucaccauguuggccagguuggucucaaacuccugaccucaagcgauccacccgccugggccccccaaagugcugggauuacaggcgugagccacagggccuggccaaaaauuguuuuaauauccuuuuauuacucaggagaauaguagaaaugcuaauuaauuuaagacuuugaaauuaaauaugcauagcaaaaaacuucuugaaagacuagaaauacugaguauaaccucuaaacuaguaguuaaggucuccuaaucucacuuuucaacucuauuacuccuauauuugguaggaaucugaaagcgauucuaucccuuuuuucagacaagagaaauuaaguuagucuaguauccggaauagaauguacucauuaaauauuugauaagcugcugggcauggugacacaccuguaaucccagcacucugggaggcugaagugggagaaucgcuugagcccaggaguucaagaccagcuugggcaacauggcagaaaccccaucucuacaaaaaauacaaaaauuagccagguaugguagugcacgcauguagucccaacuacucaggagacuaaugcaagcuugagccugggagguggagguugcagugggcugagaucacaccacugcacuucagccugaacaacagagugagacccugucucaaaacuaaauuggcuguuccagaauaugaugaauuguauuucacaaaugcauaauauuucucaacucuaccuggaaagcugguucuaucuuauuacuucagugaauggccuggguaccucuuugggauuuucguuuugcuuuuuuucuuuuuuuuuuuuuuuaagaaaauaggacacuggccgggcauaguggcucaugccuguaaucccagcaauuugggaggcugaggcggguggacugcuuaaguccaggaguucaagaccagccugggcaacaugggaaaaccccgucucugcuaaaaauacaaaaaaaauuagccaggcauggcuguacaugcuuguaguccuagcuacuggggaggcugaugugggagaaucaccugaacucaggagguugaggcugcagugagccgagauugagccauugcacuccagccugggugacagagugagacccugucuccaaaaaaagaacagaaaagaaagaaaagaaaagagaaaagacaauuaaugcuugaguuaaaacccuaaauccuaaacccuaauucuugcuucaaauuggaaaauauauauauacuuuuucccucacuauugcuucuaacaaaauaaauauaaauuaaaaauuuagaugucuaucuuuaaucaugggaaacuggcaaucaaagguucaagcaccuaaaacugugauauuuuccccacaguugguaaaacuguauauuccacaacauauggaauucuacugaaagcuuucauuggcauuuugccuuguugaauaaaaguuagaagcuaugcuuagacauuuuuuuuuuaaaucaacacugccuuuucauuagacuaacguuuaaaauaugacuuaaaaucaugggaaaauauaguaaugauaaaaucuaacacucauaaagcucuuagcucugugucaggaauaguuauaaacauuuuaaugaacuaauuuaacccacacaacaacaacauuaucagccagguacuaucuuuaccuuuguuuuacauaggaggaucaagagaaauggagauuaaauaacuuccccaauguuaccuaucucgaaggugucaacaaugggauuuuaaaauaaggaguuuaaugcuuaacgauuauacuacuguacugcuucccaaaauuuuuaucaugugcugauuaucauaugcugauuuaucuaguaucuauaucuaaagugugacuuugguauuugcuaacucauacuaccacauuuugccaaagauggcuauucugcucauuugcaaaagaucaaaacuaauagagaauucuacauccauguuuauuuuuuuauucacacuuacauauucuguauaauccugugcugggcugugcaggauuauccccaucugcaccccaggacucugugccuaaauuuuuuucacucagagaacacaaauuagaugguccuuuugcaugcaaugcccuguguuaagcaauuauuuacagcuacuuuccuaauuggcaguuaaauuucaccaagauucaaccacagccugauauauauuucuccaaagaagcuuaaaacaguuuuugaucgcagcagaaaauggccuuccuauuuguuuauugaacaaauacuuuacuccacaaggcaagauccuacuauaugccaagcacuaugauggauacuaaaaauucagagacaaacacagcagagccaauauuugccccugaggcucugguggggagauauguuaaacagugaauaaucacacaaauaauuaauuacaauugugauaagcauaauaaggaaaaaauauagaaaguacaugauagaagggccuaaccuagcuuagagguagucagggaaagugucccugaaaaauggacauuuacuaugaaaacugagaauuaguagaaauuauccaaguaaagaacuacagaagaguacaucaggcagaaggaaggccaacaggaagcacuguacuuuggaggaaacaaaaacccagugaguuugggcagccacaagcagaaagcagcugaggccaaugcucaaaggucucuuccuaacuagguggcccaccaucuccucacuccucucauaccauaccagucucgaucugcugcuggccuacugugugugugucacucuucccccacgucccuaccacuucacaucuucuccaugacuccaaagaagaaaaaccacuguauuuguaguaguuaacacacaacucuuuaagaagaauaauauaaauucugcaacaauuauauugguggagaggaugugaauaaaucuuuuuuauaagauuauugauuucaucuguguuuuaggcaacuugaggccagagaccauaucuuauauaucccaacaccuagcaaugugcauagcuggaguuugacaaguaacuuuacuauuuggggagaauuguagaaugagaaauuuaaguguugcugaucuacauuuuuucuuaugagauuuacuagccuauucauauacccuuaucuauuuuaauugcaagaauaaaaacauguuauccaccugguagauaaaagaugagccaguucuccagggauggagagaggacaaagagaaggcuggaaacacaagaaagcuauauaacaaaggucccucaacucucaacucuaacaacugugccauuucuuucuucacagaaagcuuacucaugggaauaacuuaagcuuauuucaaaagaaggaaugacuuugacuuggaugguggccagcugugguaagaagugcagugaaauucagccacuuuccccuuaaaagucauucaacuggaaauuuuaucagugggaaauucucuaagggccaaagacucuauuuucugcagcuuaacaacauuuguaaaacauuucgaguucuaagauucaccaccucucuccucuauacacacaccccacacuuaugccaauccagugugcuaacuucugauagaagugacauggaauuuuuuggaaucuaaaaguucaaaauauguacccaacacaauauaauaucguuuaugaaucuuuguuucucuuugagacuguauaaauauuugguacauagcaacauuugagggcaggaaaagagaaacaucaugccuuccaguggaggcaagagauaaucagcuauccuuauuaucauaaaauaaccuaaaaugacuagcugguauauuaaauaucagaacauaacacacuuaauugaagaacuaccaugagcaggggacuaugguaaacacagaaccaauaauaugaagaauaaaacccacuccuugcccuucagaaaccaacagucuaaagggagacacccuaggagaguagggaggagagggggaagaaaauucgauaugaaauccaucauccaaggacugaugauccaguauaugaggacauaaaaucuacauuuaccaagggacuugaaagaaggcagugaguuccccauuuccuacgucuaauuauacaaguuccuuuuuaccuaacacucuaucccacucuaccucuuugcauacaugcaaugcacauacuuaauuuaaucaaugguuauuugaucccgugucuuuuuuuuuuuuuuuuuuuuuuuuuugagauagaguuucacucuuguugcccacgcuggagugcaauggcgcagcuaacugcaaccucugccuccuggguucaaacgauucuccugccucagccucccauguaccugggauuacaggcaccugccaccaugcccagccaauuuuuugaauuuuuaguagagaugggguuucgccauguuggccaggcuggucucgaacuccugaccucaggugauccaccugccucagcaccccagagugcugggcuuacaggcaugagccaccaugcccagcccccaugucuuaauaaguauguugggaccagaaguucuuucaggaugaggcucauuaucuugaaguuauuucauuucauauuuucugaagcagcaguuuccugucuacagcacagcuccccagauggcagagaaagucuugggguauuuuaagacaguggguuuccucaccuugcuuugaaaauucauaagcaggaaagugaacuagagauggguuuuguuuuuguuuguuuuuuuuuuuaaacggugaaaaggauaagagcuggugcaucuauauauaguuaaauuuguauuuauacccagagaaacauaaauugguuuggaguaacaagaaaaaaugaugcaaaucaaguucaaguagacagaaaugaaaaaggcugagaaauacugacagaagauugcaaauaaagauagauuuucuaaauuuucaacaauaaaaaugcauuauuuuguaacaagaaaaauuauucuuucagacuauaugaagacacagcaugauaaaaagugauuacuaauaguauacuguucaauaguauuauuuuuuaaugcaauaugaaaacuaaaauacuuugauaaaaauacaaaagaacaaaauucccuacuuacauauucucaacuuccuucccuaauaaaucuuuuuguaacuuguuaagaagaaaaagguaggcuggugcaguggcucacagccuguaaucccaacacuuugggaauccgaggcggauggaucacuugaagucaggaguuugagaccagcuuggccaacaugguaaaacucugucucuacuaaaaauacaaaaaauuagcuggguguguggcgcaugcuuguaaucucggcuacuugggaggcugaagagggaggaucacuugaacccaggaggcagagguugcagugagcugagaucucaccacugcacuccagccugggcaacagagcaagacuccaucucaaaaaaguaaagaaaaauaaaaaaaagaaaaagguggcuggccgcagugguucaugccuguaaucccaacacuuugggaggccgagggggugguucauuugaggucaggaguucaagaccagccuggccaauaggugaaaccccgucucuacuaaaaauacaaaaauuagccagguguggugacgcaugccuguagucccagcuacuugggaggcugaaacaggagaacugcuugaacccgugagguggagguugcagugagucaagaucaugccauagccugggcaacagagugagacucugucucaaaauaauaauaauaauuaauaaauaagguaagacagcuuuccuuuccauaacaauucccaauagaaacagaauuaaagccgggcgcgguggcucaugccuguaaucccagcacuuugggaggcugaggcaggcagaucacgaggucagcagaucgagaccauccuggcuaacauggugaaacuccaucucuacuaaaaauacaaaaaaauuagccgggcgugguggcaggcgccuguagucccagcuacucgggaggcugaggugggagaauggcgugaacccgggaaguggagcuugcagugagccgagauggcgccacugcacuccagccugggcaauagagcgagacuccgucucaaaaaaaaauaaaaauaaaaaacagaauuaaauacuaaaauggcucggggggggggggggaaagcagcagccaccuagacaauuugaaaauuauuucaccugaacuuauguggcccacuauauucaaacauauacugcaagacuucuacagauccaagguacagggaaaagaaagacacaugaaagcuuucaaugggacguccuuccuccaauauaucaaauuucuucucuaucuuucagucuuauuacagacuugaauuuucccccccaaaagcuaacucuuaaggauuuacauuauauagcacugaaaguuguugaagcuuaaaaaugccaaggcagaaguuuguuuuuuauucuaguccuaucuguauggaaagguuuaaggguugaccugccugagagcaacaagaacugacugaauggaccuuccucaucaagaauucugaccaaacagcauauucuagaaagaaacaucuacaaagaaagcagcuaaucucugauauuugcucauuaaagacugcuacuucuuuugauacugcccuaaugcugguuuauuauguaaaaauacaccccgcugucggaaccaugaccuaaagguuuaaugaaaaggcugggcccaaaucagccagaaagcaaaaaagcagcagaucaacuuugugauaucuuugucucuugccauaugguucagggaaauaaagauccuuuaaugaggaauucugacucauaguaugagacuacauuguaaccagcagggcuccaaauaauauaucaacaucuggucuaaaucauuaaauuuuaaaaaggcacucccaagaagagaaugcaaaaucccaacgccacuuucagauagaagguaacauacucucacauuaugaauuuaguaagugaucugcauagcugaaaugacucugaaacagaaaaaccacaacccaaaauagccugaacacuuuuguuaucucaaacaaugggcaguuagccauucauuccucuuaguauauauuucacuuguuucagucaaagcccauuauaaauuccaugagauggcucaaauuugacuauaccagauauuugacagcuggggaugggaaauauucacuguacgauaauuccuaauauuauauguuauaaauaaaaauaaaugcuaugcauauguucacuuaauuuaaaaauuuaggccgggcgcgguggcucaugccuauaaucccagcacuuugggaagcuaagguggguagaucaccucaggucaggacuucgagaccagacuggccaacauggugaauccccaucucuacuaaaaauaccaaaaauuagccguccaugguggugggugccuguaauuccagcuacuugggaggcugaggcaggagaaucacuugaacccaggaggcagagguugcagugagcggagauugugccacugcgcuccagccugggcaacaagaaugaaacuccaucucaaaaaaaaaggaaaaaaaaauuuaggcugagcgcagcggcucaugccuguaaucccaguacuucgggaggccaaggcagguggaucacuugaggucaggaguucgagaccaaccugaccaacaugguaaaacccugucucuacuaaaaauacaaaaauuagcugggugugguggcacgugccuguaaucccagguacucaggaggcugaggcaggagaaucacuugaacccgggaggcagagguugcaguaagccaagauugucccacugcacugcagccugagcaacagagcgaaacuccgucucaaaaaaaaguauauugcauaccuauaacccggagaggcauauugucccugccacugaggaaccuacaacuuagugagaugacaaacacugaacaaguaugaguguaauaacagagcaucuccaugcuaugcugaacuacaggcuguggauaaugaggauauuccuauccuacccauuucaaagggugcagugaaagacugggaaguugucagaaggcucuuaaaguuacaauccuggccaggcacacuggcucacaucuguaaucacagcacuuugggaggccaaggcagguggaucacuugagcccaggaguucaagaacagccugggcaacauggcaaaaccccauuuggauauuuguuuaaauacuacuaaaaauacaaaaauaguugggcaugaugguguaagccuguagucccaacuacucgggaggcugcggugggaggaucaaugcccaguaggucgacgcuacagugagcccagauugugccacugcacuccagccugagcagcagagcaagauccugucucaaaauaaauaaauaaauaaaaauaaaaugacuauauauaaaacauaaacacuucauaacuauauaaaugaugaguaauuaaauaaguacagguuaaauaucccuuaucugaaaugcuucagaucagaaguaucucauauuucagauuuuuuuggauuugggaauuuuugcauauauaucaugagcuauauuggagauaggaccaaagguuaaacacaaaauucauuuauguuucauauacacauagcaugaagguaauuuuacauaauaguuguaauaauuugugcaugaaacaaaguuuugacuucuaccuaucaugaggucagauguggaauuuuccacaaguggcaucacgucaauacucaaaaagucagauuuuggagcauuucagauuucagauuuucagauuagagauacucaaccuguguaugaaauaaccaggcuaguuuguuuuuaaacaaauaucuaagaaauaguaaaauucaaaugaguccuauaaaaguaguuuguccuacuguuguccuuacuccaggacuguaacaggaggacccaaucuaagcuacuguugcugauaccagaggacuuuugcccucuuacuuuguccauuuagaguuauaccagcucuauuuauaaaacagcuuuagaaaagcccaauuuuccacuguguggauguaaacaaacauuuaaguugugguuccauuaaaauuuaaacauagcuauagcccugcauauccuugaguuccacaucuauggauucaaccaacuggagaucaaaaauauacaaauacaaauaaaaauaggccgggcacaguggcucacaccuguaaucccagcacuuugggaggccgaggcgagcggaucaccugaggucaggaguucaagagcagccuggcuaacaaggugaaacgcugucucuacuaaaaauacaaaaauuagccaggcauuauggugggugccuguaaucccaacuacucaggaggcugaggugggagaaucucuugaaucugggaggcagagguugcagugagcugagaucgugcaauugcacuccagccugggugaaacagcgagacucugucucaaaaaaauaaauaaauaaaaauaaaaauaaaaaacaauacaacaauaaaaauaaaaauuaaaaaaacaguauaacuauuuauaacauuuacaucauauuagguauuacaguauaaguaaucuagagaugacaaaguauacaggaggaugugcauagguuauaugcaaauaccaugccacuuuauguaaguaacuugaguaucugcagauuuugguauccgagggggguuccugcaaccaaucccccauggauaccgacggauaacugcccaucuccaaaaaucuucuguucucucagucacaugaguaaauguuaaaaaugauuggaacaaaauauaucucugucucuggcugggugcaauggcucacaccuguaaucccagcacuuugggaggccaaggcggguggaucacaugaggucaggaguuugagaccagccuggccaacauggugaaaccccaucucuacuaaaaauacaaaaaauuagccaggcgugguggcacacgacuguaaucccagcuacucaggaggcugagacaggaaaaucgcuugaaccugggaggcagagguugcagugagccaagaucgcaccacugcacuccagccugggcaacagggcgagacugcaucucaaaaaagaaaaaaaagaaaaauacauauaucuaucuauagauauagauaucugucucguucuuacaucucuuuugauguagcaacagcuuuacaaaugaaacuucaugauuccccaaguaaucuacaaaguuauuuuacauacgauuucauucuaacaggcuucaagcuaagcaggcacauauaccacaaaaacucuucaucuguuuugcaggcauacuuuugugcugaucuguaucuacucuaauuucucaaaaaagaaaugcuguggaucaggcgugguggcucaugucugugaccgcagcacuuugggaggccgaggaggguggauggccugaggucaggaaaucaagaccacccuggccaacauggugaaaccuaguguccacuaaaaauacaaaaauuagccaggcaugguggugcaugccuguaaucccagcuacucgggaggcugaggcaggagaaucgcuugaacccaggaggcggagguugcggugagcugagaucgcaccacugcacuccagccugggcaagagagugagacuccgucucaaaaaaaaaaaaagaaaagaaaagaaaugcuaugaaauuggguguggcuaugaaacaagcuuaccuucacaucauucuucucauauaggccauucaugcaggcuaugcuaaagccaggcucuaaacagauacuguugccagacccaggacaaauggaaccucuaugacuaacagcauuccuguugcuucugauucuaggugggaaaccuccacugauauuuaacaacuuugcucuaaguagauguggaaugguggugugaaaaaaagcagaggaucuggaacaacagaccacaguucaaguccagguuaaccagcugugccacugugggcagguuacuuaauuuaucugaacuacaguauccucccucaucuguaaaacggagaccaccacuauaccuacccauagacugcuaugagauuauaaauauaaaaguauuuuaugagcuauaaaugaucacauaaauauucuuuuuauuuacucuauuuuuuccuuagcauaggaauuauauauuaauuuucaaaaauuggaaaauacagaaauauauuaagaagaaaaaaaucacccacccaaacacuguuauuuacuuaacugaaauaaagucuaauaucaaccaaauuuuaaagcaaaaauauuuucagauguuaauacugauaauuacaaaugacaaaauuaacugcugaucuccuuuuaagaucagaguaggcuggacacaguggaucaugccuauaaucccagcacuuugggaggcugaggcagcaguauuguuugaggccaggaguucaagaccagccuuggaaauauagugaaacccuaucucuauaaaaaaaauuuuaaauuagccaggcauggaggugcaccccuguagucccagcuacuaaggaggcugaggugggaggaucuguugggcccaggaguucgaggcugcagugagcuaugaucacaccacugcacuccagccugggcgacagagcgacuccaucucuaaacaacaacaaaacaagagcagagcagucuuucccauuuaucaguguaaagugaagauaauacugcuauuugucccagagcuggucccaagaacauaugauauacaagugaggcccauaaaagucaaggccacaaaaaacucccaaaauaaauauuucaugagcccaaggaguacuuacaacacaugcucucagaugcacuggagaaagcaaaguaucugaagccccauuaacaaaacuggcaugacuauaaugucacaucacagacugacacauuucuaugggccauuuuaaugaaaaaaagaaaaauuuauauaccaugcuacaaaguacucagucuaagacuugugacuuuuucacacugccugcugaauccaagccuucuuagaauuucuugugcccuucuccuauuuuuccuuucccacccuucccuugacuaccuccucuuccuuguuucauuauugaauuggacucacucucuguguuuaaaacugccuuaaauagaguuuuaagugguacaugccuguaaucccugcuaccugggaggcugaggcaggagaaucacuugaacccgggaggcagaaguugcagugagcugaggucacgccacugcacuccagcuuggacuacacagugagacucuaucucaagauaaauaaauaaauaaauacucccacccuacccccucccuaauuguggaguaaaagugaugacccaguugcaaauuuuauauauauauuuauauauauauaucagugaccagacuacuuugcuuagcaaauauacaugaaauuacaaauccuaaugaguucugcccccauaaaaguaaguaaugucuuucuuuuuuuuuuuuuuuuugagacagagucuuccuuugucaccaggcuggaaugcaguggcaagaucucagcucagugcaaccuccaccucccggauucaagcgauucucccgccucagccucccgaguagcugggacuacaggcgcgugccaccaugcccaguuaauuuuuguauuuuuaguagagacgggguuucacccuguuggccaggauggucuccaucucuugaccucgugaucagcccgccucggccucccaaagugcugggauuacaggcaugagccaccauacuuggccaaguaauaccuuucuuaccacaucucuaaauauucaaauccuaucugucuuuaagacccaacucaauguuauauccucugugaagccuucccugauucuccaaucaaaaguaaucucgucuuccucugacuuuccaucauacucuguuuccucagugccacuuaagauuuccaauucagccgggcgugguggcucacgccuguaaucccagcacuuugggaggccgaggcgggcggauaaccugaggucaggaguucaagaccagccuaaccaacauggagaaaccccgucucuacuaaaaauccaaaauuagccgggcgugguggcacaugccuguaaucccagcuacuagggaggcugaggcaggagaaucacuugaaccugggagacagagguugcggugagccaagaucaugccacugcacuccaaccugggcaauaagagcguaacuccaucucagaaaaaaaagacuuccaauucaguaucauacugauugugacaggcaucacacuuauugcuuugacauuggaaggggucucaauaaacaccugcuugauaagugaaugacuauuacaacaauugaaaauuucaucuucaucuaguaaauuuuaauuauggaaauauccaaaagucauuuaggcucaagaacaguaaaugaaguaguugagcucaagaaugccuacuucagucaaaauguacacuuucuugaccaaaauaagacuaauuuggcauacguauguaaauaaucugaaagaaauucccaaagaaaagcacuagaauaaggauauaaccucccaaaguaacucccaagaaauacucacccagauuacauaaauuccagaagauuuguucuaaaaucaguuucauuauuuuaccguaauacuauguuucuuuucuagcaaauucagaguucaauuauccaguucuauuauuucuucuucuaauauauuucugauuaauuccuucuccauuuucccugccacucgcaaguccaggccuucauuuucuucauaaccaaccaauuuuaaaagcuucccaauuugucucccuucccauaguuccuucaacaauauuuauugagugauccuaugugccaauuuugagggcaggaacugaggaccauauaaagaaauaucagaccaggcacaguagcucacaacuguaauccagcacuuugagaggccaaggcgggaggauugcuugagcccagggauucgagaccagccugggcaacauaacaagacccugucucuauuuaaaaccaaaauaaaauuuuuuaaaaagagaggaauaucagacaaggcuugaccuccaggaacaaucuugaagcauguacagaauccacauauuuaacggucacaguuggcaccaagaaugugaagcaauggguagguccucuggccuccccaaaacacacuauacuauucucacacgccauucucacgcagucuuucucacacacuauucucauccuccuuccccuccugcucucuuuguucauccuuuuggauaaggccuauguuacacugcccauaugucacgcacuaacuucaucuccaauuucucuccaacuugucuccugagcugcaaucaagauaaucuacuugcuguaaccuggaagugacuuacucacaaguaccuuuguucaugauuaacuauuuaucagcacaauccucccuacuuugucucugcuaacccauagcuaccaccaaucucaaguccccucuuuuguauguguuggaaaguauauaacuuaacuacauaucauuguuuucaucuuauaaccuuauuucuuuuguauuugucucacaguguguauuacaguguuuccuaacuaaggccguauaucacaaucaccuauggagcuuccuaaaaaauacgaaggccuggccgggcacaguggcacaugccuguaaucucagcacuuugggaggccgaggcgggcaaaucacaaggucaagagauggagaucauccuggccaacauggugaaaccccgccucuacuaaaaauacaaaaauuagcuggccacgguggugcgaaccuguagucccagcuacucgggaggcuaaggcaggagaaucacuugaaccugggaggaggacguugcagugggcccagaucgugucacugcacuccagccucgugacagaggaagacuccaucucaaaaacaaacaaacaaacaaacaaacaaaggccuucagcuacuugggaggcugaggugggaggauuuuucucaguccaggagauggaggcugcagugagcuaugaucacgccauugcacuccagcgccugcgugacagagcgagacccugucucaaaaaaaaaaaaaaaaaaaagcaaaauacaaaggccuugacccgugggagcuggacaucuuaauuucuaaaaagccucacugaugauuuucaugaacacucuuaagcugagaagcacugauuuauugcaguguuuuccauauagcagacauucaaugcuuauuaauucauggcauggaagcccauaaauaacuuuucucuaaauagccuaaccagauaucaaccccuagacuacacuagcucuguuccaagugcaacaugugguuuuaagauuucauuuccugaaguacuacauggagagacacuauuaccuugucucuuuacauuguuuccuauuuguugaaaaauggaggccuggaaugcagccauguuagacaacacuacauaagaauguacucuggaguguucuguucaaauuaguuauaaaaagaagaacaauguacaaguagacauugugaaugaauacagcauucuuacugaaugaauagauucuuacuaaagcuauagagaagaaagaucaggaauuuggucgguggugucacccugucuuccuagcuaccagucuccuaaauugcuugagacaguccagggaccccugaagacugaggaagacuuucagcugcuaaagagccucuaagugcacuaaagugcucaaaucagaaaaguaacccaagccccacccagacagacccacaguugccgcccaacugcccugacacacacuauuuacacagcucagugggggagcaguaugaacuuuuuccaaaauuguuccucacaagcaggaccagucugagucacccacccagggugggaaagaaaagugugacauuagccaggggagucuugggagacuggucucagcaccucuuuuuucccauuucagacgugggcuccaccuccuccaggaaucaccucgguuaugagucacagcuguggguuacaggggucugcagagccaccaggaaaguuguggauggggagcggaugccccagccuucucuccggcaggggcggcagaucccagauuccacaggccucucccaacagcuccaucuugcuuccugccaggaggaggggccaaggagggcccccgagucuagaaaggccccagugggaggaggccguuugacagcagguaacgccaggugaaaauguccacaggagggaaugaaaggaagggcagcagggcugagcggaaggaaaaaccgggcuuguggucacgaaugacugcauaaaggugugagagugccagaggagugagcauaaguaaaaugcccaggagggaggaggaggcgacagagagugaggcaagugaauaaaagggcggaauacagggagcucuggggagcgggggugggcgaggcgggucucagggugaggggcagaaguauuagaaaggaggacaacguggcucaaauaaggaucccuagaagagaaggcaagggauccgugggaaggcccgcucucccucccccgcacagccagaucgaggaggccuaaaaggcgcugagagcgaggaagucaacgugggggcgaagccugcgcggggcagggacccucggacaucccagcaacucucauuuauugggugucugcugugggccacacgccgcgcgaggcacuccacgaauaauaccucgccauaucuucacgacaagcccgcaaggcagccuuuuucaugacugcucccauuuuauagaugaggacacugaggcccggagaggcucaggacucgcucaaggucacagggcggagaagaggccauucgaacccucggcgccuggcuccggaacccacgcggaaagccacggccagcgagccggccacaggcagccgcgacgcgggccggggccccggggauaccucccgcgcccgcucccgcgccaggcccugcgcgcucacccggacgagguugcugacggccgccugcacggcggccacgggcgcggugaggucaggaauggcuuugccguccaccucgcccuccucgugcauuaucaccaggugggagaucugcugugccaccggcuccaggaugcucucgaucgugcgcguaugaaacacuggcaucgcggcggcgagcggggcggcgaaccgcgggcgacagagaaguaggauccacggggccgggaaccggcgaagagacagacugugcagcgacuacggagucggggcuucccucggcguaaccagccucacgggcuccccgccccc

SEQ ID NO: 17458 - RNA, 34117 nt, Homo sapiens
gcugucauccacaaucauuggcucuauccgucggcaccaacagcgaaugccccgcccauuccugaccccgccuccccuaccaugagggaccccagacugcguuaggcagcagaugaccgccugaaucuagauggagagaaacccaccauuuuucuaggcccuggauuauguagaagauuuagauacuaagccucaagagacgucuuuccucucauuuacggucuuccugcauauuuaaaauuucuaauacgguagacagagucggugucuuugaagcuguuaaucaggcaauuuccugggcacuccagcugcggguccucgcggccuucucggcuucuccagcuucgguaggagaggauccggcgccgaaucacugacuggcacagguguuggggugagugugaggggcgggaaaucuguggacuggggacagcuccaaaacccgggaguaggcugaauagcuggggcccccgacuccgaucugggcucuaggagcgucuuuggugcuguuggcccgggccucgcuucccccccacucccggccuuccgggcuuucucgccagcaaggccagaagggagcgguccaccugcagcccaguguucucaggcgccugagccccggaggucaagcuuacuggguucccccucuauagugagcuggaguacagacggcaggaaucucagucccagguuucugcuuuggaggacaaaaccccaaacggaccugagcagacguccuguuagcggguggugccuggaagagccuggggugaggaaugcagugagaaggguguugcaguucuucaggagagagguaacgggguucuaagcugagcagguggcagugaguguggaagagugacgggcgauguggcuguuuguauuugguagauuuguuugaaccugaaacuuacagccuuaugugugauuaagaagauggugccagugacaggaggagguauuuuauggaguuugaguuuuaucgaauuugaaacagugguuuacauggagauuguagaaagacuuuaaaaaaaauuaugagaauuaagcccgaaagacuuucaaggugagacccaaaacagaugaaguuucauauaaaaggguaagaaguauuuuuguuuaggagaaaguuaucaaugacauaaaaugcugcaauggucagaggaggaagcugaaaucagaauaggucguuggauuuuauaauuagaaagucauugagcuguuugagagagaugcuuuaauaguaacugaggaaagacugcaaguguagaccaauccuucaucauuuggggcaugaagcaagauuauugagaguggcaaggugggggaaaguuugggguuuguuuuaaagaauacaagauaucuauuugggggcaggaagcaagcaacuauuugaagauucaagaaaaagucuugucucccagaagagaaggaaaggaaugggaucaaguuacaagugaaaggauuaauuugggaaagacagagggacacuuucaauugacacuauaggagaagugaagugaaugagguuaaugaagaauuaucuuaauuuacgaaucuuggccaggcgcgguggcucacgccuguaaucucagcacuuuggcaggcugaagcgggcggaucacaaagucaggaguucgagaccaaccuggccaacauagugaaacccugucucuacuaaaaauacaaaaauuagccaggugugguggcacacgccuguagucccagcuacuugguaggcugaggcaggagaaucccuugaacccgggaggcggaaguugcaguaagcugagaccucaccacugcacuccacccugagcgacagagcgagacucugccucgaaaaaaaaaaaaaaaaaaaaaaaaaaaaaaaaaaaaaaaccuuacguaucuuuaggaaagcucucuuugcaacaagauuauauuuucuuacuuaaucuuaugauuuuuauuucuaaccauuuaauauaauauacggccaggcacgguagggcucaugccuguaaucccagcacuuugagaggcugagguggguggaucacgaggucaagagaucgagaccauccuggcaaauauggagaaaccccgucacuacuaaaaauauaaaaauuaucugggcgugguggcacgugccuguagucccagcuacucgggagguugaggcaggagaaucgcuugaacccaggaagcggagguugugguaagcugagauugcgccacugcacuccagccuggcaauagaguaagacuccgucucaaaaaaaaaaaaaacaaaccaauauacuaugggcagauggagugcgguggcucacgccuguaauccuagcacuuugggugggugaggcgggaaaaucacuugaggccaggagcuggaaaucagccugggcaacauagcgagacuccaucucuacaaaaaauuuaaacauuagccaggcuuuguggcaugugguuguaguccuagcuacucaggagguagaggcagaaugaggcagaaggaucacuugagcccaggaguucaaaguuacagugagcuaugauugguccacugcacuucagccugggcaacaaaacaagacccuaucucuuaaaaaaaaauacauauacacauacgcuaugggaguucuuugcagauuuaaauauuuuuaaguagcucaguacugugucaauucaugaguagcacaugguauuuacagagaagaggacuucucucucccuuuggaaaugaccucucucccauuacacagagaaggagagccaucaucugccugcagucaaguauacaaaccuucccuucaaucugaagaguagaaaguguuccuucuccuuagagaaggcaaacccuuugaccuagucucucaguagcauccucuccugcuaugucaggguccucuuuccguuuuucccucucuccuaugucagcuuuucccccucuauucacaccuuuccuucagcauuugaauguauucuuccuucacuuuaugaacugcugcauuuauuuuccugucuuuucauccucuucacagcuagacuucuugaaucuacucuacauaucucuauuuuuuuacacuucuugcuauuuauuucccagcccacugcaaugucuuauuucuagcauuccacugaacuaccaccaaaacuauuuuuuuuuucugagauggagucuugcucuugucgcccaggcuggagugcaauggcaaucucggcucacugcaaccuccgccuccagaguucaagugauucuuccgccucagccucccgaguagcugggauuacaggcgccuaccaccaugcccagcuaacuuuuguauuuuuaguagagacaggguuucgccauguuggccaggcuggucucgaacuccugaccucgugaucugcccgccucagccucccaaagugcugggauuacaggugugagccaccgcacccagcccaccaaaacuaccuuuaccaagaucaccaguguccucuguguguuaaaucaugcauucucaaagcagauaaaaacugcuucuugugaggugaaaaaaauauaauacucuuuuuauguguaaagcacaaauacaauacauaaacagagaauauucugugguauuaaaauuuuauggugauauuaauuagcuucauuuaauuauuccacauuucauaaaucauaacaucugguaccccuaaauauauacaacuauaauuugucaauuuacaguugaaaaagaaagaauaauaaaaaguuuuaugggugaggaauuugauuggcaggguggugagaagauggagucuaaaagggcuccuuagcaggcauuaaggaaaagaaaguuuaaaaaacacucuuaaaucaacagacauuuucaauucuuuuuuguuguuguugagauggagucucgcucugucauccaggcuagagugcaguggcgccaucucggcucacugcagccuccaccucccggguucaagcgauucuccugccucagccuccagagcagccgggauuacaggcacccaccaccacacccagcuaauuuguugguauuuuuaguggagaugggauuucaccauguuggccaggcuggucucgaacucccgagcucaggugauacucccacuuuggccucccaaagugcugggauuauaggugugagcaccacgcccagcugacauuuucaauucucguagcuuaaccucuuugugccauguaacaguauuuaccacuccauucuucuggaaauacacuaauaagcuauaguuacuaaaaaccacccuguuuuuuuuuuuuucuuaggacucuucagucacaucuuggucauucuuuagguccacuuccuugacccaccuccuacucaaauguuggaguuccugccauaagcucucuucauacuaugcacauucuuucuuuuguuucaauucuccuuuugauuaauucccauuaacaaaaaauccugauuacuuacaauucugauuccaaucuggcuucucuaaagcaccagaaggguauauauaauaguuuuuugaauauauuuauuugggucagauguauccagaauuggucaaauuacacaggaccaggccaagugacacaucucucucaucuccacacacccccuccuccaagccuaaauguuuuuuagcacaaaaccuaaauguuucucuuaucuuuucacuguaccccauccucauagucaagacucuagaccaggccaucaccacucaucucccaacuggugucacaguguucaguuaccgauuauccaguuuccgcaguguaauuaguaugaucuuucuaaaaauguaaaucggauugcaugauuaauuaaaaaaauuauaaaaugacuuuacauugcacuaagaauaaaguccaaacuccuuaacaaguuuagcaugcuccaugaaccaaucagucucugcuuaccuccuuguccaguuucaucuccccucuucccuccaccuuccauauuugcuaaauuuauacuggauuuauuugucuuguguucucucucaccucuaagccuuguagauucccacagcacacuauauuuccuguaucaucguaggaauuacaucuuaacuguauuaaguugucuucucugcucaucucuaaaugcugugaguauaggaacucuaauuuuguuuguucuuauauacccagugccucaaaacucuguguugaaugaauauguggucaagauauuggcugagaaucagaagaguagaugcuuuucuggucucauucucucaaguucaguauaggcccuucugugccuccaucauauuauauauagaaggaauacauuuuuguuuuuagacacugucuuccaagaauauuuugacuauuguaaaugcauugcuugugaauuacccaggaugauuauaaaauguuuaguaaaaaggauuuaugauguauuuaagcugcagucaaagcucuggugggucugccucugaacacaguuucuucuaguggcuuuuaaauaagcugggagaauucuguuuuaugacucaaaagccacuaggaacaaaaagaugguugugguaauaaugaguguguaguuuucucagaaaguuuaugaaaauaauaauuaaaaaaauaacugcagcuaccaaaaggacgauaaauaaagaaacaggcuaauuuacacugcaacaugguauuauuuaauuguuauaugcauuagaccuuggucauaauauggauagaagaaguaagcucucuuuuccuauuauagaagguuaagauggguuuuaaagcuaagcacagucgagaacuuacaaguguuaugcuuucaucucagcacuaaggauaacaacaauaaaucuaggaggcugguuuaacuuucuguauucugagaccugaacuacugccaauaaaaacaacuucgguggaaacuuuccuggaaagaauuuuucaccagcuuaagaggaugaguagagaucuggcccuaaaauaaaguaacuacaaaaucacuuacuuucaaaacaagcaacucuuucagaguguauuguggcaaaggagcacuauaaauccuugugaacuauauuuucgauaggaugaaugauuuuagauaaccugugucggugcuuuuaaauauaacuuccacucuaaauaauuuauuaaacuuccucagcauaacaacuagaaugucuuuugccuccuaacuaaacaagaaaugucuuuuaccuccuccucuuaaaucauaagcuaggcugggugcaguggcucaugccuguaaucucagcacuuugggaggcugaggcgggcggaucacgaggucaggaguucgagaccagccuggccaacauggugaaaccccaucucuacuaaaaauacaaaaaauuagcugggcaugguggcgcaugccuguaauccuagcuacucgggaggcugaggcaggagaaucgcuugaacccagcaggcggagguugugguaagaggaaaucgugccauugcacuccagccugggcaauagagcaagacuccgucucaaaaaaaaaaaaaaaucauaagcuaaagcagcacauucaugcacuguucaauauauuaacuacuaaccauauaugguuauuuaaauuuaaauuaauuaaaauuaaaacuucaggcuaggcuugguggcucacaccuguaaucccagaacuuugggagaucaaggugggaagaucacuugagcccaggaguccaggaucagccugggcaauauaggcagacuuugucucuacaaaacaaaaauuugaaacucagcuguguguggugaugcacgccuguaagcccagcuacucaggagacugaagugggaggaucgcuugggcucuggaggugggcguuggagugagccaagaugacgcagcugcacuccagccugggcaacagagcgagacccuaucucaaaaaaaaaauaaaaauaaaaaagccgggcaugguggcucacgccuguaaucccagcacuuugggaggccgaggcggguggaucaugagguccggagaucgagaccauccuggcuaacauggugaaaccccaucucuacuaaaaauacaaaaaauuagccaggcgugguggcgggcuccuguagucccagcuacucgggaggcugaggcaggagaauggugugaaccugggaggcggagcuugcagugagcagagaucacgccauugcgcuccugucugggagacagagcaagacuccgucucaaaaaaaaauuaauuaaaauuucaaaaaaauuaaaacuucaguauuggguacauuagccacauuucaagugcucaauagccauggguguaguggcuaccauauuagcacagauaaaggacauuuccaucauugcagaaagcccuguuggacagugcuguauuagaacguguuccuaauaauuagucucuacaaggcagauaagagcaggagcucagaauucagcuggauuuagguuugaauccuagcuuacugcgugaucuuagguaauugaccuaacuuuucugagaugacauugucuuaucuguaaaauggggauaauaguaguauuuaugguguagcauugugaaaauaagaugagauaaagugucuagcauagugucuggcccauaauaaguacucaauacauuuuagauaguauuaauucauuuauuauucauuaucuuuaaugaauaaaacacuuugaauggggacugaguacaguagcuucacuuugggaggcgaaggcaggcggaucacuugaggccaacauggugaaaccccauuucuacuaaaaacagaaaaacuagcugggcaugguggugcacaccuguaaucccagcuacugaggaggcugaggcacgagaauugcuugcccaugggagacggagguugcagucagcagagaucacaccacugcacuccagccugggugacagugggagacucugcucaaacaaacaaacaagcuuuguucccaaguagcugggauuacaggcgcacgccaccaugcccggcuaauuuuuguauuuuuaguagagacaggguuuugccaugcuggccaggauggccuugaacuccugaccucagguaauccaccagucuuggccucccaaagugcugggauuacaggcgugagccacugugccuggccaaaaauaaccacauugaauggggccaaaagauuaauuuuugcaaagaaugcuguguuccauaugugacucaccugaagugcccaaaucugagucugcuuguggauuacagugcuccacuugaagucauacauuauauauuucagaugcugauuuucuuccaagaaaaagguguaauaauaaaaauuuaguugcagaucuuaugguuggauauuccuguuucauuuaaaaaaugaaaaugaaaaguuuaucagcuaaagauuauaguuaaaaucagcagguucuauauagcaagucuaaguauucuaauggcacuuauauuaauacccagacagaaauauaagacacaaagcaagccuacuaagcaaagcaucugacuagauaaaguagaaaaauuuggcagguuccaacccugaggugucagaguuuauugcuaauaacucaaguugauuucuuggcuaaacagagggcuuuaaacaaagaaauuuuuugguucuaauuaaacaggaacccuaaacuguuaacaguauucauacuuuauuaauacaauaauuacuaaaacauaucuuaguaacuaguauuauugauaacuacugaacaugugucgaaugggaagaggagaucaucaccacauauucuuuaaaugucagccgcuuucauaaaagaaaggguugauguuguuuucugucaacagaaucaaaugaaucaauucuggaaagucuuccuuuccucuuuggaauuuaucuucauucauagaaacuguauucauaggucuuaaauucuuucuucuuagacuauaguacuauuacuuggaaugauugagccacuagacuaaacaccugauacuggugcuuauacacguaaaagauaggaacaagguaagauaauuagacauuuuuccauugucccccauauugcagggacaauaaacuucuuauaggaagcauaacuaacacucagaaaguaugcaaaucacaauguaaagccuaaugaguuaucauagaaggaacacagcuuguaaacaucaugcaggucaagaaauaaaacauuggccaggugcggugucucacuccuguaauccuagcacuuugggaggcugaggcaggcggaucacgaggucaggaguucaagaccagccuggccaacauagugaaaccucgucucuauuaaaaauacaaaaaaaaaaaaaaacuagccagguguggcggugugugccuguaaucccagcuacuagggaggcugaggcaggagaaucucgugaacuugggaggcagagguuucagugagccgagauaacaccauugcacuccagccugggcgacaguguaagacuccaucucaaaaaaaaaaaaaaaaggaaaauaaaaaagaaauaaaacauuaccagcacucuaggagaucauccccauggcccuccacucuccauaaaggaaaccauuugauuuaacguagauuaguuuugccuguucuacaacuucauauaaauggaaucauacuguguauauucuuuugcaucuggcuucauuuauucaacaucguauuuguaagauucguuuguauguauauauucuuugaguaaaugucuuuucaaauccuuugcccauuuuuuaauuggcuuguuuauuuauuuauuuuuuauguuuuagaggcaaggucucccucugucacccaggcuagggugcaguggugggaucauaguugacugcagccucaaacuccuggacucaggcaauccucccaccucagccucccaaguagcagggacuacagguaugagccacuaugccuggcuaguuuuuaaauuuuuuuauagagacggggucucaaacuccugggcucaagcaauccucccuccucagccucccagagugcuaggauuacaguugugagucaccacaccuggcccuucuuauuauugaguaaaaguucuuuauauuuuccggauaggggucccuuuaagauauaugguuucaaauauuuacuaucauuuugugaauuuuugcuuucuugauaauguccuuugaagcacuaaguuuuaaauuugauggacucuggguuaucuauuuuuuauuuuucuugucuguacuuuugguaucguaucuuaaaaaacauugucuaauccagagucaaaaucuaugcauauuuuuucuaagaguuuuaucauuuuggcuuuuccaauuaggucuuugauacauuuuguguugcuuuuuguauccaauuucauucuuuuguauguggaaauccaguuguuccaguaccauuuguugaaaagguuguucucucuccaacuggucacccaggucuuggcacccuuguugaaaaucaguugaccauaaauguaaggguuaauguucuauugaucuguaggucuguccuugugccaauaccacauaguaguuuuguaguaaguuuugaaaucaggaagcacgaguuauccaucuucguuguuccuuuuuuuuuuuaauucaaauauauauauuuuuucaaucuuuuuaauucuacauauuuuuguaagcauccccccaauucuuguuucauaguaaaucagacuguagaugaagcauuucagaccuuuugucaaucaugucaagugugaggggaagucuuuuguaagucagccaaguauuucaaaaugaaaagcuuuuccaaaaguaaaggcagaagaccccgcuuugaaggcgcuggucggcacagaagggcuugcaaagguauguagggaaguccaccgguuacagguguaaggugaguuuaaccuacggcgaccagcuggccaggagcgccccaaggcagacgaggacguggggcuugggcgcacggccgccugcagccaucucgccccagauccuggcucaggaaacgcaggcucgggcugggguggaugugugcgccccagggcccuggcacccgggggaccgagggcuccucccagguccuuggaacagcagaguggcucccaggaaggaugcucagcugcaggugggggucccugcucccaagcacccuggccagggaggaauggcgcaccccaccccguucgccccuguuguuccuuuucaagauuguuuuggcuguugaucuuuuucaauuccuuaugaauuuaggauuagccugucaaauuccacgaaaaggcagcugggauuuuuuuuuuuuuuuuuuugagauggagucucaaucugucacccaggcuggaguacaguggugcaaucuugagucucggcucacugcaaccuccgccucccggguucaagcgauucuucugccucagccuccugaguagcugggacuacaggugcgugccaccacgccuggcuaauuuuaguagggacgggguuucaccgucuuagccaggauggucucgaucuccugaccucgugauccacccaccucggccucccaaaguguugggauuacaggcgugagccaccgcgccuggccuuuuuuuuuuuuuuuuaguagagacagaguuucugcacguuggccaggcuggucuugaacucccgaccucaggugauccaccugccucggccuccccaagugcugggauuauaggcaugagccaccacgcccggccugaaauuguuuuauuucauuuucaguuuuguuuuguuuuuuuuuuuuuaauagagaugaggucucacuauguugcauaggcuggucuuaaacuccugagcucaagcaauccuccuuccucagccucccacagugcuggguuuauaggcaugaguuacaaugccuagcccauuuuuaguauuuuauagcuauaguggauagaaauauaauugauuuuuauauugacuuguguccugcaagcuugcugaacuaaauuuauuagcucuaauagguuuuuuuuuguguguguguggauuccuuaggauuuucuauauauaagauuguaucuucuacagauacaguuuuacuucuuccuuuccaauuuggaagccuuuuguuuuauuuucuugcuuaauugcccugguucaaaccucuaguaccauguugaauagaaaugaugggacugggcauccuuguuagguuuuguuauuaaggagaaaguguucggucuuucaccuuuaaauauaauauuagcugugggguuuucaucagguuaaggaaauuuuuuuuuuuuuuuuuuuuuuuuuuagauagugucucacuuggucacccaggcuggagugcaguggcgcaaucuuagcucucuacagcgucgaucuuccuccugggcucaagcaauucuccugcuucauccuccugaguaccuaggacuacaggcaagugccaccaugcuuggcuaauuuuuguauuuuuuguaaagaugauguuuugcccuguugcccaggcuggucucaaacuccugagcucaagcaauccgcccaccucagccucccaaagugcugagauuacaggcaugugccacugagccuggcugaggaaguuucuuuuuguucuuaaauggcuuucuuuuuuuuuuuuuuuuuucguaaaaggauguuggauuuugucaaaugcaauuucugcaccuuuugaaaugauuguuuuaguucuuauuguauaucauguugauugauuuuuguauguugaaccagccuugcauucuuagaauaaaucccacuuggucaagguguauaaucuuuuuguguauguuaaaugauauuuaauguauaauaaauuuaaaccuuucuuugccccaacagaaaaugauccacagucuauuucucauaaacuguuccggugacauauuucuagagaagcacuggaagagcguugugagccagucugucugugauuauuucuuugaagcucaagagaaagcugcugauguugaaaauguaccaccugucauuucaacaccucaccacuaccucaucaguaucuaccgggauaagcucuucuuuguaucugucauacagaccgaagugccaccucucuuuguaauugaguuccuacaucgaguugcugacacuuuucagguugguuaucuaucauaccuuucuaaguuaaaugacccaaguuagcugaaggugagacaugauuauauuauuuaauuacccagguuuugauguuuacugucugucucucucuguuuaagcguaaauucauaagcccuuuucugugugguauacaguuacacacauggcugcucuauucacuauuuuuuauauguauuacagauuacaguuggcucuccauauacauggguucugcauccauaaagucacccaaccuuacauggcaaauauuugaacaaaaaaaucgaacugaacauguacaaacuucuucucauuauuacuugaacaauacaguauaacaaauaguuacauagcauuuacacuguguuagauauuacaaguaaucuagaggugauuuaaaguauauaggaggauguguauaaguuaugugcaaauacuaugccauuuuaugucagcgacuugagaauugugaacuuugguaucuacaggggauccuggaacuaauucccacaaauaccaagggaugacuguauaucaucaggaaacaauaaugcccuccgcauacaguucucucaauggucucaagauuuucauugguuaugaacucuucuauauuuacauuuuauuauuuugucuugcggaauauaccaaauaauuuaagcuuaucuauauguauuuugggauaaucagggugaaugaaguuuauagcucaaauuccaauuuaauguuucaauacuuucugguauaauauguaauaggaauuaaauucaaccuagaaauaucaagaaaauauugaggaauaauauuaggacuauagagggguuuuuuuuguuugcuuguuuuguuuuguuuuguuuuguuuuguuugagacggagucucacucuguucccuaggcuggagugcaguagcaugaucuuggcucaccgcaaccuccgccucccggguucaagcaauccucccgccucagccucccaaguagcugggaccacaggugugcaccaucacacucagcuaauuuuuguauuuuuaguagagacaggguuucaccauguuggccaggcuggucuugaauuccugaccucaagugaugcauccgccucagccucccaaauugcugggauuacaggcaugggccaccaugcccggacuauagaggguuuuuucccccgcucuguuuuauauauguucagcagcuuaagcaaugaauuaugcuacucuaaguuuauucuucagaacaaaaaguauuuagcaggccuuucuuuuugccuuccauugugugauauuuuguguguauuuugucaggacuacuuuggugaguguucagaggcugcaauuaaggauaauguggucauaguauaugaacucuuagaagaaauguuagacaauggauuuccacuggcuaccgaaucuaacauuuugaaagaauugauuaaaccaccaacaauucuacgcucuguugucaacucuauuacagguaagaugaaaacauacugugcuaguaacugagcaauuaaaacuuuguaaacaacucauuauugcucaugaucugacauauuauuaagguaguacaauuuggccauaauuaaaguuacugguaaaguuaaaauggauguacuauauauuuauuuucauggaaagaggcuagaccuuaagugauaaagaacuuuugguuauuacucuuuuuuuuuuucuaaaacaccacaacaauauuauuaccauuauuuaacacuaaauacuaagacugaauaaauuguuccaguuauuccuaaagaagccaguauaugagcccacuuagaagagaauuuaguccauuuauagacuggcauuuuaauauuuaaaauagcauuacauaacugguaugcugcuacuccacaauuacuagagaauagaaaauuuaagacgcuuaaccacacaguacuacaaucuccuccaagucuuuguuuuuaugcauucagaagauguauuaagaaaaaauaggaaauaguuuacuuaugagaucucaugcauugugggccuguacuuguguuguaagcuuccagcuggguuuaauucuugaguguagcuagaaauuaggcacauccagauaccaauauucuuucgaaagcauuaaagucuuuuagacaaagauuccuaugaaauguuauaugccacuccaacuccacugucaaccauuguaaaccccuguccagugccuugaccuaaaaaugaggugagagaggccuauaagaaaaagaucauucagcagcucuuuauucauccuuuguguaaggacgaauguuaggagaaauucaaagaaagauaagauggugugucuguacuccuaaaacuuauacucugaaugggacauuggaaaaaaaauuaaguaaauaacuguauaagacuuuaaaaagcaauuccauacuucacagauaaaguaauagcauuggaaaauaaauacacaugauguaacguuaaauugaaaagucagcacaaaacugaaaaaaauuauucuuauauauaaauauucacuccgacaaaaaaguauuuacaaugauuauacccagcuaaauacagauuauauuuauuuuugcuuuauacuuucuaauuuuccaaaauaaacauguauuuuauagucagagaaaaguuacuaaaauauauaaugcaaaacauaacagauucauuagauaguguauuacaaaguucaagagaaugguuccauuaaugaaguaaucccuccugaacugugguggguggccaccuuggaaaaucaguagaauucaggaagugaggaaggaauaagagcauucuccaugguggaacuguaugagaaaaaaacacacaugaaagagaaaaaccuaaaguuuuauuaaucccuuuagcagaagcagaacuguuuuucacuugagaaguuagagaucaaauuaaaaaguagagaaaguccuucaaagcuaggauaaauauuuagcuuuuaucauaaagccagugagcaaacauugaacguuuuugagcaggaagauaacaugauuauagguugcagguaggaacaccaaucauaaguagacugcaaaauuguagauacaguaugauugcgacuauauuuuaaagugcaauuaaaaaccaaaauuaucaaaauagaaaaaaaugcaaccuucuggugguggaaauauucaaagaaauauaccaaaauguuaauauuauauuaaaauguuaauaccauaauauuaacaaaaauguuaaugguagauauauuuuguuaguaagaagacagguguuuuucuuuaaaccacuucucugaacucuaccuuuuuguuguuguuaaguauguaguacuuucgaaugggaaauauaaauuaaccaaaauauuaaguaagucacagcucaaagauauguguuuuggacaaccagacuuauuuuuaggcaugugucaguuuaccaggaaaugagcuggauacugaauacuagcuauauugcagccguauggguaugcugaccuuaaaauaggaaaaggccagauuccauuuacuccacugaggcgugcuuggcagcaucucauguaaaauaaaguugaauacugaagggccuaguuauaacucuguauucucacuggagacauuuuauuggcagaagguuuugaaacaaccaaccucuuuuuucaucaguggcagagauucuguuguugagccacuggaauuagauuagauuacuguuaacacacaggaggcaaaagauaaguaaauaaauuuaaccugguuuggcagguagacagagggccacauggccuauauuucuuuucuagaaauuugaucauguugguauggauaugucugacaauucuagugaccauccacaacuucauuaagaaaaauccaaacauugaagaagcagcuuuuuuuuuccuaguaauaaauuuucucaugacuguuuuauacaucagcuuugccuucuccuuuuuugguuucuaggcaguaguaauguuggggacacacuccccaccgggcagcuguccaacauaccauggcgucgggcagggguaaaguacacaaacaaugaagccuauuuugauguuguugaagaaauagacgcaauuauagauaaaucagguaauugugugcaugucaucuuauuuggggaaaaacaauucaucugacacagaugaauagaaaacugaaguccuggccgggcgcgguggcucacgccuguaaucccagcccuuugggaggccaaggcaggcggaacaugaggucagaguucgagaccagccuggccaacauggugaaacucugucucuacuaaagauacaaaaaauuagccgggcaugguggcgcgcaccuguaaucccagcuacucgggaggcugaggcaggaaaauugcuugaacccaggaggcagagguugcaaugagacaagaucaugccauugcacuccagccuggcucugucucaacaaaaaaaaaaaaaagaagaagaaaggaaaagaaaauugaaguccuuuggcaguaugguuucgguggaaaggcauucauuaucugaugauuuuuaaaucuguuuguuuauuuauuuauuuauuugagacggggucucacacuguuguccaggcuggagugcaaucacaugaucuuggcucacuggaaccuucaccuccuggauucaagcgauccugcugcuucagcuucccaaguagcugggauuacaggcaugagccaccacaccuggcuaaauuuuuuuuuuuuuuuugagacgcaguuucacucuuauugcccaggguggagugcaauggugcaaucucagcucaccgcaaccuccgccucccggguucaagcaguucuucugccucagccucccgaguaccugggauuacaggcaugcaccagcaugcccagcuaauuuuguguuuuugguggagaugggauuucuccacguuggucaggcuggucucgaacuccugaacuuaggugaucugcccguuucggccucccaaaguguuaggauuacaggcgugagccaccgcucccggcccuggcuaauuuuuuguauuuuuaguagagacgggguuucacaauguuggccaggcuggucucaagcuccuaaccucaagugauccaccugccuuggccucccaaagggcugggauuacaggcgugagccacugcaccuggcccauaaaucuguuuauuuugcccauagguuacauauaauuuucauaaccacuaguugaggucugccaaacauguaaaucagaacucauaaugccuuacuuuaagccaauuauuacccuauguaccucuaccucuugcuauuuauuccuucuaacauuuauugaaaaucugcuauauaccaugcuuuugcuacuacauuaugugcaguacuucugguaaaagccccuaucugauuauuuuucacuuucuuuuuuuuuuuuaaguacagggucuugcucuuuugccuaggcuggagugcauuggcgcagucccugcuuacuguagccuugaccuccagcucaugugauccuccuaccucaaacuccugaguagccuauagucccagccaaucaggagguacacgccacacgccaccaugccuggcuaacuuuuauuuguuuuuuuuguacagacagggucucaccauguugcccaggcuggucuugaacuccugggcucaaucaguuuaccuaccucagccucccaaagugcugggauuacaggcaucagccaccacacccaaucugauuaucuuuuuaaccagacaaaacaauaguacucuauaagaaucguaaaauuuuauuauuaaaaauagcagccgggcaugguggaucacgccuguaauuccagcacuuugggaggccgaggcaggcagaucacuugaggucaggaguuugagaccagccuggccaacaugguaaaaccccgucucuacuauaaauacaaaaauuagcugggcgugguggcaggcgccuguaaacccagcuacuugggaggcugaggcaggagaauugcuugacccugggaggcagagguugcagugagccaagauugcaccacugcacuccagccugggugacagagugagacuccaucucuaaaaaaacaaaaaaagaaaaaagaaaaaaaaucuaguccuuccuuuacauuuauuuuacacauaaggaaagcccagaaggguuaagugaacuguuccaggucacacaacuuguuaauauguaaugauggcuuauugugaauuauagucaauaucuucucuuccaugaguccccuuuucauuauaacauuccaucuuauagaauaauagauuuuugccaggcacgguggcucacaccuguaaucccagcacuuugggaggcuuaggcaggaagaucacuugagcccaggaguucaagaccagccuaggcaacauagcaagaccccauaucuaucaaaaauuuaaaagauuagcuaggcauggcuuccuuaauccuaccuauucagaaggcugaggcaggaggauugcuugagcccaggaguucaaugcuguggugaacuauguucacaccacuguacuccagccuggauggcagagggagacccugucucuuaaaaaaaaagagauaucuuucuauuauggauccuauuucuuaaaaguuaacuuaguccauuucauaauacacuugccacauuuuaaaauucuauugaagccgggcgcgguggcucacaccuguaaucccagcacuuuaggaggcugaggcggguggaucacgagguuaggagauccagaccauccuggcuaacacagugaaaccccaucucuacuaaaaauacaaaaaauuagcugggugugguggcaggcgccuguagucccagcuacucgagagacugaggcaggagaauggcgugaacccgggagacagagcuugcagugagcccagauagcgccacugcacuccauccagccugggugacagagcaagacuccgucucaaaaaaaaaauuaaaaaaaaauaaaauucuauugaaaaugguuuugguugguuuguuuuauuuuguuuuugagacagagucucacauugucgcccaggcuguagugcaguguugugguuucagcucacugcaaccuccgccuucuacguucaagcgauucuccugccucagccucccaaguagcugggacuacacgcacacaccaccacgccuggcuaauuuuuuguauuuuuaguagaaacgggguuuugccauguugcccaggcuggucccaaacuccugagcucagauaaucuacccacgucagccucccuaagugcuaggauuacaggcaugagccacugcguccugccaaauguuuuaaacucauauccagucaucuuacaggguuggcuccauaaaggaaacaguuuaauuuuccuuagaauuagcauauucuggcuggguaugguagcucacaccuguaaucccagcacuuugggaagcuaagguaggcggauugcuugagcccagaaguuugagaccagccugggcaacauaacaagacccugucucuacaaaaaaaauacaaaaauuagccaggcguggaggugcaugccuguaguaccagcugcuugggaggcugaggugggaggauugcuugagcccaggagguugaggcuggcuaucauagcaccacuacgcuccagccugggugacagagcaagacccugucucaaaaaaaaaaaaauuauauucuacaguggcauaccuguagucucaguuacucuggggaccagcugggacuagcuagucagacuuuaucucuuaaaaauaaaagaauuauuauuauauuccagccagaguuaaguauggaccuuguccccugaccuguuaauagagauguaaagcuucaguuaaucugacacccagaggguaucucuauuguucuagauguagugauuguugggcuaggugucauggcacgcaccuauauucccagcuauuugggaggcuagggcaggaggauuacuugagcccaggagugaggcugcagugagcuaugaucauacaacugcacuccaaccuuggcaacagagcaagacucugucucuaaaaacaauaaauaaaaauaaaaagauacagugauaggucuagugaagacucauauuccauugauguuaucuuccuuuuuuuuuucuuucuucaggaucuacagucuuugcagaaauucagggggucauugaugcuugcauuaaacuaucuggaaugccugaucucucccuuucuuucaugguaaguuuuauucuccuguuuuauagccccuugaaugccuaauacaugugaaguacuaaaugaaaugauaaauauugagauaaguuugcaucuuagauugcaaaggauuaucucagaaauauuccuagcagaguuuccuaagacagucgcuuacaugaugagcguggucuuuguggaaagacuaagggaggucuuugccugagugugcuagaaggggcuuaaaauuggcuggcuggcuucugcaaauauccaguaucauuuuuacugaauaauuauuugcuuugcugauaugaaaggacacuggucuuuuguaucauuuuagagucagcaugauauacugcuaggaacaauuaagagaacugacuucugguguugucaccaguuugcucugaccuuaaguccucugaaccucaguuuuuuaaucuguuaaagggaaauaauacuacuugccuuuucuccuuuauaguuauugaaauucaaauaaaauaauguacauaaaauauuuacaaacuuuaaagcauuaugaaacuauaagguuguguagauguggucauaaacucuuccaugacugcuuuaucuucagggaacauauuugucaagguaucugaguacaguucccauauucauuauagucuaugaacgacugucuucuguuuuucuggcagaacccuaggcuucuggaugaugucagcuuucaccccugcauccgguucaagcguugggaaucugaaagaguuuugucauuuauuccuccagauggaaauuuccgacucauaucauaccgugucagcucacaaaaguauguugaugcaucagccagaaucugccaucauacauaucaaguacaacucaccuuucccuguuucuuucugaaaguugaguacuugaggucaucacugcucacuuuaaccauagcucaccaggagacccagugagaacgggugaaaauacgcaccuaaaauaauccguauacuuugaauguaugaguguagagugguacuaagugagacuagaguaaaaucuauagccaagaacaagcaaaccauacauaaccugggcaaaaauugugguaccgguccuuugcaagguuaugcauggucaaauuauggcacugguucuuugcucagguuaugcaugguccauuuugcucugcuucugaaagcugaguacuuugcaagcagagcaaaacggaccaugcauaaccugggcaaaaccaugaaccauugccauaaucuuaccauagucuguagaguuuguggccaacaaggagacagaccuaccuguaguucgugaggacauuccccaauuuaccugcuucaaguacgucuucucugcguugaguuuuuaaggaacuguuuagcauugaggggccgggugcagugguucacuccuguaaucccaacacuuugggaggccaaugugggcagaucacuuggggucaagaguucuagaccagucuggucaacauggugaaacccugucucuacuaaaaacacaaaauuagccaggcgugguagcgugugccuauauaaucucaacuacuuaggaggcugaggcaugagaaucacuugaaccuggaaggcagagguugcagugacagaucacaccacugcacuacagccuggccaacaggguaaaacuccaucucaaaaaaaaaaaaaauuuagcauuggggaucggaguuauagguaguuuguuucuugaaaauaccaaaaguuauuugaguaacaucaugacagaacucaaaaacagagaaauuauuucucggcucuuuucuuuuccuuuuuuuuuuuuuuuuuuuuuuuuaagccggaguuuggcucuuguugcucaggcuggagugcaauggugaaaucucggcuuacugcaaccuccaccuccaggguucaagugauucuccugccucggccucccaaguagcugggauuacaggcaugcaccaccacacccggcuaauuuuguguuuuuaguagaggcgggguuauuccauguuggucagacuggucucgaacuccagaccucaggugaucugcccaccucagccucccaaagugcugggauuacaggcgugagccaccgugccuggccuguuucuuggcucuuaucacauaggaacuguuuucauuuauauaaaacauauuuuacauuauuuuucagugggaucauaauucauuuuaaacuagggccauuugccccaauuguuuuuguuuguuuguuuuauguuauuuuguuuuguuuguuuguuuugagacggaguuucacuauugucacccaggcuggagugcaauggugugaucuuggcucacugcaaccucuaccuccuggguucaagcgauucuccugccucagccucccaaguagcugggauuacaggcaccugccaccgcgcccagcuaauuuuuguuuuuuguuauuuuuuuuuuuuauuagagaggggauuucaccauguuggccaggcuggucucaaacuccugaccuccagugaucugccugccuuggccucccaaagugcugggauuacaggugugagccacugcacccagccaccccaauuguuuauacuguuauuaaacuucagauuucugucuugauuuguauacaguucccagcacagugguacaagaacauuaugcuguacucagcucccccuuguguagauacugaaucugcaguucuagagguacugccaucuugguauccuuggaggacugguugcaaaaaucagcagaugcucgagucccuuacauaaaaugguguaguauuugcauauaaccuaugcacauccuccuguauacuuuaaaucaucuccaaguuacuugugauaguacacuguaaacacuguguaaauaauuguuauaccauguugacuuuuuauuuuuauuguaguuauauuguuauuuuuuacuuuuuuuuuuuuuuuuuuuuuuuuuuuuuuugagauggcgucucgcuccuuugcccaggcuggagugcaguggcacgaucucagcucacugcaaucuccgcuucccagguucaagcgauucuccugccucaggcuuccaaauagcugggacuacaggcaugagccaccacacccagcuaauuuuuguauuuuuaguagagacgagguuucaccauguuggccaggcuggucuugaacuccucaccucagccucccaaaguacugagauuacaggugugagccaccgcgcccagcccuagcuaauuuuuguagagacgagguuucaucauguuggccaggcuggucucaaacuccugaccucaggugauccccucccaacccuggucucggccucccaaagugcugggauuacaggcaugagccaccacgccuggccaauuuugugaaauaauauuuucaauccucagcuggucaaauucaaggaugcagaacuguggcuacagagagccaacucuguaguaccuuauuguggaguuaaaggcaggguaggauacucuggacagagguuuucaggauaccucuggagcucuccccacaccauuaauuguguuugugcuuuuguaucuuucucuguuucucuuuuuagucuaguggcaauaccaguguaugugaaacauaguaucagcuuuaaggagaacaguucuugcggcagauuugauauaacaauuggaccaaagcagaauauggggaaaacuauugaaggaauuacagugacaguucacaugccaaaaguugugcugaacaugaaccugacacccacacaaggcagcuauacauuugauccagucaccaagguacagccacuucaaaucaagagugagcaaguguuucugcaaucuauuuugugauuuguggggaggaauggagggaaagguuuggcaccuuguuuaaaacuaaaguucguaucaaaaccuagagagcauacugugcugugcuucugccacuggcugcagaaggaauccugcagcugcuacugaguagaugaacagaaaaaugugucauucuguccuuuuucagagugugccuucacucauccauuauuaauccagagccugacucugcuaucuaauaagaaagaaguaaaagcuuuuuuaaaaagagaaaacauuauguagauugaagaagauauuaugauggucuaugaauuacuaaguuuucuauauaaauugaucacuaagaccuuuuucuuccuuuauaauuuaaaagcauuauuucauacucuuucacagggcuaggaaaguugcuuccucacucuacuuaaauuuuuguguaacagaggguuuucagagaaacuguagcagaugauuuucucucagcuuccugauuagcugguaaauaugauuguuuucaauagcagagucauugagcuaccugauaaaugaaaagacauguuuuuugaauaacaucauagaauguuaaagauuauuuaauacaguuguaaggauucaaagaaccuccuccuggagaccacacagggcugagaaagggagcuucagauuccuggcccuuuaccacagcuucaacuaugacagcuuugcuuucuuucucaucugcuguugagccuucacaccgaagauuucauuugaacaauggguuucacagcuaaaaguuuuaaaaacaccaucuuaagucaaucuaauuauuuuacagaaaaauaaacagaggcugggcgcaguggcuuacgccuguaaucccagcacuuugggaggccgagguggguggaucaccugaggucaggaguucgagaccagccugaccaacauggagaaaccccaucucuacuaaaacuacaaaauuagcugggcaugguggcgcaugccuguaucccagcugcuugggaggcugaggcaggagcaucgcuugaaccugggaggcagaguuuguggugagccaagauugcaccauugcacuccauccuaggcaacaagagugaaacucugucucaaaaaaaaaagaaaaagaaacaggcccagagaaaagugaagaugguuaugauggagaacauuugaaaucagagggccuuagguucaaaucccagccuuaccucugacuaacuaugugaccuugagcgagucauuugaucucugagccuuaauguccucugagcuuuaauuuccucauuuguaaauagaagacaaaagcuacuucacagcccucaaugagacaacauaugaauaaugcuaagcacggugcuaauacaaaagaaaaugcucaacaaauguagauucucugcucucacuccccauucaaagucacagaauuaaucagagguaaacucacuguagaugccagaucucuuguuuucaagagacugcacuucaguuuguacagaaguuuaugauaucuuugaacuuuguuuuugaggguuugucuuuaauaaaugguucuauuuguuuuucauuuuuugucuuuuuaagguacuaacaugggaugugggaaaaauuacuccacaaaagcucccaagucuuaaaggacugguaaauuuacagucuggagcccccaaaccagaagagaauccgagccucaacauacaguuuaagauccagcagcuugcuauuucagguaaggauaagguugacuuguaguuaaggguaauugaguuuugcaagcucauuuauuaggcauuuagaagaguaacaaaaguuuccuucucuagaaagagcaguagcccauuugccuuuuauacugugcuugguggggcagucucacaggcaccgaccaaaugauuuuucagagcaccuuauuucaaacagcuuccccucaccuccgcccucauuuaagcaccaaaaagagaguuauucauauucacagaaaguagaauuauacuucacagacauucccugccugugugggaaucuuaaccaaaaccauaccaucaaagugcaauaauuuguaaaugauagaagagacauuucuuccaaaugguggaagggacacugguuaaugucagauuuaccauauagcgcucauugcuaacauuauauugguugggaugaugauaauuuauucuuuuucauucuuuuugauacaggcuuaaaaguaaaccguuuggacauguauggggagaaauauaagccauuuaaaggagucaaauacgucacgaaagcuggaaaguuccaagugaggacaugagaagaggccaaaauuccucaggaccaguuuguuuuccaagugucauuacgauguaucacuauuagguaccaagugagugggaauacauauucuaguuaaagcauuugugucuagcuacacaccgcuaacaaaguuacuuaguuaucaauguaggauucuuaaggagcuuuaagcuaaggaaaccuuuuagugacuuagcuuauuuuguaucuuuucacuuaggaagauuuuggaggugauuuuuuuccauaggaggauaccaucuggcggcugcacauuguaacaguaaaggcagaaagcuguagugauaaccucucuccuaaaagaguuaacuggucucauccagcagaagcuaucuuaaaucugugaugugucaggugcagccaaauaucacaccuucugaucuuagccaucccaaaccaguaucugucccgagaggaaauuccccccacccccagaaguuuacagaaaacugccucuucaaguguuugccuuauucagcuuuucacuugugccauuaagcaagcacuguagcaaaagccacuuccacauggcccuggcagggagcacugcugcuccaugcuccauucucacuguacuugguauuguauuuuuuauaaauaagauuuuuauguaaagcuuagaauuugauuuacagggaccuugcugcaguaaauaccaucucaauuuugugccacugguucagcuguuagcacaguaaaaaaaucauuuguaucaaaggggcaaaugcuuuauuaagguaguaaaagggaacauuacuucugcuuuuaggaaguuacugcaagcacaagcauuugugcuuuuaagcaaauuaaaguaguaaaagaaaaacuuaagugaaaccuuugccaucuucauguuuuauaauauaaagcuuacccaacaccaguuaagccaugguuaaccuaaaugccucaugccccaguucagcaaaaggaggaaaaugugccugccucacagucaucagucuuuuuaaaucuuuuuuguuguuguucuuaaggguuugaauuugucugcauuccuugucuuuaggggaaauucccuuuucauauugugugcuucccaaagcuauagucauagauuucuuccagaaacuauugucauaauugucacuggagugcuuaaauauacguacuauacugacaaaauacauggaagugaguuauaaugaggcagaaacaaaauccucgguaacauugaugauacucuaccgaucaccgugguuuuggaaagucagucaacaguuguauuauugcacucaauuucauugugacauuuuauuuaacuucuucaucuuggugguccuugcccaguuauuuugccucauuagacaucaagaaauggagaaagacugaaaguuaauaucuuaagugcuuguucuucauguuuccuucuuguuauuuaugcuauucucuuuguggcuccauucuucuuucaaucuucucagcuuauaaccgucuuucccuuaugcuaaggauagcccuuacacucaucccaucuaugcugucaagggcugcugguuggugcugguacaaggagcccacucagcaguuuucuuaccuuugccugcccugccuuucauggaauaagaaaggcaacguuuugcagcuuccaaauuucugaagaaacuaaucucagauuggcaguuaaagucaaaauguugccaaauauuuauuccuuuugccuaaguuuggcuacccgguucaauugcuuuuuauuuuuaaugucuugacucuucagaguucguaccucaaaagaacaaugagaacauuugcuuugcuuucugcugaaucccuaaucucaacaaucuauaccuggacuguccaguucuccuccugugcuaucuucucuucuauccaaguagaauguacgccaggagcuccuucccucuagcaauuucuacuaaaauguccaaguagaauguuuccuuuuacaaucaaauuacuguauuuauuaauuugcuagaauccaguaaaucauuuugguagcucuggcugugcuaucaauaaaaagaugaaagcaacaaguugauuuuuuuuaggucuacuauugauugaacauucuccaaugggcaaggcucauugucaaagcagggugaacaugaucagauuuucuucugcaucaucacacaagcugcgaguguugcugcaaagcacuucucaguacuccuucccuaaccucaguauguuaauagccauucauacuuggcuuaagcaucaccauucuggccacagucugagagauuagugaucaaagcucccuucccuaucacuaccaccaccuacugauaacaaagauuucugaauacuuaguaguaguaaaauauuuuucaagcacagaguuacagcuaauccuggaucacuuguucuaaauucauaagggaguauaucaagagcaaaugaaguaaaugauucuuuccugcgugugggagucaccaucauuuuauucaaagggaguuccugugauagguucauuccuuaaguggugcuacagaaggacccuaggaaaaugcugaucuuguccugagaggcaacugauuugagaaaaugauuauacuacagcaggaaggcagcaccagugaacauaugguaaauggcaaaaacaagacaguuuuagaaacugcuaauucaguagcagccuuggccuuucccuuaacucaagcaggcuggaaucugucuuuauagucggcaacuuuccaagauaaagcagugauaauagcaguuggcaacacuaaauaucaauaucaucacccuuuaaugacauguuaccccuuucagaucuagaaaaucagggaaaaagugaugucccaacucuacucuaaaaaccugcuccuacuauuuuagucaguguuucuuuaaggaagaagaggacuauguccccaaaagcuaacucuguuuuauagcccugguggaucccugaaaacccuauuuauucuauacugggcuuuggaauaugaaaaauggaccuguguggccgggcgugguggaucacaccuguaaucccagcacuuugggaggucaaggugggcggaucacuugaggucaggaguucgagaccagccuggccaacauggugaaacuccaucucuacuaaaaauacaaaaauuagccaggcaugguggcgcacaccuguaaucccagcuacaugggaggcugaggcaggagaauugcuugaacccgggaggcagagguugcagugagcugagauugcaccacugcacugcagccugggcaacagagcaagucucugucuugcagcagggggaaggaccugugguacuccuacaaacuuaacaacuuuagcuuuucggggaacagugguggucuccacagauagcuagaaucuucuaagaugaaaauaaacuguuucauccagcugcuuucugccuguuaaccuuugccacuuccauuccuucaaguguguaauccccaggguugucuuguauuacacacauccuuguuaaguaaauauaccacuguugauuucuucuuccagugcaacauuuggauuaaauaaaaaucuuuaguuuccagaucuugaggauuaguuucauugacuauucaucaaaacaaaggagaaaccugaccuaaaaguucuugcuaaaguaacauauccaucauuuaaagcauuuuuuauacaaaugcauuuuauuguuuuaaacagaacaaaagaagaggcagaaaauauuugcauauaacaaauccuagcuuauaaauguaguuuuuuagcggugaugucucuaaucaucauucagggauuuuuuuuuuuuuuuuuuuuaauuugcuucacugugucucgagcacugauauuggagaaaagcacauccggcauaaaguguaaaccagugucucaaaccacuggaagaaccgggagagcaaacaugauuuuucuuauuuccucuaaguaaucuuucuuuaguaaaacaacaagugaucuuuggcauagauucauacuuuaaaggcauuaauauugcauuuauaucaggcaagcaacuauacaaauaugcugagggccuugaaaauaaucauccucauuauaaaggaaauagugaaagccugaguguaaaggaccaacuuaaguuguacacauucgauguugggaacuaacacacagcgaugggugggaaggaaggauguucaggcaagguucuuacuccuuuacucaucugguucuggcuuugggaaaaaauaagguuucaugugcugggaaauacuuagcaguaauaaguaccaaaaaggaaacacugcccucucauuuugccuaguaggaacuuacuguggugauaagaaauaugaaacccauuacucucuugaaccccauacuugggaguagaugcagagagcuugguuguaguugguugcagggagguaggaauuacaggaguaguauuucccauugauucaucuucagcagcacuagaauucuagucugcaaauaccacucucccuuaggcaggaaguguccuucagacagggcugccuugccauuaaacacucuuaggggacaagcacuccucuuucuuaggacugaauuuaaaaaggaucuuuuagaguuacagaugaacaaacaccuacaugucuuuaaaaucuuguuuagaaaggauguggaggaaggcuacaaaaaccaggauaggagacauguuuugguuaaaauuaaaaugcagcauuucagcucaaaaugaacaauuaagagcuaagaaugaaugauaaggccucagcacagaccucugcaggcagugacuaagcauggagugccgggaguggcccugcugggaagauggcagggccacacccuggcuacucugcccuuccaguggcagagagcaccaggacacaguguguucaugggauggcuaccuuggcgggcugaggcaggauaugggacgggaaguuucccuagcacagacauugcucaggggcaugguaaaagcagaaucauaugauucugugauuucuuccugacagugaaguacaguuuuauauugugggaaacuagaaggauuaaacugaggaagggcaggaaaugaauccaggcccccauaugcuggggcuccacagaggccaccuuccccuguagcagcaaagcucacuucugaaaaggacccagguagcacagcccagggaaggaagguaugguuggcagcaacauggaaagcucaaaacaauuuugggaggcacagcaauuuucuucuuaguaacugauuugccugggcccugggucuugggauucuggaagagugaaugggagccaaggaaagagaaacagagggaaguguccccuagggaacaagggcagagcagagugucuggcuaguguucacuuggauucugagcuuaugugaaguccaugggcuagaaacccagucugccuauugggauagagggugcacaaguguaacuguguuugagaauacaggcuuuauacagaaacacauuucaaaguguccaugaaaaaagaguauaaaugucuucuaauuugaagaggcccccauuccuuucugaugugccaggccaggaugugauuuuucagcucccagcaacucugggcagcuccugggacucagaucauuuuccuucuuuuuaguagagguuucugugccagccaggcucagccaggugccuacugguaccagggagucuuucuaacccagcgcaguguaaauccagcaucuguucgaauuuugauugaagcagcuucagcuucccgcacagucuccuucacagacugcaugagguucugggcauugugaaccagcaucucuguggccugcaaggaaaaagguacuuuccguuacccagggucccugaugcaggccugucucuaaaauagguuucagccaggagugggaugcagcuaaccccacugguaccuggcaucccccauauuugcuugcaucacuagggguuuucccagaucaccaaaaagaacccaaaacuggccaucgcugauuguauacuguggcuucagauagcuuacagcauguccucuuucuuggucuucaaacaugcuucucccucaggacuugcuguuuccuguaccuggacugcucuuuccccagggaucccagggauccccucaccuucagaucuuugcucacuugucaccuuggugaggauuucccugcucauucuuuuuuugagauggggucuuucucuuucauccaggcuggagugcaguggugugaucucggccacugcagccucugcccccugggcucaaggauccuccugccucagccuuugagcagcugggacaauagguacaugcugccacaucuggguaauuuuuuaauuuuuuguacagaugggguuccgccauguugcccagguuggacucguacuccugggcucaagugaucugcccaccucagccucccaaagugcuaagacuacauacaguaggcgugagccaccgcgcuuggccuuauuuuuuccauugaaccuaucaucacgaacugauacacuacguauuuuaccuagguuguuugggaguuuugaggguuuuuucugucuucauacuaacauuuaaguuauacagaguagauuuuugucaauuuugugcacugucauacccccaguauuuaggauggugccuggcacacaggagguauuucauaaauauuuaauuaaugaauuuuaaaaacaaccaaaugaacaaaccaagcaaccaaccacuuuaaacccaugaaaaucuaaauacguuaaucuuucaaacaaacgcacaaacuuauaagacugaaaucacauugguacucuac

SEQ ID NO: 17459 - RNA, 225809 nt, Homo sapiens
gacaaauaaaugcaacaugugauccuggacuggcuccuggucuggaaaagagaaagcuauaaaggccuuuaauuggacaauuagugaaauuugaauaugaauuucagcuuagauaacagcaauuuaacaauguuaaauuuucugcauuugauaauuguacagugauuauuuaagaggauguccuucauguuagcagugaagauggaaauauuuaaggguaaaaaucuaugauuugcucucaaauguucauuuaaacuauaauuuuaggcugggcacagugguucacgccuguaaucccaacacuuugggaggcugaggugggcggaacaccugagaucaggaguuugagaccagccuagccaacauggugaaaccccaucucuacuaaaaauacaaaaauuagccaggcgugguggcacgcgccuguaaucccagcuacucaggaggcugaaguaggagaauagcuugaaccugggagguagagguugcagugagccgagauccugccacugcccuccagccugggacagugcaagacugucucaaaaaaaaaaaaaaaaaaaaaccccaaaacuacccgaacaugguggcggguaccuguaaacccagcuacucaggaggcugaggcaggagaaucgcuugaacccaggagguggagguugcagugagccgagaucgcgccauugcauuccagccugggcaacaagagugagauuuuauuucgaaaaaaaagugaaaaauaaaaaauaauuugguaagcagguugauaaaaaaaaaaauaauagcgauauauauuguauacagaaugcugaaguaaaugcagcaaaaauaugaauuggugaacauaggugaggcguguaugggaguuccuuaagguguuuuugcaacuuuucuguaaauuugacaugcuuuucaaaauaaaaauuuaaaauuaagaaagccuguuaagauauguaaaggaaggguaggggugauugcugaaaggggcuccaucgaggacuaacccugccaauagaaugguacuguaugccagagcacagccacacugaugucccuccagugccacacugaugucccucacuccuggaaagggccucuguagaagaugauacugggccaggugugguggcucccgccuauaaucccagcacuuugggaggcugaggcagguggaucaccugaggucgggaguucaagaccagccugaccaacuuggagaaaccuuguuucuacuaaaaauacaaaauuagccaggcgugguggcgcacgccuguagucccagcuacuugggaggcugagacagaaucgcuugaacccgggagguggagguugcagugaaccgagauugccauugcacuccagccugggcaacaggagugaaauuccgucucaaaaaaaaaaaaaaaaaaaaaaaaagaugauaccaauggcugggcuccaaaacgaaaucagugugggggacaaggguucaccuuguacuuugucccaaauuugccccuaaacaucaagcaacauaugagaacauaugagaccgugucagcaaugccuggucugacccuccucuguuagaagcuggaaguuauucuguaccuucuugcuuuaccuuuucuuuucuuuuuuuuuuuuuugguuuguuuguuucuugcuguugaggccaggaauacucuaacguuuccacagaugaguuaacauuugcauaacaaucugggugacccuguucuuuccuguuggaaagggacuuuucuugacuccugagaggauaaguugagggucuuuugaagcugcccaggcccuauggguggggacgugccugucagcccaccaguggagagcuggagcccagugagucucagggguuggagguguggcgggccaggagaguguguugaauaugggggcuaggaaguaggguugggcccagccaagguuggggguaaaauuguccacacucacucauguccccuugaaaccuauuauauaaggcuaggguaauacuuugaaaauucacuacauuuugucaccaguugaacacgacuguuucguggcagaacuugauagaauacaagaauguuuucuccuuguguacuaugcagauuugccuaggagaccagaaguucuuggcacucacuuacaaaauggaagugcagucacgaaguaucuguugggugucugcuggaguucaaaugguaaacuagguugucaagguuccugcccucaaggagguagagagcaagaaaggucaauggauuaccacaauagagucuaaggacagaacgagaaauuaccuaggcccuagacaauaguauuuugaguuaaaauuuuuuucuuggccaugucugguggcucaugcccguaauuccagcacuuugggaggcugaggugggaguauugcuugagcccaggaguuccagaccagccugggcaacauagcaagacuucaucuccacuuaaauaaauaaaaaaauaaaauaaaaaagaaaaaauauguauuuuuuucuugauuaaaaaaaccuuggaggccgggcaugguggcucaugccuguaaucccagcacuuugggaggccgaggugggcagaucaccucaggucaggaguucaagaccagccuggccaacauggugaaaccccgucucuacuaaaaaauacaaaaauuagcugggcaugauggcgcaugccuguaaucccucggaagucugaggcaggagaauugcuugaaccaggaggcagagguugcagugagccgagauugcgccccugugcuccagccugggugaaacaguaagacucugucucagaaaaaaaaaacaaaaaaccuuagcaaaaauugaccaaaaagucaaaagacaagugcucaagugggaaaaaaaaauugcauaugugcuagcugaagggcuaagucaauuaaaaauuagacucggccaggcgugguggcucacaccuguaaucccagcacuuugggaggccaagggaggcagaucaucugaggucaggaguuugagaccagcccggccaacauggcgaaaccccaucucuacuaaaaauacaaaaauuagcagggcaugguggcaggugccuguaaucccagcuacucgggaggcugaggcaggagaaucacuugaaccugggaggcggagguugcagugagccaaaaucgugccauugcacuucagccugggcgaggauagugaaagucuaucucaaaaaaaaaaaaaaagaaagaaaaaugcaaauugaaauuucaacaggauacuacuuucacauuggccaagagcaaaauguugauaauguuugcggaaggcuggggaaacaggcucugcccuauaucugagggaagugugcauugggccagccuccaugcagggcaaguuggcuacagcugucaagaucuaaaaugcacaucuuaugacccaacaacuccaaugcuaggaacuuauccuacagacacaguaaaaacuugcaacaugucacacuguuaagugaaaaaagcaagcuacaaagcaguguauaucauaugcuauccauugaauguauauguaaaaucccaugguuaagccauaauuuucuuaacuuucuccuguugcuggguauguuguuuucguguuuuugugauuauauuguaaugcugugauagacaucuuuugugcaugaauuucugucuacaccuaaagcuguuuacuugggacaguccagauuacugggccaaggagauagcaaaaugaauuuacaauagcaaccauugcagcaaccaucaccaucuguuaagugggcuguuuuguuuuguuuuguuucuucaucuucucaacaguccugugagguagggaggagcaccuccguuuuguaguugaggaaagggguuuaaaggaggugaagugacuuguuccagggcacacagcuggaguggugagagcagaccuggaucugcuuggcucuguugaugaaaugggucaaauuccuuaaaauauuuggauuuauucugagccaaauaugagugaccaugguccgugacacagcccucaggagguccugagaacaugugcccaaggugaucggggcgcaguuugguuuaauacauuuuagggaggcaugaaacaucaaucaaauacauuuaagaaauauacugguuugguccagaaaggccagacaauucaaagcgagggguggggguagaugggguacuuccaggcuguagguaaauuuaaacauuuucugguugacaauugguugaguuuuucugaaguccugggaucaggccgggugcaguggcucacaccuguaaucccagcacuuugggaggccgaggugggcagaucaccugagguugggaguucgagaccacccuggccaauaugaugacaccccaucccuacuaaaaauacaaaaauuagucgggcgugguagcagaugccugugauuccagcuacuggagaggcugaggcaggagaauggcuuagauccgggagguggaguuugcagugagcggagauagcaccauugcacuccagcccaggcgacagagcgaaacucugucuaaaagaaaaaaaaaaaaaaaaaaaggcugggcacaguggcucacaccuguaaucccagcacuuugggaggccgaggcgggcagaucaccucaggucggaguuccagaccagccugaccaacauggagaaaucccgucucuacuaaaaauacaaaauuagccuggcaugguggcacacaccuguaauccaagccacuugggagggugaggcaggagaauuguuugaaucuaggaggcggagguuauggugagccgagaucaugccauugcacuccagccugggcaacaagagcgaaacuccgucucaaaaaaaaaaaaauuauuuuugguuuacagcucccaaaccccugcuuuagaggcccuucaucuauucggggcuuucuuuuuuugagagagagagggucuggcucuguugcacagguuggagugcaguggcgaucauggcucacugcagccucugucuccugugcucaagugauccugcuaccugggccucccaaagugcugggauuacuggcauaagccaccgcacagggccuacuugguguauuuuuuaagggucuugguggcugagcaugguggcucacgccugcaaucccugcacuuugggaggcugagguggguggaccaccuggggucaagaguucgacagcagccuggccaacaucaugaaaccccgucucuacuaaaaauacaaaaaaauugggcgggcacaguggcucacgccuguaaucccagcacuuugggaggccgagguggguggaucaugaggucaggaguucaagaccagccuggccaacauagugaaacccugucucuacuuaaaauacaaaaauuagccaagcaugguggcaugacucuguagucccagcuacuugggagguugaggcagcagaaucgcaucgcuugaaccugggaggcagagguuguggugagccaaaauugcaccacugcacuccagccugggcaacagagcgagagacucugucucaaaaaaaaaaaaaaagaaagaaaaaagaaaacaccgaaaaaauuagcugggcguaguggcacgcaccuguaaucccagcuacucaggaggcugaggcaggagaaucacuugaacccaggagguggagguugcagugagccgagauugugugcgccacugcacuccaccuggguaacaagagcaaaacucggucucaaaaaaaaaaaaaaaaaaaaaaaaaaaagcgggggggcucuucauaaacaaugucaaauuacucuccagaaaccuaguaucaguuuaugcuccucacacucccacugagauugccaaacucuccacacucaggucaguguggagaauggcaauauuuucauuuugccaacugggagggaaaaaaauagccucucauaguuuugaugaucaugucuuugguaacuaaugaaucugaccauuuuucauauguuuauucgcuguuuguacuuuuauuaacuguucauguuggacuacguauuuuuaaaauaugcaaaacauucugaaaacuguaacaugucgauucuuuuucuuuucuuuucuuuuuuuuugagacagucucgcucugucgcccaggcuggagugcaguggugcgaucuugcucacugcagccuccgccucccagguucaagcaguuaucgugucucagccuccugaguagcugggacugcaggugugcaccaccacacccagcuaauuuuuguauuuuuaguagagacgggguuucaccauguuggccaggcuggucucgaacuccugagcuccagcaauccuccugccucggccucccaaagugcugggauuacaggcaugggccaccgcgccagguaaacuguugauucuuaauaaaucccaguagagacgugcgcuugcgugggcaaaagcuccugccgaggccaucagacgcguuguugaggcuccggguccuuggcuuuacccuggagacccaaguccaggggccuugggugcacucagauggagaaagguggcagcaaggaguuggaugugccacugagacaaaaaccaacgcuaauacucaccauccgugcauugccuucuguaagcguaacaaaugccuggggccacggucaccggaaagccccucuccuuguccgcgccugggguggcuucggggcucgccgcugagacgcggggccaggagcgagucuggcaacuuccagagcccuccgcccgccuccccugccuccugcuuaggucgcugcuccggcggggugaggccgggcgggagcgggcaggcugggcauggcccgcgaggcaggguagccggcuuggagcgcgggguccgggaggcaggcgcggggaaggaggccgagcgcgccugccgggagggcgagcaggaggcggcgggcaaagccuacuucgcuuaguuuugugcgccugacagcagcccuucagcaaggugaauucuuugaggaagggucucauucacaagcugccaagacauccgcgaccuauucuugaauucacacaaaaauuaaaggaaaaacaacagcccaacuaauuuagcaacuugcaagaggcagcuggugcuccuuuccgcgccccuggggcccagucuuccccuccccaccgccucccaccccgcccccacccccgccucgccucugagaggucuccccagaguuauuuuguauccugcagcuccaggccucauugugacagcugagugacuuagcuggcaccgugggaugcggaaugacaaaggcgcagagcaucggaggcccgguggcagcaggggauggcaagggauggcggaggcuugcagcucugaggaccccccauccagcagccgccugaggugcccagucgcccauuccaccucccucuaaaauaaugcuucuaugaauuaagugagaggcuuuugcaguccaaaaauugguacuuccaguguccucgcaggcuggagaugguggggucucaggcuucugcauguccuggcccugacaguucuuuuucugucgcugccaguagcaccuucucucuaucucauccauuaagugccaggucuccugccuucuguccccgaggccacuucgcucucccuggcuuccccaucuuugugccuccuugguggugccagcuuccucuccagccugggagaggucauggguuccaaaggccuguccuggcagugccggccuggacuccugaaccgcccccaagggccauccuuacagaacagugacuucaggccuggacucugaauucagaccucacugaggggcaaguggagugcaaugaucagcugcucaguugggaauucugaccucccugaaacugcuuaacaccucagagcacaguuuucuugucuguaaaauggggcauaauagcaauauuuaaagagaaugguuaugaggauuacaugagccaauucagggaacucacuuagguuguaagugcuccaaaaguguuagcuauuauuaauaauauuguucuaccaaacacuaaagacauguucagcaaauaugcucccucaguccacuucagcaucuugaguucccacacuaucuuccucagagguuuugaguggagccacagaauuacacaacacuauccccaauaucaguccccaacuccuuuaauuggcaggaauaaaguguucuuucccuagccacccuguaaaucagcucauaggucauuaacuguuacuaagagcuccagacuaggcugaggaagcugcaaagaggccacugaacagauacugggcagaauuucuuucucuucagauacagcuguacucccaagcaacauccuuguuuccaaaaaauucuacuuacacuuaugagaaagcuaauuauuuggaagccaauaagccaauuucugucuuaguccauuuuguguugcuauaagaaaauauccaggacuggguaauuuauacagaacagaaauuuauuucucacaguucuggaggcugggaaguccaagaucaaggugcuggcaucuggugaggacugcucucugcuuccaagaugaagccuuggucgggugagguggcucaugccuguaaucccagcacuuuggcaggccgagggcagcggaucaccugaggugaggaguucgagaucagccugaccaacauggugaaacccugucucuacuaaaaauacaacaauuagcugggcaugguggugcaugcccguaaucccagcuacucgggaagcugaggcaggaguaucacuucaaucugggagguggagguugcuaugagccaagaucacaccacugcacuccagccugggcaacagagcaagacuccaucucaaaaauaaaauaaaauaaaauaaaauaaaauaaaauaaaauaaaauaaaauaaaauaaagaugaaggcuugaaugcugcaucuucugcaggggaggagcacuacguccucacauggcagacggcagaagggcagaaagguauggcuuuaagaaaaauauuugggucgggugcaguggcucaccccuguaaucccagcauuuugggagccgaggcaaacggaucaccugaggucaggaguucaagaccagccuggccaaacuggcgaaacccugucucuacuaaaaauacaaaaaauuagccaggugugguggagggugccuguaaucccaacuacuugggaggcugaggcagaacaaucacuggaaccugggagguggaguugcagugagucgagaucacaccacugcacuccagucugggugacagagugagacugcaucucaaaaaaaugaaaaaggaagauauuugggucguauugcauuuagggaacacagugguucucccugccauccauggcuuugcuuucugcaguuucaguuaccugaagucaauguggucuaaaaauauuaaaugaaaaauuccagaaauaaacaaguagcaugaugaaaucucacaccaucccuccauccuuucuucaucacaagaaggguacaauaagauauuuugagagggagacuacauucccauaacuuuuaguacaguauauuauuauauuuuuucuguuuuuaaauuauuaauaauuauuuugagauagagucucacucugucacccaggcuggagugcaguggcaugaucaugcucaccacagccucaaccuuccaggcucaagcuguccucccaacucagccugcuaaguagcugggauuacaggcaugugaacagcuaauuuuuaaauuuuuuguagagaugcuacaauaaauuuuguugcccuggcucuauuuuauuauuaauuguuguugcuaaucuuuuacugugccuaauuuauagauuaaacuuuaucauagauauguauauauagaaaaaaaaccauaguauauauaggauucaguacuaucugugguuucaggcauccacugggaaucuuggaacauauccccugaacacuacuguuuguuaauuuagguuaagcaauaccaccugcuauagcagaaaaacuucagcaucucuucggcuuaacacaauaagguguauuucuccuguuacauaucagaacaagugggaggagucugcuccaugcaguuacuuagggguccacgcuaauggcagcucugcuaacuuguagcucaucaucuggaacacauggcuucugagauacuaccgaaggggaagagaggaauggagaaugacucacucugguucuuaacucuuugaaccagaaguaacacauaucauuucagcuucucauccauuggcugaaacuagccacaugguucuaaccuaauggaggggaaggcuaugaaaugcaggggugcacagggacuauuuggugaacacuaauuuuucugcuacagagaaagauauuacaaauuacaaauaagcugaacuuagaguuauuucaugucaucaguugcaauucaggaaacgaaaucuaggaauuauuacagacuguuuaccacagguuaugacuccauguguggcauuggaauugguagaaaacagaucucagucucgguaacagauaugccaagucacauuggccauggaagugaggcacauggagcagaugaauaggcugcaaacaccagaaggggcagcucagauaagagguccucaaaauaugauacuugauuuuggaaagagaaaagguacaaugggaacaguuccaagacuauguauguacauauauaccacagaaaaaaauagcaaauguaguacauguaauaaaaauagaacacuccauuggucaaaugcuaagaugcuacguguuuaaagucacucuucaacaaacacacacagaguagaaaaagugguuuuagacuggguaacaggaaguacuacuuuacgguaguuaggaaauauauucaugcaggcuucauguauuuaaugaaugucuaugauguguuugacauuuacaagaaaucuguaagcauaugaaguuuacagucuaauuucugaauuuagacagauagaucuuagauaaacagauaacagauccuuaaccuuuuauuuuacuuaacauuauuuauuacuacuaugugcaagacacuuuggagaauauaaagaugaaccaaccccaaucccaacccugaagcaauuuauaggcaagguuguaggcugagugcgguggcucacuccuguaaucccagcacuuugggaggccaaggugggcggaucacuugaggucaggaguucaagaccagccuggccagcauggugaaaccccaucucuacuaaaaacacaaaaauuagccggguaugguggugcacgccuguagucccagcuacucaggaggcugaggcagaagaauugcuugagucugggaggcugaucugagauugcaccacugcauuccagccugaaugacagagcaagacucugucucaaaaaaaaaaaaaaaaaaaaaaaaaaggcucaggugugguggcuuacgucuguaaucccagcacuuugggaggcugagguggguggaucacgaggucaggaguucaagaccagccuggccaagauguugaaacccugucucuacugaaaguacaaaaauuagcuggguauggcgguaggugccuguaaucccagcuauuugggaggcugaggcaaagaauugcuugaacccgggagguggagguugcagugagccgagaucgugccacugcgcuccagccugggcaacagagcaagacucagucucaaaaaaaaaaacaaggcuguaugaagcugagcuaugcccucuuacaagcagucucguuacugauaccaguagguaucagagagguaucaagcuggugaaaugguucaccagacugauccccuuggccuuccuugggaugcaacuugaaagaugaacuuuaaccugaaguucaauaaugaaccugccacuuugggaggccaaagcgggaaguucgcuugagcucaagaguucaagaccagccuggauaauauagugagaccuuaucucauuuuuuuuuuaagccggagucuugcucugucacccagucuggcaugcaauggccugaucuuggcucacugcaaacuccgccucccagguucacaccauucuccugccucagccucccaaguagcugggacuauaggcacccgccaccacgcccagcuaauuuuuuuguauuuuuaguagagacaggguucaccagguuagccaggauggucucaaucuccugaccucgugauccgcccgccuuggccucccaaagugcugggauuacaggagugagccaccgcgcccagccaacuuuaucucauuuuuaaaaaauacauuuaaagaggaaauaaugaacuugccaacuugaaugaccugaugcugucugcauugguuaccuuauagcuggaaaggcaaauucagggccccugucugcaauuauggugaaaaauuggccaggcgcaguggcucaugcuuguaaucccagcacuuugggaggcugaggcgggcggaucaccugaggucaggaguucaagaucagccuggccaacauggcaaaaccccgucucuacuaaaaauacaaaaaaguuagccgaaugugguggcucacgccuguaaucccagcacuuuaggaggcugaggcggccgaggaagguggaucacuuugagcucaggaguuugagaccaacuucggcaacauggcgaaaccucaucucuacuaagaauacaaaaauuagccaggcauggugacaugggccugcagucccagcuacuugggaggcugaggcaggagaaucacuugaaccgaggaggcagagauuccagugagcugagaucguaccacugcacuccagcuugggcgacagagugagacucugucucgaaaaaaaaaaaaaaaagaauaagaaaaaaaaccucuuuccaguuagaugcgcacauuagguugcaaaaacuggagaaaauuguuaguaguuaaauuaaacuugacuuauacuuccuuaccccuguaaauuuauaaaguaguccagugauucuuaaauguacucuggucaguuaaccagauacgaagauaguuucauugucuauauugaaauagaaaauaaaaaaagaagaaaaaagugagaaaaugaacauauugauauaaaguugcccacucuuuuuucaugggaagggcuaucuuuuauucagggaguauguucuucuuacuauuuugggggauaaaauguccuuuauucugugaaaugaugcugauaguagauagccauuaguucuuuuuaaaaauguccuuauuaucaaaauuaaaaguugguggccgggcacgguggcucgcgccuguaaucccagcacuuugggaggccaaggcgggcagaucacuugaggucaggaguucaagaucagccugacugacauggagaaacccuguuucuacuaaaaauacaaaauuagccaggcaugguggugcaugccuguaaucccagcuacuugggaggcugaggcaugagaauugcuugaaaccaggaggcagagguuguggugagccgagauugugccauuguacuccagccugggcaacaagagcgaaacuccaucucaaaaaaaaaaaaaaaguuggcaacucucaguuuccucaaauucuuuuugaaguguuacucuccuacaaaauccaaaagacugugaaucgcaaaguuaaacacuggggugguucaaauuuuuguuuuuuagagacaggguucuacucugucacccaggcuggagugcagugauggagucauagcucacuguagccuccaacuccugggcucaagugauccucccacgucagccuccccaguagcugagacuacaggugugugucaccaugucuggcuaauauuuaaauuuuuuauagagauaggggucuggcuaucuugccuaggcuggugucaaacuccuggccuccagccauccucccaucucagccucccaaagcauugggaauacaggugugagucaccauacccuguccaaauuuucuuugguauagccuggugcuaaaaacugucuuuauuaagacuauuuggacaucacuaauugauaugauuagugaaaggccaccucaccuuugagucucaaaacaaaaaccaaaagauccccgacaacuuuguucuucaacaaucuuuagcuaauucuacaaucucuuaucacucuccugucuuccucagaaucucucauuugaggcugaggcauguuucugguuuauagaaaucaauggucgggcuagucuugaccuccugggcucaagcggccucccaaagugcugggauuacgggcccuguaauuccaguacuuuuggaggcuguuugaacccaggaguucaagaccagccugggcaacauggugaaacccugucucuauuaaaaauacaaaaaauuagccgggugugauggcauacuccuguagucccagcuaaccggaggcugaggugggaggaucgccugagccugggaaguugaggcugcagugaggcaugauugugccacugcacuccagcaugggcaacaggaacaagacccugucuuaagauaaauaaauaaauaagaaauaaaucaaugguuguucacccugacugcacagggugauuuggaaaaaugcugaugaagggccccucuccccaaauauucuaauuuaauuggccuuacgugggacuuaggcucuaggcugguucaagagcuccucaggugauugcuacguguggccagggaggcaaaccacagguaugaauggugugucuucauuaaguagcuuuuauggcacuagggcaguuacacagaugaacaaacugguccaugcaguagaaaagcuaauuaggaaaacaggcaaaauaugacaagagaguaggguaaaugcuuuuauuuauuccauaauucaacaaauauuagcuaagcacuuaacaagcgccagugcuggagugaagccaggcucucaguccugugggcuaccugcaaaaaccaggaaaacuucacagaggaggcagcagccaagcaggaauugggaggagugcuuagccaaggucuuuaucagauaaggcagggagugagggcaucgcagugaggacagggugugcugggcacagacaaguggcaggcucgggaagcuggagaugagauacuagugaggugcagauaugcauaccuuuagaggacuaagggguuuaggcuugguccagaacgcauuuaaaagacguuaaagguuuuaaagcaggaaugcauaaauuagauguggguacagaauacugguauuugagauaaccccagcuguucauaaaggcagcuguagcuagaauuuccuaaccaguuuaaugcuuugacugaucaucccccauccccucugcccuugacugaaguaaccagacauugugaccuuguggggucaguuucuagucaaugaagggagaggauuccauguggcaguuggaagggagguguagaucaauguuuuuuaagugacuaauugaauguaaauagaauucaccaugggcugggcccuggacaaauacguuuagcguccuugccugugccuccuuacccaauuuccuuuagaaggacuugguagugccucuguggaugugguaccucuuaucaggcuguuugucugacuugcuucagagcaaguaaacaaacccaaaagaucaaaccaucuggguucccagagguuccugcagcuccucugcacuuuauuauucuuguucagaacucaaggacaaauaggucagaucaugaaaucagcccaguacuagggacuauaaccuuuuggcuaagacacucacagaagaaguaacuuccucgguuggggaagaagaagauuuagccuaggccagugguucucaaauuuagugacuguaagcuucaagacuagucaugagcuaaaaauauauuuuugggagacucgcuucagacuuacugaaucagaaucucugggguugggccaaggaaacugucuuucaaacacucauucccagaucauucugauuccagugaucuguagauugcauggagcaguauaacuagucagugguucuggucuguggugguggcuggcagcuguuuugggguugugggggacaggucagauaagcuucuccauucauaauccuccagcccaguaggcuugcaaaauuugcaccaugcuugguuuucaauucaggcuauuucuagguuaauuucuuaauugagcuauuuagcucagcagaggaccugagauaccacagauaagagagcgguuuaggaguaagcauuaaauaucucugacugugucucuuauuauccuuuccagucccacuuaucugaagagccagauuucucaaaggacaaguaacccuagaggggaguaucaaugggaaagcuauggauuccuugccacauccccguuacagaacuaugcuuguuaagaacagaaucucaagaaaacauaucaagagguugaaugaagacauuucucucuucuguauuccugaucuccugggguuacaagagcacagguuuaggcaaacauagccgauuucucucuaaggugucucuucacuucuugaugcacuggagauccuuguggaauaauacauuagugauaaugaguguugggugcucacaaaucacccacaauucauuggcugaaggcaucuuaaacguggacuuuuuggcuuuuauugucuuuagcugcuucuuuuaacauacuuuaguuugaguguacagauuugggguuuucaaacuuguuuuuaauuaaggcaugguuuauuuuuauugcuugagauaaaaugcagucugagggucacaaauguaauuuacaaaauaaagugcaucugggcagaccauaagaaaaaaaaagaacagaaagccuaaauaaagagugggccaggauucuuaaguuuauuuaguaacuucuuggagaauaaaaaucccagcaccugcauuauaaaaaagcacaccuuauaaguguccuucucuucgaaacaccuaagugaacuacacugaauuaugaacuaacuaaugguuuguaaaaauucgccuugagcaagcuauugaagauacuaaauaaacgaggcugagacagagucugaggaaacccaaccugcuguuuguuuuaucaguaauguaacucaaaaguagccaagcggauggcuggaguuuucucuguguuuuguuucccugggcugagccugugaaugccaagauuuaaucuaaagagguuuguguuuuaaaaaacuaacaaccaaguaauaaaacaccuauaaaaacuguuuauaauggaaccggugacaguuuguaguguaguauuacaauucuucugcucccccucgaccuuucucuauccuuucauccaacucugugcccuuugucuaaguuccuuucucaccuugcugccaagaagcucaggaggagagggagcucacaccccaaagcagcagaccaucuuuaaaaaaugaaguguguguuguggucugcauuugaagacagggcugcgugugcugcuuguuuugucugagauaaggacgaagauaaguuguccuaacaaaguaccuaccuaguuguacagugguuucuaaugggaaggugaagaugccgcugcagugucaguggcaugaggcugcaggagucaaccagggcaggaagccuggggccuccccucccuggcacccggcauagccaugcccaggcccaagauggcccugacuccagggacagacuucaggcaacaggugguuuuccacccaggccaccaugccugaaacuugguucuuuugcaaagccauaguucuccucccccucucaaagaaauggcgccugggagggaaacuucgugcucaaacucucuaggagccauuucucagcccaccuuuccuauuuucugaagucucccuugccagcaucccauucaccuccggaaagaaccaggggcgcucucuucagaguccagagagcucugggaggcaugugggcagcgucagaguggccucgccugggcggccagaggagcccccagucucccucaagugggccucaggaacucggggggcccaggggaagccuggaaaaccgaacuucgccaucagccuuccuuacagcgcuggcuaaaagagagggggggaagggccccccagcggucuuccccgccccccucccgccucagccccucugccauccgccugcaccgcccaagaaagcacccagaacgcggcugagcucgccagcuccucgcaggcagggagagagcauccuggggggcagcuucccccuccagcccgcgucugacauccccacucccacacaaggaugccgccgccgugcccuguccgcagucgcugaaugucacugcucccucuuccucccgaucaggguagacacagcucccgaggcgucccccaccccaaaacugccgcgaucgcccgaaggcgcaaagccugggcgaaggacgaaguuuggggcccacagcgacgggaguggggacgcguuggcgaggaccgcaccucagucccagcccuggcgggcacacuccccgccccaaacggcccaggcguccccauccucccgcggacaccagcgucuccgcccucccccgagggcggcgagaggagccccccggggcggaggcagguacccccggggcggagacuggggcgggcgggguccgggcugcgcccccggccaggccgggcgggcuggcgggcggcgcggggggagcggggcugggcggcgcugccucgggcucugugcgcugcagcccggagccgaggaggaggaggcggaggaggagaaggaggcggcggcggugggucccgggcggggggagcgcggcgcugcggacccgggcggcuggcaaaggacgaggcggaggcugaggaaggcagcggggagacccaggcugcagcaacaaagggcagcgagcgauuggccgggcugcaggcgagguuagccggggacccggguggccggaggcagcggcgagcggugcacgugcuugcagacacgggcgaguguggagccggggggugcacgcccgguggguaggggcuugcucccccgaggcaugggauggcgaggaggcugcagcgacaucguucugccugcacccggccuggggcuggcaggguagggguguguuggggggggaaggaugcgagccagggggcgggcgaguagucgcccgggacgggacgggacgggagagaggguggaggagggggcgggauggaacgcuccgggcggcgcgcccguccgcacacuccaccgaaggagcuggcgacugagaaccucgaauuuuaacuucgcgugcccgcccgcgcgcgcccgcccgcgcccaccccuaaauccugcggccgccgccagcgaucagcucucacacaaacuuuagcugcgggcuaggggguuugggguugagugggggaggggagagggaaaaggccuccugauuggcgucgucugcagccaauaaggcuacgcuccucugcugcgaguagacccaauccuuuccuagagguggagggggcggguagguggaaguagagguggcgcgguaucuaggagagagaaaaagggcuggaccaauaggugcccggaagaggcggacccagcggucuguugauugguauuggcaguggacccucccccgggguggugccggagggggggaugaugggucgagggguguguuuauguggaagcgagaugaccggcaggaaccugccccaaugggcugcagagugguuagugagugggugacagacagacccguaggccaacggguggccuuaagugucuuuggucuccuccaauggagcagcggcggggcgggaccgcgacucggguuuaaugagacuccauugggcuguaaucagugucaugucggauucaugucaacgacaacaacagggggacacaaaauggcggcggcuuagcuccuaccccuggcggcggcggcagcgguggcggaggcgacggcaccuccuccaggcggcagccgcaguuucucaggcagcggcagcgcccccggcaggcgcgguggcgguggcgcgcagccaggucugucacccaccccgcgcguucccagggggaggagacugggcgggaggggggaacagacggggggggauucaggggcuugcgacgccccucccacaggccucugcgcgagggucaccgcggggccgcucggggucaggcugccccugagcgugacgguagggggcgggggaaaggggaggagggacaggccccgccccucggcagggcucuagggcaagggggcggggcucgagggcggaggggggcggggcgggaucgggugggggcgggguucggggagucggaaggcgggggcugagagggaauuucugagugggagugaacugguaggagcgguggggggccggcgagggugugaggaagacuagugaggguugggugggaggagaagcugaagguguagaagcaggugcagagggagaguuagggagggaugcaauuugagagaaguggaaggcggaccgaggggugugugagggcaggugagaugauaccgaaggcgagauugcaguugucugggcgcagaguagguggguuugggugugguggauguggaguagaguugaagcggugcagaguguuggguuuggggaggcguugagggguuuggggaggcauugaggcgcaugugaggagcagguacgauugcagugaugggaaagagguaucuggguggaucgcauguuggaauaagaaggagguuugcuagcuuugggguaugaaguauuuuuuaaaaacguggaaggaugggaugguugugcuugggagaguuucugaaagaugaugcuaagacagcagagcaaacuuaaauaugaaggaaggggagagaggcugcuuagaacuugcaaaaucuguggcagaaaaucuccuggggacaagggauugguaggggugggacaaggcggcaggugugaagaaaguggguggagcuguacaguaauuuucggugaaugugauuugguggacugugccaggggugaggauggggcagagaaagguguuaguuugggagacaaguuguuugauaggcuguauuuauuauuuuuuauaaaaaugagaaaagggucucacuauguugcccaggcuggucucgaacuccuggccucaagugaucugcccaccucugccugacugaugggauuacagacgugagcuauggcgacccgugauacgcuggauucauuauguuaaacuugaucuggagucuucaagggaguguccggcagcaggguaucccaggaagagacaugcaccauaccuugggauaggacauuuugcauagcuuugaauuugcuaguacuuugcugugggcagagugcagggagugguaggagaugaccaggcaaaggcagaggagggguuagauuacaaaugguguccuaugccccaugaaggaguuuaagcccuguaauugguagaagguguugggacguguuaaagagaguguuagacagaaguugugaagggguagugauaaagaauuacagaugugggaaauaggaaaugaagaccaacgaaccaaguauguuugggguuggagguaccaaggaaauucaggguagagcauaugagggccccuccuauauggacagaagguggaaauagcaaauggaaauuaguuguguucgaacagucuuaguucuauggggccccaagaagguuuuuuguguuuuuuuuuuuuuaaagugcauucuuccugucuuacuuguauacccuagauuuuuuggcauagccuugaaauaaaacacuccauuuuuuucuuacucauaaguucuuuuuuuuuuuuuuuuuuuuuuugagacggagucucagucugucgcccaggcuggagugcaguggcgccaucucggcucacugcaagcuccgccucccggguucacgccauuguccugccucagccuccggaguagcugggacuacaggcgccugccaccacgccccgcuaauuuuuuguauauuuaguagagacgggguuucaccguguuagccaggauggucucgaacucuugaccuugugaucugcccgccucggccucccaaagugcugggauuacaggcgugagccaccgcgcccggccauucauaaguucuuuacacauuuaucagaaugaauuuggacaguauuuuauguuuuuaagaaggaaaggauaaugcacauguuuuuucuuuuccgagaacuucuacugagaguuaaagguuggaguggugaagugaugguuuaaaaaaaaaaaaaaagaaaagaaaagagagagacagaggaagauuuuaacauuaaaagaggaauuuagggaauggcugauggucaugacacggucggcagaggaaguuuugcuuacuagccacacuuaggcuucugaguagaguggauauuaugucauugcuauuauagcauguguuuauuucacacacugcuuuugaagauuggguggaaacugucagaugugaggcauagcaugaaugaaagguaaauagcaugaguauuagaaaguagaugaggaaguuuaauaauuuuaaugugcuucauaagcucucauggacuuucacguaucaauuaguaaaagacguaacuaagugaucuggcuuucagucuccuaguucucuacaguguacccucaguuuuccacgugcuuacacaugccuacauuuguacugagagaaaaggaaauaguuuuuuuuuuuuuuuugagacagucuugcucuguugcccaggcuggagugcaguggcacgaucucggcucacugcaaccuccaccuccuggauucaggugauucuccugccucagcuucccggguagcuaggauuacagacaugugcccagcuaauuuuuguauuuuuaguagaggugggguuucgccauguuggccaggcuggucucaaacuccugaccucaggugauccacucaccucggccucccagagugcugggauuaaauaaauaguuuuauguggcugggugugguggcucacgccuguaaucccagcacuuugggaggccgagguggauggaucacgaggucaagaaaucaagaccauccuggccaacauggugaaaccccaucucuacuaaaaauacaaaaaauuagcugggcaugguggcgggcgccuguagucccagcugcucaggagguugaggcaggcgaaucacuugaaccugggaggcggagguugcagugagcugagauugcaccacugcacuccagccuggcgacagagcgagacucugucucaaaaaaaaaaaaacaaaaaaaaaagaaaaauauuuuauguaaguagggauguguaagcuguagugaucagucuuuguugcagaaugguaaaugaugcguggaugagagaaguggggugaugggauauuucuucccuuuaaugccuuaauuugcauuuccaaagcaccuuuaagcaucuuuuuauagaacucccaugaucuucugauaccugucuucucgcagaccccagaaagagaauacaccaauuuucguaucaucuauuccauuguugccgaauauuugaguuguuucaaguuuggggcaauugugaacaaagcugcuaugagcauuccuauaccugucaucuggugcccaugugcacaaguuucucuaagguauacaccuaggaaugaaauugccgguuuauagcuagggugaccauuuguccugguuuuugcuuauuuucccagcguaacuguaacacuuuuaguuuucaaaaguaucuaggguuagaugaugaauuguauggucaccuagucauaagguaugcuugucuucaucuuuacuaaguaccaaacucuucuaaaguauuguaccagguuacacucccuccagcaauauaugaauucccuugcuucucgcccucuccaaucucagccuuuuuagcuuuuaugauuuuagccaauaugguaaauuuugcguuuaccugauuaguaaucagauugcacagcucuucauauauauauauauauauauauauauauauauauauauuuuuuuuuuuuuuuuuuuuuuuuuuuuuuuuuuuugagacggaguuuugcuuuugucacccaggcuggagugcaguggcgugaucuuggcucacugcaaccucugcuuccuggguucaagcgauucuccugccucagccuccugaguagcugggauuacaggugcccacuaccacaaccagcuaauuuuuuguauuuuuaguagagaugggguuuugccauguugggcaggcuuguuucaaacuccugaucucaguugacccgcccgucuuggccucccaaagugcugggauuacaggcgugagccucugcacccggccagcucuucauauacuuuuuuagccauuuagauagccucauuuauaaaguucuguucaagucuuucccacccugcuuuuaaaaguugggccuuguaucuuuuauugcuauuuagaaguucuuuauuuacugugaauacaaguccuuugucauguguguguguugcaaauacuguggcuugccuuuucacucucuuuauggugucuuuuaaugaacagaaguucuuaauuuuaauggagucaaauuuauuggucuuuacuuuaugguuagugccuuuugugucuuguuuuaagacuuuuccuacccugaggucaauaagauauucuccuaugcaguacuaucuuuuuaaagcuuuguugaccuuaaacaauguauaacuaugaguaaaauacacucuucuugaccccagccucaccauuacaaucuauuuuugcuuuccuucacuuuuuucuguucucugucuugaauuuuuacuucucugcagcuauaacuaagagccaggugcugacuucuccugucucuuaggagaaaauggucauauagacagaaguucagccagauuagauuuuacaggucuccagcugacuguauugcccuuuuuccuuuuaugagcuagcauuuuauuguguuccugcuaugugucugccaucauccuugcugcuuucauauuuguuaucucagugauuccucuuaacgguucuguaaaacagagaaguauucucauuuuuacagaagagaaaacagagacuuagauugauuuaguagcauguccaauauccccuagccuagguagcuagcagaauggggacuggaucccugacucugauacuucccaucacagcacaccuacuuguugauuaaaaugucagaaaccuguuuuuugauaacauccaaaaccaaaaagaauaacuuucuuacucuugauguaacaugccuuaaguaaagcacacaaagcuaacuauugugaaacuggauaaaauaccucucuguauauagccaguggaccuuaagugguccauggcuggaugacagaaggucuguuaacccuuaaaaauguauaccaguguauauggguacaugugcuuauuuuuuagaguagagcuauaauauuuaugaaacucucaaaagggaaccugaauuuuucaggguaucuggauaucuggucugaagacaucuguaauacaguuaacaaagaauccuguaauaaucucucuuucaaaagaaucauaaaaaaguuaagaugucagauuuuucucagccaggugcaguggcucaugccuguaaucccacuacuuugggaggcuacagugaaaggaucccuugagcccuggaguucaagacaugccugggcaacauagggagacccccgccucuauuuuuauuuauuuauuuagauuuuuugguaucuucauuuuaucuuauuuauuuuguugagauagaguuuugcucuuguugcccaggcuggagugcaauggcguaaucuuggcucacugcaaccuccaccuccuggguucaagcaauuuuccugccucagccucccaaagagcugggauuacaggcaugcgccaccacgccugcuaauuuuuuguauuuaguagagaugggguuucaccauguuggccgggcuggucucaaacuccugaccucaggugauccaccugccuuggccugucgaagugcugggauuauaggcauaagccaccaagccuggccuuguaucucuauuuuaaaaaguuuuuuaaaaaucacauuuuuuggccgggcaugauggcucaugccuguaaucccagcacuuugggaggcucaggcagcuggaucacaaggucaggagcucgagaccagccuggccaacaugguaaaaccccgucucuacuaaaaauaaaaacaacaacaacaaacaaacaauggcaugguggcaugugccuguaaucccagcuacucagaaggcuggggcaggagagucguuugaacccgggaggcggagguugcagugagccgagaucacgccauugcacuccagccugggcaacagggcaagacucugucucaaaaaaaaaaaaaaaaaaaaaaaaaucacauuuuuucccuuaauacauuauucucggucuuugucaucaaaaaccaacuaaagcuaauuuguaauuagggagaaaucuaggauugaauaggaauuuuuaaaugccaaaaaaagacacucuaaauuuaguugauuauuucuuaagugaaagugcuuaguuauaauacaucauuacuaaucaguguacccuggcuccaaagaccugaugacuucaaaugacuuuucaucuugucucuaaauuccucuguuuuacaagggaucaaauuuccugugagguuccuaacagugugauuaaauuuuagagacugaaacuauugagcacuuaaaugcagggauaacuaugcaaaccuaauucauggguuucaccaggagauuugggaccugucucuacuaauuuaugaugaugauguugaaacuaaucuuugcuagggauuauggaaaccauaauaguuuauugaugguucaguuauuguuuguugaagcacauuuacacaauuauaguuuaaugacauaacaaggauauugucaacuaggagagcaugacaugaaaaauuaaacuugcaauuaauauaauauguauuaguugaaaugauaauuuuuauggugauuuagccucuuagaaauccuuggaaaacauuauuagcuuaugaauugaaaacucucuuuguuaaugaguagugggaaagaacuuaguguuacucuaaaaagauggggaauuaaauauucaguucaaccagcguuuuauugagugccugcucugggcuugcugcugaguuaggcucauaaauauaaguugaacaagauugauguuugcagagaugaaauacugguugcuuuuguuuuuucuuucaaucacccuucccuccagaguagauggcuacuauugccagagugauucaaacauucaacagguuuguguguguaugugcaugcccuucccugugcauuauggugucaccugcuccugcaguggcuuccuauucaucugucacguucacacaccacagcuuggcuuuuuucacagccaacuuuauuucuguuuuuuuuuuuuuugagauggauucuggcucuguugccaggcuggagugcaguggcgcgaucucggcucacugcauccaccaccuccgggguucaagcaauuccccugccucagccuuccgaguagcugggaccacaggcaugcaccaccacgccuggcuaauuuuuuguauuuuaguagagauggaguuucaccauguuggccaggauggucucaaucuccugaccucgugaucugcccgccuuggccucccaaagugcuaggauuacaggugugagccacugugccuggccuauuucuguuuuucauuuuuaaauuauauuugucuuuuuuagagacagagucuugcucuauugccuaggcuggagagcaguggcacaaucauagcccacuguggccucaaccuccugggcggcucaagagauccucuugccucggucucccgaguagcugggucuacagguguacaccaccacagccaccuaauuuuuuauuuuuguagagguagggucuuguuguguugccuaggcuugucucgagcuccuggccucaaguaauccuccuuccuugaccucccaaagugcugggauuagaggcaugagccauugugccuggcccaacuuaauuucuuuaucccuuuugagcauauaccuguucuagucaggcacauggacuuggugucccuuuuguuugacagcucauucuuagcuucuguuauuucacuuugauuuccuucauucauuccccgauacauuuauuuagcaaauaggcauugaaacccucuuaugaucaaguuguggucuugggaaaucuuaggguauacaaagaugaaucaagcaugaauccuguuuuuaagaauuuuauagucuaguaggggugacaagguuaauacacaaguaagcauaauacuaagugggaaaugaaugucaaaacaguaaaaaagcuaaaagcuuccuguuagacaaagauguuuggggcuuuugagaaguuguuugcacugggccaugaaggauuugaauuugggcagagggacgguggggcacuuauccaggcucagcauuaucuuucaagguucaguuucagucccauccauccaagagauguucauccauccuccacgugguuucagcaagguaguauagucacaguuguuuccagacuucuuccuucuguaaucagaggaacacuuccuuuaaagcgaaucuuauggggaagacaaauauauguaaaacaguuaaaguggagcugcacuguuggguucaaggugcugcaauggcccaaaguuuaacccacaagggguaccugaagguaauacccgaaguaacuccuugucacagagaucuaaagagccuaguuugaaaaccucuggagagacagaaagaguuugggcuuuggcaucugaauuaaaauccuucaugacuuaauggcucugagaucuuggcuaagucaagccuguuuuccuuuuguaaaaacaacaaugcuaccuuacagaguuguuuuaaaguuuacugauaaucuauguaaaguaccuggaccacaguaggugucaggaaaugguugguauuauuauuauuauuauaguuuagugcuuuguuauuucuuuuuuuuuaaacaauuuauugaggugaaacucacauaacauaaaaugaaaaaaccauuaaaaagugaacaaaucaguggcauuuaguacauucaguguugugucaccacugccacuaucaaguuccaaaacauuuuuauugaucccaaauaaaaccccuuacccauuaagcaguuucucuagauaugucccugagacuccaccaaucuguguuuugucuauggauuuaucuauucuggaugucucauaugaaugaaauuauaugauguguggccuuuugugucuggcuucuuucacagcauaacguguuugagguccaucuacauuguaguagcauguaucgaaacuucauugcuuuuuauaguuguauaguauucuaguguauggauauaccacaguuuaucuguucaucuguugauggacauuugggcuguuuacaccuuuuggcuacugugaauaguuuuguuaugaacauggguguacguguacuuauuugaguaucuguucucaauucuuuugagucuauaccuagaaauggaauuacagaaccauaugguaauucuguguuuaacuuuuugaggaaccgccaaacagugcuuugcuauuucuuaauugcuucuuauauguucugucucuagcuuugcuuuguauuccccauaguaccuaccacagggcugcaugcagggagcaucagcucgcuaaauauuuguugguuuuucuuugauuaguauuuauaaccucaccucccaguucacauguuuugggccugaagcauugauuucagaggaaauagaugcauccaggauuugaaagauaagaaauaucaccauauggauggcguuucauguugucagacaacagauauuuguuaaccaaggacacuauuuugagcaacucugccaauaaccugagcugggugcugauagaagaaaaauaagucaaggucccuuccccuaaacaguucuguucuguuucggaagauacugcuuagauuuguggaugcucacucaguuacacaaugggcuuugaaaaaauccagguuuuccaacagugaucccuuuggggaaaaaaaagaaagaaaaagccaggacuuaugaaaguaaaauaguuaaaaauaacuguuagcaaguaaaacucaggaugacaaaaguguaaacucuauuauuaaucuuuguuuuuuucuaccacuguuuuuugccucauccauaaucucaugacuugaguguuaugacauugauuuugaaacaacacacacagcuuuaguaaaagcuuagaggaggccucgcauaauacuuaugauccaggauauuuugacucuucuuaugcugacaugaauauuucugaauaguguugauguuuauguaauaccagugaagcuaaaagcucagugcuggacuaagcauuucucuagauauguuuagaauauuuguaaugaaugauguaaauaguguuauauuauaagaccguaugauacaaccauauaauuuacugauauuuuguaguuaaaaauaaaaugauucacaaccuuagaaaauagaauaauuuaauuugauguagcacaaauccccagaauuaauuuaggaugauuugcuaccuuuuugauagccuuuuaguccaaccuucaaguuuuuauagaaaaaaaaugaaaagagaauaaugauuuuaggguuuucgcuugugauagaauguccuaucuacaugugaagcaaauccccaugcucugaaaaagagaaauaguguggauaauuccaaaucaggaaaaaaaaaaucauuucuauuuggcuuuugaaugaauuaugcauuuuuuuuuccuguggauuugucuuuccaguuagauacugcuuaggcuaaaaugaaauugguuuucaaucuauucucuugcuuauaugaauuuacaguggggccagugggauguuggaaacaaaucagccuaagauuaaaaaauuugcgguggauaauauacaaaguggauaauauacauguguuuaguugagaauuggcuacagauaagagacuucugauuuuguuccucuccuagcuguguauuuuuuuuuuuuuuuugaacacugugauucugcuuguagcaaagagcugcugaguuacaucugcuucugccuaauuaacucuguugguuggugucagaugagagcuaauuuugagauuaaaucgaggaguggggugugugucguggcugggggaggggagaaggaggauccaagguugcuugauuguuuuacguaagaucaaaaugcaguuauucacaauuguucuuuuaaauuuauuuuuugcuuuucaaguaaaaauaaucacugcuguccuaaaaugugacuugugucaauacauauuuacuauuauguaaacugguacguuuuucuuguaggugagcuuauuggucauaucuggguaguccauucaguaccuaggugccugguggccuuugggacaaacagcgaaugcugcccaggaaugugaaugcugaccuuaaaacaacuuuugacugucuuuuuuucugauaaauguuauaucuguuuggcuauuugaguaguaguggguuuuuguuuuuguuuuguuuuuccaugaugagauuuuuucuuaggaaucuaucacaaaccugauuuuuaaaauuugaacaggucugggcuuagggaugaaauuuacuucuauaggcacuuggcuggguccuuggggcuucauuuucugucucaaguuucauauuuauaagaauccuucaguggucuaaaagaauuauuauaucaccaaauguaguauaauaacucauuggagcuguuugucuugaaugguuguggagauacacggaugguugcugaauuuaaggauguccuuauguccaaaugaacauuuccuuuuuucuuuuggcagauuugccugaagaccuggauaaucuccauuuuugucauggacuguuaaaacguuugaaguuccaauucugguacuuucccuuauuuuauuacauuuuuaagguauaaaaugacaaucuuauugaaauguguugguaauggauauaaacaauuguuuuauggauauaaaugauuguggguaaagauuugugggcugggugcaguggcucacgccuguaaucccagcacuuugggaggccgaagugggcggaucacgagaucaggaguuugaguccagccuggccaacauggcaaaacccugucucuacuaaaaauucaaaaauuagcugggcgugguggugggcaccuguaaucccagcuacuugggaggcugaggcaggagaauugcuugaaucugggcgguggagauugcagugagccgagaucaugccauugcacuccagccugggcgacaagagcaagacucugugccccccaaaaaaaaaaaaaugauugugguaaaagcuugucaugaagguauauuuuagguaucuauuaguuaugaaacacauuuuuuuuuuuuuuuugagauggaguuucgcucuuguugccgaggcuggaguacaauggcgcaaucucgacucacugcaaccucugccuccuggguucaagcgauucuccugccuuagccuccugaguagcugggauuacaggcgcaugccaccaugcuuggcuaauuuuuuguauuuuuaguagagacgggguuucaccauguuggccaggcuggucuugaacuccugaccuugggugauccacccgccuuggccucccaaagugcugggauuacgggugugagccaccacgcccggcuaugcauuuuguuuuaauguacguucguuugcuuguguaacaaaacaccuaaaagcaacuuggcaauauugggcacuuuuccugugaccucuucuacuuucugcaguuguauuuugugcaaucaaauuaaauuaguugugauucauccugaauaaaugaugaaagauuaaauaauuacuuggauacagugaaauaucuucuaaugaaauuuugcccgaaaccauuuuacuugggaaagaucaauuuccuguucuaaacuaacugacagagaaugauucuguguucuauccugaaagugguugcacugugaaagccagugauuucauuccuaaacacacuguguuccaagucuaacauuuuugucaaggguuuauauaaugaaacaaaagugaguacuuauuagauuuguagaugacauagaugacagaaucaagauucaaaacaaucuuuagcagguuggaagauaggcuuaaaucaacgagaugaaauugaacgguaauaaacguuaaauugcagcauuucaauuugcagaaggaaagggguggaaagacucaacuugacagcacuuuuugaaaaaagaucugggauuuuuaguuggacugcaugcucaccaugaccacuuguguggcagggguauugaggaaguuccuguaauuuggguugcauuuauaauuggauaaugccugaacugucauauuuuaagauggccaauagccaaacuagugagcaaccaagagaaaguggugcuuugaaacaaugugauauguggaaggguuaagaaacugggauaugaguggucuaaguuauggcuggagguagcaugggguuuugucguuagugguuuucaaaagguacuuguuuuuggacauuugaaggccucucauacugaagaaauacuaagaauugucuugggauccuuccagggaauaggacuaguuaggaauaggaauagggucgaaguuaugggguggcagauuuuugcuucucugagcaagaaauuuagcuagagcugugcaacaguggggugagcugccucaaaaagugacaaauuaucaaucacuggaaguauuuuaaaaauguaaagacucauugcccaucuauuugggauauugggcagggaucuuuuauuggauaacuagagguuggacuggaugaccuucagccccaaguuucugaaucugaggggagaaugaguagagugaauuuacagcuuacugaucacagggacaaucuuguuuaaauugccuccuuuaagguggcauuuuggguuggcauuuaaaacuguacuguuugaacaaguauaguucaaugacccagcuguuuuucagcaacauuccaggaucucugagagcaaauacuauauucuucaguaugucuggcuaaaguuuuuaaggaaagauauuauuuucuucucuuagguauagucugucuaaauaaauaaccagagauaacuuuaauuuuguauuuuguuauaaaaauuucaaaguauauagauguugcauuugaugaaagugauaacuauauauugaauauuagauaauguguuuauuuaauccucucaguaguccuguaagggauauaccaguauugccuacaaguaaagugauggaagcuuaaguuauccaggguuccuccacuggacauugugguagggcugggguucagacccagguuggucucuuugcagaggcagaacuagcuagagcaggcaguuguggcucaggugagaacagugauggacuuaguuggauuuuagaauuggcugggcacaguggcuuacaccuauaauccuagcacuuuugagaggccgaggugggcugaggucaggaguuugagaccagccuggccaaaauggcaaaacuccaucucuacuaaaaauacaaacauuagcugggugugguggcacauuccuguaaucccagccacuugggaggcugugcaggagaaucgcuugaacccagaaggcagagauuacagugagcugagauugcgcuauugcacuccagccugggugacagagcgagacucuaucucaaaaaaaaaaaauuaauaaaaaaaauuaaugauguucgacccuuuaaucuguuauugacucuucccuugggugaauuccaucuucucccgagccucaguuuacccacaaaguucugcaguuuaagugacaaguuauaugugagcacacucuguacaguuuaaacuauaaaaagaauuaagaaguggauguuaucauuggacaccaagauuagagcucagguuuggcccaauucccaggccaaggcucuuucuccuuguagccucuuuguagauguacucaauaccagauuggagaucuagggugguuuuuguauauaccaagcaucucucagaacaaaugccacuguccaccuggaaucagauuuguauauaucuucuuuguacugagcuguuuaaugagcuaacuggguauuaagauaacuagaaugcucuacuacuuaaaggugaaggguuauguuacuguauuauuuucaguuuuccaauuuguggguuagaggguaucauagaccucuguuaaagggauggggaugugauuccauagaaguagcuagaugggaaguuuuuuuacguaugagacuugggaaauacaauaccuagcugaaagcuggauuauuuacucuuuuuuuuaaguuuaagauuuuuugaaauaaguuuaauguacuuucaucagauuuuuuauaucauagacuuauucuuugauguguauuuuauguuuauggcagacauauaccucaaaccacuuucauauaauuuuguuaauuucaauaaauauaauuaaauguauaauuuagaugugauuaugccucauaaaugacuucauauagagaagugaaacauucuaaaaacaauuucuucucagacugugacccaauuucuuguugaaaaauauagucacuguggcuguguuauguaauaccugccugucauuacuucuuguggucauucugugucugaaaaagucaugcuaaagaaucuuuuaguuuauuuguguaagcuucauuauuaagagacuuuccccucuuuuuauccuuuaaggucuugauuucccaguuaaagauguucuucacccgaaugcagucuuuccuguugguaaaauaagacaaccaucaacauugccuguuugucugcuuuugaaucucuuaaggauggauguuuguaagauguugcuuaauacagucuggaauacucuguccauuuguugaauuguaaaugacuuucaaaugugcaaguucuguuaaauacaaagagaaccucuauggguaacuuuuguguugaagaagucauuugucaaccaugguaaaacuugcaaacccacuuuauacagaguggauucuugaagcuauacagaaaauaaaaaagcaaaagcaaaggcccucugaagagagaaucugccaugcggucaguacuucccauggguuggauaagaagacagucucugaacagcuggaacucaguguucaggauggcucaguucucaaagucaccaacaaaggccuugccuccuauaaggacccagacaacccugggcgcuuuucaucaguuaaaccaggcacuuuuccuaagucagccaaggggucuagaggaucauguaaugaucuccgcaauguggauuggaauaaacuuuuaaggagagcaauugaaggacuugaggagccgaauggcuccucccugaagaacauagagaaguaucucagaagucaaagugaucucacaagcaccaccaacaacccagccuuucagcagcggcugcgacugggggccaaacgcgcugugaauaaugggagguuacugaaagacggaccgcaguacagggucaauuaugggagcuuagauggcaaaggggcaccucaguaucccagugcauucccauccucgcucccaccugucagccuucuaccccaugagaaagaccagguaagcgaaggaguaauguucgugcauucucacuacuguccuuuugucuuuuacgguuucacuuaaguuuuauguggacaaaaguucugaauaaaguuugauaaaauugaauguuuugccuuagagcaggcuuuuguauuuuaaaauguauauauuguacugcauuguguggaggacuuccucacugguuggccaagaauuuaauggaagagucaugugguuuguuuuuaagcucuaauugcuaacugguuggugucugaagggaccaggaaggauaauauugaucuuucuucauccaggcagggucauauauauuucagaaaucuacgaaaaggccaucguauauuuuucucuuuauuacuauuuucaaagaagaaucuacagacuucuuauuuuacuauuauuauuuuuuugagacagaaucuagcucugucgccuaggcuggagugcaguggcgcagucuugacucacugcaaccucugccucccagguuuaagcgauucuccugccucagccucccaaguagcugggauuacaggcaccugcuaccacaccuggcuaauuuuuguauuuuuaauagagacaggacuucaccaucuuggccaggcuggucucaagcuccugaccucaagugaugcgcccgccucggccucccaaagcgcugggauuagaggcgugagccaccaugcccagcuagacuucuuauuuuaauggugauaaucuaugcuuuuuuuuuugagauggaguuuugcucuuguugcccaggcuggagugcaguggcacaaucucggcucacugcaaccucugccucccggguucaagugauucuucugccucagccuaccuaguagcugggauuacaggcacaugccaccaugcccagcuaauuuuuguauuuuuaguagagaccagguuucaccauguuggccgggcuagucucgaacuccugacuucaggugauccacccgcuuuggucucccaaaguguugggauuacaggcgugagacaccaugccuggcugauaaucuaugcauguaagaaguuauuuuaauacgucaccuaaaucccucauuucaauaaaaagucauuuuuuauuguccacuucucuguguuguaggugaauguuuauuuugucucauacaguaucuuuuuaaaauacucugauuucuugggccuuauguuauuucuauaguauuuauaaauauauggcagaauucuccuuacauuacugcuaccacuuuaaguuuuugguugaguaagauuugucuuuguuucaaagcuacaguauuuacuucccaaacuaaacacaaaguagagcagcagaaaguuauuuauaguucaugucuaguuuugggguuuauucucugucuuuugggugagcagauauauugauaucaguuaauuuuauuaauacauguuauaaaacauuaaucauuguugauagaaaggugguuuuggcugggcaggguggcuccugccuguagucccagcaccuugggaggccagggugggaggaucacuugagcccaggaguucaagacuagccugggcaacauaguaagaccccugucucuacaaaaaaaucaaagaauuagccaggcuuggugaagcacauguguagucccagcuacuugggaggcugaggugggaggaucacuugagcaugggagguagaggcugcagugagccuugauuguacuccagccugggugauagagugagauccugucccaaagauaaagaaaggaagaaagaaaaggugguuuuggccaggcacaguggcucaugccuguaaucccagcacuuugggaggcugaggugggccaauugccugaguuugagaccagccuggccaacauggugaaaccccaucucuacuaaauauacaaaaaaauuaggcaggcgugguggggggcaccuguagucccagcuauuugggaggcugaggcaggagaaucccuuaaacccgggaggcagacguugcagugagcugagauugugccacugcacuccagccugggugacagagcgagacucugucucaaaaaaaaaaaaaaaaacaaaaaaaaaaagaaggaaagaaauggugguuuuauucaugguuuacugcagccuugaccuuuugggaucaaguguuccucccaaguaacugggaauacagguguaugccaccaugcccagcuaaguuuuuaaauuuuuuguagagaugggguuuugccauguugccugggcuaaguacaguuuagaaacaauugaaacaugcauguuaggaaaaguuaugcuccucuuguuuggauaccaugaacccuugaaauggaaccuguuuuccucaaugcuuuagaucagaucagcccauggaaaggcaaaccaccugguccuacaaauuggauaggaccaggugguuugccuuuccaugggcugaucuaaaaggcuggagugcaguggugucaccucggcucacugcaaccuccaccucccggguucaagugaugcucucaccucagccacccgagcagcugggacuacaggugcacaccaccacgcccggcuaauuuuuguacuuuuuguaaagaugagguuucucgauguugcccaggcuggucucgaucuccugggcucaagacauccuuccgccucggccucccaaggugcugggauuauaggcaugagccacugugccuggccaacauuuauuuguuaacuauauuuuuauuuuguuagucuucugccacauuuauuugauccuuaggugguuguuguguuuguguaaccaaccucuaguucucuguggcagaaugugggcauaaagaaagaaguaaaguuaugaaauuuucuucuuaauaacauuuguuuaaaagaaaauacaaaaagccacuuaaauccuaauucauaugucugacacagccaaaucagggaccucuguuuuuaauuaaauacauauguauauauauauuuuuguuuuguuuuuuuguuuuuuuugagauggagucuugcucugucaccaggcuggaguacaguggcaugaucuuggcucacugcagccucugccucccagguucaagugauuuccuugccuuaacuucccgaguagcugggacuacaggagcgugccaccaugccuggccaauuuuuuguauuuuaguagagacgggguuucaccauguuggccaggauggccucaaucuccugaccucaugguccaccugccuuagccucccaaaaugcugggauuacaggcgugagccacugugcccagccuuaauuaaauauuuuuuauaaaagcuuauacugugaagaaauuccuuaagggacuauagagccauuucuugauggauuuggauaucuuuguuuuuaaaaauauguacacuacccuaagguauguuaagguuuuauaaugaacagguacguggacuaauucagguagcuuuaggcaauuuaauaguauguuucaauaauuuugugauccaggggauacuuuuuacuugugauggaagagucaguacaaauuuuccacaguaucuucugauccuucgcuuuaaccuugcccgucauuucuugccaaccuuaucauauuuuuuucaggcagcaucuguacagaaguauuuuuagucuaaaggaaaauucaugucugaaagugucuaggauugagagcagaguaauuuauugcuuagcaggcaauuguuacugcucuuuuuaugaugcugaucuuuaaauuguuuaguuagcaucaugcuauaaugaggaaagcugagaaauguuuucuagaauuuuuacuugaugaaauuuggagacuaauucuauuaaguaaucauuugauucuuaaaaaacaaaaauaaauaaaaaucaguuuaaacaaaguuggcaacauguuuguauucuuuaaugaaauagcauuuuuuuccagcugggugcaguggcucaugccuguaaucccagcacuuugggaggccgagguggguggaucaccugaggucagcaguucaagaccagccugaccaacauggagaaaccucgucucuauuaaaaaaauacaaaaguagccgggcaugguggugcaugccuguaaucccagcugcuggggaggcugaggcaggagaauugcuugaacuugggaggcagagauugcagugagccgagauugcgccauugcauuccagccugggcaacaaaagcgaaacuccaucucaaaaaaaaaaauaaauaaauaaaauagcauuuuuccuuaaaaaaugugagaaaauuacaacauaauauauuacccuuugaaauuaaaagugauuuaauaguuuaaaaccauguaaacucgcuaaguaaauuuaauagaaauucuuagcccgggauccacaaaugaacuuggguggguaucccacaaauccucugaaauagagugugaagucauguguguguauccauguuuuucuuuuuuuuucuuuuucuuuuucuuuuuuuuuuuuuuugagacauaguuucacucuugucacccaggcuggaguacaauggcacaaucauggcccacugcaaccucugucucccagguucaagugacucuucugccucagccucccuaguagcugggauuacaggcgugcgccaccaugccuggcuaauuuuugcauuuucaguagagacgggguuucaccauguuggccaggcuggucuugaacuccugaccucaggugauccacccaccucagccucccaaagugcugggauuauaggcaugagccucugugccuggccuccacauguuuuucuauggcuagggucuauagcaagcuuguccaacccauggcccaugggcuagaugcggcccugaauggcuuugaaugcagcccaacacaaauucguaaacuuucuuaaaacauaaagagauuuuuggcuugcggcgugguggcacacgccuauaaucccagcuacucaggaggcugaggcacaagaauuguuugaaccugggaggcggagguugcaguuagcugagauugaggcacugcacuccagccugggcgacagagcaacacuucguuucaacaacaacaacaagaacaacaacaacaacaacaacauuuuuuugugguuuuuaauuuuuuuuuuuuuaagcucacuagcuauuguuaguguauuuuauauguggcccuagacaauucuucuuccaguguggcccagggaagccaaaagauuggacacuccuggucuacaucuuuugucaaaggcacccaaaaugccuaguagccauuuuaaaauaguuugaguuucuuauacuaaaucauaguaugcuaauugucgaccuaugaugauucuuccuuuggcugcugaacuuggauucauauguagauugauuguacuauaauuuccuauauauaagacuuuuucuaauauauuugaaaagauuaucauuguucuugaugugcuugaagucauaggauuugccuugcauugugggaggaaauuuaugauauaagugaaaacaguucagaaauggagugaucucaauuacaaucuagucaacuaaugccuuuuuuuugagacagagugucacugugucacccagucuggagugcaguggcaugaucuuggcucccugcaaccucagcaucccagguucaaacaauucuugugccucagccucccgaguagcugggauuacaggugugugccaccacacugggcuaauuuuuguauuuuaguagagaugggguuucauuaauguuggccaggcuggccuugaacuccuggccucaagugauccgccugccuuggccucccaaaaugcugggauuauagacgugagcuacuaugccccaugccuggccuaacuaaugacuuuuuuuuuuuugagauggaaucucacucugucauccagacuggaguacgcuggugccaucucagcucacugcaaccuccgccucccaguucaagugauucuccugcaucagccucccaaguagcugggauuacaggcacgcaccaccaagcccggcuaauuuuaguauuuuuaguagagacaggguuucaccauguugaccaggcuggucucgaacucgugaucucaagugauccgccugccuuggcaucucaaagugcuagguaggauuacaggcuugugagccaccgugccuggccaugacuuucaagaagcuguuuauucugguuacuuuuuugagcaguuacauuaaauguaaaacaaaauaaaaauaguaagaauaauaacuaacguuuuguaaguguuaaaugcuggcacuauuccaagugcuuuacauuuauuaucuccuugacuugucacaauaacugcaagggagguagauuauuacccuuauuuuacagaugaaaaaaugaggcugaaagcuuaagugauuugcccaaggucacugauagagcuagugaguggugaagccaagauucugacgagacagucugaccucagagcucuuuaccacugggcaguacacuggucaacagugguggcuuuuuuuuuuuuuuugagacagagucucgcucugucgcccaggcuggagugcaguggcaugaucucgccucacugcaagcuccgccuuccggguucacgccauucuccugccucagccuccugaguagcugggacuacaggcgcccaccaccacgcccggcuaauuuuuuguauuuuuaguagagacgggguuucaccguguuagccaggauggucucaaucuccugaccucgugauccaccugccucggccugugguggcuuuuuauuaacaguaaaaguaucucuuccaguucuucaaaugauuagaagcaguuuugccccaacaaauagauuuccagcauuuuaaauuugguagaugcaaugagcuuauuauaguuuuuaaaguagauacuauuuauaauauuagcaauauggaaaggcaguagagaaaguaguaagucugugucuaauuagauugaacaucaucaucauuccgaugcaugacugcuaggaggaauacaaugcaaguuaaaauagaagggcuccuuccuuucugaaauguaauugcacaucuucugauagucuggaauucaaauuggguauuaccacacuggcuucuuagcauaaauucuuuguauuuauuuaagaaagcucucuucggugaggugauauggaaaugaauuaaaccacugaagauaaaacuuuaucuuugacuuggugagggaacuccuaaaggauaguauuaauguuucucauuaaaaguaguaaagcucaauuaggucagauuaugaggacuuuggaaagucacauauucuaagagagacuuccauuaucacugcgcacuuuguagcauuaagauuccauuugaacauuugagcuuuagcauuuuuauaaaaucaguuuaguuccauuuaaaauaaauuccauaguauuucacuuuagugagaaugucuucauaaaauuuauuaagugucaagucuuggucuguuuccaguguaguacauaaugugggaauucucauucuagguuggcaucguaauuggaaggugggacacuuucaguaucaaguagggcuucugauguuuuuucuguugaagaaauauuuguauuagaaucuuacaaaaagccuucaaacauaaacaaaauuacaaaaacagugauacugucaauaagaaaaaaaucaaaaugauuuuuuuuuuuuuggauacagagucuugcucuguugcccaggccggagugcaguggcgcaaucucggcucacugcagcugccgccucucggguucaagcgauucuccugccucagccuccugaguaguuggggauuacaggcaugugccaccaugcccggcuaauuuuuguauuuuuaguagagacaggguuucaccauguuggucaggcugauaagaaugauuuuuuuuuuuuuuuuuuggagauggagucuugcuauguugccaggcuggagugcaguggcgcgaucucggcucacuacaaccuccgccucccugguucaagcaauucuccugccucagccucuggaguagcuagacuacagacgugcaccaccacgcccagcuaauuuuuguauuuuuaguagaaacgggguuucaccauauuggccaggauggucucaaucucuugaccuagugauccaccugccucggccucccaaagugcugggauuacaggcaugagccacugugucuggccacaaaaugauuuuuaaaaggaguucagaugaucagaaaugggguugaaagacaaacguaggacccuuguuauguguggucuuggcuuauucaguuguuuauucuauuucuccugccccuuuuagagagauacguuguuaggguuuuuggcacuguuauuaauaugaaauauuucuacaaauagaagauaaauguacauccuacagcaguugcuugaguuguuuacacacaugaauuagauaaguuuauuuuuagauuuucuuuucuucuguuuucuccauucuguuuucuccucuucaguccccuuaacccugcccuagagcagacccuccucaucuguucugggacuuuuccaauagccuguacuuuaugaaggacuauucauuaguccauauuguucuuugauguggcaggcuuccagaagucucucagcccuaggggaauuguucauagucucaggcaacucuggaucuuuuuuggcagaaauguguauauuuuuuaucugcuaauuauagagccugaauguccuccucucuguugaccuucuuaguuuuccuuugaauugguauccuuuguguugcagaugucaucuuucuugaagagugcuugauuauguguauuuaacugaaaaucgaauaaaucucuaaauauuguaaaauaugcucuucaaaauaaccugcauuuuggaauugguauggauaaagucaguuuuagaaucacuaaagucagacagaaaccuauuguaaugugaaagacgagguggaucaaauacuugcuguuccagggucauggaaggaaaaaaauugcaguucauguucuucuuauaauuaagcuucagaaguucuucacaauagcagugucugaggacugcuuuugugagcagguaguaccaguuguugagacauuguugagagagcacaugaauugucucaaacuaguuaguugggucaagggaaagauaaaaugaagggugaaugagucuuucuauuguacucugaggcaugacagcguguuccacuuuugagcuuuuaucaagaugggacuugucuagacuucuaaugaaaugggcuucagguaaaguagaaacauuaugucaagaggauuuuugguuguucaaaugaauguuaaacauucuuuuaacucuuuggaucuuagauagauuugauaguugugauaccuuuacuguauguaacacaugauccuguccugaaugaucagcagcuuucaggaguuacucuuguauucccagcuacauuugugauacuuucagugcuaagaaaaucuauauucuguagcuuugaaguuauuuaacaguuaaguacuauuugcugguuuauucugauuuugucuuaaaugacaaauauuuuauucauccuuucucuucaaacauuauuuaacaaauguacguuuuaauguuucucaaaaaugaaggucuauauucuuuuuauauguuuuaucuuuguauguuauuucuuucaucuuuuuuuuuuuuuuuuuuuuucugagacagggucucacucuguuacccaggcuggagugcagugguuugaucauggcucacugcagccucgaccucccgggcucaagugauccuugauccucccaccucagccuccugaguaacugggacuacaggugugcaccaccuugucuggcuaauuuuuuuuuuucuuuuuuuugagacagucuuacucuguugcccaggcuggagugcagccguguaaucaugguucacugcagccuugaccuucccaggcucaaaugauccauccucccaccucagccccccaaguagcuuggacuacaggcacacaccacuacacccagcuaauuuuuguauuuuuuguagagauaggguuucgccacguugcccaggcuggucuugaacgccugagcucaagcaguucacacaccucggccucccaaaguacugggguuauaggcgugagccaccgugcucagccuuuuauuuuuaauauauaagaaaugccuuuuuuuuuuuuuuuuuuuuaauuugagauggagucuugcugucuugcccaggcuggaguguaguggcauggucucggcucacugcaaccuccgccucccagguuaaagcaauucuccugucuuggccucccgaguagcugggauuacaggcaugugccaccacuccuggcuaauuuuuuuguauuuuuaguagagacggggguuucaccauauuggccaggcuggucucgaacuccugaccuugugaucugcccaccucggccucccaaagugcugggauuagaggcaugccccaccacgcccagcccauuguuuuaucaugacaguagcaauguguuuuaauuguaaaauucuugacuuuuuguuuuguuuauaaacuuccuuuucuuggcccugugccuuaaacuacaguagauuaggugaaacuguucucugaucacacuagcauuuaaaauaugaaccugaaucuucucagguacuuugaucucuccaaucuauuaauguuucugaguacauaaacaucaauuagcucaccaaauuaaaguuagcaaaugcgucagccauguaauuugcaugugacauuuugaguuagcagggccaagagggaaguauguuuuugugagugggugugcuuaucucucugucuucagguggugauggaaaguuguacauguaagagaaggaguuguggcaguggauaugugaaaugcuaacuguacauaugccucugcuuggggcagaagcacuuuaccagagaagucuccaacaguugcaaacuacauauucuuuuuccuuauauaagugaaucuuuuaauuaguguaauauuauguagaguguauguuuuuucuguuuuuuuuuaaugaaaggugauauuuugauaaaucugcaaaaugagcaauauagacaacauuuuagagugaaugauacuagauuuaaacuaugaggcuggucucugcaaagauacaaaguaaauacuaaucacuggucuaagcaaaauccaggaaggauuuuuguuaauuugacaaguggguuuagaauucuuuagccacuauuuuuuagaaaccagcuuuguucauacauccuuucucuaauuugccucacuuuugaucugugauaaaccagcugcaauuugguuucauuaacaaacuuaacuggucaacagauguuuuggcucuauuuuguccuuucuauuagaaacagcauaggcguacacagaaaccaugcugggccuuuuccugucuguagcucgacaggcguuacagaagagcaaccuaacuuuacuuacaaguucaauuuuucuuccucaguauuuuuauuauagguauacaaacauuguaguuuugucucccccaucaagucggucuuuuguuguuaaucuuccaucuguuaguccaguauacacuucucacccugcuuuuuagcauugcaaaaucuuagcaugcagggaaaaagguacuauugcaggagagguaauugagauaucagcgacucuuccacaauucaagggaaggaguggaacuagccuggugaauuuagauaauuucuuccgucuucuuugaugucagugagcugccauauggagagcagugaggccugcaggaaggaggugagccuuggucugggcugccuaggguguucagagugacaugggcugagagccagaggcagagcuugacuguuucuguuaguaguuucugaugugaccagcccugcuuuuuguccaagguuucccugucaugcuugccacccuauggguaugaugaaguuuaagaaacagaucauaaacauuaucuugggaaagagaaacauaagaacauauuaaaaucuaguaauaaggccauuaaaagaugacucccauuugauauuugaccaacuuguuuucaaaauuaguauuguaaacacuucugucuuauaacaaaacccagcuuuagcuguugagccuugaguugugaguaaagcagcagaaaacaggaucugcuaguggaagaguauuggcuguuugaagaacaucagcuguuccagguagacuccuggcagugugugagcagaccugggaaaggcaggcauggagggagcuaggaaaauacuucucuccuaaccuuuauaauuuauaaaauuagaguauuucauaaauauuaaaagaguaguacaguaaacacucuauuucuuucacauagauucaccaauuuuaacauuuugccacauucuuucucuuccuauauguguguauauguauauguuuuuauacaugggugugcguauauauacagcacauuuauauauucacaauuuugacuaaacuguuggaaacuaaauuacaaauauuauauuucaccccuaaauacuuaauaauauaucaaaaauguucucuuauauacuauacuauuacgcaaaaaauucggcaguggaaugaguguuaacugacaguccauauuuccccaaauggccccaaaaucucauuuauaacuuuugacuuuuuuugagauggagucucgcucuguugcccaggcuggggugcagugguaugaucuuagcucacugcaaccuccaccucccagguucaagcaauucucuugccucagccucccgagcagcugggacuacaggugcgugccaccaugcccggcuaacuuuuuuuauuuuuaguagugaugggguuucgccagguuggccaggcuggucuugaacuccugacaucaggugaucuacccgccuaggccucccaaagugcugggauuaaaggugugagccacugcgccuggccaacuuuugacuuuucauccaggauccaaccaaagaucauauauugcauuuggcugucaugucaccuuuaauagagaacaguuuucccuccuuuuugcuucugaagacauugacauuuuugaagagucuaggguaguugucuuguaggaugucccacaauuaguauuugucugacuguauccucaugauuagauucagaguaaacauuuuugacaagaauagcgugugggggucugggagugguggcucacaccuauaaucccagcacuuugggaggcuaagauggguggacugauugagcucagaaguuugagaccagccugggaaacauggugaaaccccguuucuacagaaaauacaaaaaaaucagcugggcgugguggcaugugccuguagucccagcuacuugggagacugagguagaaggauugcuugaauccaggagauggagguugcaguaagccaaggucacaccacugcgcuccagccugggugacagagugagacucugucucaaaaagaaaaaagaaaagaaaaaauacuguaugggggauguuguauauuucuucuugugagauaccaggagauaaauaauuucagcuugucucauuacugguggugcuuaguuuaucaguugguuaagguggcaucugcuagaucuucguuuauaaaggcgccuuuucccuuuuguaauuaacaaguaaucugugcaaugauacuuugaaagcaugugaguaaccuuucacccaguguguauuaguuuucuauugcugcuguaacaaauuacagcaacuuaaugguuuaacacaacacaaauguauugucuuacaguucgguaggucagaaguccaacauggguuucuuagguuaaaaugaaggugagggcaagguaauguucuuuucuggaggcucuaggagagaaucuuuucccuugcuuuuuugagcuucuagaggcugcgcauauuccuugacucaugaucccuuccuccaucuucaaagccagcaauguugcaucucucugacuguucuuucacagucacaucugccucuuaccacagccuggacaguuuuucagcuuuuaaaggaugcauauuauuagauugagcccauuuggauaauccagauaaugcccuuaucucacaguccuuaacuuuaucauaucugcaagguuauuuugccagguaagguucugggcauuaggaaguagacauuuuugggggagcccauuauuuugccugccacacaggguuuaguauugucaccuaaaucaaauuuugcauuggggguugcaaaucauugaagguuuugggcuauggugaaccaugaucaagucuguuuagaaaggaaagagggccaggugcagguagcucacaucuauaaucccaaugcuuugggaggccaaggcagguggaucacuugaggccaggaguuugagaucagccuggacaacauagugagaucccaucucuagaaaaaauuuuuaaaaauuauccaagugugauggcacagaacuguaguccuaacuacuugggaggcugaggugggaggauugccugaguccagaaguuugaggcuguaagugagcuaugaucgugccacugcacucuagccugggcgacugagcaggacucuauuucuuaauuaaaaaaaaaaaggaaaaaauaaccagaaaggaauuaaucacaguuuaugggaguaaugcuagcugaaggccgggggucaagaggccugaguuuugagucucaugguacauccugagucauuuccaggagagcaggaacgggggcgugcacucuugccuccacuucaugucccuuuacucacuaguugaagaacugaagaauggauuuggcacuaauagcuucagaguuuuuaacaauagaaguuuggaugggcaauuuuuuuuuuuuuuuuuuugagacagggucucacuuuguugcccaggcuggaaugcagcggugugaucauggcucacugcagccuugaccuccuaggcucaagcacuccucccaccucaggguccuggaacuacaggggcgugugccaccaugcccagcuaauuuuuguauauuugauaggcauggguuuugccauuuugcccgggcuggucucgaacuccuuggcucaagcaaucuacccaccuuggccucccaaaguucugggauuacaagugagagccgcuaugccuggcccaaaaugauuuuugagaaguacauuuaaaguuguagagaagggucuuucauuuaaaugcccacagggugcaugaaaaauacaaggugauuuaucaagauaggcucuuuggcucaugccuguaaucccagcauuuugggaggccgaggugcauggaucacuugagguccagaguucgagaccagccugggcaacauggcgaaaccccaucucuacuaaaaauguaaaaauuagcugggcaugguggcucacgccuguagucccagcuacucaggaggcugaggcaggagaaucgcuugaaccuuggagguggagauugcggugagccaauauugugccacuauacuccagccugggcaacagagcaagacuccaucucuggaacuccugaucucaagugaucuacccaccuuggccucccagagugcugggauuauaggcauaagccagugugcccugccuuugaugauauuucaaagacuaaguaacaucugaagaauuuuaugucuuuuauuuauuuauuuagacaacgucuugcucuguugcucaggcuggagugcaguggcacgaucuuggcucacuacagccuccaccucccagguucaagcaauucucaugccucagccuccugaguagcuggaauuacaggugccugcuaccaugcccagcuaauuuuguauuuuuuuuuuaguagagaugggguuucacuguguugaucaggcugguuuugaaccccuggccucaagagauccagccaccucagccucccaaagugcugggauuauaggcgugagccacugugcccagcauauaucuauaauuuaaauuagaacccucaaucagagaagucuaaauaggcugaaaaagaaacucauuuauuuaaaaaagaaaaaugacaugcagauggauguauauuauauucuuuuaguuuuuaguaaaaauucagaaaaauaaacaugaacuugagguaacgagccucuagaauucuucauuuuauuucauuucacaauguuucagcagucuucugcaguuaguuggaagguuuuggaaauucugacuaauccaguuguugaagaauaacuaguuagcuuaauaaauauguuuucuagagcugauaaaaaagaugauuuuuucaucugaugagcucugacccucuauaaaccuucuaacuuaacucauuuuccaccagcuacagaaauguaacaagaugccaacaauuacauccucauggagcauguauacuagcuuauaaaaucaccccuuuguuggaaaauuguguaauaucuugauuucaauuuagcauggcauguugguuagcaguaaaucuugcuaguguaugaacacaagccugcaggcaguuuggagaacauugaucagguguaaauuguauguauuuuucucgcuucuaaaaauuuuauagcagaaugaaauaaagagcuagcauugagaacacuuuuucaguuguuuuuuauuuuuuauuuuuauuuauuuuuauuauacuuuaaguucuagggaacaugugcacaagugcaaguuuguuacauauauauacaugugccaugcugguuuguagguuguuuuuuauuuugacauguaucuuguggaaagugccuucucucuccugaaauccaugauuugugucucugaccacuuagguuccccauuuaguaugugacacauagcaaaagcaaacaagcauaguuaaaacguguauuugugccuugugaaaugugcauuauaagcaguuaauacuagauuugaaggcuguacaaaaaacaugcaaaaagauauuaauauuaaauacuuagugcuuauuguguauauuaagcauuuaauauauacaauauaauuuugcaugaacucugaaagauaaguacuguuauuaacugaauuuuacagaugaagaaacaggccaaauaaggugacuugcccaagaguacacaggaaguauuggagcugguguuucaauccuggugcacaggcagaguguaguguagucacuuuaucaccuucugccucucauuucuucgggcgaaaucaacacauaccuagugaauucuugcaauauauaaaacacuguauuaggcacauaauauggaaguuaccacauaucuaaaugguaauaaaagugaucaguugaggcuaggcaugguggcucacgccuguaaccccagcacuuugggaggccaaggcaggaggaucacuugaggccaggaguucgagaccagccugggaaacaugacaaaaccccaucuguaccaaaaauacaaaaauuagcugggccaggcgcaguggcucacaccuguaauccuagcacuuugggaggcugaggcgaguggaucaccugaggucaggaguucgagaccagccugaccaacauggagaaaccccgucucuacuaaaaaugcaaaauuagccgggcgugguggcacaugccuguaaucccagcuacucgggaggcugaggcgggagaaucacuugaacccgggagguggagguugcgggagcugagaucgugccauugcacuccauccugggcaacaagagugaaccuccgucucaaaaaaaaaaaaaacauuagccggguguggugacacacaccuguaaucccaacuccucaggaggcugaggcaggagaaucacuugaaugccggaggccgaaggugcagugagcagagaucacaccacugcauuccagcuugggugacagagcgagacucugucucaaagguaaaaaaaaagaaacaugcuaauacauacagcuguuauuccuuuucaaacgaucauuggagugaucaucacuuuuagagcaauugaaauuuuaagaaugaauaauaacaaccaacauuuauaaaaugcuuuacuaugaggcaggcacuacuucaagugcuuuguguauaaccuguuuguaagguaggacuauucauucuucguuuacaaaggaagaagcugaggcaugucaggugaaaggacuugcccaagauuaccuagcuauuaaugugguagagcuggagccaggauuuagacccaggcauccaagcuccuugaucuguacauguaaccauuauacuacauuaccucucauuuuccugaugaagaaaacuucuuuuaaugagaagguauugaaaauaguuucauauuagguucuuauaaacaugagccuuuaagugccuuuuuacuguuuauaauagacgucacugagaagauuguuaaaauuuauaauaugauaucauuaaaguagcuuuucccaaaugauguucugaggaagaaggaaguacucuacaagaaauuaaugaugcuaauaauagucugagauuuacaguaccugaguaguucuaaaauuuaccuugccuaacccaagaugauuugacgaugggccucucuccucuuugucuucauagcagccauucacuugucuagaaaucuuugcauuugguuaagcaguuuggauagugcugauguaagguuauagugcuaauuccuuugcuuauuucuucuaaauacacaucccaagggaaaccauugauuaauuaaacuuggaguuuguccuucagaauagaaaaccaaaaaucaucaaauucaccccuugucucuauuaauguauugauuuaguaauauuuauguaauucuuuaaauguaguauaaaacuuuagaguugcaggagaucuuugagaucaccaaguccaggguuuuaaggcuaagguucaaggagcccuuuuuucugggguuuguagaccucugaaauuauaugcaaaaagaguauuuuucuggagcuucuugccccuccucuccuucagcaggucauuugaccuaggccagugguucccaaacuuugcugcacauuagaauuacuggaggagcuuuuaaacguuagaugcccagaucacaccuccaugcugcuuaaauaaaaauguuggagugggagucaggcauuagaacuuuuugaaguuuccuugugaugccagcaugcaucacaugcuuucuucuuuaauagaugaacaaguaggaucuacuuauguggcugaggaagcaaucuagagauguuaauuggucagggcucugcuuccugcuaaaagagauuuuagagaucguucugaaggagucuuguggggaaguggcucuggagcuagaaugcuuagguucaaaucccaaguuuuccucagcugacuaauagggaugauaauauagcacugaccacacugggauagucgcugccugagcuacagagguggugagcuuguccucagccucaacagaaaggucagcugaacagacuccaaggcaguggagggacggcagcccccagcacuccacucugccauacuguuugggaaggaaaagcuguaaaccgauguccucauuaccuucuaacgaagaccuccucuccucuugcucucuuacgccaagaauggcuagaauccguuucucuuuguggcuccuuccaccccaccucauguuauuuaaguaaucagaaaaggagucuauuauuuucagaguaacacaugcuccuuguacagacuuugaaaaacagaaagauuuggagaugauacauuaucacugcaaauuugacuauaaagauaacuacuguugaaaguguguauuuucuuccagucuuuuuuccuuuuuuccuacauguaaauauguaugcuauauuuaaauaaaaagaagacugugugagcuauauaauuuuguaucuuccuuucuaaauuuaaaaucuguugugagccuuuucccauauucuugauuauucuuugaagcugacuaaauagcugcauaguauuuaugucuuuauccuucaaaauuuaaggugcuccuaaaucuucugcuauuacaaauaauaccgcuacuaaaaauuugugcauguguggauaauuauuucccauagaauagauuacuaaaggagguaauacugaggcaugacuaugaauucuuuuucuaaagcuuuggaagcauauuaucaaaaacuguuccaaaaagauaguaccaauuuauacuuaugggcagaguauaagggagugugggcaucuaauugauucuuaaugcuuaccuuuugucauguuaauguaguagagggaagaauggauccuuaggaguuacuuugcauuucuuugauuacuaaugacuuggacauuuuaaaaugauuaauggccauugcuaaauaacaguguugugguuauuuccccauccuuauuccuaugcccugcagauaagcaucuucaacucuuucaaccacauuuagucuggcuucuuagggaaguuggaggucuguaauauucuuacgcuguuguuucuuauuuuuaaauuguagacauuaucuguugacuucuugcgaguguagauaaggauaaaggucccucauacacauacacuuuucucuuucccuuugccccucuuaucucaauauacacuacuuuuauguagguaaguauauguauucagugcuuauauuuuuaugaguuuguaaauauuauucacacuugagccaucaaaauuuuuuguuguuguuuuuuugagacagggucucucucuuucagccaggcuggagugcaguggcgcgaucucagcccacugcaaccuccaccuccuggguucaagugauucucuugccucagccuccaaaguagcuaggacuacaggugcacaccaccaugcccagcuaauuuuuguauuuuuuguauuuuuuugagauggagucucacugucgccuagguuggagugcaguggcgcgaucucggcucacugcaacgcuccaucucccagguucaggcgauucuccugccucagccuccugaauagcugggauuacaggcgugcuccacuacgcccggcuaauuuuguguuuuuuaguagagacgggguuucaccauguuggccaggcuggucucgaacuccugaccucaagucuguauaaaaaagccuguauauguucuguaaagacgcaaccauccacuuuuuuccccucagguauuuuauuuauauauuuggagacagggucuuucucuguugcccaggcuggugugcaguagugugauuucagcucacugcaacuuccgccuccuggguucaagugauucuucccccucagccuccugaguagcugggauuauaggcaugggcaccaccccaacccucgacuaccccagguguuuugaauugagguuaguugacuccacacauacagagguccaacuguauauaaaguaaagaguaaaaguuuuaccucauuggcccuguguguucuucucugaaaacagcuuuccaaaggcagccacacuuggugguuuguauguauucuuacagggcuuuuuaaagcacuuguaagcuaauauuauaccuacguuuauguauuucuuguaacagaaauugggaucggacuuugguauuuuuucuuuugaaaaguuuuuagauauauaagacauauaugaguacauucuucuugaaaaaguucuaauagcagaaagaaagugucacacaaacucccugagucucacuuaccuuaucuguaaaaugggaaggauuauauauucuucauaggguuguuaauuagaauuuaaugaaauuaugcauuuagguggccuaacacagugccuauucaauaacaaaaaugagcuaguuauuuugaacauguaucagcuuuggaauuuuuaaugaagagcauuuuggcauauuacuguauaguuugacaguggucuuuugauuugcucaguccuuuuucagggucuuacagaagaaaaggagagucuuacauguuuuccuucauagcuuuguaugcuguaaauaugaguuuaguuuaauagcagaguuuuucuuucuuuuuugaauuaauuauuuggauugcuuccucucuacugccuucaagccaaaagcucagaguuucccaaaccaaagugugccucaaucacaauuuuuaccaguuuuauacaaucuguauuaauuauuuuaucuuuuuuuuuuuuuugagauggagucuuacucugucacccaggcuggagugcaguggcacaaucucagcuuacuguaaucuccaccucccaggcucaagcgauucuccuggcucagucucccaaguagcugagauuacaggcgugcaccaccacgccuggcuaauuuuuauauuuuuaguagagagggaguuucacuguguugcccaggcuggucuugaacugcugaccuuaagugauccucgugccuuggccucccacaagugcuggguuuacaggcaugagccacugcacccagccccuguauuauuuucuuaauacuugcuuucacauuaccgcacuaaagaggcauaauaaccaaaugccgugcauggaaaacaguacaguugacccuugaacaacacagguuugugcugcgcuggucaacuuacgugcugauuuuuuucaaccaaaucuaauacaguauucauggaugcaaaaugcacacauacagagggcugauuuuuugucucuguggguucuucagggccagcugcaggacuugaguauguguggauuuuguuauagucugaggucuuggaacugaucccucauguauaacaagggaugacaauauuaaaaaauuacuuauuugggggauaauuggauacauuugaauuuggauuacauauuaagggaacuuaauggcauuaauguuauuguucuucaauaugauaauggcauuuugauuaucuaggaugucuuuaugaguugggagaugccuucggaaguauuuaauggugaagugucuugauguuugcagcuuacuuucaaaugguucagcaaaaaucauacuaaaauauguauguauaaauauaugugugaauauagacagauauagauaaagauaugaggcaaaagauaggaccccuaauuguugaaucuaggugaagggcauaccaguguucauuaugcuacuucaacuuuucuguagggcugaaaguuuuucaaaguguaaacuuggaaaaauaaauguaauuagaauauuuacuuaaaauuaaauugccucauuuucuuuaucuuaguagauuuacuaaaaaaaaggagucuauaucauuauuguaaguggaaaacaagcauuccuugccauaaauagaagauaacuguaaaaguuauuauuuuaaaaaguuucagcuggauauuguugucugccaaggcucugagccugaggccugcucucucaaaagaagauuaacaagcauuagaggcguuaaacacaauauuagcaccaaaaugagacuuucuucuugacuuaaugggaagguaugaaagaaaauugaaaagggaacaaguuucucauucugugugauucagcucaccucauaacaucucaagucucaccucaaggcaucuugaguaccacuagugauagaaucccacacuuggggaaauacuguaucaggugauuucaguguaauguguuagaaugaaaguaaauuuuuauauuaaauacuguuuauagugcccauuaugucuuuuuuaaaccuuguauguugguuuaucaucaucauuauuauuauuugguagucucgauaacuagagcuagcugcaugguuagcugcgugauguccuggcuuagggcagaugucagauauugcagucuaaauuauuauugggguauacuuauucuauuuuaugauaugcaguguugccugacucucgaagcauaauaaagccaauugagaucuuuaaaaaauuaauuauuauugauuucuuacucugaaguugcucuuguaguggguuuuugcuauauauauuuuuucuuuccuucuuuuuuucuugcuacauuguuccugcuguuauuuggaaggcacuaggacauuuugccucuugaacaaugaaaggauccagaucgugucugucucacauuuuguuaucccaguacaagacucaauugaauaaaacauauuacccaucuggccuggaaaucucaguggcacucaaaauaacuuacuaacaaguuguuggaucaugauaucuugagauuuucugaaaguucagcuucuuuuuagcuguugcuaagagagaaauuucauugacaugagggacacgaggacaugucugcacacugccaguuguuuuagaggcauuuggcucugccgccuugcagaugguuagacucuggguggugggugaauguaugcugauuaucuuauugaauuaagguaaccuuuugucauucauugaauucugcagaccaguuggucagugagcagcugcuccauguggcuugguuuggguuuugaaguacacaaaaacuaucuuaaaggguggucagucuaauccagguauucaacaaagcaauauugaaagccuucuuccccuuuugacacuguuuucuguucugauggaagugaaugagcaaaaauauuuuuacuuuuugcucaauuaacuaaaugauugaagcaaagguuuauggaauggccgaauaagaauuuuuuaaccuagugcuuuaaguugaagaaaauacacuuucauaauauuuggugucagaaacauucuacuuuuauggcauggucuuauguuugaagauacgugguagaguuuuuaaaguuuauuuuuacaaauaucuagaaacuaaaaagcauucuuuuuuaucaugcaugcuuaauaacaucaucuugacaaauacuagcugcauaacuuuugguuuguaggguuguuuuaagaucaguuuuuuguuuguuuauuauauuuuaagagacggugucccugucuugcccaggcucgucuugaacuccugagcucaagcaauccuccugcuucagcuucccaaauaacuggaauaaaucugccauauuuuuucuauauggcuuccauuucaguuucuagaaacucuuucaggaggcuucauuuuaaauaaagagguucuuaauuguuuuuaguaaauugcugaaauuguauggcucauuucucuucucagagauuuuuaucuugagcugauccuuuugguuuuacugaaggugcaauauagguaaccucagagaaagugacuuuagccacuaguugauuugcuuauugucagagagaaaucauuuaacagugauugaugaggaacuguuuaauuucuccaguuuagucaccuguugggcccuagagccuuucgauucagagcucacuguuucauuugcauuuauauccuaguaacuaucauaaugucuaccaguauuuauuaagcacauauucugugcugggugucgccguuuauauaugcucuuucauuuuguccucaccacaacuuuaugaggcaggucuuguuagcuccauguuagagaugauacagcagccucccagggauguucauucacuugucugguaucaugcagauaguuaauggcugggccauauuggaguccagggccuucagacucucaggcucaugcucccuucugcccugcugcuguuuuaaugaaaaucagccuuguucugaaccacaguuuuacaaugaagcuuaagauuaaacugaaaaugcucaaguucucuguuagggcuucagauucuaugucuauacuugucuuauuaaugguaaaaauaauguaacaacauuaaagaaaaauuuugaagggugaaacacuguuuagacucuugccaccuuaauacaaccguuuuguuuuugcuuauuuccuuccagauuuguuuaugcgcguguccuuucacacaacuauaaucaaagcauauauacagcuaugcaguuuuuuuuuuaaacauaguguuauuuuauacauauuuucuuuuuaaauguucuuuuuuguuuuugagauggagucucacucuguugcccacccagacuggagugcagcggugcgaucuccccucagugcaaccucugucuccugaguucaggugauucuccugcuucagccucccuuguagcugggauuggccaugccuggcuaauuuuuguauuuuuaguagauacaggguuucgccauguuggccaggcuggucucgaacuccuggccucaagcaaucugccugccugggccucccaaagugcugagauuacaggcgugagccaccacgccuggcuuuaaauguuguucuuuaaaaagacuuuucccaccucuuugaauuucccaaucucaacgaggucccuuuuauaauucgaacaaaggaccauaugcuuuuucuuauuagccuuuauuauagucuaauuauguauuuauuugucuggcuauuuuguaacuuaaguuguccccucuaaauggaaaagcuucaugaagacagggaccuuauuucugcuguauggaugcaagcaguuauuuauuaacuaagauuaagcuucuguuuaucuguuaccucaucugucagaaacaguuggacagauuuucaccaaacuuagaagguuuuugaagggcaucuguggugaucaggagacacaugacauauauuuucugauccugugucugagauaacauacagagauuucaaacaugagaccuggcugggugcaguggcucaugccuauaaucacagcaauuugggaggcugaggcaggaggaucaguugaguccgggaguuugagaacagcuugggcaacuuagcgagaccccaccucuacaaaaauacaaaaauuagacaggugugauggcaugccccuguagucccagcgacuugggggugcugaggcaggaggaucaaucacuugagccugggagguugagucuguugagucugcagugagccaugaucacaccacugcauuccagccugggagacagaacaagacucugucucaaaagacaaaaaaccccacgaaaaaccaaauaugagaccaugagaccuauauugaagggcccaagggcagauugucaagauggcagaccuugguuugcacuuuagaguuggguagcuucuuaacuugggcuguuccacaucuuaaucuaggaugagcagcaacaaggaugucuuuauuuaauaaugaccaacaagucucccagucacauacugacuaauuucaaauaaaugcauuugaucuuuucauuuucauuuugcuuguuuaaauauaaauugucuauugaaagaguuuuuuuuucuuuuugagacagaguuuugcucuugcuguccaggcuggagugcaaugguggaucuuggcucauugcagccuccgccuccuggguucaggcgauucuccugccucagccuccugaguagcugggauuacaggcaugcgccaccacgcccagcuaauuuuguauuuuuaguagagacgggguuuuccauguuggucaggcuggccucaaacuccucaccucaggugaucugccugccucggccucccaaauugcugggaugacagaugugagccaccaugccuggcguuuuuuuguuuuuuuuuuugauauggagucuuacucugucacccaggcuggagugcuauggcacgaucucggcucacugcaaccucugccucccggguucaaguaauucuccugccucagccucccaaguagcugggauuacaggugcccagcaccacgcccaacuaauuuuuuuguguguuuuuaguagagacgggguuccaccauguuggccgggcuggucucaaacuccugaccucacgugauccaccugccugccucagccucccaaagugcugggaugacaggugugagccaccaagccuggccuuuuuuuuuuuuuuuuuuuuuuuuugauauggagucuuacucugucacccaggcuggagugcuauggugccaucucagcucacugcaagcccugccuucuggguccaagugauucuccugccucaaccucccaaguaacugggauuacaggcacacaccgucauacccggcugauuuuuguauuuuuaguagagaugggguuucaccauguuggccagacuggucucgaacuccugaccucaagugauccaccugccuuggcuucccaaaguguugggauuacaggcgugagccaccaugccuagcccucauaugguuuaugaguacuuaagacauguuugauucaauuuaaaaaauaauuacaagcugggcaugguggcuaaugccuauaaucccagcacuuagggaggcuaagacaggaggauugcuugagcccaggaguuugaaagcagccugagcaauauagagauacucugucucuacaagaaauuuaagaauaggcugcaacacucacucuaaggggagcauugugagguauaccaagaugaguaagaacaauaugguuuagcaugccagaacaaggaaguuucaggugcuagaaacacagacauccucagcucaaacaggaacgcccagaacaguauacaagaaagccuggagcuggagucagaagacuggcucccaugugugguguccuaacucucucuagaccucaauuuccucauauguuuaauaaggauaacaaccuacucuucagcccaccugagaggacaggaugcuucaagaaagacagugagcagcagguccuuuaaaaaucaaaggaaaacaggcuccuggauaggugugagauagaagugaauuauggcacauacgagagcaacaauaaauuauccuuuacuaacaguaaccuaagggaaaugcccggcauugugucuggcacagacuagauacucaguaguucccuucucacacuugcucagcccuguuugaacccagacagagagcagcucaaaauaugcaaguauuacauacucacagaaccuggagacaagagaagcggcuucuaggcacaugggcucccauccuugcagcagcugguauagagguugcaugacaacuugugaggauucugcaguagcgugggcucagcuacaugaccuaaauaaaggucucuuucaacccugagauucuguaaguuucuuuuucuuuagacagagucucacucugucacccaggcuggagugcagugacacgaucucggcucagcgcaaccucugccuccaaggcucaagugauccuuccaccucagccucccgaguaggugggacuacaguuguguaccaccauggcuggcaaaguuuuaaaguuuuuuuguagugacagggucucacuauguuacccaggcugauuuugaacuccuaagcucaagcgauccucccaccucaggcuccugaguagcugggacuacagucuugugccaccacuccuggcuaauuaauuuuuuuuuuuuuuguagagaggggguucugcuauguugcccaggcugggugaacuccuggguucaagugauccucccacuuuggucuuccaaaguguugggguuacaggcaugagccacuguaccugucuuaguuuauguuuuaaagucaucgagagacaugaaaacuaaaugguccuagguuggaggaagaaaacuuacuguaaaggacaguauuggggaaaacuggcaaauuuggaauauguacugacuguuagaugauacucuuauaucaauguuaaguguccuaagucugauaauacauuauggaaaugaagagaaugaccuuguucuuaagcggggugaaugaucauggucuuuacaacuuauucucaaaugauucacaaaagagagauaaagcaaaaguggccaguuuuaaagggcauauggguguuuauugaauuauuccugcaacuuuucuauagguuugaaauuuuuucaaaauaaaacuuuuuugcccaggcaugguggcucacggcuauaauuucagugcuuugggaggcugagguggaaguaucgcuugaggccaggaauuggagaccagccugggcaacauagagagaucccaucucuacaaaaaaugaaaaaaaaaaaaagccagaugugauggcaugugccugugguuccagcugcucaggaggcugaggcaggaggaucgcuugagcccaggaauacaaggcugcagugagcuaugaucaugccacugcacuuuagucugagcagcagcaaaauaaauaaauaaauaaauaaauaaauaaaauaaaacuuuuuaaaggucaccgaggcugcuguguggccaggggagcuauagaggagcaaggguagaggagggcaagccugggaggaggccuuugugaggauggaggcauagacugggguuuugacaguggggauggagagaugaggacagaucugaaauauguuuugaagaacauauuuaacagaacuugcucauggauuggaagagauuuuaggggagagagagggagguagauguuccccacuuggugcacccugaugguugcagacugaauuccaauagaaucuucuccccaaggucuuuuuauucccucucucuuuuccucaauucagccacucuaugaguaguuaauacagguauuuauuucacagaugaggugagacucagggagaugaaaugacucauuuagaguuaucaggugcagacagaaauuuuacucuacccagaaaaccaaaauauaggcaugaaaucaguguucuucaaacugaauugucucucauuaauugauugugaaaucaacauaaugaguuccuaucagcauuaaagaaaaaaaaaagagaaacagaauaaaaauauagcaugccuuguguaaaaggguaaguaauguuucaugaaacuucuauuuuaguuuaauauucacauauguguauaguaggucaugaugugaacguauuucuuacuugaaguuaugaaaaauuggaaaggcacauacaggaucauuguagaaggaacuuauguuaucacagagguccuguaguccccaugggaauaagaaagcaaaagacaaauucacuugggugguuacuguagguugucauauguuguuuauuucuucagugacugauaggcuguaagucugucaguuucuuaguuguuuucuuaguugauuuuucuuuucuuuucuuuucuuuuuccgagacagagucuugcucugucgcucaggcuggagugcaguggcgcaaucucggcacacugcaaccucugccuccuaguucaagggauucuccugccucagucucccgaguagccaggauuacagccaugcgccaccacacccagcuaauuuuuuguaguuuuaguagagacaggguuucuaccauguuggccaggcuggucucaaacuccugaccucaagugauccaccugccucggccucccaaagugcugggauuauaagcgugagccaccaugcccagccuuucuuaguugauuucauagucauccuguacuuccagucuugccauuagcaaauauugaguacuugcugugugcaggguuagaaguuacuucuuugugugagaucuauguuuuguguguggguggugugugugggguguguguguguguguauguguguguguguuuguguguuuaaaaguagacuuuuuuuugaagagcaauuuuagauuuacagcaaaauugaguggaaggggcagagauuucucauguacucccuaccccuacacaugcacaauuuuccccauuaucaaccucccccaccagaaugguuguuacaucugaugacacauuguaauugcacagccuuaucacccaaagcccauaguuuacauuaggguuuacuccugguguuguauauucuaugggugugagauacauguuuaaaaauauuuuguauuagauaaauuggggauaauagucauuucaagaacaaaauguuggauaaauuaaauuagcuaauaaacacagagugcuuuaaacauuccuagugcaaaauaagaucuuguuguuugugguggugguggcuauucaggcuuaaggucuagauuccacuuaguauguaaguaaauaauagcaauccuggcugucaucuguauguguaauguaguaaucaguuuuguuuagcuaguucuuauguguagcacauuaaagcaaucuugaauagugaggggaccucauuacuagauuaccauuaaaugguaauguuaagugacccugaaaccaaaguaauggaaaauugucuuccuuuuuuucuuuuuuuuuuuuuuucccuugagauggagucuugcacugucacccaggcuggagugcaguggcucauggcaaccuccacuucuuggguucacgagauucuccugccucagccacccaaguagcugggauuacagauguacgccaccacacccggcuaauuuuuguauuuuuaguagagaugagguuucaccaugccggccaggcugaucucgaacuccugagcucaagugaccugcccaccucagccucccagagugcugggauuacaggcaugagccacugugcccagccugucuuccuuuuucucaaacauuuaauuugcuguuucuugaucacauaucauccuucuuuccuuucaaggucaggggagauaauuuuuuacuguauguacugcugcaucuucacacaaauuaucaucugaaaagccuucucagauuugacaaaugaagucucuuuucauucccaggaggaacuuguuaaaccaaugaaguucaaaauucuaauuccuguuccuuucuagugugcaccacuuuauucaucuugaauaaacauacaaccucaagcauccuacaaggcaaauagauuccuuuuuaauuaguggcucuauacacagaguuuuaucaucaugaaauuuauaaaccaggaagggaacaaauauuuacacuugcaacuucaugucaacauugccuacuauuugaagagcucugaaauuguaaauguaucacccccuccuucuucccccacuccccaccccugccggcuuuuaaacuauggcaguagaaaaauagguuucaacuuucuaggagcacaucucuccuauguggggaauguggcagauucuuuauauaagugcucuuucuuugugacuggcauuacuuuuuuuucucacaaagauuuguuucagaagcuaaucuucauuuuuuugguuguugcuuuuuguaguacuauuucuaaggcaucuccaaguagaaaggcaaaauuuuauuuugagaaguuacugcuuucauaguuacacagaauuauuucucaauuuaaguaggccuuuuauuccaggacaaaauuaagccagucagaagguuucugggagaaaaauaaugaagagcugagguuuuguauguuaaugugggcagucuaaugcuugauaaaagaaaacuuuuggcugggugugguggcucaugccuguaaucccagcacuuugggaggccgagguggucggaucaccugaggucaggaguuugacaccagccuggccaacauggugaaacuccaucucuacuaaaaauacaaaauuagcugggcaugguggcgcaugcguguagucucagcuacucgggaggcugaggcaggagaaucgcuugaaccugggagacugaggcugcagugagcucagaucgcaccauugcacuccagccugagugacagagugagacuccaucucaaaaauaaaauaaauaaaauaaagaaaacuuuuuuuuuguuuguuuggcccuugucagggacagauuccgucucagaaaagucucgcucuguugcucaggcuggagcgcaauggugcaaucucggcucacugcaaccucuaccugccgguucaagcgauucuccugccucagccuucccaguagcugggauuacaggcaugcgccaccacgccuggcuaauuuuuguauuuuuaguggagacaggguuucaccauguuggccaggcuggugucaaacuccugaccucagauaaucugcccaccuccgucucccaaagugcugggauuacaggcaugagccaccacacccagccaagaaaacuuuuaaagauguguaaauaugcagugauuuaaaaaucucaguugaagcuuguuaaaauguaucaaaauaauuuaggaaaaggggggcugauuuugccaaaauuugggagaugcauacuuuuuuucaaggcuuuacugcaguuuuaaaaaauauuuuauuguuuuguaggcagcuucugaaccagaguaggcucagagacucccuuuauugcaguuuugaugcugcagaaagugacugcuuaauuucagcuguugaggauguugguuauacuaugccuggaucaaaaaaaugauuuuacauugcuuaguuuguuaaaauauguuuaauagguuaaucuuuuuuucaaagcaucaaaaauaauuaagaugaaauaucagauaaacccuaugucuagaaugaauaauuuaguucuaaacauccuggaugcuaaggagaaaagaacaagauguugguuuauaaaauucuuauugucaaauaaagaagcauagaaguuugaagaaagauaauuuuuuuguuuuuauuuuuucucucugaauuuaggaguaauuuauguuuggguucuaauccuauguuaucaucaaagaguaauaacauuggcaaucuucccucccauucugcuucauccuccccacuaaagggaaauaccagauuguaaaagaaaaaaaaaaagcaugcugguuguauaaaaagaaacauuuuaaacaaauaagaaauauauauauugaaaugcagucucccugaaugaugcuaaaccccuguccaaguaggcauuucucagcccacagaaagggauggcauuaaaucacagcucaauggagacauuuuuaugaggagcugugaugguuuguguuuagcaaacauguauugggcaucucagauuugccuguuagggaugcaacagugagugagauacuauuuguucccuuaagaaacucaaagaggaaagggguugacuuguucagucagugacuuaugaaauauuucauacucauucauuuacagaguacuuuuuguagguauaguacagcguggucagccagggagacuauagugggugcauuaguaacuaaccauacaacuaaugcuaauguugcgggcugacuggguuuggggugaacaaaugaccccuaaagcucaggaguucuagaccagccugggcaacacagugaaacccugucucuacuaaaauacaaaaaauuagccggguaugguagcaugugccuguaaucccagcuacucgggaggcugaggcaggagaaucacuugaacccgggagguggagguugcagugagccaagauggugccgcugcacuccagucugggugacagagcaagacuccaucucaaaaaaaaaaaaaaaaaaaagacauuuguuuuggcuggggaaggcuuugcagagggagguaacuucuagauugagauuugaagucagaguccauccagaaaguagggaagacauuuuauguagagaaguaacaagcuacagggaucagagguaugaaccagggugcauguuuggguuauggugaguggugucuggccaaacuguguggcucagggucuuucugcuucaccaucuuuagcauagaagccuuccuugugcucacuugcucaucucauucucacaaaauagcugcuucauaucuaggcaccaucucucuauucccacaggggaaagagggaaagugccaaggguaacagcggaaacgucuuccuuuuuauucaggaaaugagggacuccccaaggcuucugcuuauauuucauuggcuugagcugagccguacaaccaucacuaguggcagguagucugggaugucaagaaaguagcuucccagucucuuugguuagaaggcaaaggagaagauggugggaaucgguuugcaucagucacucuacacauuaucugcuuuguuagggcagcauuaucuuaguauuguuaccaaguucagggucuuuucuggggugaucaagcauccugggucgccugggaccaagugguuuucuggguuguaggacuuugagugcuauagccuggaaagcccuaggaaaaccaggaugguuggccauccuagucuuuccccauauccucuguuguccaaaaauauggaagcaggucauuucuugacauaggagcugccuugacugggcuuaaaaaggccugaaaggcagcuuaauaauuuacaaugagaaauaaaugauauuggaucaggggaggauacuggaagaagagcuccaugggauuugcuuggugcucgugagauuuugacugacaagagaucuuagggcuacuauauuacccaaauucaggggacucuguucacuuugccagcagccugggauuaauucuguagugcuaaugccauucugagaagccuuucaaugaaucugagcucaggguucuuagucccccuguuacugaagcuucuccccagacagugucguuuuuguuuuuuccuuccuuucuaagcuucuggugcugacuagucuccccuucuaauggacaguguuuagauacguuauugucuaaagguagaucuggccaggcaugguggcucacaccuguaaucccagcacuuugggaggccaaagcuggcagaucaccugaggucaggaguuugagaccagccuggccaacacggugaaaccccgucucuacuaaaaauacaaaaauuagcuggacauggugacaggcaccuauagcugagauccauugugagugccauugcacucuagccugggcgacagagugagacuccaucucaaaaaauaauaauaaaaauaaagguagauuaaaaaaaaagagacauaauuugcguuaucguaaaauuuacuuuuuuaaaguguguaauucagugguuuuuaguauguucacaaagucauucaccacugucuaauuccagaacauuuuucuuaccccaaaaugaaauccuauacccauuagcaucacugcccauuuccugcuuccuuuagacuguggcaaccacucaucuauuuucugucucuauaacuuugcguauuuuagacaugucauauaaauggaauccuaugguauguggccuuuuuuaaaaaucacuggcuucuuucacugagcauaauuuuucaaguucuuuuaagcuguaguauguaucaguacuucauucuuuauaacugccaaauaauaguucuuuguauggauauaccacauuuuauuucauucauucauuagacauugaugguucuacuuucuggcuauuaugaguaguaguacuaugaacauuuguguacauauuuuuguguggacacguuuuuacuucucuuggcuguauaccuagcaguggaauugcuggucuucaggugugucuuacugauguuuuuuuuugagauggaguuuuggucugucgccugggcugaagugcaguggcgcaaucucggcucacugcaaccuccaccucccaggcucaagcaauucuccugccucagccucccaaguaacugggauuacaggcgcacgccaccaugcccagcuaauuguuguauuuuuaguagagacgggguuucaccauguuggccaggcuggucucgaacuccugggcucaagcaauccuccugccuuggccucccaaaguguugggauuacaggcgugagccacuguuccuggccuuaucuuacucucucuuuuuuuuuuugagacggacucucacucugucuuccaugcuggagugcaguggugcagucuuggcucacugcaaccuccaccucccagguucaagccauuauccuaccucagccucuggaguagcugggacuacaggugcagcuaauuuuugucauuuuaguagagaugggguuucaccauauuggucaggcuggucuccaucuccugaccucaggggauccgccugccucggccucccaaagugcugggauuauaggugugagccacugugcccaaccaucuuuaagccuccuuaaggaggcugugucucuaacaugcccuguugguuuuauaguuggacucucacuggacagccucguuuuucuaagauuuggggguuauaaggaucagaguuguccccaguuggcuccuuucaccucguccauaagguuguugugaggcuucacugagguaaucuguauaaaguaaggugcuggccuguacccuguacaucacucaguaguggugauuucacugcccuuugccuccugccuuuggcuucuggcuaucuccaaacaccccaugccuucugugcuccacccucuguugaaacacaggaaucuaaaaccauucauugauacuuuuugagugauuauacugaaaacaauugcauguugucucaugcagaauuuucguguuaaacccuguguugcaaggaugccauuaaccagcacacagauggcgguggagauugauugauugagaugggguuucgcuguguugcccaggcuggagugcagugguguaaucguaguucacuguaacuuugaacuccuggacuccagugauccuccugugucaguuuuccaaguaacugggacuacagucucaugucacugugccuggcuaauuuuuaaaauuauuuuauagagcuggggucucgcuauguugccuaggcucuucucaaacuccuggccucaaagcgauccuccugccucagccucccaaaguguugggauuaccagcgugaaccaccacacuuggcuggggauggaguuuuagacaccagaggcuuccuuccgagguugaccuagaaagcacccuuggugggugccaugggaugggggaauacagucaaaaggaaccugcucuucccgcugcgccuccaccugagguggaugugucugcuggggcugcuggagucuccaucuuccacuuuaacuucacuuaagagcugaaagcucugccccuucuucaagauuuucccugcugucuccccuucccugcucaaccagagauuccucuuauucuuccucuugcuauuaguauuaaucuggcucacugacucuuuuccuuaaccucauccuaaaacugucugaugcauauuuuauauuuucuugcauguuugacuuuuaguuaguauuuuacaguaauuucguucugcagccauccucuuaucugauacccuggaacucauuccugugccuaucaguucucaccucugguaauuaaacuuuguaaaaaagaaaugugacauuuggacauauucucuuauuaguaaagguauuauuguguaugagacuaaugcugugcaucuauaauaaguuguuucaccuugugaauacuaauguaauuuggaaauaaaccuuucuuuguuaaagacuuuuucuacaugggccacguuuuuccagaccuauuuccuaauaauuugugguuuuuaaagguaugucaauagagaugcuguagccagcauggcuggauucuguuagauaaacauuuugugagauugcuuaccuuaaacaauugucuuuaaaaguuaauuucuucccuaaugugucaguaaggaaauucuauaguauuuaagaagccugauaaaguccaguuaaaacauuuugcauugcucuuuaaacaucuuuucugaggguugauguguucguguuuguuugguucacauaguuucuucugaauuuuaagaaagcuuugucagaaucaguaacuugccuauaguguauuuuucaugaccauauggcuuucuucaucaaaaacagcuaaguaaaaauuucagugaauaauaguauauauauaugggaauguauuccucaucauuuguaugcucuugagagagugacucauguacuguuuucuauugaguucccgaaaguuuauaaagagaugacaaacaauuggcuaugggauugaaauaaugcacauguaaaauggaagggaaaacauggaaacaguuucuuccuuuguucuucccuuaccuugaugaaauuuuuaccacuuaacguuuuucaguaaagucaaggucaguaucagagccuaguacgguucugcuugccgcugucugaggauuaccugucuuauuacagaauguacaugcucccagaggagaagauacaguuugauuucaggaugacaaacagcucuucugggacaauagugucaaguauaaaaggauuauaaagguuuuaggaccaugggaugguuugaaggggaaagggugaaaugacaguuaagguuggcaucaccgaggucccaguuguuggcugcccccuacuucuccuguuccccucuggcaguauuuuacagauguauuuccuuugaccuuuccuuuaguaggaaguuguaggcuuuaagauccagcagaaaaaaauuaugagccauuugugacccucuugagcaguccuucagguagaacacauuucauaagagcuagugaauggucuuggguaauuaaagcucacuuuaugauuauacagugugguggccagcccagagggaacaucacaaauacacauuaugaauguauagaauugagacuuuauaccuggagacuguuggaugaccugguccucugcccccaggccuacccuucugcccauccucauccaauucuguuuugauuuuuaaaaaguaugugcuucuuagcccucucauugcuucacugugaggggaaaaacuuuucuauugaggugcugaagcugugcuuuccaggacucauacuuaugugcuguugaaugagucucagugcuccuaggagucuauaaaaggaauagaagacuucuuuucucuaacucccuuaugguuuguauuuuaucugcuaagagacacuggcauuucauggagaugggagagaaaaagacacagccuacuuagacaguuccuuuauuccaacauauauacucacuucacauauucauagacaccuuccaccuagcaucaaauucugaacucauagaagacuuagguguuuuugguuuuguaugcauagcuuuugaaaucccuggguugaaaauuuucuagguguuguuuguaugcucuagucaagcccaggacauaaaggguuauguuaaaauuacuuuccuuagugacuauuaaccagaaauuuuaucugucaggagaaaggauucaugcaacucuaagaaugcauugcccucugcauaggcuauuagcuuuggcaaccgaagauagaugagacuuaggcuguguuuaaauuuuucauugugaugagacaaaucuauuauuauaaaagcccuacuuuaucagugagaguguuuccuuauguuguuuuaauuaaaggagcaguguguuuuuaaauuuaauuaugguaccuugaagaucugauacuagcuguaagcuaaggauucuuuggguuuucaagauuuuuuuuuuggagacggaguuucacucuguugcccaggcuggagugcaguggcgugaucugggcucacugcaacaccugcuuccugguuucaagugauucuucugccucagccucccagguagcugggauuacaggugcgggccaccaugcccggcugauuuuuuguauuuuuaguagagacagguuucaccauguuggucaggcuggucucgaauuccugaccucaaaugaucugccaucuucagccucccaaaaugcugggauuacaggcgugagcuacagugcccagccaguuuucaagauuuuuaaugcauuuggagcagcgcuauccuaaagaaccuucuuugaugauggaaauuuucucuaucugcaccauccaauauggucugguaaccaccagccacauguggcuauugagcacuuaaaauguggcugagacugagaaacuaaaauuuuaauuuucuugaaaauguaaauuaauuaauuaauuaauuuauuuauuuauuuagagacaaggucuugcucuguuacccaggccggagugcaguggugcaaucauaguucacugcagccucgaccuccugggcucaagugauucuccugccuuagccuucugaguagcugggauuacaggcauguaccaccauaccuggcuaauuaaaaaaaaaaaauuuuguagauauggggucucucuauguugcccaagcuggucuggacuccaggccucagccucccaaaggagaaaauguaaauuuauauagucgcaugugauuagugguuauuguguuggacagcacagauuuagaaucugaggaaacucuccauuuaguauaaugccaucugaagcucuuaaccaguugaggcugguuaaaucugaaguugauauuggauaauauugcuauuaggccaaugagagauuucuuuaauaaagaugcaaguuuaucaaacuuaaauaugcuagauaugaacuuugggaaggcaaaaauuaauuccagaaauaauuccaauauaauuaauugaacaaauauuuagaaaauguuaucuaggauaaagaaguguaguaaauauuguggaggacucagaggugagugggacuuaggugaggcugccuauuuugaguccugcuggggaggccuugaaaggucaaggagaaguucuuuuuuuuuuuuuuuugagauggagucuugcucugucaccaggcuggagugcaguggcacgaucucagcucacugcaaccucugccucccagguucaagcgauucuacugccucagccucccgaguagcugggacuacaggugcacgccaccacauccagcuaauuuuuuguauuuuuaguggagacaggguuucaccauguuggccaggauggucuugaucucuugaccuugugauccucccaccuuggccucccaauguccugggauuacaggugugagccacugcgcccggccaggggaagcucuuucuaagggaguagcuuagagcacagaaugccaacuggguuaucaucaggcuguaaacaguaggauuucaguuugugcaagcacgaugguuggggcuguaacaggagaagggggagcuguuuacaucaggggaacauuagguuacauuuggcucugacaggcaagauuaauuuugucugagagaagguugaggugggauuggaauuuucccagguaugcccugcgauguucugcugaguuucauguguguuggagcaggccucucaggccaucacaguucugggagauggacuuuccaaagauugggaagcuggaggcagggacaccuggacacagagccuucuucacccccaccugcaucccaggugaggaggaauucuugaaaaugccgaguuugacucaccaaccaggaguaucuaauguauauaaauauuccuuuaaacguaaguauagugaugaguagauaagccagaguauuuaaaagccacagcaaagauucagcuuccucuccgcucccccgugccccacaucugggaggaccccaccugagcuugguguuauaguuggcugaugcucuuagguggaaacccaggggcaaaggacaagccacagaaacauaggcugcaucugcuccuacucuguacuuccaccuuaccugcccauuaagugcuauguucuugacuaaauaauucauguaucgcagagagggaagguauguguucccaccaaccucugacccauccauaacccaguguauuacacugacccaggaaccagagcucacuucacccugcuuggagucagggaacucggaaccuaacuguccugggcccucuuucugguaguugggugaguccugagggccugauacgugagguuuggacaggcugggcaguagguuauggcauaucuuguaagggagaccaugucagcaguggggagcagaaugcagaggaaucaaagaccugaucucauagugcaggugugaagggagaagagccagccuuucuccaccgucucucuggggacaggggacugucucgcagggacuacaccuuggcauuugggcaugucagaccaggaucuagucaucagaguuacccaaugcccugggguugguuucuaccaggucagggaugcaguucugcaggcaguauguuacaucugagacuacaggagagagggguggggugacagucuuuccauaggguguccagacacuccuggcccagggacugagccauggauagugggaugcuugccucucuguguggcagggcuuucgucucuguuuuuuguuuuugagauggagucuugcucuguugcucaggcuggaguguaguggcgcaaucuuggcucacugcaaccucugccuccuggguucaagcaauucugccucagccuccugaguagcugagauuacaggcacaugccaccaugcccagcuaauuuuuguauuuuuaguagagaugggguuuuaccauguuggccaggcugguccugaacuccugaccucaggugauccaccugccucagccucccaaagugcugagauuacaagugugagccaccaugcccagccuggucucugguuuugagccaugaugucaggcugaccaggcuggcacauuuagccuggaauggguuaggcuucuggcuuugauguuaagaaaggaaacuagugccaagugcaguggcuccugcccauaaucucaagacuuugggaggcuaagccaggaggauugcuugagccuaggaguuugagaccagccugggcaacauagcaagaccccaccucaaaaaaaaaaaagguaguuugguguggggcaugcgccuauaauuccagugcuuugggcugaggcacuuuggggagauugagacugcaguaagcuaugauugugccacugcagcccagccugguugacagagugagauccugucuggaaaaaaaaagagaacuggcugguccuuccugaaauagugcccacaggcuggcagagcacugacugacaccugccucuuucagagguggggucaggauagcuguauggaaauucuccaauguguggguuguaggaguguaucucauaucccuucaagcacugccaggccagaacccaguggaguuugcaaagaauggguuucuuguuagaagaaaguauuacguacauguaaguaaucuuggguauagcugggaagugaugaauaaauuugaccauuaaaagauuguaaugucuguaucaccaaagacaaaaucacaaauauaauuaaaaaacaaauaacagacuaggagaaaauagaccaugugcaauacacaaaggauaaauacagaguauauaaagaagcuucugcauauuaauaagaaaacacuagaauaaaugggcaaaagauauaaaaaggcauugacagaaagggaacaaauggccaauaaauacaaagagaugcuuaacuucauuaauaauuagugaauuacacauuaaagcaacuagauaugauuuuaucccaucagauuggcagaaauuaaagagaauaauauucuuuggcggcaaugagaaaaaauggguguacuuucauauucugagcauauaaauuguucagaccuuuuuggagaagguaguuuggcuguaucuuugaaaauaaaaucacauacuuuuaauuugguaauuuugugucuagugaaauacaccugaacacaugcucauuccagcacuggaauggugaaauauuggaaugauuaaauguacagugguacagccagcauauagaaugcgauaccuaaaaaguguguaagagugugguauagaucuuuaugcagcugaugugggaggcucucucagauacguuuuuagugagaaaaaauauaaaauuauuacauuuauauuuguaaaccucaaaauuuauauguauuuguaaauucuaaaacaugcuuuucagauuuuuuaacauuucugaaaucagcguaucuaacaauuggugacauaguuuacuaauuuaaacucuuggugaagcauagugcacauuacaagugauaagaucuuagauuugaugaaggaugauauguaaauacguggauaaaggacucuaagacagacaugggacgagauugaggaagugucaguggagacuuugucugugucaucuauguugucaaauuuuuuuuacagugaaauuauauuccauuauuguguaacgaaaaauuuuaaaaauacauauuuauauuuuuuagacaagauauaauuuuagacaagauaagguugccuggaugucucugaugucugauccauuucucuacuugggugauuaugcuugauauucagcuuugagaacuuuaaggccuggaugguugauagagcguucagcuucauuaagaaguuaaguagcugugaagauucagugggagagaauugagaacugagguccaagagaagggaggagccgaacuccagaauucagggccaguugccucauggggaccuuugcaucuguguaaagagguugaaauucucuccccacaagguggugccaggcuuuuuauacuggacugggcauacccuggagcaaggcucaguggaugggaggcagaaaauagaucaaaucaaggagccuuauccaaugucauugaaaggaaaauucauuguuuugggagagagcuaagcccuagugggaaagagccaaaggaauaaaugggcuuuuaaaucugaggaauuuacacaaggcaggcaggagaugaccugccauagguuggaggcaggcucugcuuggauccuguguaaacagggcauagugugagugucuccccauaaguaaaagcuguguugugaagaugaacucacaguuuaguagugacuuuuugaccaaagaugacucuucaagaagggauaagguguauggaguauagcucauugccaggacugugggaggcagaggaaggagaggacacuuggccaagaugccauuugagcuggucacuguaggaaagggagaauuuggacauguaauuuuuuuuuuuuuuuuaagacagagucucacucugucacccaggcuggagugcagugguguagucuuggcucaccacaaccucugccuccugaguucaagugauucuccugccucagccuccccaguagcugggacuacaggcacaugccagcugccuggcucauuuuguauuuuuaguagagaugggguuucgccauguugcccaggcuagucuugaacuccugaccucaagugaucuggccuggacauguaauuuuuaaggagauauucagaagaaaagggaggugagcccaccauuuacaaaugcacacaggaggccgggugugguggcucacacuuguaaucccauuacuuugggaggcugaggcaggcagauugcuugaggcuaggaguuugagaccagccuggccaacaaugcaaaaucccguccguacuaauaauauaaaaaauuagccgggccacugcacuccagccugagugacagagcaagacuccgucucaaaacaaacaaacaaacaaacaaaaauacacacaggagaaugugaggagcugaguaguacaguuuucucggaguacacgucuauuaaagggaagcaguaggaaguaaaauagaaaaagguaggcuagggccggaccaugaagagcugagaaugccaaguuuagaaauuugaccuugagucagugaacucauguuuuacauuuaaucuuuugguuaccaauuuuuuuuuguaccaucauugguuugauuuuuaaaauacagucacuuuguuuucuaaggauuuuaugauauauguucaaaucuugaguuaaagguaaauagaacacaguuuggguuuuuuuuuggcauauaaaugguugaauuucaaaauuauauuuguguuacaaacuuuguuuuuacucucugccuuccagcauuugcaaauaaccauuucucuuucaaaggaaauucuaguauguauucccauucaauaaaagcaaagagcugagcucuauaugaauaagagguaaaauugaacaugaaaauuacugagcaagauuagugggggaugaaauggaugaacauuggggaaagcugugauccuuguuaccuuugcuauagugcaauuuggaauggcuucuuuauuccuggcaauuccugacagcauuucuuuuaaaccuggccaccuuuccauugccagcucgaccuugauguuagcuggugcugcuacugcaagggcugccuuuggcaggaagccuucagucaacuuucugggcucugguuuuggcucugcacaugccuugcugagaagaccuuaagaaucugaaauguggagggucauuuugggguagggaaaugugguggcaacucuugaguuuucugccacgauguaacuuaacagauccucuuguuuuuccuuaaaugguacaaggguuugcaccgaaaugguaauucaucugugucugugaugcuuuaaaaaauaacaguuucacuaaugugucacaacauguauuauuuaucauuuuaguaaauggauauuuuaacaagcaacaauuugcaaauuuaagcauggcaguuaacaugaucugacauuaaaaaauuaaauaaucuccugccaucuuuguuaucagccuugcauuaaggauuuuagcccuucugggagcuuuuauuuuuuuguugacucugacugaugauggcagauugugguagugaucagagcuaugcuuuuauaaauuauuuuuuaguuggaacaauauuggcauguaacguggacuggcagaauuaacauuguuuaucauuaccaguguuguuuugacagauauucucaguucuuuaaggaagcagauagggaaugucuguaauggacaucugcuguccacuauagguugcccaauaaugaguccugguagguucuaccuucugcuguggaagccagcagaguucaaaugggcauuuucuguucuugccuccuaggaacugcagggguggacaugcuucuuaggcuuagccuguugacugcuuccaccuggaguuugaaucugaacaguguuagaaaaugcagggacaggcugagugugguggcucacgccuguaaucccagcacuuugggaggacaaggaaggaggaucacuugagcccaggaguucgagaccagccugggcaaaaaagcaagacccagucucuacacaaaguaaacaaauuagccaggcaugguggugugcaccuguagucccagcuacuugggaggcuguggugggaagauccuuugagccuagaaguuugggguugcaaugagcuauauuugccccacugcacugcagccugggggacaaagagagacccugucuccuauaaaggcagcgacaguuaguaguggcacuagaguuacuaaaauuaucaagauuuucuuccuggauaguccugguugcacacaucaguguuacuauagguggacuuagccuuuacuuuuguacauuucgcacugauaccucuaaccaccuuuugugcacauagcagcuauuauaccccccauagcauaaccaaccuguguaagagaagaguauaagucaguugcuugcaaggaacucuuagggguagggagcucuugccugggggagguggggguuucuccucuuucuguccuccccuagucauuagagaaaggccucaagagaauaacucagagauuacgguugaauucaagaggguagauugacaucucauugagcugcacagagguaccagccaggugcugcugugggauuagaauggacuccugagaaagcguucuugagugagugugguguggcuuuccuggaguuuggggaugucugugaauacagaggcaaguaucuuccucucaucugaaagccccccauguggcuggagcugccccuggggacaguguauggagagaggacagcaaaaacgcuugacauuuccugugggccugguggucuacauggaggacagcuggccugagucuuuuugaaagacuuguccugccugcgaaggcugccugccagggcuaggcccgcagcagaaagagguugugggugaaccacagaggcaggagcugagaggagacugagagcugagucaaagggcacccguugccugcaucaggcagcauggaggucccagcaaaggggucucacuagagagagcuggcauguggacuccugcaaaugguggaagauauuuuacaggcugcaggacuggaccacagaaaagugggcagaccuuucccuuuccucacacuugccgccuuucauuccuuggaccccucucuuuuuccucacugcuguucuuaggggaaaagcuugacauuggauaaaaugaauuuggauuuagacuaaauagacuuuuuaauaacugaaaguuuggcuuuauuuaagauaauauuuucuuuuuaaaacacugucuagaaaucaguggguuuuuuuuuuuguuuuuuguuuuuuuuuaaagacagaguuucguucuuguugccuaggcuggagugugaugacgcaaucucagcucacugcaaccuccaucucugggguucaagcgauucuccuggcucagccucccgaguagcugggauuacaggcaugcaccaccacgcccagcuaauuuuuguauuuuuaauagagaugggguuucaccauauuggccaggcuagucuugaacucccgaucucaggugaucugcccaccucagccucccaaagugcugggauuauaggcaugagccaccacgcccagccaaaauuagugguuuuaauguuacuaaauccugaaauagcuuuccaugaugacaaaaucaaucaacaaucucaaccccaguagacuggaguggauuuuagaauuuagcacacuuucccuuauuuauacucugcagguuucaagcauacaacuugccagcaauuacuguguuggcugagaaauuugaaauuuuacuagcuugaacacuaaauuuguugauguaacauacagcuaauaauaaaggucacguccccauauuggcaugagggaccccuuaugaauuagccugaaacuuugcagccuuuaaucauauuuuucucucuuuuuucccuugagacggagucucccucugucgcccaggcuggagugcaauggcacgaucucggcucgcugcaacuucgcuugccggguucaagccauucuccugccucagccucccaaguagcuggaacuauaggcaugagccaccacgcccagcuaauuuucguacuuuuaguagagacgggguuucaccauguucaccaggcuggucucgaacuccugaccucaagugauccacccaccucggccuccccaagugcuaggauuauaggcaugagccaccgugcucggccauguuguuauuuuugguuuguuuguugauuaugguuuaaaaaaaccacauaacauuaaauuuaccaucuuugccauuuuuaaguguguaguaugguaguguuaacuguaugcaacaguuagugcaacagaucuuuagaguuuuuuuaucuuguaaaaccgaaacucuguacccaggaagcaauuccugauucccugcuucugccagccucuaccaaccaccauucuacuuuuuguugcuaagaguuugauuacuuucgauaacucacaucaguggaauaaugcaguauuuguuuuuuucuuacugguuuauuucacuuagcuuaauguccucaagguucauccauguuguagcaugugacaagauuuccuucuuuuuaaggaugaauaauauuccauuguauggauagaccacauuugcuuuaucuaguugucuguuggugaacauuuaggguacuucuaccuuucggcuccugugaacacuacugcagugaacauggguaagcaaaaaucucuuugagauccuuuuggcuauauacccagaaggggauugcuggaucaucauucuguuuuuaauucuuugaggagccgccaaacuguucuuuauagcagcuacgccauuuuacauucccaccagcagugcacagagauuaccauugcuucauauccuuaucaacacuugguuuuuuuuuuuuugccauuuuaaugggucugaggugauauuucauuaugguuuugauuugcauuucucuaaugauuagugauguugaacaucuuuuuauaugcuucuugcccauuuguauaucuucuuuggagaaaugucuuuugaagugcuuugcccauuuuuuaauugcauuaguuuguuguuuuuuugauuuguaggaguuauuuauauauuccggguauuaaugccuuaucagauauuugguugaaaauauuuucucccauucauaaguugccuuuucacuuugcccuuuaaucauauuauuauuauuauuauuauuaugguuaaaacauuaauuguguaauacugaaaaguuuaggaaauaauaugacagauuuugaucaggucuuaaauaucuucccaauaggcccuaugaguaaggcauaaaaagcuugaauuaauuccauaguuucaccaaaacgcucuucuucuuaaucuuauuccuuauuuuuuugaggcagagucuuucuggcccaggcagccuggagugcaguggugcaaucucagcucacuacaaccuucacuucccggguucaagcgauucucgugccccagccaccugcguagcugggacuacaggugugagcuaccaugccuagcuaauuuuuguauuuuuaauaaagaugaaguuucaccguguuggccaggcuggucucgaacucuugggauucgagugcugggauuauaggcaugagccaccaugccuggcccuuaaucuuguuccuaucaaucuuuccagcuuuaccuuccccagcaugacuuccucuuauccccuuccuauguccaaagauucccuaaaaauauucuagcucuguaccauuccacacacugcuuuuuuguuguuguuguuguuguuguuuuuuuuugccugaaauaugggauauguaccuuucccucuuguuuaaccuuguuuuucagacuccuucuuuuucuuuuccuuuaaagacucagcccagaugugaaaauguuccagucagccagucagcugcuuuucucuccuauagccucuuagguacagcccagguuagcacacuugucugaaaguauugugaggacuuuuauaaacccccucucuccaggaccauaugcugcuagaucaccuagcuuagcuuugccuuuuuauuccucuuugucaugggccuaccauaauaucuaguccauaauauuuguguacuuuaguuuuuuauuuauuuauuuauuuuugagaugguggucuuacuccaucacccaggcuggaguacaguggcacgggaucucggcucacugcaacccccgccuccuggguucaagcuauucuccugccuuagccucugaguagccgggacuacaggacacgccaccacgcccagcuaauuuuuguauuuuuaguagagaugggguuucacuauuuuggccaggcuggucucaaacuccugaccucaagugauccaccugccuuggccucccaaagugcugggauuacaggcaugagccacaacacccggccuauuuguguacuuuaaacgauuauggguagaaagaaagagcaaaugccuuuuuagaaauaagauaacagaacuuuuuaccaauugugcuuccaaauaugcuuucucuucuaauuuuaucugcuaagauuuuggcagcuaauuguagauuuuaugaacuuacauuggguugccuuugucuucuguuauaaaagcaauaauuagaggaaaugauccuuuugagagguuguuuaaugaauucugcuuguuuuaaaugugcugcuuuaaaucuuauuucacguaaacuguacuaaugcccaaauuaucucacccuagaucagcauugaaccaaaguauuaugaugauuaauuuccuucuguuaaaucccuuauagucuuuucuuugguguguguguggggucaacaaucaaagaaagaauuuauugacuuuacauuuaauaugguuuacucuacuugauuauauuguucaagugugaauuuguguaugguauaagauuaugccauacugggauucuauuuucuguuaaacaaauagcuuuguguuuuauuaacugccaguguuuaaauuuaaugguuuaagauuucagagagcccuuuuuguaaguauuugaaaguuuuuauuauaauccugagccuaaccuucuucugguuucacugcauccuucuccagccuugaaacaagcccuggcacagacgcaaauccuggcgugcaccaccucuuccucucccccgcuccccacucuaacaugacaagaagugucugucccagaaguaaucugauugugcaccuagaguaccuguuuucugccuggggaagaaugcacacugcuggaccuagagcgguggcaaaagugcccucuccacugugggggccacagugguaggcacaacccuuaucccucagccccauuaguuaauuaagucauuuuaccugcauuaaacuuuacgggcagagaaaauucaguaagucaccacuaccaggugacuuucuuuuuuauguuacccccuagcaaggcauguaguuugcauccuacagaauauaaaagauggggccagcaucuauucugugucuuagcagugaacuucauccaauagauacuugauuuuuaaauacuuucaccuugugucaugauuaaaucacuaaacaggaaguuucagcuuuucuuuaaagaaguacauccuauuaaaaauuuaaaugucuucauaacugcuuacgcucaguaaaugaacacuaggaaucuauaaacaggaaucuauggcucuaaaaauugaaauuuugggggcuguuucauucuuuagaacuugaaaacgccauaggcaauuagcuauaauucauuugcagauuauuuuugccauguuaaauuaggaauuuuagccauagcaagcauaacagacaagcacacuuuuaaauuauuuuguucagcaaaacaccauaggcccuuauauguguuugcuggaauuuuucuuugucaacaauaaaucuauauguuucuuuaguuaaaaaaaaaacagcaacaaaguguuuauuguagaauguuuacuuuuuaaacaaacgugaaaggcauugguacaaaaagggaaaagcaccuaggauuuggauccucaguggguccaggaguacagcuuccuuguucugcaguuacuggaggcaguguggugaggggaaggaugugggcuuuggacugagcugcugcuucuaccugugcuaugacuuugcacaaguuaggaguagccuuuuugagcuuuguuuucuccuuagaagaugacuaagaucauguuugcacauagcacaugacacaaacucaugauacugguuuuguuuuuucuaacauugucucagugggucuucacugccuucuuucuacaauuuuuuuuuuuuaagggaauagggucuuacucuguugcucaaggcuggagcgcaguggcugaucauugcucaccauagccucaaauuccuauucacugcccucuuauauaguggauaaugugggcguuagucucaugcaguuaagagaacagguucaaaagaaguuuugaacugucuguuuuauuuucacaaggccagucagugacagagaaagaacuuccacuuggguguccuggcucugugucccaugguuuuccuacugaaauacuauuacugugcuauagcagaagaaagaaggcuaagacaguucugugcuuacagucaccuucaguuucaaauguaaucauauccugggggaggggaaaugaaacuuugaguuucaucucccaaaucauuccuuuauuuagaaucaaccggcugggcacgguggcucauuccuguaauccuagcacucugggaggcugagguggguggaucacuugaggucaggaguucaaaaccagccuggccaacauggugaaacccccgucuguacuaaaaauacaaaaaaaaaaaaaaauagccgagcaugguggcaggcaccuguaaucucagcuacuugggaggcugaggcaagaaaguugcuugaacccaagaggcggagguugcagugagcugagauugcgccacugcacuccagccugggugacagagcaguacuccaucucaaaaaaaaaaaauaguaucaaugaauucaaagaaauaaaauguuuuucauguacucauggaaacaacuauuucuaaaauucuaaaugaauuauuauuauuauuauuauuauuauuauuauuauuauuauuugagacggaguuucuuucuugucagucaggcuagaaugcaauggcgcgaucucggcucaugcaacuucugccucuuggguucaagggauucuccugccucacccuccccaguagcugggauuacaggcgccugccaccaugccuggcuaauuuuguauauuuuuaguagagaugggguuucaccacguuggccaggcuggucucgaacuccugaccucuggugauccacccaccuuagccugucaaagugcugggauuacaggcaugagccaccgcgcccgaccucuaaaugaauuuuuaaaacuccagcaucucacaaaugguucuugaauaauuuuuccuuagccugcaguguuuaaguuggguuuugaagguuuuguuacucaauagucacccuuuuuuggguguaaguuuguccucuacuccugaguaaguaagugaccuuagggcaguauuaccaugaaacagaucucacaaauaacauugauaccaacaucauuauuuuuggucaaauguuaaauaguuaaaauuugucauccuagucuauauugaacuaauuugaaauaccuuauauuuaagcaaacuuuauuguuuuuaacauagcaaaacaauuaauaaaacuuuaaaucaauuacacaugaaacaguaagaaagcagugcaagauuaaaaucucuagguaaguguucuauaguguauaaguaaguucuguagaacuucagaaaaaagagaggucaguaggauucuuagagcaaagugugauuuuaucuguacuuugggucagaauaacuuuucugauuuuuuuuauuacuaacauaccuaaacacagauaauguuaacauuaauuaagugaccuuagggcaguaucacaaugaaacaucucacaaguaacauugauacuaacacaauuauuuuuagucaaauguuaaauauuuaaaauuugucauccuugucuauauugaacuaauuuaaaauaucuuauugaaauauauuauuaauuaauucauaucagacuuagcuagagacaccuaauguucaaaacagaaaguagagguggauugggcccaguuggcuccaguugcucagaggauguggucagugcuguuuuuguacaucuugagcucugcucacucugucugcgaguagguuuugcguuuugcuuguuggcugucuuguugggggugggaaaauggcugcccauaccuucugccaggugggcaaccccaaagacuuuucuuuuccagcgcacguguaggagcagccuguuggaggcaugugcccaugcuuuagacugucacccaggucaugaggacugugguuugaagagugugcucacucaacuggcuagggggugagggcacuguguuugacaacugucaaggacuagcgagguucccagaugaaagggggugauauaccagaagaagaggcaugggugggaaaugugcauagcagucccagccaauagcuaucacugccuaccacauagugcuacaaaacagcguaagaauuauucauugagugcaaauguugggggaguggggguuaaacagagaccuauucuaagugauucuugacuguuuguccaggugucauuccuuguuauaggaguuuuaaaagcagaaaauucucaacugcucauucaccuaauacuccaugaaaguauauauucuugaguguccuaaguguguguccuuugaaauguuuauauauauaaaagauauuuuaaguauaaaaucuuaaauaucuuuuacacuuaaaauaucuuuuauauuuuauauuugugcuuuuauaaguuaaaaaaugugaucaccaugacccucuacuuggaugugacaacccuccauuuuauaaaauaauuaccguugaaucaaaauuuuugcucaacguaugcuauccaguuaccugucaaagccaacugaaugaaugaugaaaagguucagaucaaaagcaacuggcuuaacuucacggagguuuucaugcuuuaauuuaaaaugugucuaugucuaacugauuaucucucacauuuuauaaagaaauauugacguucuguaaaguauguagugaccucacuucuggcugugugggcagguuucacugcaggccucugaagcauugauauuccuguaaccuuugaggcaagauguguguguaguguauuaaugagcugauugaagugauguacaguaauuucauccuuggguaaaaacagaugugaaagauucuguuuuaauauuuaaucagccuccaagccucuguuggcuuguuuaaguugaccugacagcauuauaccuggaaacacuuugaauuaaacucugagugcuugaccuuguucaaacaguuguaauuuaauaaggcugcugucuugguggagauagugucgcuaauaggcaaauccucuucugacugggauuguucuguuugugagugcugggguuggagagauucagagauucucaucaguuuguggggaggaacugggauuugaagaaguaaaaacaaaucuaaauuaagaaagugucuuuuagaagaucuuuaaaaacuuuuauuuuaauuuuuagacauauagaaguaauguuuuuaaugucauuuugauuaggcucauuuugguugaaaggaauggaaaaucauuuguuaaaaagagagcuggaaacuugucagaaaucaaagaagugcuaggaggacugcauacucacucuggcucuccuuguccuccuguccacccaucccuccacccacccauccgucccugcuuuucucugucucugucuugggcguccucugcacgauagccugucugcucucuccuuucuucuguuggcucccucaaucucuguuucguguacuucucucuagcccauagcuccucuuuacuaaucauuucuguucucucaugccaucaguuugcaggggcucuugguaguuucagcucucuuguauccuuucagcucuaagucuugcugucaacaaguuuguuuccuuguucacguuccaguuagcugggucugaauggcucuccugaucuuuuuugugccauauccaaauugcccaugcuuuccaaagcagggggagcuguggacaagacaguuuuuggcuugaaggaaagauuaguuggggcaaauaccaugauuugcccaauauaaaugcguguagauauauauuuucugguucuaagaguaccauaugcuuacuggggaaaaaugagaaaauuuaaaaaacuaauaaaaauacaguuaaaaucuccuguaaaccgacuauucaaauagcuaaacuacuuugguguauuuccucugauuuuuuuugcuuguuuauacauaaacauaauauacacaguaaacaucccaaaauuuuagaaucauagugguaacauuuuaaagaucuucauaucuacuuguuaccaguggcaucuguaggaauacucuggcugucaggccuacguuaaaaacugugguaauuuggugugaaucuuuuauuaauucuuuccuuuugacuaauauuaaguguggcaucauuaaucauguuauauuaucuucacuuuggcuugcauuacuuaucaacuccuuugagaagaguuaauauuauuuucauauuucacaguacuugacauauugucucauacuuaguagauguucaguauuuggucuauaguuucugcuuaauuuuuaugaaacuugauuucugugagugggcaaaauacauucauaagguuccagcucagaagaaggaaaaaguaacaauguauagcacuaagaauauuggaaaacaacggggaaauaugcuaauugcuuuuaaacgaacagggauuuuggcaguauugugguauaugaagggucuccuguaggaagcugacuggcucuucucuuuuaggagcccucccaggguggcauucauuaccuugucggauugccaugguccaguguggguagcagaauccugagagacccccagugacccugcccuuuguauuauaucuuccccuuugaguauagguggaaccuaugcauguuugagauaucacccaugauucuacuaccuugcuuggcagagggagacuauccaggugggcugaucuaaucacacaagccccuuagaaaccauauucuccagcaggugggaagaaagagugaucugaagcaugaauaggauuugauguugacugcgaagaugaaagggaccaugugccaagcaauguggguagcuucuagaaacugagcaugguccccagcuggcagccagcaaagaaacagggaccucaguccuacaaccgcuaggaaccgaauuauucuaacaaccuaaacgagcuuggaggugaauuuuuccuaagagcucauggauaagagcagagucuggcugacaccuugauuuuggcucugugagacccuaagcagagaacccagcugagccugacuggauuucugacccacucagcugugagcucaugaauggguguuguuuuaagccacuguuuguggcaguaagacuaauauaguccagggucuggcuaauucuuagcuuugucagauuuuaacuugauuuucuguggauaucaaggguggagcugucucucagggguagacuuacaggagccuagcugaagaaacugguguauggaaucaggaggccagcauauuuauuuguuuauuuaccugaaaaguaaauguuccagggacugagauacuccauguggauggucaguacauuaucucccuuaaggcagaccuguguaggaggccagguguguauuagugagcauggcauccaaaccaugaguuagaugagcacaguuuccauggcaucaaacaccugucucacaacaaggauggccuucucuaugucuggacaauguuuagauggguacugccagcuucucuggagacucacuguauuaguuuucaauuacaguguaacacauaaccacaaguuagcagcuuaaaacaaugaaaguauauuaucucacaguuucuaugaguccaggcacagguaacuggguccccugcucaaggacucaccaggcugaaaucaaaaugucagcagggauguggucucauaagcucacugguuguugguggaauucagugccuuaugguuguaagacugagguccucuucucccagaggcugcccugccacauggcccucucuacaauguagcauuuugcuucuucaaggucagcuggaaaaucucccacacacuuuuggucuuuacaaucucugacccccuuuaaaagccuagcccuguguaugcucauagggagagauuguacaggggcccaaaucuugagggcauuguaaaauucugcucccacacuugcuuuccccucagcaucccuugaugacuggccagcuuucuguuugacaccuccuuucuuuagcuguguuaauauauccagucuuugggaguccaggcuugguuggauauuucacaucucugaagugacuacauaguucuucucacauucaguauguauugauuuuuaaaauuuaaauuugugaacuuaaucacaccuuuauuucugugauccuccccccuuuaguaacuggggaaugggaugaggaggaauuucuucaucuuaguuucagaagucuucacagcaguggccucuauuuguaguuugauggucuaaggaguuuagauuguuagagaacuucuaccuucacuagaauuuugaagacguaacuuaaaauuacacuuacuagauguagaaacuggggagacaaaaugaguuauuugcacaguuaaauuauuagcuagugaagaaggguuuuuauuucuuauuuauauccugccuucucucaauaugaugauguccaguaaaaggcauagauagucuaaaagugaagcaauuaaaaauuuuucuauuaugggaauuugacaguacaaaaaaacacagauguccuugcccauuaaagugaacaccaaggaguccaaaauauuuucaugagguaguuuuuugccauugccugucaguugugagagaucauugccucaggccacagcgacuagguguguggcagaguuaaccugccugcucucuagggaaaccgucaagaaaugggcaauaaauuaauaaguagaaaguguucucugagcuccaggcaguuguugauugacugauggaaaagguaggcgguaggcuaauagacgaugacauccaaauucagcuguugccucucagcugaacccaacccugggcuucugcugccuuuugcuccuuuucccugaguggugguggccugcagguuaaacaggugggcuugggaauugggcugccuaggguaaauccucauucccccauuuaacucagucugccagacucuguuuucuugucuguaaaaugaggguuaaaagagagucucuguaaagcauuuaauacguuguugggcacuagcgguggauuaaggagaagagggcugugaugggagcugucagccccagcaggcaggaguuagaauugucuggaauugccgguguagggugauaauaaaaagcaaacugacucuuggucgguuuauuacuauuuuuaaauucccuacugacaaggcccucccuauugccugcacucugaguggaccacuccuuccauccaugccuugcaaugccacugucuugcacauaagggcucaaaaguguaugcuguuguugcccuucucacauuucggcugagguguauauuuucauuaaagaggauuauguagaaaaauugguuuaauaaaaaugaugagacuuuuuaauaugguuuguacaccauuaagagugaaauauggcaaaaucuggucugaaaaauaggaaaaaauauagcaauaacugauuaauagaaaaccauaggauuggcugggcacaguaucucacaccugaaaucccagcacuuugggaggccgaggcagguggaucaccugaggucaggaguucgagaccagccugaccaacaugguaaaaccccgucuccacuaaaaauacaaaaacuagcuggacgugguggugcacuccuguaaucccagcuacucaggaggcugaggcaggauaauugcuugaacucaggaggcaaagguuguggugagccaagaucgugccacugcacuccagccugggugauagggacuccaccucaaaaaaaaaaucuuuuuuuucccuuuuuauauuuuugucuggauccuaaauauugggacauuugaaagaugugcauauuuaguuuaagcaaauucugguggauuugguugguucucucuguaguaagaguagagaagaaugguagaugugaaaagaauauauucugaaaagaauaugggauaagagaaaaucaagaaggcaagaaaauaaucauuuccacccuuuuaucuacuuugaaaucaccacuuuucuuacuuuggucuucuguuuccucuauaaacuaugcuuaagagaccagagugagcagacuucuucgugaaaaccugagcuugggaguugggaugguuuacagucuuggcuucaguccacuuuucugacuuaacacccagaccccuuuccggcuaaauuuauugucuccuguuccugcugggccuuucuggagcguccgccucuggagugcccucugcucuugaggucccaaacugcccaucccacaccuaccuggucacagcuuugcaguuuaaguccccacaugccagugacugcuuccuuucuggaccccuuuacugcauuucagcagugcugucaauccuuccuuuaaauuuaugucacugguuuguagggcucauucuuccagccugcagacgucaguugagauuccacugugaucaaagcaggauauuuaaguucugcagcgggugggcugcaagugguagaaauaguuauuuucuugccuuccugaauuucucuuguuccauucucuuuucaggauacauuccuuucacuacagagaguugucugcucucacuacaaacagaaccagccaaacccaccacgauuugcuuagacauaaugggcaagaacuuucagaacauuuggaacuuuucagaacauuggguggucuuagagacuagccaguacagaaaucucuugagaggguguuacuguguuccuucuggacaccuccaguuucugauuuggcuguccuguuugucagcaguacauccuucauauugagcccaaaaccuccauucauucugguguucuucagugcagucacacugcuucgugauggcuuuucuucagugcagucauuugcuucaugugacuuuucuuuuuucuuuuucuuuuucuuuuucuuuuuuucugaggcagaguuucacuguuguugcccaggcuggagugcaauggcauggucucggcucacugcaaccuccucugccuccuggguucaagcaauucuccuaccucagcuucccaaguagcugggauuacaagugcccaccacuaugcccgccuaauuuuuguauuuuuaguagagacaggguuucacaauguuggccaggcuggucucaaacucuugaccucaggugaugcaucugucuuggccucccaaagugcugggauuacaggcgugagccacugcacccagccaugauggcuuuuccaaugcaaaacauugcaauaguuauuccuuugaaccuuauaaaauuacugauuguuauguuuugaauauuuguccccuccaaaacuuacauugaaauguaauccccaauguggcaguauugagagguggagucuuuaagaggugauuggaucaccagggcuuugccuucaugaauggacuaauccauucauggauuacuagauuaaugaguuaauucaugaauuaauggacugauggguuaucaugggaguggaccugguggcuuuauaagaagaguaugagagaccugaaccagcacauucagcuucuugccaugugaugcccugcacuaccaugagauucugcagauucuuccccaccagugggaaggucccaccagaugugaggccccucgaacuuggacuucucagucuucauaacuauaagaaauaaguuccuggccaggcacaguggcucaugccuguaaucgcggcacuuugggaggccgaggcgggcagaucacgaggucaagagauugaaaccauccuggccaaaguggugaaacuccaucucuacugaaaaugcaaaaauuagcugggcauggugcugcgugccuguagucccagcuacucgggaggcugaugcagaaucgcuugaaccugggaggcggagguugcagugagccgaaauugcacuccagccugggcaacagagccagaccccgucucaaaaaaaaaaaaaaaaaagaaagagaaauaaacuccuuuucuuuauaaguugccuaguuucaggcauucuguuauaagcaauagaaaaugaacuaagacacugauauucaauuguuuuagccuauaaaaaugggaauuuuaugugggucaaccuaguauauucccccugauucucugcuuuuccagcucauauacuuuuguaguuuagauaaccuccugucaguuaaaucaugauauaaguucuucguuccuuuuuuuuccuuuauaguuuaaaaauuauuuuauguguaucuuuccucugguagcccccugagacuugcuuacugcaagcccacaugcugccuugacuccuuuucccugaaucaacugugaauuguuccgcagcuucucuccuuuuuggucucugaaccaagguuucuuaauuagaguauccacaagucuauaugugaagagguugagggaaaaguaaccacuggggacaugagaaaucugaaaaguaauaguuagaaauggccaucuuagccuuauuaaaauguaaguaaggccguguaugguggcucacaccuguaaucccagcacgagaggccaaggugggcagaucaccuuaggucaggaguucgagacuagccuugccacaauggcgaaaccccaucucuacuaaaaauacaaaaauuagcugggcgugguggcauuugccuguaaucccagcuacuugggaggcugaggcaggagacucgcuugaaccugggaggugaagguugcagugagcugagaucgcaucauuguacuccagccugggagacagagcaagacaacaucucuaaauaaauaaauaaauauaauguaaggcaaggccuuuucccuuauaucuauuuuaggguuuacccuuguguauacagaaaaauuguucccuguccagcuuauuaugggcuggauagcaggcagaacuccucaguuuggguuagcauugcauuaacagaacugccacaucuuucuggauaaucuuccuuugugcauaagcuccaggcucaccuucucugccucacagcugugcgcugguuucccuuagcuuucuuggguucuggauggauacuggccuucugggugagaaggggguucuuuggcaaaagguguuuuugacauaauuuaggaccuucuuaaguucuacagcagaccuaaauuucuucccccaaguucuuugucuauauagaguacucagcacucauuacccauucucaguucugaaggaaaucuuauggagcaguuguaguauuuauaggguaagcagagugcccaguuuccaugccccaccccaaaccauuuagauuucagucauguaugucaagggaggagugaguacauuuuuguggucagcugccucuucuuuucccuaacauucucacuuuuucaucuuuccugcuuucuugaggucauuuaucuauugaauaggaugucuauugaaaggaaaaaccuccccuaaucgccuuuaaacuaauauuucuuacugggcaugguggaucaccugagguugacaguuugagaccagccuggccaacauggagaagccccaucucuacuaaaaaaaaaaaaaaaaaaauauuagccaggcgugguggcgcaugccuguaaucccagcuauuugggaggcuaaggcaggagagucgcuugaacccaggaggcggagguugcggugagccaagaucgugccauugcccuccagccugggcaacaagagcgaaacuccaucucaaaaaauaacuaaacuaauauuucucuuuucucaauaauaauggcaugaaaagaauuuuuucugugccuuuucaaaaucccaauacccccucguggcauuuccuauguugaaguuuucaacagccuuaucaggaggagaaaugagcuuaauuuuugaguuuuagugcuuagggacucugucuuggcuucuagagauaacuucacugugggcacccacaaauaauauguuuaauuuuuuuucuaaaccuuuugcugauggucauugcaauauuuucuugauuuuaauuuccugaguuuucuucuuucacauuuuuucuuuuuuuuuuggugauauuuuuccauauuccauuaucugcauccuucucacucucccugauuuuucaaacaucauggacuacagaucugcaaccucccugguaauuccucuuggguuugagaggaaguuugucaaguacuggaaacuugaacuuguauaaaacagaugucaccacucauuuuaauggaagaaggcauggaguaaauacagauagcacauaacagcuauaugcauucucuuaaauuucuuucccgaucuugggcuugagguauuuuuaucuaaucuagucuacccuugccauuuucaagaucuuuuucuuugauacuugauagagaagugucuucuguauuuuucuuccuucuuggaagaauauauuuuaaaaaauguauuuugagauugaguauuuugugaaacaucuuuccucuaaaauccucaaaguaacuuugccucucuuugauuucuauggguaguccagcggagagugauacacauaaggauauuucauaaacacugcuugcauuccucugggauuugugcuccuagaugacagcauauauaugcaugugauucuguguguguaaacaugcuuuaaaaaauuuauugaacauaguuuucagcugucuucacucacuuuaaaccuuagucuacuuucuuuuucuuuuuuuuuuuuuuuugagacuaaguauugcucuguagcccaggcuggagugcaguggcgcagucucaacucacugcaaccuccuccagguucaaacgauucuccugccucagcuuccugaguagcugggauuauaguugcccaccaccaugccuggcuaauuuuuuguauuuuuaguagagacaggguuucaccauguuggccaggcuggucucaaacuccugaccucaagugauccgccugcuucagccucccaaagugcugggauuacaggugugagccacugugcccagccuuuagucuacuuucuguuuuuacaauuccaugccauguuuauugaaagcauguuguugguuucuuuugaugccuccccugucuuucuucucaucaugauuuuaaaaauuaauacuuuguaauauuugagauuuuuauaucuaugucaaguuaacuuuuccugaaaaauauuuugauacauuuucuagaauguuaguguauuguguuuauaacaugggggaaaauguacuguuucauuuuuaaauuuauuuuuauuuauuuuuguuauuauuauuuuuuaagaaacagggucuugcucuguugcucaggcuggagagcaguggcaugauccuggacucaaacaaucuucccaccucagcuuucugaguagcuaggacuacaugcguaugccaccaugcccaccuaauuuuuaauuuuuuuguagagacagaguuuuacuauauuguccagacugguuuugaccuccugggcucaagggaucuucccaccuuggccuccuaaaguguuaggauuauaggugugaguuaucacagccaggugcaauaaguguuuaugauuaauuuaaaagcagaugcugugcuuuucaaaaauuaugcucaauuuuuuuuuuaauauuacaaaggacuuuuagacuggcuuccuccuaaacauuucuucaacuccuaucaaguucagucugcaaauauccuaauuucuagguuguuugggaauguuaauugauugucucauguauguauguauguauguauguauggauagacagauagaugaagguugaaggauggauggauagauuaaauggauggauggauagauagauagauagauagauagauagauagauagaaagauagaugaagguugaaggguagggcuggaggaggaauuccagcuuuccaguagauuuucuaucaagcagucauucauauauauaacuuccuauauuguuagccaaaguucauccaugucucuuguauuuagcucucugucuguauuguagaaagcuuauuuauuaugugagcauuuugcuuucuccuaucccucccucuuucuuuaacaucaguuauaacagcugugaauacaguuuauaauaugagcagccauauucaguuuuuaggcuuucaaaaucacaaauacaaaggaggauauaauacauaguccuauauuuuauacaaauugggacacuuuucuucauuucuuauuucguggcauugccuaacuauagucaagcuaaugacccauguagauguaguguuguaccugguguccgugucccugugaaugugucauguugugcuggccugauuccccaacaucagccccagggagccagcagcuggagcagcugucaucuugugaaagcagaguguccuuguugcuauugauuggguuguucagucaauugcaaaaaaguggaucuaacugucaaugguaguuauaugauaauccuggagauaaauaagugucaagugaaguauuacuugaauuuaggacuugaagagagagaaagggguaugaguaguuggaggggaagauuugcuaugacaagcuauuauucagugugguuauuuuguaugacagguaagucuacagguaucuuuuguuagauaaaucagaaauuaagcauucccuuuguaaacuccaaacaagauuuugaaacaccaugguccccccuuauccaccuccaagaucuccaguggaugucugaaaccacugauaguacugaagucucuauauauuauguuuuuccccuguauguaauacauaccugugauaaaguuuaauuuauaaauuaggcacaggaagaaauuaacaaaaauaaguaagaauagaacaguuauaacuauauguucuauuaaaaguuaugugaauuuguuuucucucucucucaaaauauccuguugugcuguguguucacccauuuuugagcugccguugacuguggauaacaaaccacagaaagugaaacuucacauaaagggggacuacuguauucucauaauguuaauugcuucuagaauucacaaggauugaauucaacuugaaucuugcuaaagaaguacuuuauuauucgauguuaguccagcaacaacuuauaguguagaaauuugcccuuuugagggugaauacacaaaggggaaagaaaacuugugugcccacgguccacuaacagauaagcuucuggaggccaggaguaaaccgcccugcaggggagccaucucccaggguuuccccagcagagagcugugcccagugccggggucucaugcuuaccuauuucucugugccaguauaguagaccuguuuucaagccuagcaugagccuuaaguauuacuggcugggagugguggcucaugccuguaauccuagcacuuugggagggugaggcaggcggauugccugagcucaggaguuugagaccagccugggcaacauggugaaacccugucucuacuaaaauacaaaaaauuagccgggcgugguggcgggcaccuguagucccagcuacuugggaggcugagguaggagaauugcuugaacccaggaggcagacauugcagugggcugagaucacgccagugcacuccagccugggugacagagcgagacucugucucccacaaaaaaaagaaaaaaaaaaaaaguauuacuuauuuaguaaguccauagcauuuuguucacacaguguaucauugugcuuuucuguuucaaaguguaauuauuuaaucuagaaauuuuaaguccugugacagaaaacaaaugcuguucucacaaaauaugagaaaucaaauuccaucuuauuauuuaaauuaauucuuuuuuaacugaagaauuguuauguggguagcuuucaacauaauuuuuucaauauuagaugcuuauaacuaauguggauuuaguuaauucgauguuuaucacauuuaauucuuauuuacuacaaagguuaaagcaauuuuauuucuucuggaaacuuuuaggaucuugugagugagggacgucagccaaaauuggcaacuuuuucaagcaacuggcucaagaaauuaggaauuucucuaauaaugagccaucguuuuuugaauucaacaauuuaaaagggcugcauaguuaggauaugauuccaguuuccccucagugcaaauugauauuuuuuucuguugacacauucuacuuuguuuucgaagacuaguuuauaguguucuuuuaaaagcaaagaaaauaucuuuaaaaaucccagcuuuuuggcugggugcgguggcuucaugccugugauccuagcacuuugggaggcuggggugggaggaucacuggaggccaggaguuugagaccagucugggcaacacaggcacuccaucucuuuaaaauaaaaaauaaaaaaauaaaaauagccaggcuugguggcccacacuuguagucccagcuacucgggaugcugaggcaggaggauugcuggagcucagggauucaagguuguagugagcuaugauugagccacugcacuuuagcuugggcaauggagcaaaaccuuguuuccuuuaaaaaaaaaauuuauuaaaacaugcucuuacuuuggcaaaaauauauguuucuucauagugaugauaaucauaaugauacauuauuacuauaugcagcuuauaagaaucaguugucuaauguauccguguaaguuucucugugguuuuaagaaucauuccauaggcugauaaaugcauacucucuucaccccauugcacauccagcauucugaauuuuucucacuuccuugaauaugccauguuccaugcacuuguagaucuuccaucacagaaggugccucaucuguccagaaccccugccauaccucugcucccuuugucuagcuaacgcucacucauccuuuagaucccagugaaaugucacuugcaucugggaggacuuucugacuagguucugagcuuccuuugcauucuguuuuucauugacauaaugacaucacauuuauuaguauugucucauuguaaaccccaguaaggcaggaacuguaucucucuguauccccaacacuaccacagugccuggugcauguuaaauugcaguuaauauuucuagaaugaaagagugcuuccauccuucaucauccgucuuucagauaaagaaguaucuaguuaccuuugucuuaaauuaaaacaauuucaaaagguugcaugugcugguggaccaguugaaauccacagcucccauauugcugcucauugccacuguuauugaugcccuggagaugauuuaaaauucaguuauguugcuugugauggugguauuuaaaaaucuauaauuuuggcugggcgugguggcucauaccuauaaucccagcucuuugggaggccaaggcagguggaucacaaggucaggaguuugagaauagccuggccaacagagaaaccccgccucuacuaauaauacaaaaauuagccggucgugguggugugcaccugcaaucccagcuacucaggaggcugaggcaggagaauugcuugaacccggaggcggagguugcagugagcugagauugugacacugcacuccagccugggcgauagagcaagacucuaucuugaagaaaauaaaaaauaaauaaauaaaaucuauaauuuuuauacucaugugcuauuauagugacccugugagacaucauaaugccuuaaugauagcuugucuuguuuuuacuuucacuuacaucuauaguuccaaauguuuuauugaauugugcuuuauuugauaauucauaguuguaaacugaccucaucccauauuuguauuuuuacaaucucaacaguuuuaucagggacauauuuuuauauucuguagcauaauacagugccuucuguagagcuuaguuucaugugcagugaugugucagaaugaaauaucugcccagugguauugaauuucauguauuaugauuuacauauucuucuguguaucaacugguuuuauauuacccagagaaugcuuaugguggugguugagaguuguguauugcuauugacuguacgggccauagacauauuuguagguauauuaaauuugcuuuguacuucucacacaauugauuuggugggcauucuucuuaauuauacuugaugggugcauacauaaauucauucuugguuaaaaaaauucagauaguguagauauggcagugguuccuuuaaucccuccaauuauuuauuuaccuuauauaucugggaacuuuguauaaaaacuaaacacuggccuggcacgguggcucaugccugucaucccagcucuuugggaggcccaggcggguggaugucuugagcucaggaguuugagaacagccugggcaaaauguggcaaaacccugucucuacaaaaaaauacaaaagugacccaagugugguggugcacaccugcagucccagguacucgggaggcugaggugggaggauugcuugagccugggaaguggaggcugcagugaacugagaucacaccacugcccuuuggccugggugacaggccgagacccugucucaaaaaaccugaacacuucuuuguuauguuucuacaauuugacacaauaauucaagucagccaagcacuuuaaaaauuauuuugaaauaauuuuagauuuauaggaaaguugucaaaauaggguagaguuaauuauauauaaccuuaugcaguuucccugauaaccacuuauauaaccauagcacaguuauaaaaaaauuaucaggaaauucacugguauaauaccauuaacuaaacuguggcccuuuuugacuuucaccgguuuuucaccuccuguauuuuucucuguuccaggaucccauccaggaucccacauuaccuucaguuguuguuucuccuuuauuuccugcaaucuauuaaagauucuaauccuuucuuugucuuucaugacuucagcaaacaguuuuaguuggaugcuuaguauauaccagucacugagauuggugcuugagggaagggagauaaaugaauggaugagacauggcccuuaccuaaugaggugagccaacacauagacaaguaaugcuaaaacaauguagugccuuuaaaaggccuuuguacuaucucccuagagaagagagaguugcugacucacugaauaacaguguugaggcagcauuuucagaagaaaugacauugaucugggucuuaaagaauggggaaacuuuuccuuguggagaaauggaguggaagaggaguucaucauggacaggcaggggcauuuggcaugaaagugugaaagacuggcuuguuugcagacuggcaaaucacuugauaggaauggagcauaggguaugugaagaacacagugaggcaugaaacuagaagaguaguuacaaagcuaccuuuuuucauuacuuuuuauuaauaaauauauccucauauuuguaggguaaguuuuggcuuaaauuuuuuuuaaaucucauuauucauacuuaaugagcauuuaauuguaaucaguguuucuaguuuuaaacugcacaacauuaagauuguuacuguacuuuuggaaagaaaaagagaacaaauaauuaugcuuagcuguugcaauagcaucuaauagcauuuaaauucuguuaauaaagaauaugaauuuauucuguaaugccuauugggcaccuauuauauggcaggcacuguuugaggugagagagauauagcagcaaagaaaagagaaaaacuccugcucuuguucuaauauauucuagugguccuaguugcaauauguuugaacuaacaugguaguucagucaacaagucaaauguuaacugccuagcauguuaucuagaugcucagcagauuuuuaaaaaaugaauagauauaugacugggucuugaaggaguaaaagaauuucaggcugggcacgguggcucaugccuguaaucacagcacuuugggagaccaaggcaggcggauaaccuaaggucaggaguucaggaccagccuggcccaacauggugaaaccuugucuuuucaaaaaauacaaaaauuagccaggugugguggugggcccuuguaaucccagcuacuugggaggcugaggcaggaaaauugcuugaacccgggaggcagagguugcagugagcugagauugugcuguugcacuccaaccugggugacaagagugaaacuccaucucaaaaaagaaaagaauuucauugaguagagguuugcuggcaugaguaauuuuuguuuauuucauaugcauucuuggagauuauucuuagguaguuagaacacauugaagauauuauuucauugucuuuugacuucaauugucaaucucagguaauugucuuuucccuggcugucuuuaaaaauauuuucucugggccgugcaugguggcucacgcuuguaauccuagcacuuugggaggcugaggcagguggaucaccagaggucaggaguucaagaccagccuggacaacauagcaaaaccccaucucuacuaaaaauauauuaaaaaaaugggccaggcgugguggcaggugccuguaaucccagcuacuugggaggcuaaagcaggagaauuaccugaaccuggggcauggagguugcagugagccaagaucgcaccacuucacuccagccugggcaaaagagcaaaacuccauaucuaucuaucuauauauauauauuuuuuuccucugguucuuauuuuugaaguuuuuguacaauauaucaagauacagauuuauuuuuauuuauucugcuagguaucugaggauugguauuuuaguucaggaaaauucgcagccauuauuucuucacauacuguuugugcuucauccucuuuuuuuguuuguuuuuuugagaugaagucuugcucugucauccaggcuggagugcaguggcgugaucauggcuccacugcaaccucugccuccuggguucaagcuauccucccaccucagccucccgagcagcugggauuacaggugugcuccaccacgcccugcuaauuuuuaaauuuuuuuaguagagaugggauuucaucauguuggccaggcuggucuugaacuccugaucucaggcgauccgcccaccuaggccucccaaagugcugggauuaacaggcaugagccaccauacccagccugcuucauccucuuuuaaucucauuuucagucuccaauuaaacauauguuaaaauuucucacuguaugcucuaugccuuuacccucuuuuguguuuuucuucuuuuucugagcuguacucaguuuacugauucucucuucaacuauaucuaaucugucauuaguuauagaauuuuuauuuaguuaucaaauuugucaucuuuuauaguuuauaguucccuguuaaaaccauuuaguuugguuuuuaucucuuugaauauaguuaaugucauuguuuuuaaaucuuuaccuguauuuucaauaucugaaguuccugugggucuucuucuguaguuucuuguuucugcugguucugacucaugguguuuguuuuuuccugugccugauuacauccuggauguuguuuuugaaaaaguauuuauagaaauaauuugagguugagaauuuucauaugcuucugccuucugccuagguuguacaguuuaaggccuccucaagccaaguucaugauucagguauugugaguugggcugcaaaccugugugcaggcugguuacuuacaguucacuuucccucuuugaagccccauuuacaauagggguugguauccuugagaccccaccugcuuaggcuccagaugucaccagaauuucacaucagcuuuauuuccuggauugguaaauauaaccccaugauaaaaguggcucugaguguuggguuuaccucuuggacuuccuguccucaccaauuuuugaccgaaaauucaacccuauguuguuagcucuuugaauuaccuauucuguccucauuagaagagugccuccagcauuuauugccuaaacaugacagcugaguauuuuuaguuugauuuuuuuuuuaacauuugcuaauaauacguuuucaaccagaucauaaacuuuguggauaaggucccugucugcuauuucuuuacccuucucauauagcauuuaauacaaugauagguggauaauugguucucuuggccaguugacugaucaaggggcaauucuccaaacucuggugauuucuccuuuucguucguaagacugcuuuuauaccccaacaaagaaacuuguuauaauuuaauaguggcuguguccauuuuucuuuucuucucugcuguuccaucccaaggugggauggccccaauuagacuaaccacugaaacccugggcauaaaauggugcccagggagcuuuucuucauauuaauuuguguguacucuaaaaggaaagauuauuuggcuugcucauaaauccaaaauuuuggugaugaaaauauguuuauaauuauuucuuuugagcuugauuuguuguggauuuuuuccuuuauuuugguuuaagaucaaaugguuuccuaauguguaugggucacuguagucuaaauuuuuuuuuuuuuuuuuuuuuuugagauggaguuuugcccuuguugcccaggcuggaguuaaauggcgagaucuugccucacugcaaccuccaccuccuggcuucaagugauucuccugccucauccuccugaguagcugggauuacagaugccugccaccacgcccagcuaauuuuguauuuuuaguagagacaagauuuuaucauguuggccaggccggucuggaacuccugaccucaggugauccgccugccuugaacucccaaagugcugggauuauaggcaugagccaccgugccuggccucuaaauauuuuuaaaguauagauguuuuuaaacuuguagcuccugagugugaacugucccuugcuguuuuuugggcaucuaucaaggcauuuguucuaaccacugaguaagaaggacaucacuaaggggguuguagcuauaccuuucuucuuuuuaucuuuaauuaacaugcauugacugccugguauguuagaaacagaccugccuauuacagucucauucccuuccauacucauccuugcuuguguggcuaccucccaagcuaggacugcaagacccuuaucacuccugcuuacuauugguuuuuguguccuuuuggcaauuuucuaguggcugcuugaacuauugguugucagauugaccugauuuguuucacuuguaaacaaaaugcuuaagccacuguugauuuuugugacagcucaguugcuuagagcaagguguuaaugagacaucggucauagguccaggcucuggguugacugguaagcuuugcucuggcccauggccacagacccugacucccccuugccagcugucuugcacauguagcuauggcucauuauggggacacagcaggggguggagauaagacaaggcaaaucugucaucucugccagaaaagacaacuccuacugauaggucaguaaccuuuucauuggaagaacagcacguuaguauuagcuucuguagaugugucuaacugagucuuuuucuuaaaauaacucaugugauuguauggguugucugcagcaaguuuagaauacugcucacauuuuaaagcauguuugaauauaaggauggcuuuuuaguuugugaagauuauuguccuuaaucagggauucuuaauaucauucucuaaaguagaaaagugagcuuuagaagucaaauuugauaaagcucuagaaaacaacugcaaaauugcuguuauaaagaaaccugucaaauuuaggaagugcccuccaggagcccuucaucccaaccaauccucuccuaaaagaaaggaaaaaaagaagaaagauggcuagguagauggaauagugaucagaaaaaaagaacuuuucuagaaaagcauaccagugugcucuuuaccagagcauuuuagcagguaauauuuuacaaaggacccagcagauaauugggcagguuuuuucuuuaggaacuuaguguugauggccugaauuaaucugacuaggaauuuagacauuucuucaugauauauuuugaguccauagaugaucugauucuaaugugacuucaguuuuuaacuuacauagcguuaagcaaaaggauguguguguauguauguguguuuguuuuacauccuaaagguauuacaggccccaugguaaacuuuuuggcucaagugaauccagaguuugguauauguaaccuccaguggugguucaugaacaaacacuucauuucuguagucauauuuuuuuuuaaagaauaaaagugagccagguuuaaaacuuguuaagaaaauaauagcacaggugauacacagaugaagcaaaauugccguggauggucugggaaugccugaggauugagaaacacuggcugaauuauacacuguggcagaagaaauuauaggcccuuagaaacagguagagguuauuggaaagauucaagcaccuaauguuuaguuagaagguaaguaagcugguuucuuaaguucuuguuuauuuauugggugugggcucaggauaaguuaguuugaaauagaucuuagagaaguaaaugcaagacaacuuuaucaaugagucaugggcaaacaauucuauuauuagaaguaguauagaaaaggaguaggagaaguagaagggaggaagucuaguauucauucauuuauuuauucauuaauucagccacuauuucuugagcaccugguguaugucaggcacuguuguaggcacuggggacacagcagggagcaaaacagacaagucucugcccucaugaaauucauuuacauccuaaugggaagagacaaauaauguaagugaguauauagcaugucagcugugagaaaugcuauggagaaaaauaaagcagaguaagggaauuaaggagugaugggauggggaggcauugcuuuuuuaaauaguuugaugaggaaagaccucucuaagaaagugacauuuaacuugacuucugagggaagugagggagcauuccaggcauggagaaggaguguucuagauggagggaacagcaagugcaaagagcccuugacaugucugagaaacagauaagaggccaguguggcuggcguggagagagaggggagagucgucaaguaguaagaggugagagcagaugggaggaaggucucagcacaggucaggccucuggcuuugcugagagugauggaugccuuugcaggguuuugaacagaggaggcacaugauuugacuuaacguuuuaacaagcuguuuccugcugcuguguugagaauaagcuguaggcggcaccaagguggcagcugggaggguauugccacaaaacaagcaagagauaugaugguuuaggccagugguaaugguggagagugugagaagaggacagauucuggauguauuuugaaguagagcccgcagaauuuguugaugaacuugaugcagaguguuagaaaaagagaagacuucaagguuauuggccugaauaacuggaaggauggaguuaucuaucacugagauaaacagagguaacagaaguaaaggggagagauggccaugguagaagguggauuacaccuuuaaauuuuuaaaacauauuuuuauuuaaaauagcccucacucccuggcccagugcacacaaaggaccugauuugcuuuuacccugaguuugucacuguagauauccuggaauacuucguuaaaaacuauaaauaaaguggccauaauacggcucauuuuguucagauucuaaaaaaaaauuccuucauaagcaguuggcuuccaaauagcaaugcaugcugucaguuuggugacuaauuggguuagagguuaauagcaaggcaguccuauaaacaucaacgggagugguguauccaaaugaaagcuugcauuaggcaacaauucaaagaaugagaaugacuaaauaccauguuacaagccaagugaauuauauuaagaguuuuaacuuugagagaaagggacguuaccccugaaauaacuaucuuaguuggaucuucccuacuuaauacucauaguuggguuguaaaaauguaaagguuaccaucaaaacagcacuucuuaaccaugaaauugacuaacuuuguaaaauuagaaauucuguuacuuacuuccuacuaugcugauuggacauuccuucuuuugccaaaagaacagaaaguuggauuuugugccuucuagccaagagaaccacacaccucucucucuguagaccagcuaaaugcuuccuacugcucggugaugaaaucagaucauggaaucagucaguuugcuauacugaauuuuuuuuuuuucagcuguguucuaauugaaccuuuggggaauaaacuaauucuuaacaucugaaaguuuaaaggucugauacuagaauuuauggggugguagaggagaccuuuuagucucuguauccaaaccaaaauguaaauuuacuuuuauuuauuuuuuauuuuuugagaaggagucucgcuuaggcuggagugcagugacaugaucucggcucacugcaaccucugccucccggguucaagcaauucucccuaccucagccucccaauuagcugggauuacaggugcucuucaccacgucuggcuaauuuuuguauuauuuaguagagacaggguuuugccauguuggccaggcuggucuugaacuccugaccucacgugauccgcccaccucagccuccaaaagugcugggauuacaggcgugagccacugagccuggccaauuucuuuuuuuauugugggauaaucauuccauacuucucccuccucucuaguccccacccccaccccccuuuuuccccccacaagugaagaugauuuccugugcuggucuaggauuaguuuuguuacagucugucuuuauaagaacauuucuuuuccauaauccagaagcauuuuguaaaaccuaugccuggaaauugagucacuuuuuauugcuuagauuuucuucacagaaaaacauagguucuguuggaugaguauuuguugugaaagcaaauuauuaaggggugaaaauugucuauacaaguugauguauaggaggauaucugaacuggauuaguugcucuuuuaucuguguuuucaaagcucuuuaauaguaacucuuauaacacuuauaacaguguuaucacuauuguuugggcaucauuccauucugcuagacugggaauucuuuuauaauacagugccugauaggcauccauucauuccuugaaauaauguauugagugcucauuaugugcuugaaauagagugugugcaggagccagagcagucggcagaacagaugcagcuugugucgcaugugcguacagcccauggcaggguggggggcaggggacccagcaaacaagauacagauaacugcgcaguacagugccaauaugcacaggaacagugacuguccccuaccuacauaaaugcauagaccucauauguguauugugaauccucuauaauuguugaauuugacuuugaaauuaaacacuugauauuuuagacuagucaaaaaugggauauguuauuauuuuaauaaaaacaccauuguauccagccgggcacaguggcucacgccuauaauccuagcacuuugggaagccgaggcgggcagaucaccugaggucaggaguucaagaccagcuuggccaacauggcaaaaccccgucucuacuaaaaauacaaaaauuagcugggugugguggcacacgccuguaaucccagcuacuugggaggcugaggcaggauaaucacuugaacccuggaggccuagguugcagugagucgagauugcaccacugcacuccagccugggcaacagacugagacucugucucaaaaaacaacaacgacaacaaaaauaacaccacuguauccauauugccuacaggagaaaaugcagaucacuuauuuuauguauguguugaaucauuuuaaauaaccugacggagguccuuucuugggcccaugccucugcacauguugggcauguuguaguugucguuacuagcaagacacaccuacccuuuaagaccagucuaaaugccaccuuguucccuccauguaaucucagaacuucuuuaagggcaaggaccaaauuacgucugugaaacccuagaguuugaucuaccacuucacguggaggcaugggacagagguuuuguuaaugagugaauguauccauuuaauaaguuccuucuucaguacacucuugagaccuauucuggcuuucccaggaaacagcugaaggagugaccuccaaucaagucagcucugugucaauccuucauuuucggauguuuuuucuuccuuuucucacagggucauaaggaucaaauguaauaaugauguaagaguuaagcguauucaauaaagggaggcaguggaaucaucacaauguugaucaucacaaucaacauuauuauuacugcaccacuauaguuccuuguaauacacaguccagaaauauuaucacaaaaucucacugaggaugucauuguucuggguuugaccuagauguugauguaaugaacaguucucuaucaguuaguguguuggccuagcacaggugcuugacaaaggcccuauucagacuucugugcauuacuucaaaccccucccuuugcucccauaguauaguaaugaauuaggagucauaucuuuugacuggcaagggacugccuaaagcagaucccugcagauuggggccucacuguuucuguggguauaaagaaccucucgggagagccugaaugaucaggagaucugaacuggggagccaucggcccagcaggaggugccucugcuuggccaaccagagccugcugcaagaaaccuuuuuuuuuuuuuuuuuuuugguucugacaggcuuguuggggaaauugaaaaucuccuguuugaaagccagauaauuuaaaauccuuucugauucagaaucucagcaaguagugaagggcuagguuauugauugugggaaauggggcagccucaaagggcucugggcuaucucaguaccccaucucccucaccccucacgcuuccucagguuucucucucaugcuagcuuggaauggaugguguauuuccuacccaguugccuuuguuuauaagcauccaccaccgcugcaguagggucaggaaacuggcaauuuccucagugauccuugcccuugaacccuaucuccuccagccuaggaaguauucagaccaaguacucaugugugacucuccagugcuucuggauagagaagacccucugagcugcccuaaacucgcaagagaauacuccacaggcuuauguaagccaaaccagaucaugagucagacaucugaacucaucaacaaaaagugcuccaggaaaaagaaauggucuaccuggcauauuauuguuugaaaauuuauuuuaagucaauccucuauuucauuaaggguaauaauaaucagucuacaaugcaaaacucagggaaaaguaaauuucauuuuguauagcuguaauauaacauuuuuuacucugcucaaaauucuugaaauuguuaauccaacucuauaaauuaggauauuugaguaaaguaaguauccauuguuugacugugccagaagcaggaguuaacuuuuucuuucucugguuaaaauuaucacuuacuugauagcuaaguaauuuuuugaaagucucuuauauccugaugguacacuaaggcccugaagagaguauaaaggugcaagauucaguccccucucucaagaaacuagcaguaugauuggauggauaagauuuaugcaugugaaacagagaaugcuagauauuuugggugguaaucaaguguaauaguaugugauuuuaguuauaagcgugaugagugcaggaagggagaugaaaaauaaauaauauuuagugaacuccacuacuacagaauaaauauuuauaauauuuucuauuucaucaggaagaacaauuugaaucacuggcuuaaucacugguggggggccugguuuuuagucugugucuuaaaauucuuagcucacuuaugucauuugucauaugaacuuuuuggagaaagaaauauuuaguuuuuauacguaguuuuuaagacuuuaaagguuuuauaacccuuuucuugaaaaauuaagacaucaaaucagcaaguauuuauugagcacugaccuuggucugaggcauguacauuuuuuaguuuuuagacaacaguaaaguaacccugaaauaaugccuacaaugacuuugauaaguacaagauggugaguugagguuuuagccaagaaccuuuguuuucucuugcugaauauuuuucucuuugguuaugugguagaauuuagagcucaaaauguucagacuguuucuguccaaguagcauucucaccauggucaagauuuguuuagugauuuauaauuaauuagauaaaaguacgcaaagcuuuuugggcuuuguacugggaagugcuacauaagacugcgugguagugguuugggccucauugcuuauaucugacauagcuuccaggauuuaugccugucuccaccaagauucuuuuccucuuuaaugaauuugaaaguaacuauuuaucuugaaugaaauuaguuuuuucuaccuagagcugggaguuucauuuucuaaucagaaugucugauuuauuuaugugccugccaaaaaaaucccaaaauacuggccgccugaguucuggcuaauguuuccaggugcucuguuuugaaaacauuccguuucuacccuguauuacagaugcucuugcguacagugaaaucuugugauaaauauuuuucagugaacauaaaguauuuaaaaaauaaacgaauggcaguauuagucauacauugaccgaaugccaccaguguauuauuuaucaucauauacaggacauaguccaagacacaauccuuauuuagugguucuguagucuaauuaucuguaaaauggucaugucaaaaaaaaccaaggaaccaucaguugggcaaauuguuugcaauuaugauuaauaacuugcugugguuaauuaaugggaaaauauauauggcuucuaacgggcugcuaguuucacauauauaagcaguguguauucaaaagaauuuauaccaaguaauuauuuauuacuacauucuagguuuaauucuuacuuguguuuucaagccauucaaggaaagugagcacaaguaggugauagccaccauucuuuaugguaauauuauuuaggucuuaaaaucagucagaggcaaauuauauuauuugaaaaaugauugcuuuucacagacuaaauuauccuuauauuauuuuuccuuuuuuuuuuuuuuuugaggcuuagucucaagcuguugcccaggcuggaguacaguggcauaaucucggcucaccucaaccucuaccuccuggguucaagcgauucuccugccucagccuccagaguagcugggauuacaggcaccugccgccauaccuggcuaauuuuuuuuguauuuuuaguagagaugggguuucaccauguuggucaggcuggucccgaacuccuggccucagguaauccacccacuucggccucccagaguguugggauuauagcugugagccacugugcccagccucuuuuuuuauuauuuuaacauacuuugaaaauacuuaauaccuaucuagaccagaccucuuuuguaccagauauauuuauuuuggucuagagaaaaugaagacaacguauuaaaguuggguguacccaaugcaaauaucuguuuaaauucaguguucagauuggaguuuugugggcaaaauauuuaacaagaauuguauuuaacuuaccugugauuuugacucacauagacuuagcugaaaugaaacauaguaaguacagauuuaaauauguauguauuugaguagaaaucuuuccaccuguaugcagguaguuuuuuguaauaaugaaagaaaaugauuucauuuuaguucuuuuauuugaugugacaggaauugauugguuagucaagaaaguugguuaaaagcagggaauaaaaaugugcauccacucucuguauguguuaaauauuuauuaauauuuuaacuuuugaaauauaucauguauguguauuugccacuuguuugauggagguuccaggcuuuucuuugagcauggguuggaguuuccaucuuuuuucucaauaauuuucagucucaguuucuuuaaaggcauuugugaagaaucugaauguagaguucuucuagauuguaauuucccccucgaccuuuuacaguuuuuuucacuguuaaucaaauccaucuaaaagcauucagcuacguguccauagagacugcaagucuuuuuuugugcacauagcuuauuggauguuggauaacaauauuuaauuaagguucuugauuauaguaacaggcauaacugacacaaacagguuugagaacaagcgcaauuaagcacagaacucaacagauggaagcagaagugccugggugcccuagacaauagcuuauuugccacuaguguugaggauuuuguggggaaguaaagagcucugggcuggugaggcugguaggggcggucagugaagagggcuuuguuuuccuugucugaggcuugucuccaacugaaaggccuccuuuccucuccugucccugggugaaucuuugcucaaguccccuguauuuucaucacagccaucaccccuccccuuuccacccgugucuacugccuuuuccucugcaguuuguuucugaacugacugaaaucucugucagucuccguguuaaaauucccuucaagacucaccuccuuagagaagcccuguggauggacuauacccagcuuuuacccuucuauugaugauuuuugauccaucuauauagcuuuaaugaaauaaaacuucaaaaaccugaauuuuaguauuaaauaugcugccacucauauaauaaguguucaaguauuucuuuagccaugugaacuuacauuagaaaauaaugaaauucuugagaugguuaauuuuuaaagcuguuuaccauaccuuucuuuuaaaagggauggaagaucuggccuuuuagaauaugauuugccagccuuccauagaguauacuauugaagaaagcaagaaauguguguuugcgggauucuguugcucaggcuggagugcaguggcucaagcuuggcucacugcaaccuccgccuccuggguucaagcgauucuucuaccucagccuccccgaguagcugggauuacaggcgcaugccaccacgccuggcuaauuuuuguauuuuuaguagagacagaguuuugccauguuggccaggcuggucucaaacucccgaucucaaguaauccuccuguguuggccucccaaagugcugggauuacaggcgugagccaccacgcccggcugaaagcauguucuugaauguauauguguguucucuccccaugugauuuguaaacccuccaaggcuugggucucacauucucauucuuugaaucuuuuauggcauaauggauagagagucugugcucuuguccaguugaaguaaguagugggcgcucaaaaaauguugauuggccaaaauaucuacaucaaguacaguaacgacucauagcugcuaacaucuuuugagcaauuaacaugcaccguacacugucuuaagcacuuuauauaugucaccucauguaauucccacaacaacuauaguuauccccauuucacagauguagaaacuaaaacuuagaggagucagauacuuggccaagaucacacgaccagaaaaugauagagcuaggaaaguagagacaggaaucaaacucagugagucugauuccagauucugcagccuugacuccuuuaccccaugccugguggaucaguaaccuuucagaaaauuuuuguaacaaguucugaaaacauagaugaaauaggaauuuucccuuaaacuaaauggaaaacuaaaaaaguaaucauuagauggagcagauuucugcuaaaugggaagucuugggagggccucauuagaaaaugagggaauggggggccaagcaugguaucaucugcuacccagugagaaaaauaucgacuuacgcugugaacccuuuuauuuuauacauguaccaccugaaugaggaugguauauuuaugagcucucacaucucauugcugggugacaucagggagcucuuuuuugggauagcuguccaucuguucuccuccaggaacuccuggauccgugccacugccacuuggcugcuggcuucaaaagagccugaaucagugaguugcuuacaccagggagaacaaacaggcucuucuccuuaaagugucuguaauuauaugaccauaauuagaaauaaaaccuucuuuauacaauuugagcucacaaggaaagacuuucugcauacacaccauuuuuuccuguguuguuucacaugcugaucaggaaacaggucacuuggccuaaucauccaccauugaauagaguggagagagccagauuccccacaacccccuagguugcugcauguccuugagguagucuccugcccucucuaaacuuuuguagcauuauguaugaugagguuaguauagccauguaggaaauguuaugagaaccuuagugccugcuauuaguuccuuggaaaaaagagauagccuagacauaaguaacucaugaguagagacuaccaguuuuggugcaguuaggguuuugaguuuguuaucauuuuaaacaguaacauuguuugggugguucugugguguucgaagagauguaggucaccguugauuuuugccugauggguuuugaguuugaguagauguugauuaauucaugagccccaacugcaagauagauguucaguauugauuagacacaugccccugguuguaugcuguuaaaaaggagucagcugugaaauacuccuaaagcuaaaucaauaaacuacuaaaguuguuuucccccaauaaguguuuguauuuuaucccuuuaagugagaaaggcuguuaggaauuucugugaucuggccguuaagaaaacuagcuguaucuuuggaacaauaugcucauauguuagccauuccaggugaguauaaauuauucauauauacaucuucgcugaggauaacaauggcuuaauggaggagaaaacacaacaauuuucuuugaaaaauugucuuuauucuggugacauagguagacaacuuugcugagagcacaccuaaguacuaauaaaaauuucaagggauugagacauacauccucacagaguaagaguuuaaaaaugccuacaauuggccgggugcgguggcuuaugccuguaauccuagcacuuugggaggccgaggcgggcagaucgccugaguugaagaguuugagaccagccuggccagcaugaugaaacccugucucuacaaaaaauagaaaaauuagcugggcgugguggcagguaccuauaaucccagcuacuuggcaggcugaggcaggagaaucgcuugaaccugggaggcggagguugcagugagccgagaucgcaccauugcacuccagccugggcaacagggcaagacuccgucuccaaaaaaaaaaaaaaaaaaagccuacaaucccuguuauaaucauggccaguaauugcuaagcaauuagcuguacuauuagaaugagucacuaccaaguuuucugccuuggcaauuuuuuucugaaaacuuuauugaauuuagaacaauuucuggaugacuuuuuuucucucaacauacagacauugaccagucuucauaaaauccacuaaacucagcaccuucuaggcuugucuuucuccuuuccuugccuucucuuccaaauuccuagaaugggccgugugaacuuccugacugaccaugccggcugcauccuuuaaaucuuuacaguggcuucucauuuccuuuugcaucuacucuggcuguucacgccacacaucagaaucgaucaccagcaggcucuggagucucauuucccucaucugcugcgugggucuccagucuucucccuccauucauucauuuucaguuccucuaggcagcaccuucuuccuugagccuuuucucaagagcuaucguuuucuuagacucuguucucuuuuuuuccuucuguuccaaguaacucuugaaaucccgucuucccuaaaagucuuuuugaauuaacuagagaguugcugaugggcucuucuucauucaggucugacaauaauagaccucccauagcuucuuccucuaacauccaccccaauuauacucaccucugcuucccacuuccaaaaugacccuugcucuugacuuauaucuacugacagaaucccuucccuguccugguuacuguuucuaauuuagagauccacacaggggugaagaaagcagguucugagaugaacugccugaguuggauucugagcucugucacuugcagcuauucucuuugggcccauuauugaacaauuucugugcugcacaauuucugugccucagcaagacucgagcguaacacugaccucacaggauuguugaaauaauuuaagcacuuaacacaguacauggcauguaguaaacaugcaauaaacauuuacuguuauuuauuaauuggagagaaugaagagcacacccgauauuauacauauguacauacauuuacauacacacacauauauauauauacacacaucuguguacucauauauagcuacauaauuuggaaaaguauuuagaauuauaucuuuuuuagaaaaugaaaacaauauaucuuuuuuuuucauuuuuuuuuugagacagagucucgcuaugaugcccagaccagagugcaauggcaugcgccaccaugccugacuaauuuguaaaacuuuuuguugagacgagaucuugcuauguuguugcucaggcuggucuugaacuccuggcuucaagcaguccuccugccucagccucccaaacugcugggauuacaggcaugagccacagagccuggccaaaaauacaucuuuuuaaaugcaaaacauaccaaguaaaauugaacaaaauccuggcuggugaggcaagaguuuaaacaagggaggagaagcacuguaccaguuguuucuacacaccuaugaaagaucuggcaugaauggcuuggucuuuguuuaaaagcauagagcgccauguguauguauggacacuugcaugcuuuugagugaugaugauuagggugagagauuuuccuuaggaaaguuucaaaaguagucacuuaucuacucaguuuuaaguaaauagaaaauaauuuuuuuuaaaaggauagugugaggaaguaauuuuguuuuuaaaaggauagugugaagaacacccuaaaaauguuuguagaagaggauuauucagauaaaucuguagugaguuuaugcauaccuccuuuaaaaucuaucuuuaguacagccauuauuuagcaugaagaugauuuguugcuuuuguuuuccaaguuuuguugcuuguaaauaaucuguuaagaaauuuugggccgggugcgguggcucuucccuguaaucccagcacuuugggaggccaaggcaggcgaaucaugaggucaggaguuugagaccagccuggccaacauggugaaacccugucucuaccaaaaauacaaaaaaauuagccgggcaugguggcaggcgccuguaaucccagcuacucgggaggcugaggcaggagaaucacuugaacccaggaggcagagguugcagugagccaagacugcgccacugcacuccagccuggcagacagaguaagacuccaucucaaaaaaaaaaaaaaagaaauuuuguaaaacaugcugaagggaauccugggccaacagguauuuuuaaaaaauaauauacuauucccagguuuauguugauuauuuauauuugaaaauguugauuguagauacugguagauuacuuucaaauuaaucauuuauuccuaauugaccagggaugagugagauguuuauuuagaaaacaaauaauuuuagauaggaaaauugaaucuuuaaaaaauaauggugauuuaauauaucaaugugugguuuuuguguguauguguguaauauuggagcauccaggagugugcgguguguauaugaccuuauuuuucuacuguaucuuagagguugccacuuccauggguauaaaacuuaauuggauuucucgauuuuuauuuuguuuaugcacuuuuacaacuuaugucauuuuagguuguuuauuaaugccaguuuuguauaauaaaauuauuagagaaguuaugaaggaggauggcaugagaaggguggccagaguuucacuguuucauguuuguaacuuucauuccuuuugaaguguacauuuauuccuagugauagaaauugauguuuucuuuggcaagcauuagaagcaagucuaugugaaauuauguaaugucugaaaaguuauauucaugauuaauuggccuauccaagaaugguauuuguguguguggaauaaggcgaucaugcuuuuuauuuggcagugaguuaaagugccccugcucagaucggguuacuccacagggcuuuuugacugagaauuguauguuuagcuuaaucucuaaaaagcguaaaauguagcuucggagccaaauaugcuggaauucauauuguaaccaaaguuaaucuuaggauaacuuuaaaagcaagcuguuccacucucacaccuuaguuaacaaauaaagccaagagguuuaaaacaacaucaucaucauaauagucucugaaagcacagccagccuucauuacccaaagcuagacugucugcacuguauugucaaauauuaauuuaaaaucuucuugaccuugaccuaaacugauaaguuauaaugaucuauuuauuuauccaagcuggacuuuacaggaaugagaaaaagaaggucuuuaaauaauugccuccuccugugugucagcuugagaaauuaugaccuccauuacuaauauuacagugauggugaacuugauagauaacuagagacaggguaaugcaaugguucuaaagccugacuacccugggaaaguuaacuucaguuucucauguguaaauggagauaauguuaccucucuucuugcauuuuaaucauuaacuaaaugcuuaccagaauaucuguucauaguaagugcucuuaaauguuugcuuuugcucuuaaauuauugcugucgcugcuucugcuauuacugcuaugauaacuacuacuaacuacugcaauugcugucaccagcaaccacuacaauuacuauuauuccaguuccuccuccagggcuuucacuauaggguuuaacucuuuggugaauccucauaucgaaaugguaaaacauaccccaaacauaccccagaguugaauaugaguuguuuuggcaagaucauagcucacuguaacuucaaacuccugggcucaagccauccucccuccucagccucccagagugcuggaauuauagacaugagccgccucaccuggcuguuucguuguuguuguugucguuguuguuuuuaaaugaccuguauucuuaccauucaaaaauguggaccgcaggucagcaacaucaaucuaaccugggagcuuguuugaaaugcaggauuuuggccccauccuagaaccacuguaucagaaucugcauuuuaacaggacguuaaaagauguucuguuugcauauuaaaguuuaagaagcacugaucuacaccauccuccccaccccccagcuaucccccaaaucaucuuaaugauuuagggauggcucccuacauagacuaccagcaguaucaugugaaccaggcccucaaaguagauagggcagguaauuggaaagaagagaagaugaaguggaaaaagagaagaaagaagggagagaggaagaaaaaccaugccugacaauacugauauuuuaccuguauagaugggucuaugcuuacugauuauucuuugagucuuuagauuauucuuuguugugacacugaauauggaaaggaauacugaaauuuuaugggcugguaaaaaauuuccaugcccuuguaauuuccaaugaucugucaaacauacauggagaguuuccuguuaacucauggucucagauaaauuaugcacccuuuauuuucucuuuuuuugugagacagagucucacucugucacacaggcuggagugcaauggcacaaucucggcucacugcaaccucugccuccuggguucaagcaauucucgugccucagccuccugaguagcugagauuacaggugcccgccucuauaccuggcuaauuuuuguaauuuuaguagagacaggguuucaccauguuggccaggcuggucucgaacuccugaccucaggugaucugcucaccucgaccucccagaguguugggauuacaggugugagcugccgugcccagccccuuuauuuucuuaacacacacacacacacacacacacacaccaguccccuuguauucaugcuuuaguuaucuuuuuagugugaagauggugugcuuccuaugcugauccugcaagaucacuggauaggagagcagaguuugguuuacuacucucugccuguuugguagugcuucuacugcuguuugaguugauucuuccaauguaaaggcugugaggauguaugggaacacuaaucuuugauauuaacuaugaauuaugggugcuuguggagguacagcuuuauuuguauuaucacauacuaggggcuaaggaaaauuaccccuuuuugacuuaaaauaugaccuuggagucuguuuuuuuguuguuguuguuuauuuguuuuuugagauggagucucuguugcccaggcuggagugcaguggcacaaucuuggcucacugcaaccucugccuccuggguuccaaugauucuucugccucugccucccaaguagcugggacuauaggugugcgccaccacgaccggcuaauuuuuguauuuuuaguagagacggggucucaccauauuggccaggcuggucucaaacuucugaccuugugauucgcccgccucggccucccaaagugcugggauuacaggcgugagccacugugcccagcuggagucuauuuuuuaaaguugauuugagaaacaaguuuaugguaugauuuuaaacaacuaaauuggcaaagggaagaaauuugauaaaauauguuggaagugugcagugauacaaccugucgcaauuuaaaaugccuguuuccguuacccagcaauuucacuuguaagaguuuauccuauagauguauuugcacauggaaguguacauguguacauuuuuauguagaaacaaaugaguaguaauaacaucaauauuaauuaggaugagacugggacuggguugagaaguugagacugcugcaacuucuuuuuuuaagguguuauuugugugugugugucggggcuauuaaugaaagugucuuaaugaaucugguuacaauaacuaccuuuggagacaggauuugaagguguuagaccuucaaaugugagggacacuuacuuucuauuaaaaugucuuuguacuguguggaauuuuuuaagaaaaccauguguauguauacauuaaaaucaacaaaauagugcucacauugaggaguuuaaagcuauauguacucguaauuacacuuacauauuuuuccccuuuuuuuuuuuuuuugagacagagucucgcucuguugcccaggcuggaguacaguggugccaucucagcucacugcaaccuccaccuccuggguucaagugauucgccugccucagccuccugaguagcugggacuacaggcacgugccaccaugcugggcuaauuuuuguauuuuuaguagagaugggguuucaccauguugguccgccuggucuugaacucuugaccucgugauucgcccgccucagccucccagaguguugggauuacaggcgugagucaccgugcccggccuuuguuuuuuuuuuuuuucuuucuuuaaagagaaguucuugcucugucgcccaggcuggagugcaguuaugcagucagcucauuguaacuucaaaauucugggcuucaagcaauccucccaccucagucuauccauagcuaggacuacaggugugcaccacugcacccagccuuucccccauuuuuaaaacauguuuauguaccuaagcucauuuaugccuuugagucccuaaauuaggugguaggcaacaaauucuuggucgccucacugcucuguauuuucucuccaacuccuuagacucuucuuagcauaaacuguccaguguucugaugauucagagcugugauuccaaaguugggguaccaucagaauucuugaagauugguuacaaauuaagauuccuaaguuaaucccagaccuauugagucaaagucugugggugagacuuaggcaugugcauuuuuuuuagaagauccauggguaauucaucagaaucagguuaagauucuucgcaccugguuaaaaagcacugucuggagagcaauucuugguaggaaucuucuucuacuaaaaugccagcuguuaucugugcacccgcacccccagaucccaggagugaugugcauguggcauaucaccaggcugaaugagcagauccucuacauccaaggaaaagggaauguuauucugaauagucacaugguucucucuauugaauuagaauaauaaugguaaugacagagaugauaccaaauaagaugucuauguuagaaccaacauuuucugccaauaacauuacaaguaaauaggagaaaucaagaguugguccuuugaaacaucaauaaaauuuagaaaucuguagcuagacuaaugaaaaagaaaaagacaaauuaucaguaacaggaaugggagaggagauagcauugaagacauaauaaggauaauaaaggaauauuaugagcaaguuuaugcuaaaaaauuggguaacugagaugaaaucagaauuuguggaaagcccaaauuaccaccaacacacaaacacacacacaugcaugcacacaugcacaaucugaauaggucuauagcgagcaaagaaauucgguucauaauuuaaaacuuagcuacaaagaaaacuccagacucagacaacugacaacauaauagugaugaaaucuaucaaaucuuuaacaauacaaauguuaaauucuuucagaaaauagaagaggagggaacacaucccauuucacuuuaugagauuggcuuugcuuucauacuaaaacuagccaaaaacuggccgggugccacggcuguaaucccagcacuuugggaggccgaggcgggcagaucacuugaggucaggaguucaagaguucaagaccagccuggccaacauggcgaaaccccaucucuacuaaaaauacaaaaauuagccaggcauggugucaggugccuguaaucccagcuacucaggaggcugaggcaagagaaucacuugaaccugggaggcggagguugcagugagcugagaccaugccagugcacucuggccucggcgacagagugagauuuugucucaagaaauaaaauaaaaacgaaacaaagacuuugcaagaaaaggaaacuauggaacauuccucaugaacauaaacacagauuuuuuuaauuagcaaauuaauccagaaauauauaaaaaggauaauacauuuugaguuuuaccuagaaaaggguuuauccagaaauacaguugauuuaauauugugacaugaagcaaauauaugaucaucuuauuaagauaaggaaaaacaaucaacaaagcuaaaaauccauuaaugauauaaacucuuagcaaacuaggaauagaagaaacuuuugucaaccugauaaaagacauuuauaaaaagccauaucuggcugggcaugguggcucauacuuguaaucccagcacuuugggaggcggaggcaagcagaucaccugaggucaggaguucgagaccagccugaccaaaauggagaaacccuaucgcuacuaaaaguacaaaauuagcugggcaugguggcacaagccuguaaucccagcuacucgggaggccgauucaggagaaucgcuugaacccgggagguggagguugcagugagccgagaucgugccauugcacuccagccuaggcaacaagagcgaaacuccaucgcaaaaaaaaaaaaaaaaaaaaaaaaaaagccauagcuaaugucauuauuaacagugaaagacuaaauacuuucuuccuaaggucagaaauaagacaagaauaucccccuuucaucauuucuauucagcauuguacuggaguuucuagccaguguaacaagguaugaaaaagaaaugaaaguuugggaggaagaauaauaaugucucuuacaguauuaaguauuaaugauaauacuaauacuaugucuuacagcaugcagauugagaggaagaacuaauagugucucuaguuuuagaccauauggucaucuauaucaaaaauccuaaggaaucuuuaagacagcugcuaaaacuagagaggauuuagcaggguccuaggauacaaaaugauuauuuuuaaaguugcauuucuauaugguagcaaugaagauucagaaccugaaauaacauuuacaauagcaucaaauacuaugaaaauauauacagauaaaguuagacaaaauauaggcaaagccuguaccccaaaaacuguaaagcauuauugaaagaaauuaaggcagcccuaaguaaauggagaagugucccauguucauagaagacugauaauguuacaauguuaguacuucccaaacugauuuauagagucaaaacaagcccaguaaagaucccaaaaagcuuuuuccuaaaaauugggacguugaugaacaaauuugugacaaaggauuugaaauaguuuaaaaauuuuuugaaaaagaacaacaaaguugaaggacuaguucagugggaagaagaaaaucucaacaaaugauccuggaauaacugguuauacauaugggaaaaaaaaugaaccuugacccuuaucucaccucauacacaaaaauauacuaaaaaugguguauagacauauaaaaaacuaaaacuauaaaacuagaagaaaauguaggauaaaaccauugcaacuuugggauagauaaaaauuucuuagauugaacacaaaaaguagaaaaaucgauaaauggcacuuuaucaaaauuagaaacugaaguuuuuccaaaagaaauugguaggaaaauggaaaggcaagccacaaacugggagaaaauauucacaacacuuauaucuuauguguuauauacauacauacaaaggaccuguauccaguauauguaaggaacucuuacaacugaauaagacaaacaacccaauuaaacaauggguguuacagguuguguuccucaggaagcagcuacggauaaagcucagguaugggauauuuaguaagggaugcccuugguauuaaggcuuuugagaaggagggcaacaaagcagcacuggauggagggagauguugagcagugaugcggcccaggaacagccuuggaugacuucacagauugcucugaagcuggacuggaccuucggaauuucccugaguugggcccugauggugccuuuuuauuucugcaucacucaguaaugugggccuguaucacuggauauggcccaugcuaggaaggauauaucuuggccagugugauucucugcagcuugaggcaaucccuggagggagugauagcugaauacugauuucccauagcauucuuagcugagacaauagguuuuucacugaaagaggaucugacaauauauugcagugaccauuguaaugggcaaaagauucuaacagaaacuguacaaaagaagauauaugaauggccauuaagcacaugaacaacgucauuagucaucaaggauaugcaaauuaggccgggcgcgguggcucacgccuguaauccagcacuuugggaggucaaggcggguggaucacgaggucaagagaucgagaccauccuggcuaaaacggugaaaccccgucucuacuaaauauacaaaaaauuagccgggcguaguggcaggcgccuguguucccagcuacucgggaagcugaggcaggagaauggcgugagcccagggggcggagcuugcagugagccgagaucgcgccacugcacuccagcccgggcgacagagcgagacuccgucucaaaaaaaaaaaaaaaaaaaaaaaaaggauaugcauauuaaaaucacaaugagacacuuccauacacucgaauggccaaaauuaaaaacacugauaauaccauaccaagugcaacuggaaguguaaaauggcacaagcaccuuggaaaacacuuugccuguuucuuauaaaauaaaccuacacuuaaccguaugccuagcaguuccacuccuagguauuuacccaagauaaaugaaaacauguacacaaaaaagacuugcaugaauguucauaugaaguuuauucauagagccccaaacuguaaagaacucagaugucugucaacagguaaauggauaaacaaauuuagauauauucauaaaaugaggcacugaguaacauuaaacggaauaaucuacucacacaugcaacaacauggaugaaucucaaaaauaugucaaguguaagguuaagucauaaaagaguacggauuguaugauuucauauaugaaauuuuauaacaggcgaaacuaaucugucgugacagaaagcagaugagugauugccugggucugaaaagggaagagaaugcaggaaggaacauuuuggggugaugagagggauuuaugucuuaauuguuaggauuauuacauggauguaucauuugcccaaacuuuuguuuuuuucuuuuuuuugagacggagucucacucugucauccaggcuggagugcaguggugcaucuuggcucacugcaaccuccgccuccuggguucgggagauucuucugccucaccugagugagggauuacagccaccacacccagcuaauuuuuguauuuuuaauagagacggggucucaccauguuuaucaggcuggucuccaacuccugagcucaagugauccgcccgccucagccucccaaagugcugggauuacaggcaugagccacugugcccgccggccugcccaaacuuuaaaagguugcguguuuuugcaaauaaauuacaccucaauguaauuauacuuaaguaaaggugaguuguuuuuuaaaguaaaacuuuucauaauggagauuauuuucaugaaggauauugacugcacuuuuaauuuucuuuucuuauaaugucuucaucugauuuugguaucagaauuaugcuggcuucauaaaaccaauugagaaauauuuccuccuccucuauuuucugaaauagaucguguaaaauuggcauuguguucuuaaaucuuugaaauaauucaccgcuaaagucaucugggccugguaguucuucuagggagguuuuaaauaaugaaucauuuucuguaguagauuuaggguuauucagauuuucuguuucuucuuggguuaguuuugauaauuuugucuaucagugaaguccauuucuuaucucuguugucuaauuuauuggcauaaaguuguuaauaauauuucccauuauuuuaccgucuuaauggucuguaguuauaucucuacuuuacuuccugauauuggugauuugcauuuucuuuuucuuaaucagucuaguuagggguuucuaaugaaguuaaacauauacccaucuaaugacccagguguuccacuccuagguauuuaaucaagagaaaugaaagcacauauucuaaaaaauaauguucauagugauuuuuaaaauuuuagcccugaacuuaaaacaaaugcuaaucaauuauagagagaacaaauaaaauuuuguauauuuacaguaaaauacuacucagugauaaaaauuaaugaaauacugacagauacaacaauguaugugaaucucaaaaauauuguggagaguggaagaagcccuacauaaaaaaaucauagugucugaguccacuuaaaugaaguuccagaacagacuuaaucaaaucguggugguagaaaucagauuugugauugcuuaggaagggaaguggaaagguaugagcagggaacuagcaggagagaacuuucuggguuauggaguggucuguauuuugauagggguguggguuaccaguguaugcauuuauuuaaagcucaucaaacuguacauuucauuguauguaaaauauggcucaacuuaguuguacaacaacgggaauguagucagugccacuuaacuguaugcuuaaagaugguuaaaaugguaaauuuuauguuauuuauauuuugccacaauugaaaaaaaaacuguuuguuuguuauauuugguuuuuuuugagacgagucuuacugugucgcccaggcuggaguucaguggcacgaucuuggcucacuacaaccuccacccccugaguucaagcaguucugccucagccucccuaguagcugggauuacagccgugugcuaccacgcccagcuaauuuuuguauuuuuaauagagaugggguuuugccauguuggccaggcuggucucgaacucaagugaucugcccgccuuggccucccaaaaaaguacuggaauuauagggaugagccaccgcucccggcugaaaaaacaaaaacaaacaaacuaaaaacaacaacuguaaaugggaagaugugaagguucuaaaugugcaaacauuuaaaauguguauuuccccccauaaccgugugcuguucuauuauuauuuauuuaccauuuauaugcuaaaguaagaauguaauuuagaaacugauaagaaaguaccaaguaugagaaauguuacauucguauauucaacagauauuaaucaaacaucuacuguguguauaauucuuuauuauguauaguaauuaagauaaaccaaacaaggaucuuccaagagcucaccauguacuaagcuauuuaagauaugcaaaauuuuaccaaugucaccaaaauaaugggcuuuuucuuccuucuuccuacaguuuacccuuaguaggcuuucuacuguuuacccuuaguaggcuuucuacuguuuacccuaguaaagaucuaggaaauuaaguuuaaaaucuucacccucaggggaaggccuugucaugccugguauuucuucuccuggcuuugcugcagcuuguauuaguaugcagggaggggcuuugguuuugugcaguuccaacacaccuuacagugaagcuguggugccagggagcagagucuguccaagauaaugcucauguaagugcccaggguggugccuggccuaaagcauaaggagauuuagaaacucugccacaaagggggucuaagaaugagucuucugcuacacagaauuaacuccaaaaaacaaggucagagcucuugaccuucagguaguaauuauccacauaauccucuuuuccuacugcuuaugaauacugcaauugaaagggucagagguagucugaaagcagggaaaacaaaagaagucaggagcauggaaauucugcacaccagaugguuugugugcccagagggcaauugagaauuaaguguaguaauggaauuacacuacuuuuauugguucuaugaggacaagcacuuggaguaccaauuauauucugcguggcauacuuugggugcugaguaaauauuaguaacuuauugaauagcacauaacaucucaacugccauguaaaucucugugagugcagggcauugucagaggugguggugauaauauuauugagaaagugacuagugucugacuuuucuagcuuguuaauaaccacuuaccuaugucccaucuccucauucuacuuuccuguuuggaucuaauuacauucaguugaguugccugugucuccugagcaguuagagcagguuucucuuggcaggauuaauaguaagaaugucuacauucaguucacagugugccuaggcaguguuuuguagcaccauaucuaaauuaaaaugaaugccuuggggcaacugcagaagcuccuagcugccucuagcugauacacagcucuacuaaguaucagcucuugcuuguguuucuuguaaauuguuguuaugccuauccuuuaaucuaugcauuacuauuuugcuucuagccucacuuggaaaacauucccaagucauagagaugaauuacaauacagaauuucuaccaauggcaguacuugcauuguuuucagaaucuagugcccagguuuuccuacuguuuuucuugccgucuuuaagacagaauuucuauuuacauccuugucgauuuuuguaucccuaaauaaauuauagucuugaagucuggaccugcuccagugaagguuccuacagcacugaaguugggaaucacuagagaggcacuuuguuaauuuucuuuuuaaaaaggaaugacuaaagguuugugacacuugaauguaaguugauuuuaaaauuccauuuuucuaaauccagaguaggguuuauauugcuaauaucaugauaugcuugccaaagagaauaguuuguaaauccuaaacagacuuccuguaaccauguguugaauuuccagcuguguugaaucagacuuuggucccucuucagaagauaaauccaauaccugcaguuucuaauggcagaaguggaggagagaagucccuguccagauaagaaacugaaggcccuggggcaagcaauuguuucaugaauguccuuuccccagccccgcgccccaccccuaagaaauuuguaggcuucaucuaccaggaaaacaaaacaaaacaaaacaaaaaaaacaagaaaacacacaccacacaaaugagaugcuauuguuaaaugcaguauguaggauuagauuuguuuccuuccaauagaaucacuuuccuuaaucagcacuuuuauaaauggcacaccugccugauuagaacaaguucuagacuacaggauacagugugagcauuucaauuaaguccacacaauuaaaaacuguugugguugauguucuuagaaagacuuuccuucucucgucuuacuccguuauggcuaagcuuuauuauuuuauacuucugagucagccuuugaucaugggacuuucccacuguguggucauuuauaucuuuuuuuguuucuaaaugauuucuuuaaaugaaaaaagaagcgauguauuuuagggauauauguagggaugcuuuugaauauuuuuauuuuauuagauuuuccugcuuccuuacugucacuuaaaauauggagaacccucauccugugacaaggagguaaaaauacagcagucacauucaagaucuccauacauuaacaauaauaaauccuuuugcccugaguaauacagauacuuaauccacagagcucggggggaugauauagugcucccucacagaaccaauuacccacagagaaguauaaugagcaggggaggugauacaauaaaaaucuauauagggagaguagaauuaugaugacaguguugccuguguaaagucuuauaguaaguauaucuccaauuaucuuuuagaaaaaaauuguuuggugucuacuuauguccaauucaugaugaaauugcaagaauagccauggaauaaaacaaaaggguacaggaguauagagaaaauggcgauagacuugucguaaacagaguucuguucuaccccgaaggaugugaaguagacccagggcugcucugagggagugcugggcaugaaccucccugcagaggaauggcuguccugaccacaguuacuguuacugcagaugcagacgggaacaaaauaacgcucuggaaaaaaaauaagaugauuuagaucaucacaggaaaucccuacuuuuagaguuaguguguuuccgaagaccauaucugaagcagauugcugugagggaaaauccugagugugcaugaucucuauccuaauuaggagcaaacuugaucuguuccgacagacaucaguugcauaaguggguuaaguggcaagaaauaaagucuaguucuuuauuagguaagugucaaauagaguucugaaguagcaaacaaaaaaaccuuaguaacaacaggaagcaguuuucagccuuuguugcagugccaucaguugugaaguuuguggacaauaauucauuaccaguaauaaggcaccaaaauuuguaaaauauuuuucuuuuaaaaauagaccauaacaggccagacaugguagcucauuccuguaauuccagcaccagccgaggcagguggaucacuugagcccaggcguucgagaucagccugggcaacauggugaaaccucaucucuaccaaaaauaaaaaaaaaauuagccagucucaaaagcuugucucaaaauaaauugaauagauugaaaugaaaauuaaauuuaaaaagacuaaaccgauacauagucuuguuauaauuuuguuaccauugcaguguauucauuuuacuuggcuuccuucuuuuucuuuuuuuuuuuuuaauuuuuaauuuuuguuucuuuugagacagaaucuugcucuguugcccaggcuggagugcaguggcaugaucuuggcuugcugcaaccucccucucccggguucaagugauucuacugccucagccuccagaguagcugggacuacaggugcgcaccaccaugcccagcucauuuuuguauuuuuuaaguagagacgggguuucaccauguuggccaggcuggucuagaacucuuggccucaaaugaucugccugccuuguccucccaaagugcugggauuauaggugugagccaccacgcccagcgacccuuuuuuuuuuucuuuuaauaaccuuguauucuuuguagagauggaaagaaauagcgggacuggggagggggagugccaccacaacuaggugcuggcaacuggucaugcuccaaaucugucuuauauagugacuauuacaaccuauagugacuauuacuaagcaagcccuaauagugaauacugggcagauaauuuuccucccaacugauuuuaaaauuuuggucccgucuugucaguuuaugcccagggaaguauauagcaaacauaaaugucguuuauuaugugugucagaguaaaaaagguuucagauuagacaaugguggaacccaccuugccauugaugguuucuuuacaugucguguuuguggucauugaggauauacaugaaaauaaaagacaguugacaauauuuugggaccugugaauuggagaaaccaguucccaacuucagagcaguuuauucauuuguuuauucauuuauucaauagauacacuuuugaagcuggggcuacagcaaugaacagucucugccaucaugauggaacuuaugguuuaguaagggaaacagacaaauaaaugauaugcaauauuucagauaauggucagugcaaugaagaaaaauaaagccaagguauggagccgagcacaguggcucacaucuguaaucccagcacuuugggaggccgagguggguggauugcuugagcuuaggaguucgagauggccugggaaauguugcgagacccccaucucuaugaaaaguuaaaaaauuagcugggcgugguagugcgccaguauagucccagcuacuugggaggcugaggcgggaggaucacuugagccccuggagaucgagcuggagugagcuuugaucacgcccccgcucuccauccugggugacaaagugaguggugucuccuaaaaaaaaaagguauggagauucuggaguggugccaguggaguacaguuucagagagggauggucagggacagccuuucugcugagguauaucaagcuccaagugaaaggagggacaaaccauggggaaagccagagagugaagggcuuggcaucagcaggcuggaaguuccuccaucucacuaguuaggugaccuuagagagguggccuuguagcauggcauucguauuugggacuugggaaaagcauugugguaaacagcaaagcauuaccuaaacuucacauuucaguacaguguaacaagggagagcaaacuaaagagacacagaagagucuuuuuuuuuuuuuaagauggaguuucauucuuguugcccaggcuggaguauaauggcgcggucuuggcucacugcaaccuccgccucccggguucaagugauucuucugccucagccuccugaguagcugggauuacaggcaccaugccuggcuaauuuuuuuuuuuuuuuuuuuuuuuuuguauuuuuaguagagccgagguuucaccauguuggccaggcuggucucgaacuccugaccucaggugaucugcccaccucggccucccaaaguguggggauuacaagcguaagccaccgugcccagccaguauucaucuuugcuugcuuuuguaguauuauucauuuaagauuuuguauuuguuuaugcuuuucuuucuccaacaucuuuuucuuuucauuuaguuugaguuuuccuuuuauuaaauaguugcaggccuuuuggcucucaguggaggcauuuucuacucuguuccuguacucccugauuaauucauucuuuaaaaaaauccucuaagauuaauauucaucaugggggcucagaaaaugaaagucuuuuauagaguaauucuaaacuccagaauaauucauuuguucugaugcuuauuaaggacuugaaguuguuuguuugcucuuucuguuuuuauagccaaauaaaauuuugcaauacucauaauaauauuugaguagaacuuuguaguuuacaaaauacuuuccacacucacucacauuugaacuuuaacaacccgagagcuagacaacacagacacuauugugcacuuuuacagaugaggaaaccugaggcuuagagagcagcguuuaaaucugggucuuucuguggugcaaauaugaacauaugaaugaaaaaugcugaacuguuuuguuuuuaacacuugggauuacuaaaaugguauguuuuuuuaagcagucucaugaaagauguagaugacuuaagaaguauggaucuauaggggauuauggagagagaggguuauaugucccugaucauugugaacagauaccauggaaauggcuuacaaaaccccuuuuugugucauugucaggaggaggauaugaaucuaaauacuccuggcucugauuuugugcaggaauuuucauuuauuuuuguccaguuacuuagacuaaggcuaacaaauauauaguuuccuucugggcagaaacagaaguaaucacaaaguaaaauaaagcuucuuaaaaaugcauuguccuagauuuaaagaauguuuccuuagaaaaugcuaucuuauuuugagaucaaaggucuugaagacucuuaaaauuucuaaaguauuauagaaucaauaaaaauuagaacugggaaaguccuuagagauuaacucuagaaccguuaaaauauuugaucuggaaggaaccuuugaagagucccagauccccaaauugugugaggugaaauuguauacuguuguguccucagcauccugauggggcccauccagucucuccauggccucuugauuauaggggccucuuauugccucaagaauaauccauuccacaaauacuguaugauuucacuuauaugcgauagcuagaauaaucaaaugcauagagacagaaaguagaaugguguuuuccugggcugggggaagagaauaugggaaauuauuguuuaauggauacagaguuucaguuuugcaaguugaaaagaguucuggagauaaauggugguaaugguugcacaguauugugaacuuacuuaaugccauuugaaccacaauuaaaaaaauaaaaacuaagcaaaugaagcggaaaaaaaaaagaauccauuccauugcuggacagcuguuggaaaggcucucuaugaugacuccuauugguguaaguuuuguacucuguaaccacaagaacgaaucuaacccuuucaccuggaugaagacacccagcgaguccaccccagucuuuuaaagcuaaguagccuuuguuccuucacuaggucauaauauuuuguuuuguuuugcuuauacuuuguuugaaucaugaucaagauaugguucacacauugugauuggcugauacgcccuuuaaaugucuauuaaucuagcgauucuucuguaucuauuuuuugcucgccuauucacuuggucuccuguuuaauuuguugaagaaacugggccauuuuuuccguaguguuuugguacuagcaucuccccgcucuauagauuaacauauuccucuguccucuguauuuccucugagucgguaaugggcuugagagaccuugauuuauaaauguuuguaguccaacuacugucauccuuuggcaucugugggggauuggguacaggaccccucccucaccccucuaccaccacugauaccaaauuccauggaugcucaagucccuuauguaaaauggugcaguauuuguguauaaccuauguacauucucccauauacuuuaaaucauuucuagauuacuuacaauaacuaauacaauauaaaugcuaugugaaucauucuauugucuaggggauaaugagaagaaaaaaacauauauguucaguacagacaaaaccauccuuuuucuuuucaaauauuuugcauucaugguugguugaauccacggauauuaaucccgcagauauagagggccuacugaaaauaaugauucaguuuagaucuuuuuugagaguaaagggacacaauuuuauccccccccccccaacuuuuuguuuggaaaaguuguaaagaugaggaaaaauuauagaaugaacacccauaugccuuuuacauagaauaauguaaugaacaccuauaugccuuuuacauagacuccccaacuguuaacauugugucauguuuacucucucucucugugcacauuaacauacgaacacccuuagguuuguuuuuuucugaaucauuggagaguaaguuacucuccaaucauaacacuuuacuccuaaauuucaacauaaagacaucauaacacuuuacuccuauauuucaacauauaucugcuaaaaacgaagauauucuccuacauaaucagaauuauguucacucaagaaauuuauauuauaucuaguuuauauauugccuaauucugaguauacauuacccuaauuaucccaauaauauccuucauagcuguggauauuuuguaaaaguccagaauccaaccacggaucacagauuauauuuauauuuaguuuucaugccuguuuagucaccuuaauugguccugcccccugccucccuucuuuugagaaacagggucuugcucugccacccaggcuggagugcaguggugcaaucacgacucauugcagccucaacuuccucagcucaagccguccucccaccucaacuccccaaguagcugggaccacaggcaugcgccaccaugccugccuaauuuuuuuauuuuguagagcuggggucuccccguguugcccagguugguccugcccuuuuuuggguauuauaugacauuuuuucaagaguacagaaaaguuguuacagagaauaucccccaauuuggauuugccugauuguuucuuuaugauuggacucaggauaaauguuucuggcaagaauacuauauagguggugcucaguccuuuaggauaggcacuuggaaggcacaugaugucacuuugucccauacuuguuuauaaaguguccaccagauuucuccauuguaaagguaccuuuuccccaugguaauuaauacauaauccaugguguuuagugguuaccuuuuuaauaguuuuaaaaaccauaugccauuggucaugggagaaauuguauggaauagauuaugaacacauuaguaaagaguuauugccacugauggaaagauaauuuuagacauuuguuauucugaggaauggaggggagguagcaaaguaagaaaugggcucucaugaagacagacuuguguuugaguacagcucuacaccugaaccuaugcaaccuuaaaaauguuacuuaacuucuuagaugcucaauuucuuuucuaaaauagagauaauacucauaccgggcaagauuguuaagaugauuaaaugagauagugcaggagcagccuguagccuagcagcugccccagggccauugcaugggagacaaggagauccuuccagagcacaguuugcuggauguauucaucuuuagacuuauucaugagccuuccuucuugggauuaguuuaaaauauucaggcauguuguugggaaaaugugaucaacagguuaggugccuuugugaaauuucaaagaaaggaauuaagaauuuggagauuuuugguaucauuuucagacaucuuaaauauaacuuaccuguaguagauuuguauagaaucaaauugccauuuacucagaccuuuuucugacuggaauccauuuuacuuuauuauaagggauuuuuuuaaacacaguuuauauguagucugauugagaacagugaaucauaauaauccugugacccauuuacaugcguuacuguaaaaguuucauuucguacaagugacaauuuuuaaaaguuaauuagacuuggcuacacggagguuagcaaaaagugcuuugaauuaucaauaauucagcagggcagacauuucuguauaaugcagugguuuuauagaguauugugagauaguuauccuuaaaauaaaugguugugagcauacaucagcauggcgggguucgcuugaauguagcgugaagugauaacaucuaugcuuucuauuauuggacagagcgcgggacaucagucuuucuggccaugaacuacuagcaaccuuuguccuuuguguuaccuuuaguuaaaaacgaaaaaugagcaugaaugcuggcugauggccaugucucucucacagcuaaaaauucaucugggaaagaaaaauggguuuggagauuuggauuuguuucauugcaugaaugauaugugacauucuguaaauuauuuaucagugcaaggaugacagcaguagcuugaacauuguuauaucaaaugaaagcaggaaucccguuaguaagaggaccggguuuuagcucaaaucuaucaggggaauguugucacuuuaaagccagauuguucuuuuaauugcuauuuaaaggaacaaaaguguucccaagguacugcaguugagcaguugcaaguaauaacuauggauccauaauuaugcagugcugauuaucuggcauuuaaaaaacuguggcuacagucagugaccaauuuguuauagcuugucucuuuucguuuuucuaguacagaauguuuuauaaucuacuuuuuaacuggggcuacagaaauacauuugcauagcuaccucagaacguaaagccugugcauauuauaagaacaaauuaagcugaaaguaaagggaagauaaugaaugcccuuguaagaugagauuugcagucauauuaaacaauuugugaauguuuggucaugagaugguuuuuuguuuuugaugacauguugucccaaggaacuaaggcauuuguuggaaucauuauaaccauugauuuuuuuuguucuuaacuagcauauauuuccuucauguauucaguuagcagauauauuuugagugccuacuaugcaccaggaaaugcauuaggcauuugggcuagaguggcugaacaaaugaaguuuauucuaugcugauguauauuuagagaguuagaccuagcaaaaucuuguuuuuaauuuacauuuaaaaacauuugugauuauguuggguguucuugcucugaauuuuugauucaugagauucaaauauagagacaucauaguaacauucagauggcuagcagacaacaugugugaaggcuuggaauaugcgguaaaauuacaguuuucguaguuuuggcuguugaaaauaaugugaccagaucuguaggcacugucagcuauuccuauggaugggaauacuagcauugcugauaguaguaaauaacaauggaaauacuaaaauguauguagauuuauacauuguuaaaagcaauuuucauacgagaguuaaagggugcuaggggacuagacaaauguuuuguuguuucuuauauaaagugggaaugucaggccgggcucgguggcucacgccuguaaucccagcacuuugggaggcugaggcgggcggaucaugaggucagaagaucgagaccauccugaccaacauggugaaaccccaucucuacuaaaaauauaaaaauuagccggguuugguggcacgcgccuguagucccagcuacucaggaggccgaggcaagagaaucacuugaaccugggaggcagagguugcagugagccaagaucacaccauugcacuccaggcuggcgacagagugagacucugucuauaaauaaauaaauaaauaaauaaauaaauaaauaaggugagaaugucagagauucaagguuuaucuuuuuuguuugguauggugugguuuacuuuugaagaccuucguggcacaaaagccuuguuaauaaugaccuuuucaagugucccacagaauccugcucauucuauuauucugucaccuaaaaacauauagauauuuuaugucaaauauuuaguaggugaauaauagcaaucugcgcugcaauauuuaauaaagucuuaacagucuauacaugauauucauagacuauaaugcugaacgaauaauuuauuuuaagcauauagauaauagaaacaauugagauguccaaugaauccuuaauuauguucauuucaggcaagcuauauaauauauaaagguauuagauuucacugguuuaauaaaaaugacuucugagucauacauuauacugaaauguauucagguaguacuuuagugucaaauaauuuaagagauuuaucccagcacuuugggaggcugaggcagguggauuaugaggucaggagaucgagaccauccuggccaacauggugaaaccccaucucuacuaaaauacaaaaaauuagccaggcauaguggcgcgcaucuguaaucccagauacucgggaggcugaggcaggggaaucgcuugaacccgggagguggagguugcaaugagccgagauugugccacugcacuacaaccuggcgacagagcgagacuucgucucaaaaauaauauaagaguuuuuuuacuagcagaaaguguuuauuuaaauacguuauuuagcaguuuuucuuuguuaaagaaagaagaagcuuuaagugaaaaauguaaaaagcuuuugauuuuaauguuuuuacuuuugaaauggaaaagugacaguauuuuuuauuuuaauuuugucauagccccgugcugaucccauuccaauauguagcuucuguuuggggacuaaagaaucaaaucgugaaaagaaaccagaagaacuccucucuugugcagauuguggcaguagugguaaguuguguuuuuccuauguguuguacaaugacuucccauuaucauagcuucaugcuauuugucucucuauuaaaacuguauuguuauuuaaggcaguuauaugguaauagcauaggcuuuaaauuuuaaaagaaaaaguaaggaauagagaaaaaagcgugaguauguuaguacugacauauggauauuauauaugcuuauauaauacuauacauauuuaugauuaagcuuuuauuuuauaccagcauugguaauucaguguggagaugucugcauuauagguaaauuccauguagagaauucuaagcuuucaagcugaguacaaccccaucuuuaaaaauuaauagcaaaaaauaaguaaaaauuaagcuuuuucuguuaaucuucaaauuuuuuccccagacuacccaaacuuuuuucuccaaagucuuguuuuaaaauucaugacuauuucucuaguuauaguaaucucuaaaaaaaaaaaacaaaaacaaaaaucgacagaacaccauagcuaauucuuguuugggaagucuugagauauacuggcuaggagcaaacucaagagccagccauagcccaguuccucugccuugaguuaguuacuugaucauucugagccccuguuuccucauuagaaaauuagagauaauggcagcaccauccucuuggguuuuaugggaaugaaaugugagggcacaaguaaacacccuggcacaaggucugcagaacuaugguaaguguacuacaaaugucagcaguguuaugguuuagcauguuugauauuguuauccuugauugcugcacguaauuuaaaaucuuaucaucacuuaugacagcugcuugaugguuggguagaagaaauguuucaugcugaggaaugacaguguuguguaaugauucuuauuccuuauaugaagguuuaacgugauaggcccuuugugguucagcagcuuucaggugcugacuagaagggagagccuuggaaauaagacauuucaaacccugcuugaaaaaugcauucugacagucuuuuugaugggcuuuacagauucauuaaaauucuuuuaccuggccauggcaucauggauagugacaaaagggcauggaaacauuaucuguacguucaguuuaauacauuucagccccacgauaucccuguuuuaugcuggugagguagugccucacucaucaguucugacucugucguuaucuuuuggguuuucucacgaggcucauucugaaugaauuauucuuuuguguaacugccugaucaauuuagugguguucacuugucuaggguuuacccuuuguggcuuuuaaggugguacuuuaaaaacacccuucccuguuuuuauuucuuuaggaucuauuugucugggugccuagacagauuaaagauguacuuaaaugugggaagaaaaguucccuucauauauuuccuuaccucuggugauacacuuacuugaguugauaagaaguucgagaucauuaucuucuagaucauaacuucaaggccuccuucacaggguauaaagguguaauucuaaacagguagaucuuagauuuucugauguaaucaaucucccuuugucuuucccggauugaagaccugccagaggggagguugaucuccuuuauguuugaggucacugaaaauuucuuuccccugguguuucuuacuuuucgcucagacuuuuucaggguaaagccagggguguuuagguacaguguuauguuuucucuguucaaaaauauccucuuguuuucucuuuuaacaaauggagaauaaugacuugaggauacuguccagaggguuuauguggcuggugugguuuugugagccagucuucaaguggagagagccagaggcuuuggggccaagguaugggucauggcagaaauucaagcccuggggucaccaugucucuuuguuggggauaaaggaugccucagagugcuucucuggacucugcgaugggauccggcucuaguguugaaguucacuuaaucuucccuugagugugcugugccagccuggauuuggcugcuuuagucaaaaaaacuauuguuccuaacgcagggaaaugcuuuguacauauuuauucaucugauaaaucagaagaauagacuuuguuguuuuuuccucuuuaaauugaagggucaaaauaaaauauaguucauuuuagggaguuuggggguucuugugguucuaaggcucuguuuugacaccuugguaauucuaaggaaaaaagaaaacaauaggccagcauaccucaacaguguccucaaauaauggcgggagcccuguugucacaguucagcauuucaagugggaauuacagauuaguugggacuccuaguugaccuuauggaaauggcugccuucucacucucagaagagucuauugguucugggauugaauugagaccguucauaauguucaaagggaucccaaaauguaaguuguuuaugugaaaaaauacccauagcagcauaaaaccagaaaaaggaaauauagauggcagccuguggggaggaucauucuuaaauguguuucccauaugugccugaugcuuuucagucgucccuaucugaaguaccauucauaugaugucacauuuagacuccgcuuagauuucauagaugagaguaauaaauguauccuucugcuuacaucauaaaguaaagccaauuagaaauuuaucuguuuuuaaaggggcucgaugcuuuaaaugggcaguauuuucuuuaacaguuuuuuuuucuacuaaaaauucuuuaaaaaaaaaaaucauucaaguuuauauguaguaaaaacgugaggugagguauguagugcccggagcucugaauguggugucccuagccuggguuccaguucucuuccgccacuugcuggguguguaacuuugguuuuccucaucugugggguguaaaggagaaugucugcacccuccauccacagagcuauugugggauccagugagaaaaugauaggaagaugaucaguaacuguaaaacaugagacaaaugugaaggauuauuccagccacuaauaugaaugugggaaucaucagauagucuaggucuguggaaguguuagaaaugauuuuacuugacuuucauggaucagccuacuuugaaauuaacacuguuauauucucuuugccucauuaagaccaaauuaucuuuaauuagcuucacauaaguauuagauauuauaccaaaugaaauuuugugucugcugcucagauugcugggugguuaaaucuuacuuacagaugaguugugugcauguguguuuucaaauuagcaaaucuaagauaaguguacaguucaaaauuacagcaucauucuaaguggaagcucauugaaacgggagacagaagaaaggcugcugugaugcagcugggugagugagagaaaucccuuuuguacaauaaagggagcaagagccguggaguagaauaucagugcacccucgggagaccugaagucuucccuggguuugucuuuauuuguguguuaacccugaacaaaauuugcaugcucauggagggaacugguaggggcaguguguggauauauggacauauaaaaauauuuuaaaagaccacuaguuucuuaaggucaccccaggaguugguugcuuagucauccaguuucacauugacuagaugcagauugaaucauuagguuggaaagaagacucuugacuagaaagaaaccuaaagauaugauccaaagaagaaaagaggccaggcgcuguggcucacgccuguagucccagcacuuugggaggccaaggcagguggaucaccugaggucaggaguucaagacuagccuggccaacauggugaaaccccaucccuacuaaaaaaaggaaaaaaaaaaaauuagccgggcaugguagcgcauccuguaaucccagcuacucggaaggcugaggcaggagaauggcuugaagccgggaggcggagguugaggugagccgagauugcaccacugcacuccagccuaggugacaagagugaaacucugucucaaaaaauaaaaauaaaaaaacaaagcagaaaagauuggggguugggggaaagaaggugagccccaucccugcaaaagcccaaagcaugauugaccauccaaagagauguaacuucacuaaaacugugcuugucuggguaauagugaccucuuuguagcaaaaucuaaugaucauuuuuaaguguuuaucaaaaucuaauugguaucuuuuaauccacaccaaauaauuucucuuagucauauuugaucuuguagagaaucuuuuuucuugaaguguucuuuuccuuuggccccugugacaccauauuaucuguguuuuuucucuaccacuucuuuccacauauuuuuguuagccccuugguccucucuccauucccuaaauguuucuucagaugucugucguggcccuguguuuguuacuuugccuuguagcuucuacugagcuucugacccuagauacaaauaacuauagagcuuuuccaacgagucuacccccgaggcaccucaaaguuaauauccagaacagcucaucaaccuugcacugcuuccuccacccaaaacaacagccacaacaauaacaacagaaaucccagcaaacaaacaguaucccaccucuccuggaggauuuccuauauucagcaaguggcacaccguucgcuacucacucaguuacacaaacuagacauuuggagccauccucuguccuauucuuucacaccaaggaaucaccaaaaacacauugauucuaaaucauaauauguaucuugaaugcuaaauuuaucgaugcauccccaccagccagccccacucagaucugcuguuauaaugaccucaaucuaggcuucacccuuuuuccuccaauccauuuuccauacuauagccuaaguuaccuuuuuaaguuauaaaucugaucacauaauuucauaaguggcuaucaguugcucuuaggagaaauccauauucuuuaauauagcccccaaaaacuucuggauugggcucugguuuaaccccaucuuacaucacuauucuguucacauucugcacauugguuacauugaacaacuucucucuccuuggauauaccucguucaucucucccucuguucaugccaucuucccugcucuuccccucuucuggucccauccaaucacauucaucuuuugggucucuuuuuuagggaggccuuucucuaacuuccugcuagauucucccauaucccuaagccaccccauuguaaggcauuaaugcucauucuuguuuaauguuugucuuuccugcugggcuaugugaucuggaagggugggaaccaugccucuccuuuuccucacuguauccagugcucauuaaauauuaguugaagggaggagagauggacagauggauggucagguagccagucugaggggcuuagugucugagucguuauuaguuuuccauugcuacuggaauaaauuacuacagacuuaguggcuuaaaaacaacacauuuuuaaucuuauaguuguagguuggaaguccaucaugggucucaccagauuaaaaucgggguaucagcagggcuggcuccucucuggagacuuuaagugaggauccauguucuuuuuuuuuuuuuugagauggagucucacucugaugcccaggcuggagugcaguggcgugaucucgguucacugcaagcuccgccucccggguucacgccauucuuccaccucagccucccgaguagcugggacuacaggcgcccgccaccacgcccggccaauuuucuguauuuuuuuuuuuuuuuaguagagacgggguuucaccauguuagccaggaugguccugaucuccugaccucgugauccacccgccuuggccucccaaaguucugggaaggagaggauccauguucuuauccaucuggguuauuggcagaauucaauuccuuguguugacaggaccgagauccugguuuucuugcugucaggugaaggucauggccagguucuacaggccacccacauuccccggcuugcagcccccuccccaucuugaaagccugugauagcagguggagucucucucaugcuuugaacccuuccuccuccuuuugccauuucauuucuaaccaaguccguaaaagguucucugcuuuuaaggauuaaugugauuagaucaaucaugcccacucagauaauccaggauaaacuccccaucucuaggucgguaccccuagucacuucugcagaguucuuuuugcuacaacagguauaguauguuuacagguuaugggaauuagagcacagauggcuggggcgcugcuguuguugugcuuacuacagagccuguguuuuuucuuccucaguacuuucuccaaaaagcuuuuccacugguuuguaguuccauugguacuuguuuaauuuuaaauaguauuccuuugguuuugcuagauaaaacuauuguaagcuacuaguacuugacaauguauuuguguaaaauugaaugagugaaugaauauguauuauggcucucaaaucugauaaauugcaaaauacaauaguaaaacaaacuccagaaagacaaagcaccaugaaacgugucaacagagagaacaagaauuuuagaggaaauuagcuggacgugguggggugugucaguagucccagcacuuugggaggccaaggcugguggauucuugaggccaggaauucaagaccagccuggccaacauggcaaaaccccaucucuaccaaaaaaauacaaaacaauuagccgggcuuggugaugcgugccuguagucccagcuacucgagaggcugaggugacagcacugcuugagucugggaggcuaagguugcagugagccgugaucaugccaccgcacuccagccugggcaacagaguaagacccugucucaaaaauaaaaaaauaggcugggcgcuguggcucacaccuguaaucccagcacuuugggaggcugaggcagguggaucacaaggucaggagaucaagaccauccuggcuaacacagugaaacccugucuguacuaaaaauacaaaaacaaaauuagccaggcauaguggcgggcgccucuagucccagcuacuaaggaggcugaggcgggagaaugucgugaaccugggagguggagcuugcagugagccaagaugacgccacugcacuccagccugggcaacagagcgagacuccgucucaaaaaaaaaaaaaaaauuaaaguguuagaggaaauuguugaguuuaugaaaucgcuaaaccagagguaaggaauuacuugaucaguagcauugcuuuccuuuaucuaauuacuauagauugugcaguaguauaucaagacacguuacggucuuuuguguuauuuuaaaguuggccaugagaaaauaaaauggaaauauuucuucaucccucagcauccuuuacagaaucauagaaauuuagaacuguaagggaucuauggccaauucucuugagcuaaauaaagguaagauugcugccuaaaggaaagauaggcugaagauuuuagaauuugauaggguagcuuaaauaguaguaguugagauacaguauugcuuaaagugagagaaaccauuaagagaaagaauauuccuugccccugauugaaaauggcugaaauccacuaauuuucaaacugcauaauuauuaaaaagucugucuuucauaagauaccugugagaauaaauaguaagcuguaauaugaugugaauuaccuuaguuacugaauauuaagucacaaaguacaaaagcagauuugaauguagagaaaaauucagugcgugaaauugaggucauaugugcccaugauauaugccuuacaggaaguaauaaaaaagaggggggaaguaagugguauacuuuuaagcugaugggauccauuuuaaggguggaauuuaaauugcuguucuuuaaaaguuaaguuuuuacccuccucacuauauaaggggacagaggggagggcucugaucaaaguagaccucuccccuccccgcuucagugugcuucuuagaagucgacaagcaagcugucuuuguuugccguuccugagcagaaagaggagauugauaccauuuuuaucuauucagacuuuuuccuugcauucauuugaaugagagaagccucauaaaagaacagugucacagguuaaaugcaucugccugggugucucuccugccugaggucauaauccugugacaauauuuuauuuucucaacaucuuaaauacagauguuuagaguuuuuuuuuuuuaacucaggaauagugugcuuuuauuaacgguauuggugauugauuuugaauguuuuuacuucaaaaagccaaaucuccugguggguggaauuuuaugaagcaccuguuaagcuuuagggaggaggaccuuuuuggcagcaauccaaaauacauauuuaaacaaugagccugccaaagucaggaaauuauaaaacaguuuugaaauugcagaaucugcuuuuuuuuauuaccccucagguuuccuuugcagcuugguuguaaguucuuucacaugggauuuacuaauguucuuacuauuuaaagaccagguuuaaaaaaauaaaaucaaguuuggagaucucuucggguuuaugugauaaaagaccauuagauuuuaaacuguacagccuuccaaagaaucuaggcucacgcuccgcacaccucuuggaggaaucuauuacacacuggcucauggcuggcuccuuugaauggcauugccccucagggucuccaguuuuccucugugaagugagcaguaagaccugguguguggagcgcugcuaggugaaaagugugccccaaacaggaaaaugggggaaccugcugaggccacacuucuugguggguccuguuuaaccuggaucucucagcuucuuaacucugucucucaaauucacuguuuucugcuccugcuuccagaguuuaaacucagugacccaggggcaagauggcaauggaauauccucugucuagcccagcaaugggauguucuuugugugcuauuggauuugggugggggagggcaucuguaguuauguuaagcagccucaauuuuuuauuuaguuaucuguugaguuuuaugauuucaucacacacagagagcaggaauuguuugaacuuuggcaacuccccucaguguguggcaaaccaggacccccuggguagauggugguugaugaagacggcaaguacaggugcaggaguaagaaugccugagccuguguuaucuucaaguucucaaaggcuucagauuggaauugguauaaauuaaguucucuuagggaaaacauucguacagucauuuuguuacauacagggaaagaaggcaaggggaaaaggcagaaaggaaaaucuguaauucggauucucugaucuguuggcauuuucaaguuccuaagguucauuggcuagccucaucagcuaucuauuaaauauuagggaaugggaguuuaaaaaagucaaaggcaccauucccaucaagcaauuugcuuuuuauucucauaggacacccauccuguuugaaauuuuguccugaauuaacaacaaauguaaaggccuuaagguggcagugcaucgaaugcaagacaugcagugccuguagaguccaaggcagaaaugcuguaaguauggcucccguaauccgccuccagguaacucgcuaauuuccaguguuaagguguuuucauuuuuauagaguauggcuacuuucuuucuaaagcuuuaaauacacaugaugucaaacugcaaccaggaucuuggugcacuuuccuuauauuguauuaauguuaauccaguaacaaaagaauuuuuggccuuuuacaguugguuucagucucaauuagucucuaauauguuauauuacaggauaauaugcuuuuuugugauuccugugauagaggauuucauauggaaugcugugacccaccacuuuccagaaugccaaaaggugaacuucuaaacuguacuaaaaauguauuuuauuacauauugguuagcuuuguccugaggucugacagcucagagguauacagguucuuuaagcauuuuuuucaucccucccaccuucccuauacuucugaguuuagcacagguugugaauagaggaguauaaaagcauagaaaaaaauacauauauauauguguauauauauacauauauauaaaauaaaggcucuaauucagacccagggaugaaaagaccaucucucucuccaaaccauuccccuauuagaauaagauuagauuauuaaggucaaaaguuuagaacacuuuccauauuauucagcacaguguuaagagcuuaacaaauuuuauauuuuugaggaugauagugacuccaaaguccuacaacaggaagccaucaccauuuucuuggccauuaguugauauuuugaacacgagcaucugaaugaucuuauagcugauugugucugauggaauguggauuuucuucuguuuauuguguaaaucagcuaagcucagccuuuuccccucauuuugcaauauauuaaacauuuaaaaauaacuuugccuuuuuauuauaaaauccauaauuuacauuguggaagauuuaaaaaguacagauagacaaaaaaggaauaaaaauaaaaaugaauuggaaauuuccuucucugccuucacauacccuuugaagggaaauggaacauucuguacauguuuuuguaauguacuuuuuccucccucuuaauagauuauaagcauccccuacaucauuaaauauucuccuaaacauaguuuuuaauaaguauguagaacuccauaguauagagcagggauuacaaaccuggcaacuaugggucacagauaugcuuuguugguacaauauuuuuacaaguuugaaucugaguccucuggguggugcgugugugcuccaguuugccacaaucucacuacucccugcugucuuacguuccaauuugcuucagucacauacauuauacaaucuagguccuuccuggagguauuugauuuuccaacccucuauauaaaugaacucuaauuuauuuaaccagucccuuaggguggauauuacaaauguuuccaauuuuuuccauccacaauuauuuccuugaaauaaauuccuagaggaggaacuguuggaucaaaggcuagauacaugaaaggcuguaucaguuuucaggcuguccagcaguauagaaggauaccuauuuuccuguauugugaccaguacucaccguuacuauaucuccuugagucuaagacacauuuuuuuaauguuuuaauauuuuugaagucagaugcaucauacaguaucuuagauuugauuagaguauuauuauuuuuaaaauuuuaccaguuugauaauagaaauaugucugauuauuucuuuuuaaguagucagauugaacauuucuuguguuuuauucuuggcuguuuguauaucaucuuuucuaaaguaccucuuuuuauccauuaaucauuuuucucuugggauuuuuaccuuuuucuuccugauuugcagaagcucuuuuuuuguguguagucauauucaugaaucuuuuuauuuauggcuucaguuuuaaaugucagucaugcuuagauuauauaaauauccacauaucuuuccugguacuuauaacauuuuauuuuuucauauuacaauauucaucugucuagaauuuauucuuguaaaggauaggaaauaauuccucuuccagauagauagcuauuuguucuaucaugcuuauugaaucauuucauccuuucuccacugauuuaaaauaugaccuuuugauaugcuaaacuuuucuguaggcuuugguuguucuggucuuuccauucuuauccauugaccuauuucucuaugcuagauguauaguuugaaucauuguaguucugcaguacucaaaacuuuuauuuaaauuuuaaaauuauauuuuauacugauaauuuuuuuuuaguguuggaacuuuccagaaagagaugauaagacaauuuuuuuuucuucuagaaauuccaaaaauggacugauuugaaaaugucucccucaaaucaaaagauauaauaucugacaggggcgaguuuucauguguguuuauguguuggugagaggcuuaaugacauguugggaacagcuucauggaaggauucugagagaggggccaccucugcccucaccaccuucacuccagggaaauugaccuuagugauggcuuccuaaggaaaaugacaaagggaaugacgcauuuuuuggaguaaaguucagcauacaggcauccuugagcagcuuauuacagcuacaacuuauauuuaauaucuucucuuaaaaugaaacauuaaaauauuuuucucauauauauauuaauucagggauguggauuugccaagucugcagaccaaagaaaaagggaagaaaacuacuucaugagaaagcugcacaaauaaaacgacgauaugcaaaacccauuggacgaccgaaaaauaaauuaaagcaacgauuguuguagguugagaucuuaucaaaagaaaucauuuauguuuugcuuuaaaauauaggugauuguuauucucucagauuccuuuagggguuuuuuggcaucauuuuuucaaacucaaggguugaaaaauacuuuuccuuuugcauaagcuguggaaauuuuuugaaaauaacauuuuuaauuaccauuggcauuuuggggucuucuguuggcaguagcugugauacuaagugacauuuuucaagcagcaggauggaagcagaauguaagaauuggaaacagucauucagccuacuuuauuacuggcugagcauuagagcuuaauuauguaaauauuuucauaggaauuuuaaaacgagagggauuuguccaugucuauagcaaaucucuuuugucacuccagauaacauuuuagaaaaauaccucucucuucugauaguaauguagcauuaccacuuuuuaagaucucuuuuaugaaauaggagcuucugaaaaaccugcagaugaccacuuaccucugaagaguuagacagaacuauuugacaacugcacuagugcagacauauauauaaaauaauauauucgcaguggccuggaaaucuacuaugauaaccccauuuucacuaucuuguugcuguauaauugccauuaaagcccaguagagcauuuagcaggaguuaguuggaaaagcagagaaaagauaagaggugaaaugaauuuauuuuaaccuguguagaguauagauuugacuaucagcauuaagguguuuacgaaugggaucaguagacuugcacaucuauagcaguucuaccaacagacuaccaccaucuuuucaggcuuagugaaagggucauugugauggagaaagaauacaugcucugcacacaccuugaacagacuccaagaaucucacucccuugcuuacuccuuuuccccuaauuuuaucugaagcugcucucacuaucuuauuugcucucagaaaaauaguauucucccgcaccuuuaucuccuaagaagaaguaagaaaugcaggcuccuuucuagaguuuucuaugaaacuuugcaaaaacccuuuaaccaguagacauuuucaauagauuuugaaaaaauuucuagaggcaaacaugaaacauuuaugaauaaaaucuuucaugguaguaucauuugaaguagaaauuauauguuuuugcauucauccuguguaagcauuguucccaacauggguccauauccucagggcccaauuaaaaaaaccaaauuaggauauaaacuuucuaaacagaggacacagcugaaaauugcaucuggcaccaauccuaacuuuuuguuuguccaaaauuguccuuugagcuuaggaauuuuuaagacagucuagggaguuuuccuuuuuacaugcuuuauaagcauauuauccuuucugggcaaucgauuccagauacaauccaaaugcagcuuucugaugugaaacauuuuugccuggaugaguuccuuguugguaacucucacugugucucuagugacacuagagaucucuagcguucaccugacuuggcugaauugguggugccaggcagagucccuggcaguagagccaccucagaugagccugguagcugcaccuaccuccccuucaacuaacagcugaaaucuggucauuaaaucuuuguauacaagaugaucacuaaaauauacucuuguauuuguaauuacuuaagauauuuuuauaauucaguauuguaucuuuuuaaggcuuucauuuugucauuauucaccuuuagcuaaauugaucauuuugaaaguacauucuugggccccagcauugucauaauucaucugcaaauguuucucuauuguauaaaacucugcuacaaaauggguagcuucgcaaacccuagccugaggugaagacagucggccgcuguucauguaagcagcuguguuagcgagugaccucuaguuucuagaacuacucaacaguaugggcagaaccaggguacaaagauucugacgccaagugucugauaaugaccaugguaaaugugccgcuucuucaccagacucuccaugucaugucugacccgcuguagcuuuucuuuaaucauuucuucaguuuuuugcuauuguuguccuuuuuucagcaauauuuuaugcuguaguuaauugucuucucuccuaagagaguauuauugguuaucuuaccauccuaagcacaaacugcugagaggaagaggaugucuuuuuauguuuucuuaaaaaaaaguacaaauuuauagccauauccaaacucuauuuauauaaguuugcaaauugaauuaaaaauuacuuuuaacuagagauuagauaagcuucuucuuuugcuucuggauaacacauaugacuuauuuccuccuaauacuuuaaaaaagacauuucaggaaaucauaacuacuugugacaacaccaaaggauagcuuguuuuuauuuaauuauaauuaaagcauuggguguucuuuuagucucuucagcauuuuucuugcuuauauugcccuuggguccacauggauucuuccaguaccugguggaugggcccuggaagaaccaugacauguaaaugcaguugcugcugccuuuccaacagagaaacaucuaggugguggcacacacaaaaaauacaguucuuaaguuuaagcccauugaaugcaucuaguugcaauaaauuuguuuuuagauaccuuuauaauucuauuuauuaaaugcugauacuauucucuaaauuucugccuaggucuguaaccagugaugaaggauccaugaaugcauucacaggaagggggucaccugguaggggucaaaagacuaaagucuguaccacaccuucaucuggucaugcugcaucugggaaggacucaagcagcagauuggcuguuacagaccccacucggccuggugccaccaccaaaaucaccaccaccuccaccuacauuucugccucuacacuuaaaguuaacaagaaaaccaaagggcucauugauggccuuacuaaguuuuuuacaccaucaccugauggucgcagaucacgaggugaaauuauagacuuuucaaagcacuaucguccaaggaaaaaggucucucagaaacagucaugcacuucucauguguuggcuacagguaccacacaaaagcuaaaaccuccaccuucuucacuuccacccccaacccccaucuccggucagagccccaguucacaaaaguccagcacggccacuucuucucccucuccccagaguucuuccagccagugcagugugcccucccugagcagccuuaccacuaacagccagcugaaggcacucuuugaugggcuuucucauaucuauaccacucagggacagucucgcaaaaagggacacccgaguuaugcaccacccaaacguaugcgucguaaaacugaauuaucuuccacggcaaaaucuaaagcccacuucuuuggcaaaagagauauuagaagucgguuuauuucucacuccuccuccucuagcugggggauggcuagaggaaguauuuuuaaagcaauugcucacuucaagcgaacaacuuuccuuaaaaagcacaggaugcuaggcagauuaaaauauaaagugaccccucagauggggacccccucaccagggaaggggagcuugacagacggaaggauuaaaccugaucaggaugaugguaagcaaaaggucaaagcuccaaccaaaccugcgucccgucccuuucuccccaacccugaaaaaaaucaaccaaucaauuccuauuugucacauaggucuuagcuauuucucuuguucucacuucacuuucauacagaagcagugaaacuuugaccuuuuucuaaugcugacuaaaccuccaaaauguuguuuuuccaacuaauacucucccaccuuuuauuauuuauuuccauucguagugacacuaggacccccagaugccuucauagcauugcuuauggcuuuguagucccgcaugaguagccacugccaugcuucugccaugcucucccccaugucaccucugcagccacagcgcuguucaguugugugcugucagugcuuccaacaggggguguuucagcucuucccucugcuccauugcuuucucaugacaaaguucauccugcuuccgucucagcaaagccugaucugugacucugugaugugugcuuuuggaugugagugugucuguguguguauccaccuuagggagaaaacggauuucauaauuucauugaacaaauuggcccauuacauuugcuacccuuuaucaaacaaaaaccgaaacugugucauuuggacaaagugguagaauuuauuaucucaaaagugauaaugggaaugcuauaacuagacaucgauaaaacuucuaaucuugguugaaaaauaugauuucacuuuguauugcucuuacuuucccucauauauuuauuaaagcuguaaaaagaugacagugauaaauucaaauaaaaauuugaguauagcagggaaaggauacugcuggaucuaugagcagugcuuagauguaaaagcuuauuuauaaagcuuuaaaaaaaaucccuauuugcccaguaugcuaauuuggugccauuuugguaauauauggugguuacucaugauucaagucagugaauacacuuucugcugguuuuaaaugacagauacugaaauaaaaauaaacaucaaacaagaaagugcagauguaaaugugauuggaaacaaggaugucguuacugaagaggauuuggauguuuuuaagcaggcccaggaacuuucuugggagguaaggcgaggaucccacauuguaguagcaaguauaagauguggcuucuaacuauuaauauggaauuacuguguugauuuuauagagaaucccuuucaacauccuuugugauucuuuagccguuaucaugcccauuucuacugacuguacauucaaaagcaaugacuuaguagaauugucgccacucuuaaaaguagguauggacucagcuggucucacaaaauaaaacagaguagcauuaguugaggcagauuuuggaaaacauuucuaggugugaaggaauagauuucugaugaguuuugccuaaauuuagaaaauaacaauuuaaaaucauuaacaaaaagaagaacaucacuguuaaauucaccgauguuucuuccaacacagauggccagccauaugaaaaaugucucauauuuuuagcucuucugcauugaugaaaacaauauuuuguuucacaaucaguuguagucaguuuuauuuuuauuguccaguaauuucuuuaagugauuccacuuuaauucugcuuaaguuauuaccacccagauauugacaggugaggcugucagacuucucaaagacgaaucuaauaugaauugugaauuuguugugucagugacuacauucgguuucuaugaccaguguggucagguagacucccuacccaaccccacuuccuguuuuguggggaagggguuuucuguaggcucuuaacgcuuuauuuuuaguagcagccaguugggcuaaauacuccugacaguuucuaccuucagagcuauuggguauuuccaacccucauucugccccgaucuaucaggaugccuuguaucagcuuuccuuuggcuaagauaaaugucagauuucccccaguuauuaagguuggaaguccuugaaccagcccagguuggaaauggagcaggucaaaacuccuacguugaucaguagugggauugugcccuugaauggccacuuuacuccagccuggacaacacagcaggaugccaccucuuuuaaaaaaagauucgaaguccuuaaauauuaucuuuuuuuggccuacuucugacauucauauguaaacaugaacaguaggccauuaucugaaagauacugcuaauucuaaaguuuuuucauuccaacaugguaaaacuggcuuuuuuuauucaagaaauauucuuguucugugucaggcacuguaccagacaccagggauaccacagugaaucuggcaggcagaguucuuaaccucguguggcuuacuacauggaaauaagggaaauaagaggagacaaaugcuaagcugcagauuucacaauugauuauuuaauuacaguugugauaaauacuacuucguggaggaauaggaaacuguaagcuucuguaauaaauaagccuguguaauagccacaucauuuauaaucaccuaauuucuaaucuguuacaacagauuguuaaauccaguucuaucgacauuuguauguauuuauaccauacuuauuuccuuugcuauauuguuucuuaggguauucguuugcugugaaucuuacacaaagguaauguuagguuggugcaaaaguaauugugguuuuugccauugaaaaaauuauaaaaacaguaauuacuuuugcaccaaccuauuucauaagggucuauaguguuuuaaggccaugcaaauucacaauuaagauuaguguucugaucuugauaaguuuugauagucacuggugaaagaaccaaaauguaagugaaguauauauauuauuauuuuccuuuucuuucuauuugacagaaaauagagugugagagugggguggaagacuguggccgguacccuucugugauugaauuugguaaauaugaaauccaaaccugguacuccucgccuuacccacaggaauaugcaagguaauggaauaagucuggcagguguauaacuugaaugucacauaugugagaaaggaaaauucuugauucuaaagcaggaauuagggaugauuuuaggaaauaaauuuugguagucaaugccaagugcuucccaaacuauugcuuuugccagcaccuuuuuaugguauuccuuguucucgguaaauuccuuaugcuccuuaguuacaugggcauuauaaauuuugccauuuagcuucuagauugugcuuucuuuccuugguuaauuggggaaauguugguuuuguaugaaaccaaauuaaaaaaaaaaaaagaaauuugccauggugaauuauuggguagacuuucuucuccaguugucuuuuauauuuuuuaauuaggccuguuacuuuuaucucugauuucuggcauuuuauuuucaaguuuuuaauagaaauuuagcaaaagaaggaaaaaugggagaaaguaagugggaauggguagucuuaagagacccuuccccaaauuuuuacuuuagaacauuugugacuuugaagagaaggccaggcccggugacucacuccuguaaucccaucacuuugggaggccaagguggguggaucaccugagguuaggugugcaagaccagccuggccaacauggcaaaaccccaucucuacuaaaaauacaaaaauuagccagacgugauaggacaugccuguaaucccagcuacucgggaggcugaggcaggagaaucacuggaacccaggagguggagguugcaguaagccgagauugcacuacugcacuccagcucaggugacagaccaagaucccaucucaaaaaauaaaaaauaaaaaggagaaaauaaugguauccaaguuuuuguuugucuugaacucaagauuagccugugaacgaauauaucccaaaauggguacauugagaauagaugucuuccauaaaguaugucaggguacacuuuacuaguaucuucaaaaauuuuuuagucugcaaaguuuucaguauuuauaaacuugauuuucuuauagaauagaucuuauuuuuuuucguuagcaugugagugucuggccaaucacguaacuggagaaaaugcuaaguguuuucuaaaaguuaagugacaaaauaagagucaagaauuuugguuucuccuuccuuauaccauuugguuguguguucuugaacaauuuuaaaagacuaugagcuuuaauuugcauagguaaugauaagccaugugcucugaaagauuugaauaaaauuuguacauaagugcaagauuugaaaguagucucaccugugucugccucucucuugaaaaccuuuuuccccauucuuauacuccaaagaccuugcaagugcuucuaaacauuuucuuauaaauaccagccauguucauuaagauauggaaauaaaaaauguucugauuuuuaagguggagaaaaagucagcagggaagagagguguuugucuuuuacucaaaguaacaguggaauugguagaaaacaaauuaggucuuuugauuuucagccgugcuauuuacugcauuuagaccauauauaaaucucugauaauaacuuuaaaguuaccucuuccagagguggaaaugguaacaacuaaguuugaggacuuuucagccucauauguaugcagauuguuuaaaauaauaaauucacuucugaguaagauauuauaucuauaccacuaaccauauauaauuggaaauaagauaguaaaugugaauuuugaaaaauaugcuuggucccuugacaggaugauauccuuauuaaguugauuuuuuaggguggugguuccacaucuguaaagcuuucuuuauauaggauauuuuuaaggaaacaaauuauuuguucacaaaguaaagggagcacauauuauggauuauauuaaaaaauaauguaugguuguuuuuacauucugucuuuacuauuggcuggcuuucuuucuuucuuucuuccuuccuuccuuccuuccuuccuuccuuccuuucuuccuuucuuuccuuucuuuccuuucuuuccuuucuuucuuuauuuuuuugacggugucucacucuguugcccaggcuggagcgcaguggugcaaucucgauucacugcaaccuccgccucaugggcuuaagcgaucuuccugccucagccucccaaauagcugggaccacaggcaugugccaccacgcccagcuaauuuuugcauuuuuaguagugaugagguuucaccauguuggccaggcuggucucaaacuccugaucucaggugaucugccugccuuagccucccaaagugcuggaauuacaggugugagccacugcacccagccuccaauguuauuauacagccuuuuuaugauguagagaaaauugaacaauauuuaaucuuccccccaacaguauaaucuaucugauagauucuaugauuuuuaaacuuuaacagauuaccaaagcuuuaccugugugaauucugucuuaaauauaugaaaaguaaaaauauuuugcuaagacacuccaagaaguguggaugguuucauccuccagcaaaugaaauuuaccgaaggaaagaccuuucaguauuugagguaagcgcguguaaauaaaaaaauucagcuuuuugaaaucuaguacuccuaauuguugacuaugugcugauuuguguuuagaagguacaaaguauacuuaauuuuggcacugaaauucagacugcccuuuaaaacaucuccauguuuuggaauguuuaucuaaccauauuaagcaaccauuuagacugaugaagaaucccuacuucaucacauuaacauuuuugucuuccccaaaaucccugucuacacuagauauauucaccaugaauuuaugaucuccucagcucuuuguaaauucuacuuucuuuggcaggagaaaugagcuuuguucagcagcuccagccaaugucuggcaggugcucacucuuccagggaauugagcagcuguacauaucuccucaauacacaaccaccuguguuuccauccacuucuuggcaguguggauaauccuuuuggugagacccuagcagauguugggacucccucccaucuggguagauggccaccccugaagaacucugcuguucacaggaaccccuuguggccauaugucugucauuguggguuucuugaagacauuuuguauuuccagaauugauuucguagcaggccuuugccucuauauaguugcauuguuuaauuauguaucuguugucaguuucagggauuccguuaagcugagucaguuucaccuugaggagaccaugccuuucucacagguuacugucugucugcagggcuuuucacguuucuccuuuaugcucuucccuccacuugcacacuucuguugucugcugcauuuucuccucugugacccauuguggugugcauuggugcucauuccuaggugcuugaaacaagccuaccuuguacagcaaacgugauguccucuuucucuggaauauaguuucacuucuggauuuucuuuuucugaauuguucaggcugaaacuuauuauucugccuuacaguucucuuuauuucuggccugcagugucuugccauccuauuaaauaaagggaagguuguagguuucucacauggaccaggcuccuucucagacaggucugggcccacuaguuuuuccccaagacugaucagagaacaugggaaacuccaguugugucuuaugauuuuuuuaaagcuuucucuuuuucuaucagcucuuucgguaagcuuggaggaagaaggguauuguugcugggaagauuaggugauauauuaguucuuacuaaaagcuaggcacuuuugacauuucaagcugguuaguucuuuguuguaggggcuaugcuauacagcguaggauguuuagcagcaucucuggccucugcuaauuggaugccaguagcaccaccaccccuuccaguugugccaaccaaaaaugucuccagacguagccaaacauccccugggggcgcagaaucacccccaguaagaaccagugggcuagaaggaaggcugaaugcacguugccugaccuuccuguugguaugcuauccugccagccccagccagcugaggugacagagcugcucacaguugaagcuuagcuaaugucacaaguucagcuuuccuauuggcuccuuccuugaugccuuagaucuuuucuuccaaccaaaacauuguuucucaaagcucaaaacacauuguuggccuuaaguaauuauuucauaaaucagcaugagucagcacugggauugaagcucucauaaauccauggaacgucuucucaugggcaagggaaucagucuuguuaggaugguaagaaugggcuguucuuucagggcaggugcuuuuggaccauccagagaugagaggggagacaucagaagcauguauguaaaauucacuuauacgaauaaggaguuggauuugauaaguaccgaggucccuauucuagaaucugaguuaauagaguauaacauuugggcaacuuuucuccuagcaguuucuuacaaaacuuauaaaauaaaggaggaauaaucacacauuacgauuuucuggccuucccuuucuuuauuccucuuacacuuuucacaaccaaucagaauuuucuucagcacugucaucucuguauuuuucugguucacaguuauguauaucuccaucuuuccuuuuuguaauauacuaccauuuccaaaagggccauacucucaaauacauguaaacuuccuuuaauuaaagggagaauuguauccucugugcccauugcccauauuugauuguguugcuauguaugggaccuagguuccauccgagggaaauaguuauaugaaaucuaaaaauaauuugugcaagaugagaacccguaugguccacaggagaccugagaauggucaaguucauuguuucagagcucugguuagcaaauauccauuucccuuaagaaaagugcuagggaaauucuucuugaaucugcuguguuuucuauuuucaaagaguaacuacauuugaucaaagaaauuggcaucugugccuagccuccugucuauagccaucaguaucacagcuugauucuuuuauuuugaagagaaguagacuguaaucauagugcuuauuguagguugaaauucauaucacuuucucuguaaguauucccaacauagauauuuuaucuuuuccaauuauauuuaagaugaugcuugggauaaaaccaaaauggaaaccucuuugcuaauccacacuucugaggaaucagaauaauacaguucauuuauuuuaguuuuaugugaaacccuuuugaaacaacauaaaguuuaacuuacuugagaaguauuuugaucuguuuauauuuccuuaauacagauuuauucgguucagauagagaggacaugccugaucauuuuuagcucagaauaaauuacaaguaaaaauuacuccuuuacuagugguuuggcccuucuuugguagcuuaaagagaaauuuuaacuaccuuaaauguacccuaauuuaagagaaaauguggaauucugauuugccagugacagcuguuuucugguuaaagcuguacuugcuuaauagaguguuuuaaucucucaguuuaggauuuggaaauaaaaugauguacuuucugaaauaccauauagaagaaacaauuuuauauggugcaguauuuuuauguuaaauaauguugucuguuucuuuuugcuagguugaugggaauaugagcaaaauuuauugccaaaaccuuugcuuguuagccaagcucuuccuggaccacaaaacguuguauuaugaugucgagccauuccuuuuuuauguccuuacaaaaaaugaugaaaagggcugucaucugguuggauacuucucuaagguaaaacaagagccagcaugaccuucauuuucuuuuucaaaauguuuuugguagagcccaauucuuugaacagggcuuuuucauuacuauaauuugaauaagugacauguguuuuugaaaagcucagguucuuguucagagcucauuuuaaaagaugaaaacaaaaaacauggugccuaguaaguguguaaaggaccucagcacugugugccgccuugaugacacucuaauugcugccuuguggaccacuuagcgucuuugauuuucucaguguuuagcuuauuuccguuuucccuuuaaguggugucaacaugaagguuucaguuuaguguagcauuuaagagagaauucuccuuucuccuuguugccuucccucuguggucaacaguaucucagugaguuaggacgcuggcauuuggacagucaagcugauaaaaugacugguuuuacacuuuugucucuuauucucugugcuaugguuuuaaguucuaaagcaaucucaccuuuagaaagccuaaguaucagccgggcucaguggcuuacgcguguaaucccaggacuuugggaggccggggugggcggaucaugaggucgagagauagagaccauccuggccaacauggugaaaccccaucucuacuaaaaaugcaagaaauuagcugggccugguggugcacgccuguagucccagcuacuugggaggcugaggcaggagaauugcuugaaccugggagguggagguugcagugagccgagaucgcgccacugcacuccagccuggcaacagagggagacuccaucucaaaaacaaaacaaaacaaaacaaaacaagaacaaagaaagccuaaguaucucuggcuguuagaguggggaaaacaaucgacauauugaggggacggauauagcuuguccuuuuuacugguucagagcaguucacucacauucuucugcucaaaggcuucuaagaaacaauaacuccuuugcaauaaaggaaaacugaguuuggagauguuuaccagguaaugaccuuaacuuuucugagguaccuaggaaauaguuaaauguaccaggaugguacauaaauagagacaauaauuaugagacuuuuagauagaagguccaaacucucuuauuuaugauauuuuuuuauauuaggugauacaugaauuuuaaugaaucugcucuugcacaauguaaaugggaugcuuuauagaagugccauuuuaaugaaguuucaaaagauagaauauaugugaagguacuugcaaacuauagcuauccuaaauuuaagaaucaacccaaagaucauaaacaaaaauaaguaacagcauucauggaaaacugucucaguguuuuaauccacauauuugguaaagcuuuaaaaugaaaaagaagaaaguuaauuugcacauuacaaauucaaaagaugauagagaauuaacacugaauaaaacaauaaauaggaaaucuauaugauuaauaaauaaaacaccuuaccuuuuauguagguuugucaagaucauucuucuccagaaacuuaaaaagaauagugguugcguccuugcuguuagaaaaugguguuucuuucauugucuguggauuuaaacauaggcuuaacggugcccaccuuccucgugcugcacugaccaucccacuccugggucuuguguuggcugcugaguagcagccauguguagaguugguggugauucuugaaguuugaauuucugccucucuuccugccaggguacccaaaauuuuacucagaacuagcucaacuuuucucauaguuucuucuauagcauggcagcagcugcuguuauuuccuacuauucuggaauacuaauaugccuuggcaguauagugaaacaaaaauuaaucuaaaaaauaagcauguuaaaagacuagaugaggccgggugcgguggcucacgccuguaaucccagcacuuugggaggccgaggugggcagaucaugaggucaagagaucgagagaccauccuggccaacauggugaaaccccgucuguacuaagaauacaaaaauuagcugggcauuguggcacccuguaaucccagcuacucuggaggccgagacaggagaaucccuugaacccaggaggcggagguugcagugagcugagauugcaccacugcacuccagccuggcaacagcaagacuccaucucaaaaaaaaaaagacuagaugaaacuaaaccauauucucaugugucagcuggaaucuagaggacucuggcccuuuggggcuauucuugaaccacauucuagagguuauuagaacuacaguucaaggauagccagagaagggcuggaaugaccuggaaagguucagugcaaauuguuacaugcauaugacuuuccaagcacauaauagauggcuguaaacagaaaggaaagaaggauuaguuauuuuauucauagcuuagaauuuagcuguaguaacauguuaagcugcacggaggggaagaaggaucacuacuauguuggaucucaaaaaacuccgaaagguggaaaugguucuggacaaagcaaggaaugguaucaaggaugaauucucuuaacccagaguacauuucuuuuuagagagagugacccauuugucuaacuuugcaaaacagacgaauuacuugaaccuuugccauugaugugcacauccagugagggacaauucaucuucuuagaaaaacugacacacauugcuucauccucauuuuuuagaggcuccauagacaacuacaaaugugcaaaaguugggaguacaucuuuuucacaaagaaaucuucaauucugcccuguaggguuuuuuccacaaccaucuccugugaucuuucaaauugguucauuaaagaucuggguguucugaaguaauucuuugguguggucuguaccauuuguggucagucuuauuugugguuuauauuuggccagagcauccacgaccucaaaagccuuuuccagaucucuguguagguuuuggcaacuucuuuguacucugaauaaaaaaauacugcccugaugccacaucccaugaaaguugcaaauucuucuuuaacuguaagagcuguuucuuaccauguucuacccagucuuccuccugguuucaaacuguucguaauauuuuggucuaaccuuuguuuggaggcuuuaggguuucuuguuguugucuuuuuguuucauuuuauuuuguuuuccugguuugaaaugcagauuauuucucuagcuuuuuacauugacuuuuuauucauaggagaaauauaugugugcacaucuacccacacagauacuguuuuaguuucacugggacauuugcccaaaggcagaagacagauugcuguugcagaguuguagauuauuauuauauuuagcaagauagccagcuaaauccuaacuuacuccacugggugacucccugggauguuauuuucucuaucucugaaguuauuugagcaaggaaagcauuucuuuuaugcugucuauauucuguuuuauuugguucauauauuuccuuggauucuuuaugcauauuuuauggcacugacuuucaagaauaaagauguaguugagaggcaugucagagucgaugguuuguuguuaauugauaguuugauugauuaauauaguaggauuuuucugcuugauccugaccuaacccauuggcuuucuuuaguggacaguuuuacaaggacaguggcaggugcagggaauugcccacuucagcagggcucugacauacuugaucuguuucuccuucccucaggaaaagcuuugccagcagaaguauaaugucuccugcauaaugaucaugccccagcaccaaaggcaaggauuuggacgguuucucauugauuucaguaagugaaguacuuuauuuacuuucaugauccaggaagcugauggccguuacaggaaacaguaaaauauaaaacuuuauuuaaccugcauuguuguuuuuaucaauagauaaugggcuuucuauuuauauuuacauagguuagaacaucuuccucaagugaaaaauguacugcugcucagugauuguacucuaggaaauugagacuagaucucucggcagcaggccucaugcacaaagccauuacccugaaugaaccgacagaauuacauuccauuuuguggugcucaugcucauuagcaccaaaagaggcaauuauuugugauuaaagcuaaaggaaguauuauuugaaaggauuuucagcucucugaaauuuugccuauaaucuuguacaguacaaagcagaaaagguauauuuccauuuagaaaaauaauuuucuaggcagcuuauccugggccuugcuaguagaaauaacucuuaccuuauuuuguuaauuucccuuuucuauuauggaaauuaauacaguguuuguaucuagagguuucccaagaaauauuuaucuuauaugcacucauaucuucugaaccuucucaguuaaaaccggcauaauauauaaaaguaugcacauggauaauguuuuuaaaaaugguaguuuuuuuuuuccuccuuguuuauauuauacuggauguguaaauguuguguuagggguacauuuggagaaucaauucaaaauaucuagauaacaugaugaccagauaacccaugauaauagucauuucucgucauguaaaaaucugucacuggccgggcgugguggcuuaugccuguaaucccagcacuuugggaggccaaggcaggugggucacaagaucaagagaucgagaccauccuggccaacauggugaaccccaucucuacuaaaaaauacaaaaauuagcuggaugugguggcacacaccuguacucccagcuacuagggaggcugaggcaggagaaucacuugaacccgggagguggagguugcagugagccgagauggugccacugcacuccagccugggugacagagugagagacucugucucaaaaaaaaaaaaaaaaaaaaaaaaaaaaaaaaagucugucgcuaggaaccaggugcuucuugauuaccagauugcaguuuaucugauuauuaacugaaaggaggaaaauuuaggacuuugcacaaucuucaucagcuacaucagaugcaaaaaccacaauguaaaugcgcuuacagaaaaccaugaagaaauauagugaaucuaaaucuauauuguuagguauuaaaagauuaaggucugauuaaaguguaaaauaacugaauagcaguuuuggacugauuuauaugauuuauugacauugaagaauaugauucuuuuaaaagaagaauuuugauuauuuuucucuuuuuagauaauauuuuuaguuauuuauuaauuacccuagucuuaucuauacuuuccugaccuaauuauccaugaaaccaguaaucccaaggagggccaccuuaccaaaugcaguguaccauuuuuauuuuuauagaguccuagcuguaaucauuucugagggcaaaaccauuuaucuuguucucuaguuuuguguggcuaccauucauaaguaguucauaaauauaguuucugguaugcauagcagccauucaagccuuaaauguuuggucauaucuauaugccuacagaauaaggcaaacuccuuagcucaauauuuaacgucuuccaacaucuaguuccagccuguccuuuaggcuuuuucaucuacuaaucuccuuuuucucaaauagucugagcaugguccuauaccucuauuuuuuugucuauucagucccuuccuugaaaugaucaccucguccuuuccuagacuccgucuguucaaaauccugcccauuguuaagagccagcucaagaaucucugcuuuuugaucccaccuccuggaauuuuaucucauaccuuuauuuuaucuuauaccauauucuauaugguaucacacuuacacucuguucacccuuuuaugauaauuauugauggagguuucauacuuccaacuucucuguauccacuaggacaguuuccuuuauaauaauauguauuagaugauauaaauuaaauuuuauugauauaaacuaaauuuccaaauugauauaugguugcuguccacaaucauugucuaccuaaaauuaaaaaggaacugguacuuacuagguaaaaguucaagcucuaaauucaguaguaucuuauuuguacagcaugaucuggcacuaaggccuucuacauaagagaacaaucuggguaacaaauacauuaucuucaaaugcuaugucuuuuuuuuaaccauuuuagugaaaacuguuacuagaaacuaccuuguauuauuaaacuacagaacacauugaaaccuuuucucaguggcuccaggccaccaugaugaaugcuguccaccaggaugugagcaggcaaaguagugcugagggugugguuuuuuucuuuucucuuuccuguacaccuagcauugccccuacuggagugaguuaagaagugcagugaaagauuugaauaaaguugaagagacugguguuauucccucagagaaggggaaacuaggggaagaauuuuauagcacucaaagaaaaugggaacugguguaaacccaauagaaauucaguuuaaaaccaaaagaauuucuuggcuauaaaaguuuuaaggaagauagaguaggcugcugaagaaauuaauagcaccuucucuuggaaguuacuuaaaguaauaguagauaaauaucuuuccaaaaugauugaaauccagccuuugaagguagggaugagucacaugaccucucaugaucauuuuugaucucauaauuuggagcccaggauagaaagcuaacuaggguuacagguuuucuaaaaucugcucugguuuuuuaaaggacuuuuuaaugguuaaauuuauuuuauuucuauuugguaaaugagccuggggccuuuuggucagggauguauuuucaguaagucaaaugagguuguaaaucagguagaucuuuauaauugccaguuuaguaagcugaaacacgauacgagcagggagaaagauauagccgcccacuugcacacuugaucacagacauggguggaaugugaugcacuguguguauauacaugcuccuagacuuacaguggggcugugggcugauaaacccaucauaaagugaaaauaucauaaauuaaaaauacauuuaauacaccuaaucuaccaaccaucauagcuuagccuggacuuuaaaugugcucagaacacuuacauuacccuacaguugggcagaaucauccaacacaaagccaauucuauaauaaaguguugaauaucucauguaagaguguuguaccacauaucgcuagcccaggaaacgaucaaguaugguuuuuacugaucauaccauaguaaaguugaaccaaguuguaaguuguaaguugaaccaguuguaagccaaggacugucuguauaaagaacugcaaaugcagggcuuugaacacuguucuucagggcagcagagugagguggaauggucauccaugggaccaugugcugcuugcagaguaagucauuuguauaucacuuccuagaccagcuucucugggauuugucagagcaaggcuccccaggaggccauuugcagaguuuggccagagugaguaaagggcaccaacucccaaucugguuauaaacucccuaguggguuuuaugacucuuugcccacaauuggaauggguggaggagagagugacuaucguggauugguugagaacgcauuccuuccucuuggauucuaggauucccuuucucagucagaaaauuugaaagucuuccccaucucugucuguaaagucuuucuaucucucucucccuccguccccaccagacaucucagaacuucagagaacucccuugcccacaaaacauuugcaguuccuacuucagagccucacaccgucaaggcaaggagcucuucuucucccagccacugcugagcacugggggcccagagugcucccucccaagcccuggacugcuucugcugcuggggcugcccagcaaugccuuauccaucucacuauuuuuuucuuuaauuuugaaauaauuucagacuuagagaaaagcucuaagaauaauaccaaaauuucccguacauuguugcacauguucacauuuuaucacaucuguuuucugcucuauuauucucaaucucucccuuuguuucucuucucucucauauuuucuuuucagaaucauuugagaguaaguugaagauguguugcaccuuuaccccuaaauauugcaguuuuucuacaaagaugcucucauauauagccacaauacaaauuauuaaaaucaagauauuaaaguaauuuaugcacauuuguucaaauuuuaaauuuugcgagauuauacugauguucuuucuggaggaaaagaaaaaucuccuacuccaggaucacauggaguauguaauuaugucccuggggccuccuuuaaucuggaauaguaccugcuuuuuuguuuuguuuugcuuugcuucguguuuuccaugauuuugauauuuuuuaagcauacaggccauuuauuuuguauggugugccucaauuugggcuuaucugauguuuccucaugauuagauuuaggcuguacauuuuuuggcaggaauaccauagaagugaccguauguccuucccagugcauuucaucaggaucauaugauaauacauuugucucaucacuggguuaaggugguaacugccaggcuucuucacugugaaauuaccauuuuucgcuuuguaaucaguaagcaucuggugagaagauacuuugggauuauauaaauaucaauucucauccaauuuucaccuccuaguuuuaccauucacuuauggcucuuaucuaaaauaauuauuacuaugauaauuaccaaaugguaauuuucuaauuccauucuuucuacaacuuacuaauuggcauucuagaaggaagaauuauuucuucuuccccauuuauuuaauuuuuuuguauaauuguggguuuuaauuuuauucuauagguuauaaccugucauuaccaugauugauuuugauguuccccaaacaucaaauugucccagauuuauuuaucagcaaauguuucaaguggguucuugugccuuuuccacaugcuuccauccuguggauucuuccuuccuuucugccacagcaugauguuccagguuuagcuuauccuuuucuuaagccagcccuggaaucauccauuucucccaagccuugguuccuuaugguggagaacaguaguuaggaaccaggaucugggcugggugagguggcucaugccuguaaucccagcacuuugggaggccgagacaggcggaucucuugaggccaggaguucaagaccagccuggccaacacggugaaacccugucucuacaaaaaaaaaacacaaaaaugagccgggcuugguggcaggcgccuguagucccagcuacuugggaggcugaggcagagaauugcuugaacccgggagguggagguugcagugagcugagauugcaccgagcugagauugcaccacugcacuccagucugggugaaaaagcaagacuucaucuguuaaaaaaaaaaaaaaaaauggaggaaaccaaguucugaucacuuaaaugugcccauugcugcuugggugucacugcuucuagcccucucagaggacagagcuaggauagcaugcauauuuauauccauguaugugcacauauacauauggguguuauaaacacauaugcguguacacacacacucccuucaugaguucagaccauuccagaucugcgccaccauacgguuguauucugucuuucccucuucccauguaauuccuuucucugacagugagaacccugacuuccauuacccacaauauacuuaugugcuacacccuagaauacacaguaaguaguuucagaauuacuaacucaugccauugugaaaaacaaaccucuuaaguggaggucaauauuuauauaugguuccuuuuggcuuuaccccaaguguauuuagucaaaacacuguguuuaaauguuacuagaguuaguuuuucucccccuucaguguuacuguaguauucauuggaauacaauuaggcuuauuuguuucuguuuguuuuuuauuuuauacuuguuaccuuuuuaaauuagaauguaaaacauuaacaugauuuuaaaaauggaaacuguauuaaaggguauucucagugaaugugcccucucuacccauucccauucccucauccuuuccugcaggucuccaaucucauuagcuuguaguuuauccuuccuguuucuuuguguacaaaugagcagauagaugugcauuuuucuaauuucuccuccuuucuaacacaaaauguagcauacuauagguagucuuuugcauuuugauuuuuccaguauauccuggaaaugacuucauagagauuucuuuucuuugacagcugcacucuacuccguugcaugcauguauacaguuugcuuaccugcuuuccuauguauggguuuauagguuguuuccaauauuuugcaguuuaaaaaguagugucaugaguaaucuugggcauauuuugacugauagauacuuagguagcaguuauuguauauuagauauccuuucaguuguuaggacucuguuuggcuagguaauaagugagcagauaaugaauugucuuuuacucgggccugcagagccagaacccuggcugaugggcaggauacaaaacccguucuccugggcucugacccaggagagaccgagggaacaccaacugauucagcaguaggugagagaaccaagugccagaugguggugagggagguggcaccaucacucacauguguguuuguguauaugcauuuaucugaugccaaacuggaggauaaaggaagaugcgaagagucauguccuucauuuuuuaccucuuuacuuuaaccuuauugauugggauaccacacucuacauucugcuaaacaucagcaaccaaaagggaagaagacauagcucuugcugggcugucaaguucacugacaaaucaacaaauguugcauaguauuuuggacaguaugccuugagagcucauaagaaguugaaaugaaaacauucuaggcagaggggagcagcauauucacaagcaugacugcgugaggaagcauguuacauaccuggguaacuacagcagaaacuccagguagauuaaagacuugauuaccaaaaaacagacacacagaaacacuuaaaaagcuagaggagagguggggugcgguggcucacgccuguaaucccagcacugugggaggccgaggcaggcagaucacgaggucaggagaucgagaccauccuggcuaacauggugaaaccccgucucuacuaaaaaugcaaaaauuagcugggugugguggcacacaccuguagucccagcuacucgggaggcugaggcaggagaaucacuugaaccugggaggcggagcuugcagugagcugagaucgcaccacugcacuccagccugggcgacagagcgagacucggucucaaaaaaaaaaaaaaaaaaaaagcuagaggagagauuauguauaauuauuuaucugaucuuuggauggucaaggacaucauaaccaucaaagcaaugaaagaauaugcagauagacuugacuauauaaaaauauagaacuucuaucuaguaaaaaguauuaauauuuaaagcaaacauaaugagaaagauguuugauguuuacaacauaugugcuaggcaaaguuuaauaucuauaguguuuaaauaaauauauauauacuuuuaaguuugguagcauuaaaacaaaaacccuaauagagaaaugggcagaggaucagcuaugguggcucauaccuguaaucccagcacucuggcaggccgagacaggagacucacuugagcccaggaguucaacaccagccugggcaacacaaggagaccaucucucucucuuucucucucucucucucccccuguucuccccacccccccauuccccuccuucucucgucucucaauaaauacauaaacaaauaggcagaggacaggaacacagaauguacagaaaaggaaaaucacugguggccacgacauugcugacauuuacugagugaguaacaugugccaaccccuuuccuaagaguccugcauuuauugauugauucauucaguccucacggcaacaguugagauaugugcuuuuagccccauucuauggguguugaaauugaggcacaguuacacaaauaaguugcacagcugcaaauugaacccaagcacuuuaacuguuagccacuccacuccgaagucucuuagguauaauggcuaauucaaauaugaaaaaaaaauuguuggugguuuaaaaaugcaaauuuaguaacugcaagauuacaauuuuuugccuaccacacuaacaaagaguuuacaacuuacccaaaucuaacuaagcugguggaaaauggacaccuuauuuacacugaagaaaguguauauugguaggcauuuucuggaacuuugacaguguguaucaaaaacaucuaaugguuuuuuuuuuuaauaaaauuuuauguauuuaaaaacuaggcuggggacaguggcucacgccuguaaucccagcacuuugggaagccaaggcaagcagaucaccugaggucaggaguucgagaccagccuggccaacaugacgaaacccugucucuacuaaaaauacagaaaauagccgggcguggugaugggugccuguaaucccagcuacucgggaggcuaaggcaggagaaucacuugaaccugagcggcggagguugcagugagcugagauugugccauugcacuccaaccaggugacagagugagacuccaucucaaaaaguaauacauaaaacaaaaaauagagacagggucuugcuauguugcccaggcuggucucaaauuauggagcucaagcauuucuccugccuuggccucccaagugugggauucaggugugagccaccgugcccagccuccaaugguuauuuucuaaaggaauucauucuagggaaaucagcauauuuuaaucaacaaacauuauuuucauaguuaauauagcaacauuauuuuguuucauauuauuauguuuuaaauaguggacuucucuuuuugccucccucccccagccccugauuauagcaauauggacucauaguagaaaguuaaaaaaaaagguguaauuaauagaagaaaaugucacccagagaguuaauguuuugguauauuuguccuucacacucauuauuuacaacagguaaaaaacuaaaacagacuugauauuucaaaggcaagagagaaccauucccacgagaaaguuauggcacauccauauaauggaauauuauuagcugcugagaauuauguucugaccaggugcaguggcucaugccuguaaucuuugggagacugaggcaggaggaucacaugagcccaggaguucgaggccagccugggcaacauaguaagaccccaucucuacaaaaauaaauaaaugaaauuagcugggccugguagcuugugacuguaauuccaguuacucaggaggcugaguccuccauuaaggauggcuugaucccaggaggucaaggcuucagugaacuaugauugcaccacugcacuccaaccugggcaauagaaccagacccuguuucuuaaaaaaaauuaucugggaauuuguaaugcuugugauaagcaaguggcuuucaaaauuauauauguaauauguucucaauuauguaaaaaauaugcaaagcaaaacaaauacauuucuagaugaccucuggaauuagaauuacagauacuuuuuauuuucuuauuuauacuuuuugcuguaacuaaaaagaaaagaggccagagucaauggaggccugacagugaggaugcauggaaaagaggcagguccuguucguuccguagcaggagcaugccuggugcagaguggugcucagaaaauacugguauuuauugaaugcauaacugagcuuggagagauagugagcgcagcuuuauguagcuuucacugugcguuuggaugucuacgugcacuuugcacagacuccagagcucagcagggggucugcauuagagggagcagcugggagucguggacaugcggugguagcugaaaccauggaugugggugagggcaaccagggggaaguguauagggaaacagggcugaggguggagugcuuggaguguuaacaucuaagggacuaauaaagaaugaggagcucgccaaggaaauuugcaaagggcccagaagucagaagaaaauugggagauaaugguguuaggaaaaccagaagaggucaguauuucaacaguaacagucacaauaaucaucauagcugccacuucuagagcccuugcuaugugucaggcacuguuaccggaauuacacacauuuacucacuuaguccucacggagacccuaugggguagguuacugugaccaucucucuucugggacgagacacuaagagacuugucuaagaucaucccccagagauucagugccccagagagaaagucauaagaaguauucuuuggacaacuguauauuaagugcgauuaaaaguagauucaaaaagcuuuugacuguuuuauucuguuugguugggcguagcgucucacgccuguaaucccagcacuuugggagucugagguagguggaccacuugaggucaggaguucaagaccagccuggccaacauggugaaaccccauuucuacuaaaaauacaaaaauauggaugugguggcaugugccuguagucccagcuacucaagaggcugagauaggagaaucacuugaaccugggaagcagagguugcagugagcugagaucaccccacugcacuccagccugggcgacagagcaagacucugucuuuuuuuuuuuuucuuuuuuuaaaacaaagcaaaacaaaacaaaacaaaagcuugacugucaagggcuggggacacaggaaccuaguugucuuuauuuuuaagcuggagagccuggagcauguguauguacaucaguagggaaaagaaagagcagcgcugauggaaaaaaucgaggggaaaacaaaaagcaacauccaggcaggugguuuauuacaaagucugaucuggcauuugaugaaauucaacauucucuccuaacuaaaauacuuaaaccuacuaacuagaacuauaaggguucuaaaucucagauuaacuuuuucuuuuuuaucgggggcagacggacguguaacuaacgcuauaaaggguaaaggacagcuggauccaagucuacagacuuacgucuauaguuuuuagagaccagauaaacuugccauuaauauuaauuaauggcaaguucgucaguuaaguuaaauaucaguuaauuguacauucaggcauuucuaaaauuaguauguuuguggaauaaucauaaaaaugugucagcaguuucaauuuuuggcuuucuuuauucaguauuaaaauauugggcaguccuucauggaacaaggcuguaacuauaggaagcagaagugauugaaugaauuaggcauucacuucggggaauucccuuugcuggcucuucauauguugaggguuucaccuuagcuuuugugagguccgugugcuauuuaaaaacugagucuauaauuaaucagcgcugcuagaagauggugcaaauggcccaguuuugugccuccagguuaugaauuuggcucuugucuucagugugguuugcagcguccuucuacauguccccuuuuuuagaaaugauacuccccuccaccccugccccccacacacauauacagccaaccggauuuaaggaaagcaggaacuacaauaaacuuuugaggaaagaugcuuuaggguaugauuuaguaccuuaguuccuuucucacuugaguauuaaucagugugguuuucugcaccgucguucuuuccuccucugguuuaaugacagagauuucuucuuuaggugccacaaccacccacguccguagagauccccgggcuuguuucuccuuuagccucugaauaguucuuggcugauuucuugaggaagcaccgcauuggaagagaaaagcaucuucucuuugguuuccugcucccugcuucucugcccuuuuaaguccauaaagcgaauuaggaagaaagccacauacuucauuucuacccagggggguaucaugucaggaggcuaaucauauccacucucucagagagaaagcugcuucuucccagaaucuuagaugcaagcuacugguuuaaauguuguauuauaugauggcuaaauacagaaguacgugucauaguaguucagguugccagcuacuacuaguuuucacagucugccuucagugggcuauuuuguuuaaaagagcuuccacuuacaagcuuuucaaaauacaauuuaagugaaacuuaagaguguuuuuaaguagagacuaagugguuucauccuaccugaaaauugccuucuugaaauaaauguuugauacccacuggccuaucuccucuggaaaacaggaguuuucauuuagaaguccaguugguuggauuccaguaagccguuucaccugacuguauuacgcccccuggaaccagggcugugcaggagccaccggcuucucccagagggcagggugagcacaguaucagggcacauggcuuacccucaggagcugcaucccagccucaaggcccuggugagaaacugugcucuccagcaagggucucuggccgucucugcaccguguggucagcuuagggcugugccucccaagacaggaccugaggauggguauggguagcagagauauugcucccuuugcuccuggguguccagagcuccagugccugucaccucaccucuagcagccucaggagcuguguaaauucugucauauacaugaugagggagaucaugaagcacucacuugaaucauaaagucugucugggggaggcugcagaguaaauauuccacuuuccccacuuacaggccccacaaacaagccucagaaauguguuuggagggaccaugacagcaucucuuagggacuuguguuauuuaguuuucucucucucucucuuuuuaguggcacuaaccaaaaaaaaaaaacaacaacaaacuaggcuaagcaagugcagagucauuuauaaacuugcauaggucuuuuauauacagucauuuaucauuuaaaaacugagauucauuuugagaaaugcaccauuaggcaacuucauugucgugugaacaucauaguguauguacuuagacagaccuaagucgaagucuauagguuacuacacaccuaggcuauguggcauagcugauugcuccuaggugaccaaccuggacagcaguuacuguacuggauaccguagguguuagugguuguaacauaaugguauuuuuguaucuaaacauaucuaaauauagaaaagguacaguaaaaauaugcuguuauaaucuuaugggacuaccauugaauaugugguccaucguugaccuaaacaucauuauguggugcaugacuguauuuauuguugauugcccaugucuuucaccaaaaguaagcuucaugagaguguggacuuugcucuuugcugcauucugaucuucuagaagagccuggcgcuuaguagguucuuauuaauuguugaacaaauguuaaauuaauuaugacgggaagaacuuuuaaaaugugcuuucccuucuagugugugauucuuagggacaauuuuauuuuauuagaacauaaaccaucagcacugguuuacuuacuuccaaaugaugcuagguaugcccugucuucuuucgaggucugguacuuuugcugaaaugcagccucuaucuuaagaucauuucaguugcaucagaaagaagaugucacugccugcucuaaaccuugggcggagaaagcagagcugugacauaauccacauuuguacauagcagguugaagagacacuuaaaucuuuugcuuacuuuuucucuuaucagauaauucauuucuugauugcauuuauuuuugaaaggaaaauaccagcuuuagccauaagaagcugucaagaaagcuucucuuugcuuagccuucccagcagcuacgcuccugggugagugcagucaaggcaaucauuaaagaauaauaaguuaugcuuuugaaauggugcucaaguacuucauagccuuuucuaagauaaggagccucccaccuuugcccccaugacacuuguuggaaaauacuggaccagcagcuauauccuugggcuuuugcuggguuuuggaagacacauuuugaccuauguaaucaaguauaaugaugacauuuauuuuaauaggauucuagucuguaauauaauaaggaaaauggcuauuuuuccuuauuuucucauuauaauauguuacacuaaaagcuucugccauuacuguuuuauuauauuggucugagguacaauauauuuuaauaugcuaaagauaacaucaagguugaaaauugagcucucagugauuuauucagagguugacuguugcugaaugcauugaaaugaguugcaugagacagugcggcuaacgauuuauuuguguaucuuuuuuuaagcuaagcuugucauaaauaagagcaaauaaauagcucuuauagaauaguuuguauucauugccucaaugaaaacauuguaaauaugaaacauacggucugcagucucucucauuuuuucugaaagcuaguguuuugccuuacauagcucagaauuuuuucaaguuuuggcaugcaggugguugguuuuuuuuuuuuaccaaacaaauuuuuugucuguuuggauuucuaacguugacuggcauuugcauugaguuauuuugaaauccacuacuggacaaauuccauucaaauaauugguaugagaauaaccuaaucuucagcagaacuggaacaaaaugaaaccuuagugggaccaucaagagggcaggaacuuggucauugcuaaacuccaagccaugagcacagugccuagcacauagaggauacagaauaaaggauuguugggggaaaucaaugaaugccugagucuaguuaauccacuucuuuguaugacugucaacaccugccagaugcauccagcuagcuuuugaccaguagugcuuaaacucagaucuccucucagucuuuguuuuuuacacuuuauuuaucccuucaucccauccuucagcaaacaugcuuuaaauacacugugccagggauggucuaggugaugaggacauaaggaugaaugauuuaguccuugcccauagggaaguagagggucagacacaaaauucuucccaguccugcaauuucaaauuucagagaggcuguggcagugcagaggaggaaaugcuuccaacucuauuuuccauuuacccaguuaagauauauagaagagacgcauuuuuccuugcuuuucuuuuuaaagacugggucucacucugucacccaggcuggaguacaguggcgugaucauagcucacugcagcauugaauuccugagcuaaagugauccucccaugucagccucccaaguagcugggauuacaggcacaugccaccauuccuggccauuuuucagggggagggguggggggucagcuagagacaggcucuugcuuuguugcccaggcugguuuccaacuccuggcuucaaguuaugcuccugccucggccucccaaggcacugggauuacaggugugagccacuaugcccugagcuguuguuaaaacaagaucaagaaagauuuugcucugcuugguugaaauuagugcuauaccucauuuggguuucaagagaacuauucccccuugaacauauauuccagcuuguaauagagacauuauguuugagauagaauauucuaagauaaaaguuugcuuccacuuaccccucucaugauggcauuucguuuuuuuguucuuuuuuuuuuuuucuuuugagaccgagucuugcucuguugcccaggcugaagugcaguggcacgaucucagcucacugcagccucugccucccggguucaagcaguucuccugccucagucuccugaguagcugggaucacaggcacgugccaccaugcccggguaauuuuuguauuuuuaguagagacaggguuuugccauguugcccaggcuggucucaaacuccugaauacaagcgauccacccaccucagccucccaaagugcugggauuacaggcaugagccaccacgccuggcccuaaacaacacaacuauaacuucagcugguuguaagguaguuuuuugguugguugguugguugguuguugguuuuuuguuuguuuguuuuuaaauauaauuucauauuggguaaaacaaaagguuuuccuuaacuuguuuagaauuguuuaggaaaauacuaguuaggaaucugauuuuuuuucucccccauggauuugugguuagcauguuuguacucuaauauucaugcuacauuuucauguuuaccaauauaaaaaccuuuuuuguaauuauuuauauggaguccugcuuugaguuaacaucauagaggaacgcuuuuuuucagcaaaauuguuuuaaauuaauguuucuaaaguguauaaaaaugguuggguggauuaaaagcaauucaguuucacaugaaccauuuguccacauggaaauaaauaugcagcacaauuacacggcagaagguacgaaaagguguugcugaaaucaugagaaaauguaauacaggcggacgucagucuccacaauaaauuugcauauguccuuuuuugggggcaaauacagucaucauuuuaaaugaagucgaagaguuauuucuguaaacaaaacaaaaguccuccuugucauacuagacagcaaggaagcaaaaauuguuagggucaugucaaaaagacucaggagucaauuugaagagguucugaccagacaauaaauauaauaauaaagauaaaaaauugcaauuuauugcaacuugucaaauguuuaaauucacaaguucauaaugauacuaaaaaacaaacugauuuagaggauaauaggaaccaguuuauuuucuugaaagcugcaaaaauugcaauuaaaacauuuauccugccuuucuuacauaaacuguacagugaaguaaucaaguaguaaaggaggggaaacaucauuuuauuuuuuaaauuuuuaaaaauuuuuugagacagggucuugcucuaucacccaggcuguagugcaguggugcgaucucagcuuacugcagccucaccuccuagacucaagagauccucccaccucagccuccugaguaacugggacuucagguaaacaccaccaugcccagcugauuuuuucauuuucuguagucucuuuauguuguccaggcuggucuugaacuccugcgcucaagcgauccaucugccuuggcuucccaacgugauaggauuacaggcaugagccacugcaccuggccagaaacaucuuuuuauaaacauauuccagcuaaccaaugaaaauaaaauguacgguggcucacaccuguaaucccagcacuuugggaggccgaggcaggcggauugccugagcucagggaguucacgaccagccuggacaacauggugaaacuccaucucuacuaaaauacaaaaaauuauccggguguugcggcaugcaccuguagucccagcuacuugggaggcugaggcaggagcaucccuugaacccgggaggcggagguugcagugagcugagaucgugccacuguacuccagccugggcaacagagugagacuccaucucaaaaaaaaaaaaaaaagaaaagaaaaugacagaauuaaaauauaaccauuuuguaauccccaccaccaccaugaauuaauggaucuagacaaugaacaacaucaacaguugcaaaaaggacaaccagaaauuaucuaucuucugaucaaggauauuuguagucuugccaguggauggaacccaagucuaaucaaucaagcacuggaucuaguuaccauuuugcaagagauacagaguaaagaggagcauacugagcugcagugcaaguaggagaucagcaaaauccagagugaggacaguauaggucaaguggccccaguucaaccacagauagauuacaaggaaaagaaaggggugaagguggaaccccuagauuaaaaugacauuaagauuuuuuuuuuuaauaggcaagacuguucuagugccuggacuguuuuggugaugaaaguauaaaaaaaugcaagagauuauugugaaagucaggauagugguuacuuaugagagagaaaggagaggugauuggcuggagcggauagaaaguuuucuggaguagccggcaaacuucuauuucuugauccugggugauaguuacaaggacaguugccuuauaauaauccauuaagcuguguauuuguuuuuugucauuuuauguaucucuguuuuauuuuuguuuuuuagaaagcaaucaucuuaaaaugggaggugacauccuaugguaucuuagugcuuggguuuuuguaacucuugaaacugaaaacuuacucgauuuauugguggcauccuacuagucauguuuuaaagagagacacaguuuucaccuugacugcuugaaaaugaaaacuugagugcacaaguauuuaguguacgggcaucaacuccaugucagccuuugcagagccauuuuuaugugaaggaaauguacugaaauuuacuugaaucaaauccucugaaguguugagucuaguucauuagagaacagcauuccuguaaauuucacuuucacucuuaaacuuagaaaaacauaauugaaggguugugcguuaacagaaugaggaugaaauggaggauucggacaaggaauggugaugcagagugaggauggaguacagagaaaauauuuaacugugagcccgaggagagaaagaagagacacugcagcaugagaacuguuuucccauuuuucuuuuuuugugggaagaacagcaccagcagacacuguaagauguguacaggaaaauugcucuuuccuccuccuagguugcugagcaguucuaaaauuugugguagaucuuuaggcacuagaaacagaacuuagagaaaagauguuaaaaguuagauuuuuaagaaagggaagaaaaaggcuacgaugacuuaaaauguccugaaaugaggcucugcuauuuaucagaaaaacaggcuuccuucuucuuaagaaggugauugucuguucauagacuaggaguccugcccugggguucacccagcguuggagcuuuucuccaugaaguuaaggacauuaauaagauuuuucucuaccaaagcagaagaugcucugaagacagccuuucaucccuguagcuuuugaguugcauccaguuaaaaacuuguagaacauaaugaauguuuuuagagaggaaauaaaaugaaugaugcccgugaauuuguuuuaaacauuguuuauuuuaccuaauaauuuauauaaaucuuccuugaagaggaagagaaauuaccagauuuaauuaauaauuggaagcuuuuuagaggauuuacuuugaaauaccucccugccaauuuuucauaaauuaagcauaaacuuucuuugaccucaucacacauaauuaaauagcuguggaaggguuaaaaccaacuaaaaagcaauucuguaucucaaucuccauucuccugcaaaacuuauacaggaaguuuguuucaguucucaagcaggguaauuacaagagacaguuacauaauuuacacuuccaaucuacuugucuauaaucacacacuucuaccuaguuguauauacccccaugaguauguguguuguacuuugauuuguaaaugaugauugcagugugauugauuccuugcaauguagcauauugaauucauuuuuuaaaaaugaacuuuagcuguuaacaugucuauuugaguuccuguuauuuacguaguuugugguucuuguguucagcaguugcauaccagcuaacaaauuaaacucccagagcuuuuuuucucauuaaauuuggaaaauagagugucuguauacaaccuaaauagaaaaguaccuaguaccuaguaggcacucaacuguuggacauagcacaaaaccauuucaagccuuugcagguggaauggagauucuuugauuaacauaauauaaagucucauggggauaauauuaguauauuguggugaagcucugcuaauauuaauguauuguuacugaagucuaaaauuuagccaaacaguggacagaauagcgguucauuccaggggcuuagagaaaugugucaucuacaaccuaagagguagucauugcugucuuuaaugcugcuggugacgauacugcauauguguuuguuuuucuaacagcuaacaucuacuguagccaguuuggacuuuaagauucccuaagauuaaaggcuaagucccuggccgggcgcaguggcucaugccuguaaucucagcacuuugggaggcuggggcaggcagaucaccugaggucaggaguucgagaccagccuaacaugaagcaacccgaucucuacuaaaaauacaaaauuacccaggcgugguggugcaugccuguaaucccagcuacucgggaggcugaggcaggagaaucacuugaacccgggagauggugguugcaaugagccgagaucaugccauugcacuccagccugggcaacaagagugaaacuccaucucaaauuaaaaaagcuaagucccuacaugacaccaaguccaugggcaaaccagccagucacuugucuggccccccucccacccuagcuccgcuacccagggugccuuugugcugcacagcuucagagggggcucagcaauaacccuggggggacacaaccauugaucuccagaggcuucuuaccucaaaucacguuucaaagcauuugggagauaaauaaaaaauaagcgaaaagaaaaguagaccaguggagugggauuguuugucuagauaaccugaggacaacuagcgacaguuucucuuacauuuccaacagugguugaucagucagauuaggugaugggcuguacuuugauuuuagaaaguuaucuccaaaacugacagauuccuuuuugaaauguacuuuguuugaaaacaaagaaaauuucuaaggagauuuguauucucauuuuuucuuucuucaaucuugcuguguauuuuuguuugcugugugaaagcucaucauccagaauuggaauuacaacauacuuuguccuauuuuuaaaaauuacagcugguacauacacacaacacucccuuccacauauacacacagcauuuuagggggcuuguaggagagcaaauggaaaggcaaguugcuauuccaaccauccugucucccaaaccugguucugaaaucagugguacugccaugauuauguaaauagcaccccucucccacccuccaccaucggucugugggguuggaccagaccagaugacuagauauuagaaugaagugucucagcugccucaguagaaccucagaccuauaaaaguaggcaaaagaagucucaguuuuugcauuuagugauuuaguuaaggaaaauguucaaucgcaguguuuucgcagcaggagaacaaucuuaaagguaaagcauuuuaagugcaugcagucauuuguuuggcgcagaugcuuuauuuaaaguguauauguguucgauuaaguuugccaucuuaaagccuuucagugguaaguucuuguuaccagaauuuuguaacuuagacaugaaaauuuuauccaaguuucaacuuggggagcaagccuagggggagccagguauuuaaaaugcuuucuuuuagugaaaacugaagaauuaaguugucuucuauuucaauuguguuauuuucuauuucaaaaacuauuucuuuuuuuaaugaaucucuaauguagacuuuugccuauuuauaagagaggaaauaauuuuaaaaugccaaauuacuucaucuuuaaauuuuuaaaaauaaauguguuuuuccuaaaauauccuagaauuuaaaagugguuugaacuguggaaaacuuaaaaggucaaagaggaagaccuuccucugcaugccuuucuaauuucugucaugcugaaggccauagcacuggggcuuucucauuaccuaacugaaagugccucugggucacaaaucagagcauuaacuuaguuuggugauaggcaaugggcuucgugaacaauuugguuacuucaacaauuugguaagcuauucuuacaucaacauauuuuuaaaaauucuugccuuccccaauuuuaguuugggcauaaaugauacugacagaguauaacaucucucauuccaugaucauuuuaucuguguggcaggugccucauuuuccuaacaaggaaauugaaggaugaaucuauaucauagucagucaccuuauuaaaaaauuuuuauucuucuaauccacuagaccaggaacucgguuguggugacacaccauacacucacaaauacuccucaguugaauguuuaaugaaaugaaacucugugaaguguaucacacaguuguuuacggaguggccauccuccccugcgucaguucagagauuugccugcugcugggauuucucauuaggcaccacugcuaccacuauagcccugugagguggcaaaaaugaagaaguggugcuguaccccauuuaauauucuggcccaaguauagucccccaaggcccuuuccuuacugggacccauaauauaucugaaaccaggcaagucaugagguuggguggaacacagacaucuguggcuuuuuaaagccccaagugagucugaugugcaggcagggucgagaaccacugggcuauacuugaagacagaagaaggaacaauaggccaggugcaauggcucacaccuguaaucccagcacuuugggaggccgaggcaggaggguugcuugagccgaggaguuugagaccagccugggcaacauggugaaaccccaucucuacaaaaauacaaacauuagccaagcauggugguaugcacuuguugucccagcuacucgggaggcugaggugggaggauuucuugagcccagaaaguugaggcugcagugaaccaagaucacaccacugcacuccagccugggugauagagugagaccguguccaaaaaauaaaagaaaaaggagcaauuaauucucucacuggguaagagaaucagguauaaaugccaucucacacagaugucucuggcccucaggcugcuuccauguggcacgugcuauccuggcaccuccggcucaggagcacauccacagaggucuacgcuucucaacacaggggcggugcagagggagggaaguccccuuucgugcugccugaugcccuacuugugaguucauuuucuuucugagcaccuguaccuuucccugggggacugacaugcagaaugaccaaccccgcaagggaguccacaccuacccacagaaccauggaaccaucugguaaaucccagcauggucagucagcucagagacacaggcacaccacacggcaucggggagucacacuccugccauacaucuuccacugugggaguugaaggaagaccauuccacucuggaauggacuugaaaggauggggacauucaguaagaaaaaucaguggcccuuuggggaagagcucagcaguggaggucugcugaggaacuugugggaucccagagaagagagaucuaagaguggggcuuagaguaacaggcugguaugugacccagggcagccagccuccuuccccaaagacaugcuguguccaugcucaggguuucacugggucaggccauuuucccagagacacacuugagucuuguugaauauuugagucuuucaucugucuugggacugucccugggcucugcugaagcccuaagcagucauuguuucugugguuggaugggcuagccauuuccuaaggguaguccuugaaguuaaggacuaaggggccaaagggaauuugggggcacagaacuguguuugcugggaacuuuguugccauuucuuaagaccacuccugaggcagaauuuuuuuucauagccucuuucuuuaauucaauugauaucugggugguuagcuggggggaggggagaggaaggaagggugggaugagaggagagcuucugucugaguucauggaaugguuuuuagguuccucaggcaaaaguaggaaaacaaaguuagcuuuucucaaucugauucuauagagcagucugucucuguuguuucccuucuguccaaauuuuauuucuuuccccuaccuuaaggauguuuaguuacccaaaugaucaccuugagacuugauucauucaguauguugaauaauaaucauagcuaacacuuauuaggauuacugugaugcgucaagcacuguucugcauguuucauauuaacucaauccuuaccagaacuguaacaguuagguacaguuauuauucacaucuuauggaugagggaucugaagcacagagagguuaaauaaaaucccugaggucacacagcugguacaugguggaccccagauuccauucuggguagucuggcuccagagcccaugcuuuccacccacccauagagccucucacgaucugucguauuguaugcaauauaugacauauuguuuuaaaauacgggugcccuguuacccagcuuuaaaaaacucaucuuuguuuagugcacauggucucaaaguaugguucagggagucuacaaggucauaauuauuuuccaaguaguacuaagauacucuuuuuccuuuuuacuuucauuuucucaugaguauacagaggaguuuuccagaaugucaugaccugugauaucacagcagacucaauaccaaagcaaucuaugaaaaucuagcaagcugggugcaguggcucacgccuguaaucccagcacuuugggaggcugaggugggaggaucgcuugagccugagaguuugagaccagccugggcaacauagggagacccugucuucuugaaaaagaaaaagaaagaacaaaauaaagagagaaagagagaaucuaacuggcuucucuuaagccagaaguuaaagagauuuguaaaacauguaaaauaaugccacucuuuucacuauaaauuuuauuuauauuuuagaaaguauaggauuuuuuuuaauuuaaaaaaauguuacauaauggguuuaucguuaucuuuuagaugaauuaauaaauauuugucaaauuucucaguaaaauuaauagauagagcccuuaaaagcaaaagcucucugagugcugaggccaaagcauuugaaaacuaccgauuuaaaguauaaaccauugcuauucaagugugguccauggcacaggaaguuguuagaggugcagaaucucaagccccaccccugaccuacugaaccggaguccaugcuguuaaccagaacuaguuugucugcacaauggaaguugagaagcagagguguagaacaucugcacgaagcgauuuggcaacucagugaccucuagccaaauuucagucugguggggcuuuggcgaguccauucuccaauuaucuugcauccaaggagcugagugaggucuuaccuauuugagauucuucaguccuacugucucuuaaguggccacacccucaucaaagccagcagcuucagagcaggguucuaguggugguuuucaaacucggguacaucagaaucaccugggggacuucugaaagcacagaugcugggcucugccucuccccaccaaagauccugauucagcaggucugagauagguucugagaauuuaaaguucuagcaaguucucaggugauguugaugccacaggucuccacacugagaucuugauaaacagcauuuauucaaguucuuauauaauuaugucaugcccauaggacuuaugggagagaggucuuaaacuuguuucaacaccaaucucuuaaaaguaaaauauaugaaaaauucaaaauuuccgucuuugccaaggaggcaccuguaucuuuuaauaaguggaaagcaguaagauaucaggcaggucacaggucauuuagagcacggcuguucucuuaaaaugaugugagaacuaagguucagcauccuucugcacuaauugcaaaaucaccacaaaauuuaaacgaggagauauaaauagccugucaaguucauuugucauuauuuaaacugauaacaugccauucauccaguuggucagugcugcucugcaccagaaaccaggaacagaugagcguacaaaccagugaauugccaucuccaagcaugagauaacuugguuagagucaucagauuuccugugcucaaaagcugccauaaaucccuggccucgugucuguucccaggcuugcaaacccagugccgucgacugauacagaccuuucagcaggauuugcugagcuaaacaggugucugaugaaaaguguguaauccucaaagauuaucauccccuaaaagcagcuggugaccccaaacucacauaauccagagagauggaaguugggagugaguagcuugccaaaguuuacacuuugguguuugaggagguucauaugguuugguuugguuccagguaguggaagauggaggugugcaggggugagggugucugccccugucgggggagaucccugucccuauccaugcccuugccugagaacauuauucuacuaugguccauuuacacucuugaauacuccuaguuuaaagggaaggaauuuucauuuucaaugagcguuaacauuacaguuauuaugcugggaauuaaauuuaauuugggaauuugggucugcaaaaacauaucuugaccuugucuagauaguuccuuccuuauccuaauagaucugucuacaugagauaacucucuaccacuuuuauuuucucccacugggagagaguuaaccauuucaaacucagggcuaguuaacaugagauuugauucuuuuacugcaaguaguuaagccuuaacagaggugaggcacacucggguuccaugcaguacagcuuagaaaugcuuacuuuuuauagacagaaaucacauuguucuuccuuucccuuuaagcagacaucuugacaauccuuugaauugauuauguggccuguauacugaaagucagaugucaccuuccccaggauaaguacuuccaguaaagcaaaagaggaagccagcuuuugcuacgaucaagauaguugauguggaugagggguuuaugggcuaccccguuuucaauuacaaggcucccacucacagaguaagugcuguuggccagcaccucuggcucacagacaaguuccagggaauaauuucaccagcgauuaauuauacugcagcuacugggauuuguccuccaaacaucacuuuguuuuccaucugaaacagccagguuucuccagggagagcugagguuuucugauugaaaguaucccgaguuaaggagaaguguuagagcaccaugggaaucuauucaccagggguguacuguacuuguuucagaugcuucaggauaauacaccagcuucuaagauaagugcuuuuuuuuuuuuuuuuuuuuugagauggaguuucacucuuguugcccaggcuggagugcaauggcaugaucucggcucacugcaaccucugccucccggauucaagugauucuccugccucagccucccgaguagcugggauuacaggcgcacgccaccaugcccggcuaguuuuguguuuuuaguagagaugggguuucuccauguuggucaggcuggucucgaacuccugaccucaggugaucugcccaccucagccucccaaagugcugggauuacaggcaugagccaccgcgcccagccaagauaaguguuuuuuauuucccugcaucuuagaucaauuauuuggaauuuuuuugguaaguuaagagcuguaacuuaaaccaccacaucucuaugauguacucaauaagugaaauguucuuaccaaaaauuuuucuuccaaugggcuauaucauaauuauguugugaagagccuagaaaaaaauagaggccgggcacaguggcucacgccuguaaucccaacacuugagggacugaggucaggaguucgagaccagccugggcaaaauggugaaacccugucucuacuaaaaaugcaaaucuuagccaggcauggccacuggcgccuguaaucccagcuacucaggaagcugaggaaggagaaucgcuugagccugggaagcggagguugcaucgagcccauaucgcaccauugcacuccagccuaggcaacagagcaagucucugucucaaaaaaaaaaaguacaaagaaacaaaagguggcaagaaauucguuuuuuaaaacaucgcauguuaugagggucagaguagugaagugccaccagcugcagccuucugagaggaagugcugcugcugguucaaauggaauucuguccuacauccaccaagcacgccaguggaguggacaugacacacacuuuucuucuaagcuguacaguuuaacauauuacaagugaguucauuuaacuaguaaggaaucagaaauguaucuuuguucauuuugaucguuuugauggauucuguuuucucuuacgugaguagacuuuguggacuuccaaauggcuccuggcauaagugccaguuccugcuauuaguuccuugagggucucaugagucagagaggagagggaaaaacccacugcaagccaugcaggggucccuucggauaguggccuugugcagucugcagugucggugcacgucaucccugcacacccgccugcugugcucuggcuggagcuuggguuugcaguugucuucuuuacagcacccagggaagcauggccuccuggcagguguuggccacucccugcuuucuccuggccuuugcaagcacagugcaaggguguuugcugaaaaagaccacugggcuuucaguguacccacacccaucagggcugaucacccugcugccaccuccccaggacucuuccgugacuaucagucauagccugaagucuguguccaagggagugucucaggagacagccacuuaacaugguaggaguagcaggugcuaaaagguuuaugccuaaaugcuccccauggaccccaaguugccugcugguuugaguggccuaacccauuuaggcucaggcccugacagggugugugugcaccacuucggggugugaaagcaugaacagcugcggaaagcguggguuuucugaugcuggcugcugcugccuuccggauuagggacuguagcggggagacagaacaaaggaacacaugugcuucuggguaagcuggcccaucauagugggggacauaagguaugggggggcacauaccaccuugguaugaacacuuugguuguacagaauucuuucagcaaggcugagaggaguggggcuuucuguccuugacugcuggauucaaauaagcaccaguagaggaccuggggacuuucacacucacugcaggggacuuucaauugugggaucucauggacaaaagggaaugguucuauauccacggcucuaugguucucacccccccaggaguacaaagcugggaccccccagccuccuggguacguuucucagcaugugccaagcacuuuggaggcaggugacggaugugccaauuaucuguauucugaggugugggcucccuucauacucuggcaacacagagacguagagagcucuucuucguguugacaggacacaauaugggcuggcuucggcacaguggccaucacuguguuagcauuccugacacacugcuauugaaagccccaaucugcugccaaauuacauguagacagugguuucacuguaaaauguugcggugcuuguuugcauucagucaaauacuuugcacuuaaacauggguuaaagagacaaauaagucaaaagaccuuagcaaaaccugaaguuaaauuuacgccuauucuucauaauggcauucagauuaaagccaucaaaaugcaaaaugcugugauuauacccuucgaggguucaggcuggauucuuguuuuguauuucugcauuacuguauuugcagugauuuugagaugcaggaaaaugcaucagaggcauugauuucuucuuuaacaaaaaauaacccuaaaauugagaaaauucuugagaaugcagccauuuuggaaauguagauaaagaagaaaaaugcugaagauuugggugguuuauggagccguaugauuuugucauugcugccaccuacuguaugugguugauguuuguuuaaacuuaggaaguucaugaaggugaggcuguugaaauagauaauuagagcaagguagacaucauuagcuuauagcauuucuuuucuaccccauaaguggcucuuaauuacugagacagccgccagcuuucauucauuaccuucaaguggauuuaaagggcugguuucuuuuuuuuuuuuuuuuuccauuuuuaaaguuccuuugccaaggaaccuucacaguaaugcuguaaaaugcguucaaaagcuuaagaugcugggggauuuucugagcauacaugcaauagguuguuuuaaggaguuuguuuuguuuugucuuaauuuguaggagcaauauucugggauuggauuguaaauuaauuucuaugaaagaggugaaaauggagcuaguggagcugaugggaguugcagcaguugacuugaaagacauucuuuuauuaguccuaaaacaaagcuucagaucaaccugcuaguuaaauguaacaagcaauauagacucugagucaacagagguccuucucuuuuuauuaagacccagcugucaaagggucauuagguccuuccuguggaaaacaacuugcccauuaauguuggggguggucccucgacaggauuucugaguaagugccugacauuucguuuuugaaagaaucuaaagcugugggagacuuagauguugagacuuagcaggaguaaugucuucaaccauagcuuuuagucuuuguuaaauaugucacaauauguguuuggaaugcugcugcuagcugcgugaauugacuuagagugccacugucaaagauucaggagcguaaacuucacggagaucaaaucacuauaacugggaagaggcuacauuccuaaagcgaaugcacuucucuguugugauguuuuuaccuugucacuacucauauuauuucuaguggcuccuguucuaagcucugggaaugccacagugaggaaugcccauuuauuuuuucugcccuaggcuauuugcuuucuagaagagaaggccaagcagggucuccugaaaagccucucuccgaucugggccgucucuccuaccuggcauauuggaagagcgucaucuuggaguaucucuaccaccaccaugagaggcacaucagcaucaaggcaauuagcagagcgacgggcaugugcccacaugacauugccaccacucugcagcaccuccacaugaucgacaagagagauggcaggugaguccugggacccugggcagcuccguggcucaggcaucccacaccagaaagggucccuggagauaggugcauucauuccaguuaaagacugagguucccuaacaguauuaucaaaccuuuucuccuaaaaauaacacaugaaaugacacuuuuuuacugguuggauuccaguguucuguacccucucauugaggugcuuucugauuuuuccuaacgcagauaacauuagugcuagcauauguccguaugugaagcugaagugaaauuucagcuugugauuacaucuuguucugccuuaucacauuacagauuugucaucauuagacgggaaaaguugauauugagccacauggaaaagcugaaaaccuguuccagagccaaugaacuugauccagacagucugagguggaccccaauuuuaauuucuaaugcugcagugucugaagaagagcgagaagcugagaaagagguaaugauugucuuuaucauccuaaguuguguaacuucaaucuuguagcauucuuaagcuaagaaagucauuaagaucguugucaaaagcuugguuauguagagauagcaugugaaaugauauggcacuaauuuauccuaacugagguugcaugguaagacaugauaauuuuauugaauugaguaugaaaaaugaaacauuuaucauugauuacaaagcagcauuuuucacuacugagagcauguaaucagaucaaauucggugcugagcuccaaggcugcagugucaauugauucuuuguguuuaugaacuugcuuaaagugcuccuugccagugagcauguaauguagugauaaaggacucaaaucaauucgcugcaucauuaauacuguuaaauaucccaugaaacccaaucuucuuugauuuguuauccuaacugaugcaaaagguuccugagaugaugcagcuggaaugugcuuggcuggcuggcuguccugaucagaaccgacuuagagacacuuugccauugauccucagaggcucuggcuguguaacugcccucucacuggccaccauuuuuacccuccccacuuaggcugagcggcuaauggaacaagcuagcugcugggagaaggaggaacaagaaauccugucaacuagagcuaacaguaggcaaucaccugcaaaaguacaaucgaaaaauaaauauuugcauuccccggagagccggccagucacaggggagcgagggcagcugcuggagcugucuaaagagagcagugaagaagaagaggaggaggaggacgaggaggaggaagaagaggaggaagaagaggaagaggaugaagaggaggaagaagaggaagaagaagaagaagaagaagaaaauauucaaagcucucccccaagauugacgaaaccacagucaguugccauaaagagaaagguaggugucuguuuagauuuucugugagucgcguucaaucaaaucuuauuugucauugcagacauucugucuauuaguauuuguuucacucucuguucuuuagucguaguuuauguguacccagucccgcugaucauauaucauaaucguuuaucucacagucaugauuauguuuacuuuucagguuuguuagugcggugacaggaaaccagggacaggccagccuccuagucuaguagucacugccaccugcuggucugcaggaguagaguaacugagguuuaugggaacaaaaaggggccccagaaagcacuuaaaccacccuccaagaccuagaggccaggagacuucucuaaggucauaugacucauuagagauggaagcagaaccaaaugcgugcucaagacucuaagccuggguugggcgcaguggcucacgccuguaaucccagcacuuugggaggccaaggugggcagaucaccugaggucaggaguucaagaccagccuggcuaacguggugaaaucccgucucugcuaaaaauacaaaaaauuagccagacacgguaguacgcgccuguaaucccagcuacucgggaggcugagacaggagaacccagggaggcagagguugcaguaagccgagaucgcaccauugcacuccagccugggcaacaagagcgaaacucugucucaaaacagaacaaaaagacuccaagcccagugcucuucaugcuguuucuuucucuuguucuuggcacagaauuguuagaaagcauuuuaggcccuuaauuuugauggugauauuuugcauuuguggccaacugcgcauuacugaaucuccucagaucuuaguagcccagugaugucucuagauagaccauaucaucuccaaugguacagaaaguaaagaauugacuuuguuuuuagguaacugcucacccagaucugauaucuuugucuucaguaucuaucugggacauagaggagagccaagacugauagagauaucacaauacaagcuaaggcuccgccccaaggccaucugauguggcaucuguuagggaacuugcuguucuaacucccagcucagcgcucuucuaggccuggcagucuucuggaagggucuccauggggaggugguagaaaggagcaucccacaaaguagacuucaggcuuaagaauaauguuuccauuucuuaggaggaguguguauucauguguuguauauauaauaaaagaaauuuguucuaaaacuaucaaaaaccagaaucauccaaggcaugaucugaacuggacucaaccugaagaaaaccaguucucuaccuuggcuucccucauauuagggaaaauucucauggauuaaagagggcaggcagacuggggggaauaauaaccguaaauguuuaauuacagaauaugauuaacuggcuacgugugugcuucagugagcauucagagcguuaacaaaaguaagacacaagaauucuuggaggccggacacaguggcucacgccuauaauccccacacuuugggaagcugaggcaggaggaucauuugagcucaggaguucaagaccagccugggcaacaaagcaagacucugucucuauaaaaaauaaauaaguauuuuuaaaauaauaauaauaauaauugaauacaguuuaccugaagguuagcuuuuaaccaagcauauugaacccuucuuugcaguguauuuucaauaauuuggggggcaacaauuacaucuuagcagcaaaucuaccugcuauuccucuauuugaauuuugugucauuaaaaacuuuuuugcugggcgaaaaacauuuuauaauuacaauuauggacagucauuugugccaaccuuuagugcaaacagaaaaaauauuuuuaggccaggugcgguggcucacaccuauaaucccagcacucugggaggccaaggcggguggaccacuugagcucagggguucgagaccagccuaggcaacauggcaaagcccugucucuacaaaaaagaaaaauaaaagaaaaaaauauuuuuauaucauacaaauaagacaucuggcaugucuuuaacauuuuuagauuccuucuauuaaaauauuuugccagguuaucaguugcucacaucucagcagccaccaauacuugacuuuguuaacauuuuaaacaguaauccuuucuucagguaccuuuccuuuccuuuucauagcccugaaguccuauggaaugagaaaaaguaggcuggucuuguaucauauuucccagugcuguccacauagugggugcuccuucaagaguucucaaguauuaaauggguuaacccaguggcuaguuaauuacagcaccauuuauaaagacauuagagucugugaugaccuuaaaugucugugaugugaggaauauugaagccagcaaguaccauuggaaaaauauaugcuagaaaagcaaagcuuaguuuuuaaaaucuccagucaagcugcuaggauguucccucucagagcaucugcuugaguaaacaacuguuuuauuuggaaaacacuugccuguguaguuggagcccgagagggauguuagacaucaaauggaagguuaaguacaaaggcauuacagaagucaccacguguaagauucucagacacgcguucaguacaugucuacugcauaucgacucaaccauuuaauuucucaugagcucuuauguguuauguuuggaauuaauuucagaggccuuuuguacuaaagaagaaaaggggucguaaacgcaggaggaucaacagcaguguaacaacagagaccauuucagagacgacagaaguacugaaugagcccuuugacaacucagaugaagagaggccaaugccacagcuggagccuaccugugagauugaaguggaggaagauggcaggaagccaguccugagaaaagcauuccagcaucagccugggaagaaaagacaaacagaggaagaggaaggaaaagacaaucauugcuucaagaaugcugacccuuguagaaguaaguagaggaaugauaaaaaccuuacccuugagaaugucuguaucugacugggugccaaagagcaggccucuggcgugaugcccagaggcaccugcgaaguggugcugaugcaccuggagcaagugcccaucugcccuuucccauccuuacaagcuucucucccuucuuccuggaauuggauuuuauguuaaacaacuucuaaggccagaacauuccucuagguggguucaucuuacuuaccagaaauuggcuuauccccaaaaacuuugaagucuguugacaagaaacacauuacauuucuuugauucuaauauguacuuuuuuuuuucacauuuaguuauuucugaaaucaagguauauauuauuaucagugugagcauugaauggaaucguuucuuuuuuccuggaaaacaaauauuaguaaaucaauaguacauuuuauaaucaguagugucguaguauauacuacuauaaagauucaucuaaacuaagcugggcaugauggcuuacaccuguaaucccagcacuuugggaggcugaggcagguggaucacuugagcccaggaguuugagaccaaccuaggcaacauggcaaagccccuacucuaaaaaaaauacaaaaauuaaucagauguaguggugugcaccuguagucucagcacuuuuggagacugaggcagcuggaucacuugagcccaggaguuugagaccagccugagcgacauggcaaaaccccaucucuacaaaagauacaaaaauuagucagcagugguggugugugccuauagucccagcuacuugggaggcugaggugggaggaucaccugagcucagggugagccaugaucgugccacugcacuccagccugggugacagaaugagacccuuucucaaaaaaaaaaaaaaaaaaaggaaccaucuaaacuuacccacacaucaauauuagcuuugauaauauugcauaacauaaaaaucaguaaacugacuuuccuuuuaaguugacagggacaccucuaccccauccucuaaaaaauacacugaacaccagugaaucgucuuuaaaagcacccauccuugccugucagguugagaacgugugcucccagcugaaucaugaggguuuaugguauacucucucuauucccuggccaagaugacucuauucagaacuuacuuuaaucuggggaacaggccaucucauuucccugggaaccacaggaucacucuagcuuuugaaaagccacaguuuuaagaacauaugcaagcaucuucuugauuuucuuaguucacagaaaugcuauuccugcauacaguauuuugcugaaggaaugacuucuuacccuggguauagagaaaccaagccuuauucuuuggguuuuuuuuuuuuaaacaaauaacaaacugcagugagcgaucauuuugugugugaaaaugagguuuauuuccccuucuuggcugucuucucauauuaugccugauuccuuucaggauguccuucuuucuuaaaaauaauugucagaaagcucaucuucugauuuugggagguguuccaacaaaagccgguagguccaguagcacguagaauaagaaugcagaauccagccaggcaugguggcucaugccuguaaucccagcacuuugggcggccgagguaggcagaucaccugaggucaggaguucaagaccagccugaccaacauggugaaaccccaucucuaccaaaaguacaaaaaaauuagcuggguguggugaugcaugccuguaagucccagcuacuugggaggcugaggcaggagaaucgcuugaaccugggagacagagguugcagugagccgagaucaugccacugcacuccagccugggcaacagagcaagacuccgucucaaaaauaaaaagaauguggaauccgggggcacuggcauggcuauuaccugccauugugaauagaaauguccugagaugacucuuaacucgggcaugguacucggcacuucucaaggaaacauucuacaucacauauguguucuuuucagcuggucgguuugaauguaauacuugcagguaaguuuaucuguaauccuuuuauuaccuaaaucagccagugcuuacucugcuguccaccaguuggacuagaacucacucuauucuggcagaagggauaucuguuuuaugaugauugugagaucuuauuuuuauucuccaaaauagaguuucuaauaagacuauuguucuauauaaagcuuuuccuuuaaauugaccacugauucuagaagauugguguaaucuaaagaucuuaagaauacuugggugcuucaugcauauauuuauuaauauauauuuauuaauauguauauagcuauucaucugcuuguauaaauauguacauauuuacauuuauauuaacaugugcauauagguucaguaaaaagcucaccugaacugaaaugaacuucacaauuaugguuuguuucuaagugucuuuaauaugcaaaccuuacaucagcaacauauugauccagaauucaguguggacagaauuaguguuaaaaagaauaccuguauuuuaaauguucaggaauuugcuaguaauuacauuguaguuuguaucaugcaaaaaugaugauccuaaaaaugaugauuacaaaugcauuuguuuuggguauuuaguuauuuacugauuuguuucagagguacacagcuuauuuuuaugccagagagaacauucaaaucaaaguaaauaaaucaugucuuccaagaucauuuacauccuauaaauguccacaaacagagguuuacuuucucuagguagauaugagaguuaaggcuucuagucauuuuuccaggacaguaaugauuuguauauaagcuagcauuaauuccuuuccccuauauuuccuaauuuguaaauguucaaauugauuuuuuuuuuuacacuguggaacucugggcuuuugcaucagagaaugucuuguucauuaaauucaaauaagcacauuagcauugccuauauccauguguucccaauauguuacucucccaggccuagguuauuuacuugguuuauaacacaauauuauuacacauuagccuugauuaugucuuuaccaucaacuuuuaacaugccaaauugaaagcaguguuugcuaauuaauuuagaggaaugaauucaaguugcccaugguuaugcuuucuaagacuguuuuuuuuccuucccguuuuugucucuucacuaagacaauaugaaugaugauucaaguaacuugaaagaaggcaguaaagacaaucccgaaccucuaaagugcaaacaaguguggccaaaaggaacaaagcgcggucuaucuaaguggaggcaaaacaaagagaggaagaccggauuuaaacugaauuuguacaccccgccagaaacacccauggagccugacgagcagguaacaguggaagaacagaaggagacuucagaaggaaaaaccagccccagucccaucaggauugaggaggaggucaaggaaacuggggaagcccuguugccucaagaggaaaacagaagggaagaaacaugugccccuguaaguccaaacacaucaccaggugaaaaaccagaagaugaucucaucaaaccugaggaagaggaagaggaggaggaggaggaagaggaagaagaggaagaagaggaaggggaagaagaagaaggaggaggaaauguagaaaaagauccagauggugcuaaaagccaagaaaaagaggaaccagaaaucuccacggaaaaagaagacucugcacguuuggaugaucacgaagaggaggaggaagaggaugaagagccaucccacaacgaggaccaugaugccgaugacgaggaugacagccacauggagucugccgaaguggagaaggaagagcugcccagagaaagcuucaaagaaguacuggaaaaccaggagacuuuuuuagaccuuaaugugcagccuggucacucgaacccagaggucuuaauggacuguggcgucgaccugacagcuucuuguaacagugagcccaaggagcuugcuggggacccugaagcuguacccgaaucugacgaggagccacccccaggagaacaggcacagaagcaggaccaaaagaacagcaaggaagucgauacagaguucaaagagggaaacccagcaaccauggaaaucgacucugagacuguccaggccguucagucuuugacccaggagagcagcgaacaggacgacaccuuucaggauugugccgagacucaagaggccuguagaagccuacagaacuacacccgugcagaccaaaguccacagauugccaccacgcucgacgauugccaacagucggaccacaguagcccaguuucauccguccacucccauccuggccaguccguacguucugucaacagcccaagugucccugcucuggaaaacagcuacgcccaaaucagcccagaucaaagugccaucucagugccaucucugcagaacauggaaaccagucccaugauggaugucccaucaguuucagaucauucacagcaagucguagacaguggauuuagugaccugggcaguaucgagagcacaacugagaacuacgaaaacccaagcagcuacgauucuacuaugggaggcagcaucuguggaaacggcucuucacagaacagcugcuccuauagcaaccucaccuccagcagucugacacagagcagcugugcugucacccagcagauguccaacaucagcgggagcugcagcaugcugcagcaaaccagcaucagcuccccuccgaccugcagcgucaagucuccucaaggcugugugguggagaggccuccgagcagcagccagcagcuggcucagugcagcauggcugcuaacuucaccccacccaugcagcuggcugaaauccccgagacgagcaacgccaacauuggcuuauacgagcgaaugggucagagugauuuuggggcugggcauuacccgcagccgucagccaccuucagccuugccaaacugcagcaguuaacuaauacacuuauugaucauucauugccuuacagccauuccgcugcugugacuuccuaugcaaacagugccucuuuguccacaccauuaaguaacacagggcuuguucaacuuucucagucuccacacuccgucccugggggaccccaagcacaagcuaccaugaccccaccccccaaccugacuccuccuccaaugaaucugccgccgccucuuuugcaacggaacauggcugcaucaaauauuggcaucucucacagccaaagacugcaaacccagauugccagcaagggccacaucuccaugagaaccaagucagcgucucugucaccagccgcugccacccaucagucacaaaucuaugggcgcucccagacuguagccaugcaggguccugcacggacuuuaacgaugcaaagaggcaugaacaugagugugaaccugaugccagcgccagccuacaaugucaacucugugaacaugaacaugaacacucucaacgccaugaauggguacagcaugucccagccaaugaugaacaguggcuaccacagcaaucauggcuauaugaaucaaacgccccaauacccuaugcagaugcagaugggcaugaugggcacccagccauaugcccagcagccaaugcagaccccaccccacgguaacaugauguacacggcccccggacaucacggcuacaugaacacaggcauguccaaacagucucucaauggcuccuacaugagaagguagacaacgugggcaguccacaaaaccuacggggcaucacuauuggauugaucugcacaaauaccuuugaagaguacgauuucaaaaccagcaauuggugugaaugcaaaaacauuuguuggcaccauuuauuuaaaaaaaaaaaaagcuguaugcagcagaaagccuuauacaaguuguuuuucuuuuuuuccuuuuucuuuuuuuugguaccuucauuucuguuacuuuuauauaaaauucucugcaaaggaaggccucucuuuggacuacaauuuggaggcagccacuuguugugccugcuucuguuaaacaauguggauaucaagcccccccaaauuaucuguuuuaauauugaaccuagagcuuuuuuuuucccuucccuguccacuccauguaaaugccuuuagcauuucaguuauuguauauuuuguuuaaggugacacuucagcaugccgcuaaugucuuuguuagugacagugcauuuuguaguacuguacaaguguugugcuaacaguaagccauuucuuaaguuuuuugccuugauuagggugcccuaauuugaggguuuuaaaaaaaacuauauuuuuguuaauuauaaaacuguaaagagcuauaaaagcuauucccauuugguuagucaaaaggguuuuauugcuaaauguuugguguaaaguugagacccuuuuccauuuuggugacagauuucuuuggggaaaaaaggcagcuuucuguuuuauaaaugcagacuucuguuuauugaaugaagcauaucucaguguuuaucugucagguuuugaaacauuucauauauguccaaauacuuggcaggauuuaaaaaaaaauagugaauuugguguaaaguugcuauuuuauggaaaugccucuaacuuuacauuuucauuccaucuguagauuuuucuaucuuuauaaaauauuggaguuauuuuuuaaggaaaaauagaaaaguagcuugugaauagcucaaacuaagcuuacaaaucgcauguaaaaaagcaaaaaaguuauuugugucuguuuauauugcuuccuuuuuuguagccuuuguaccuguacagggugacaguaagggccaagcaggagaggcguaauccuuguauaaaauaggauccagcgacacucuuguauuuaucuguucucuuuuuagucagucacuucaaaaaaacaaaaaacaaacaaaaaaaagcuguacauuuuaacauaaaauaaauuaugaugagccauuuuuagccucuuguguccugucauauuaugauugauagagaaugaccaauggaacuguaucaugugucacgccucagaacacauacacauuuugggaaaauaaauuauuuaguguaaauuggaguuaugggauuuucugauuuguuuugacuuugggggagggguuggcaauaaauaagaguaauaucuaauaaaaccaucacauauaccaaauaccuauuuaauaaauuaauuuauaauggauuuuaaugcuuuucaugaaaguuuauuuuaugcgagugcauaccuucuguaugccaaucauugucuuuaaaauaaagugaaauuguuuuuuucuuuugg

SEQ ID NO: 17460 - RNA, 225809 nt, Homo sapiens
ccaaaagaaaaaaacaauuucacuuuauuuuaaagacaaugauuggcauacagaagguaugcacucgcauaaaauaaacuuucaugaaaagcauuaaaauccauuauaaauuaauuuauuaaauagguauuugguauaugugaugguuuuauuagauauuacucuuauuuauugccaaccccucccccaaagucaaaacaaaucagaaaaucccauaacuccaauuuacacuaaauaauuuauuuucccaaaauguguauguguucugaggcgugacacaugauacaguuccauuggucauucucuaucaaucauaauaugacaggacacaagaggcuaaaaauggcucaucauaauuuauuuuauguuaaaauguacagcuuuuuuuuguuuguuuuuuguuuuuuugaagugacugacuaaaaagagaacagauaaauacaagagugucgcuggauccuauuuuauacaaggauuacgccucuccugcuuggcccuuacugucacccuguacagguacaaaggcuacaaaaaaggaagcaauauaaacagacacaaauaacuuuuuugcuuuuuuacaugcgauuuguaagcuuaguuugagcuauucacaagcuacuuuucuauuuuuccuuaaaaaauaacuccaauauuuuauaaagauagaaaaaucuacagauggaaugaaaauguaaaguuagaggcauuuccauaaaauagcaacuuuacaccaaauucacuauuuuuuuuuaaauccugccaaguauuuggacauauaugaaauguuucaaaaccugacagauaaacacugagauaugcuucauucaauaaacagaagucugcauuuauaaaacagaaagcugccuuuuuuccccaaagaaaucugucaccaaaauggaaaagggucucaacuuuacaccaaacauuuagcaauaaaacccuuuugacuaaccaaaugggaauagcuuuuauagcucuuuacaguuuuauaauuaacaaaaauauaguuuuuuuuaaaacccucaaauuagggcacccuaaucaaggcaaaaaacuuaagaaauggcuuacuguuagcacaacacuuguacaguacuacaaaaugcacugucacuaacaaagacauuagcggcaugcugaagugucaccuuaaacaaaauauacaauaacugaaaugcuaaaggcauuuacauggaguggacagggaagggaaaaaaaaagcucuagguucaauauuaaaacagauaauuugggggggcuugauauccacauuguuuaacagaagcaggcacaacaaguggcugccuccaaauuguaguccaaagagaggccuuccuuugcagagaauuuuauauaaaaguaacagaaaugaagguaccaaaaaaaagaaaaaggaaaaaaagaaaaacaacuuguauaaggcuuucugcugcauacagcuuuuuuuuuuuuuaaauaaauggugccaacaaauguuuuugcauucacaccaauugcugguuuugaaaucguacucuucaaagguauuugugcagaucaauccaauagugaugccccguagguuuuguggacugcccacguugucuaccuucucauguaggagccauugagagacuguuuggacaugccuguguucauguagccgugauguccgggggccguguacaucauguuaccgugggguggggucugcauuggcugcugggcauauggcugggugcccaucaugcccaucugcaucugcauaggguauuggggcguuugauucauauagccaugauugcugugguagccacuguucaucauuggcugggacaugcuguacccauucauggcguugagaguguucauguucauguucacagaguugacauuguaggcuggcgcuggcaucagguucacacucauguucaugccucuuugcaucguuaaaguccgugcaggacccugcauggcuacagucugggagcgcccauagauuugugacugauggguggcagcggcuggugacagagacgcugacuugguucucauggagauguggcccuugcuggcaaucuggguuugcagucuuuggcugugagagaugccaauauuugaugcagccauguuccguugcaaaagaggcggcggcagauucauuggaggaggagucagguugggggguggggucaugguagcuugugcuuggggucccccagggacggaguguggagacugagaaaguugaacaagcccuguguuacuuaaugguguggacaaagaggcacuguuugcauaggaagucacagcagcggaauggcuguaaggcaaugaaugaucaauaaguguauuaguuaacugcugcaguuuggcaaggcugaagguggcugacggcugcggguaaugcccagccccaaaaucacucugacccauucgcucguauaagccaauguuggcguugcucgucucggggauuucagccagcugcauggguggggugaaguuagcagccaugcugcacugagccagcugcuggcugcugcucggaggccucuccaccacacagccuugaggagacuugacgcugcaggucggaggggagcugaugcugguuugcugcagcaugcugcagcucccgcugauguuggacaucugcugggugacagcacagcugcucugugucagacugcuggaggugagguugcuauaggagcagcuguucugugaagagccguuuccacagaugcugccucccauaguagaaucguagcugcuuggguuuucguaguucucaguugugcucucgauacugcccaggucacuaaauccacugucuacgacuugcugugaaugaucugaaacugaugggacauccaucaugggacugguuuccauguucugcagagauggcacugagauggcacuuugaucugggcugauuugggcguagcuguuuuccagagcagggacacuugggcuguugacagaacguacggacuggccaggaugggaguggacggaugaaacugggcuacugugguccgacuguuggcaaucgucgagcgugguggcaaucuguggacuuuggucugcacggguguaguucuguaggcuucuacaggccucuugagucucggcacaauccugaaaggugucguccuguucgcugcucuccugggucaaagacugaacggccuggacagucucagagucgauuuccaugguugcuggguuucccucuuugaacucuguaucgacuuccuugcuguucuuuugguccugcuucugugccuguucuccuggggguggcuccucgucagauucggguacagcuucaggguccccagcaagcuccuugggcucacuguuacaagaagcugucaggucgacgccacaguccauuaagaccucuggguucgagugaccaggcugcacauuaaggucuaaaaaagucuccugguuuuccaguacuucuuugaagcuuucucugggcagcucuuccuucuccacuucggcagacuccauguggcugucauccucgucaucggcaucaugguccucguugugggauggcucuucauccucuuccuccuccucuucgugaucauccaaacgugcagagucuucuuuuuccguggagauuucugguuccucuuuuucuuggcuuuuagcaccaucuggaucuuuuucuacauuuccuccuccuucuucuucuuccccuuccucuucuuccucuucuuccucuuccuccuccuccuccucuuccucuuccucagguuugaugagaucaucuucugguuuuucaccuggugauguguuuggacuuacaggggcacauguuucuucccuucuguuuuccucuugaggcaacagggcuuccccaguuuccuugaccuccuccucaauccugaugggacuggggcugguuuuuccuucugaagucuccuucuguucuuccacuguuaccugcucgucaggcuccauggguguuucuggcgggguguacaaauucaguuuaaauccggucuuccucucuuuguuuugccuccacuuagauagaccgcgcuuuguuccuuuuggccacacuuguuugcacuuuagagguucgggauugucuuuacugccuucuuucaaguuacuugaaucaucauucauauugucuuagugaagagacaaaaacgggaaggaaaaaaaacagucuuagaaagcauaaccaugggcaacuugaauucauuccucuaaauuaauuagcaaacacugcuuucaauuuggcauguuaaaaguugaugguaaagacauaaucaaggcuaauguguaauaauauuguguuauaaaccaaguaaauaaccuaggccugggagaguaacauauugggaacacauggauauaggcaaugcuaaugugcuuauuugaauuuaaugaacaagacauucucugaugcaaaagcccagaguuccacaguguaaaaaaaaaaaucaauuugaacauuuacaaauuaggaaauauaggggaaaggaauuaaugcuagcuuauauacaaaucauuacuguccuggaaaaaugacuagaagccuuaacucucauaucuaccuagagaaaguaaaccucuguuuguggacauuuauaggauguaaaugaucuuggaagacaugauuuauuuacuuugauuugaauguucucucuggcauaaaaauaagcuguguaccucugaaacaaaucaguaaauaacuaaauacccaaaacaaaugcauuuguaaucaucauuuuuaggaucaucauuuuugcaugauacaaacuacaauguaauuacuagcaaauuccugaacauuuaaaauacagguauucuuuuuaacacuaauucuguccacacugaauucuggaucaauauguugcugauguaagguuugcauauuaaagacacuuagaaacaaaccauaauugugaaguucauuucaguucaggugagcuuuuuacugaaccuauaugcacauguuaauauaaauguaaauauguacauauuuauacaagcagaugaauagcuauauacauauuaauaaauauauauuaauaaauauaugcaugaagcacccaaguauucuuaagaucuuuagauuacaccaaucuucuagaaucaguggucaauuuaaaggaaaagcuuuauauagaacaauagucuuauuagaaacucuauuuuggagaauaaaaauaagaucucacaaucaucauaaaacagauaucccuucugccagaauagagugaguucuaguccaacugguggacagcagaguaagcacuggcugauuuagguaauaaaaggauuacagauaaacuuaccugcaaguauuacauucaaaccgaccagcugaaaagaacacauaugugauguagaauguuuccuugagaagugccgaguaccaugcccgaguuaagagucaucucaggacauuucuauucacaauggcagguaauagccaugccagugcccccggauuccacauucuuuuuauuuuugagacggagucuugcucuguugcccaggcuggagugcaguggcaugaucucggcucacugcaaccucugucucccagguucaagcgauucuccugccucagccucccaaguagcugggacuuacaggcaugcaucaccacacccagcuaauuuuuuuguacuuuugguagagaugggguuucaccauguuggucaggcuggucuugaacuccugaccucaggugaucugccuaccucggccgcccaaagugcugggauuacaggcaugagccaccaugccuggcuggauucugcauucuuauucuacgugcuacuggaccuaccggcuuuuguuggaacaccucccaaaaucagaagaugagcuuucugacaauuauuuuuaagaaagaaggacauccugaaaggaaucaggcauaauaugagaagacagccaagaaggggaaauaaaccucauuuucacacacaaaaugaucgcucacugcaguuuguuauuuguuuaaaaaaaaaaaacccaaagaauaaggcuugguuucucuauacccaggguaagaagucauuccuucagcaaaauacuguaugcaggaauagcauuucugugaacuaagaaaaucaagaagaugcuugcauauguucuuaaaacuguggcuuuucaaaagcuagagugauccugugguucccagggaaaugagauggccuguuccccagauuaaaguaaguucugaauagagucaucuuggccagggaauagagagaguauaccauaaacccucaugauucagcugggagcacacguucucaaccugacaggcaaggaugggugcuuuuaaagacgauucacugguguucaguguauuuuuuagaggaugggguagaggugucccugucaacuuaaaaggaaagucaguuuacugauuuuuauguuaugcaauauuaucaaagcuaauauugauguguggguaaguuuagaugguuccuuuuuuuuuuuuuuuuuuugagaaagggucucauucugucacccaggcuggagugcaguggcacgaucauggcucacccugagcucaggugauccucccaccucagccucccaaguagcugggacuauaggcacacaccaccacugcugacuaauuuuuguaucuuuuguagagaugggguuuugccaugucgcucaggcuggucucaaacuccugggcucaagugauccagcugccucagucuccaaaagugcugagacuacaggugcacaccacuacaucugauuaauuuuuguauuuuuuuuagaguaggggcuuugccauguugccuagguuggucucaaacuccugggcucaagugauccaccugccucagccucccaaagugcugggauuacagguguaagccaucaugcccagcuuaguuuagaugaaucuuuauaguaguauauacuacgacacuacugauuauaaaauguacuauugauuuacuaauauuuguuuuccaggaaaaaagaaacgauuccauucaaugcucacacugauaauaauauauaccuugauuucagaaauaacuaaaugugaaaaaaaaaaguacauauuagaaucaaagaaauguaauguguuucuugucaacagacuucaaaguuuuuggggauaagccaauuucugguaaguaagaugaacccaccuagaggaauguucuggccuuagaaguuguuuaacauaaaauccaauuccaggaagaagggagagaagcuuguaaggaugggaaagggcagaugggcacuugcuccaggugcaucagcaccacuucgcaggugccucugggcaucacgccagaggccugcucuuuggcacccagucagauacagacauucucaaggguaagguuuuuaucauuccucuacuuacuucuacaagggucagcauucuugaagcaaugauugucuuuuccuuccucuuccucuguuugucuuuucuucccaggcugaugcuggaaugcuuuucucaggacuggcuuccugccaucuuccuccacuucaaucucacagguaggcuccagcuguggcauuggccucucuucaucugaguugucaaagggcucauucaguacuucugucgucucugaaauggucucuguuguuacacugcuguugauccuccugcguuuacgaccccuuuucuucuuuaguacaaaaggccucugaaauuaauuccaaacauaacacauaagagcucaugagaaauuaaaugguugagucgauaugcaguagacauguacugaacgcgugucugagaaucuuacacguggugacuucuguaaugccuuuguacuuaaccuuccauuugaugucuaacaucccucucgggcuccaacuacacaggcaaguguuuuccaaauaaaacaguuguuuacucaagcagaugcucugagagggaacauccuagcagcuugacuggagauuuuaaaaacuaagcuuugcuuuucuagcauauauuuuuccaaugguacuugcuggcuucaauauuccucacaucacagacauuuaaggucaucacagacucuaaugucuuuauaaauggugcuguaauuaacuagccacuggguuaacccauuuaauacuugagaacucuugaaggagcacccacuauguggacagcacugggaaauaugauacaagaccagccuacuuuuucucauuccauaggacuucagggcuaugaaaaggaaaggaaagguaccugaagaaaggauuacuguuuaaaauguuaacaaagucaaguauugguggcugcugagaugugagcaacugauaaccuggcaaaauauuuuaauagaaggaaucuaaaaauguuaaagacaugccagaugucuuauuuguaugauauaaaaauauuuuuuucuuuuauuuuucuuuuuuguagagacagggcuuugccauguugccuaggcuggucucgaaccccugagcucaagugguccacccgccuuggccucccagagugcugggauuauaggugugagccaccgcaccuggccuaaaaauauuuuuucuguuugcacuaaagguuggcacaaaugacuguccauaauuguaauuauaaaauguuuuucgcccagcaaaaaaguuuuuaaugacacaaaauucaaauagaggaauagcagguagauuugcugcuaagauguaauuguugccccccaaauuauugaaaauacacugcaaagaaggguucaauaugcuugguuaaaagcuaaccuucagguaaacuguauucaauuauuauuauuauuauuuuaaaaauacuuauuuauuuuuuauagagacagagucuugcuuuguugcccaggcuggucuugaacuccugagcucaaaugauccuccugccucagcuucccaaaguguggggauuauaggcgugagccacuguguccggccuccaagaauucuugugucuuacuuuuguuaacgcucugaaugcucacugaagcacacacguagccaguuaaucauauucuguaauuaaacauuuacgguuauuauuccccccagucugccugcccucuuuaauccaugagaauuuucccuaauaugagggaagccaagguagagaacugguuuucuucagguugaguccaguucagaucaugccuuggaugauucugguuuuugauaguuuuagaacaaauuucuuuuauuauauauacaacacaugaauacacacuccuccuaagaaauggaaacauuauucuuaagccugaagucuacuuugugggaugcuccuuucuaccaccuccccauggagacccuuccagaagacugccaggccuagaagagcgcugagcugggaguuagaacagcaaguucccuaacagaugccacaucagauggccuuggggcggagccuuagcuuguauugugauaucucuaucagucuuggcucuccucuaugucccagauagauacugaagacaaagauaucagaucugggugagcaguuaccuaaaaacaaagucaauucuuuacuuucuguaccauuggagaugauauggucuaucuagagacaucacugggcuacuaagaucugaggagauucaguaaugcgcaguuggccacaaaugcaaaauaucaccaucaaaauuaagggccuaaaaugcuuucuaacaauucugugccaagaacaagagaaagaaacagcaugaagagcacugggcuuggagucuuuuuguucuguuuugagacagaguuucgcucuuguugcccaggcuggagugcaauggugcgaucucggcuuacugcaaccucugccucccuggguucuccugucucagccucccgaguagcugggauuacaggcgcguacuaccgugucuggcuaauuuuuuguauuuuuagcagagacgggauuucaccacguuagccaggcuggucuugaacuccugaccucaggugaucugcccaccuuggccucccaaagugcugggauuacaggcgugagccacugcgcccaacccaggcuuagagucuugagcacgcauuugguucugcuuccaucucuaaugagucauaugaccuuagagaagucuccuggccucuaggucuuggagggugguuuaagugcuuucuggggccccuuuuuguucccauaaaccucaguuacucuacuccugcagaccagcagguggcagugacuacuagacuaggaggcuggccugucccugguuuccugucaccgcacuaacaaaccugaaaaguaaacauaaucaugacugugagauaaacgauuaugauauaugaucagcgggacuggguacacauaaacuacgacuaaagaacagagagugaaacaaauacuaauagacagaaugucugcaaugacaaauaagauuugauugaacgcgacucacagaaaaucuaaacagacaccuaccuuucucuuuauggcaacugacugugguuucgucaaucuugggggagagcuuugaauauuuucuucuucuucuucuucuucuuccucuucuuccuccucuucauccucuuccucuucuuccuccucuucuuccuccuccucguccuccuccuccucuucuucuucacugcucucuuuagacagcuccagcagcugcccucgcuccccugugacuggccggcucuccggggaaugcaaauauuuauuuuucgauuguacuuuugcaggugauugccuacuguuagcucuaguugacaggauuucuuguuccuccuucucccagcagcuagcuuguuccauuagccgcucagccuaaguggggaggguaaaaaugguggccagugagagggcaguuacacagccagagccucugaggaucaauggcaaagugucucuaagucgguucugaucaggacagccagccagccaagcacauuccagcugcaucaucucaggaaccuuuugcaucaguuaggauaacaaaucaaagaagauuggguuucaugggauauuuaacaguauuaaugaugcagcgaauugauuugaguccuuuaucacuacauuacaugcucacuggcaaggagcacuuuaagcaaguucauaaacacaaagaaucaauugacacugcagccuuggagcucagcaccgaauuugaucugauuacaugcucucaguagugaaaaaugcugcuuuguaaucaaugauaaauguuucauuuuucauacucaauucaauaaaauuaucaugucuuaccaugcaaccucaguuaggauaaauuagugccauaucauuucacaugcuaucucuacauaaccaagcuuuugacaacgaucuuaaugacuuucuuagcuuaagaaugcuacaagauugaaguuacacaacuuaggaugauaaagacaaucauuaccucuuucucagcuucucgcucuucuucagacacugcagcauuagaaauuaaaauugggguccaccucagacugucuggaucaaguucauuggcucuggaacagguuuucagcuuuuccauguggcucaauaucaacuuuucccgucuaaugaugacaaaucuguaaugugauaaggcagaacaagauguaaucacaagcugaaauuucacuucagcuucacauacggacauaugcuagcacuaauguuaucugcguuaggaaaaaucagaaagcaccucaaugagaggguacagaacacuggaauccaaccaguaaaaaagugucauuucauguguuauuuuuaggagaaaagguuugauaauacuguuagggaaccucagucuuuaacuggaaugaaugcaccuaucuccagggacccuuucuggugugggaugccugagccacggagcugcccagggucccaggacucaccugccaucucucuugucgaucauguggaggugcugcagagugguggcaaugucaugugggcacaugcccgucgcucugcuaauugccuugaugcugaugugccucucaugguggugguagagauacuccaagaugacgcucuuccaauaugccagguaggagagacggcccagaucggagagaggcuuuucaggagacccugcuuggccuucucuucuagaaagcaaauagccuagggcagaaaaaauaaaugggcauuccucacuguggcauucccagagcuuagaacaggagccacuagaaauaauaugaguagugacaagguaaaaacaucacaacagagaagugcauucgcuuuaggaauguagccucuucccaguuauagugauuugaucuccgugaaguuuacgcuccugaaucuuugacaguggcacucuaagucaauucacgcagcuagcagcagcauuccaaacacauauugugacauauuuaacaaagacuaaaagcuaugguugaagacauuacuccugcuaagucucaacaucuaagucucccacagcuuuagauucuuucaaaaacgaaaugucaggcacuuacucagaaauccugucgagggaccacccccaacauuaaugggcaaguuguuuuccacaggaaggaccuaaugacccuuugacagcugggucuuaauaaaaagagaaggaccucuguugacucagagucuauauugcuuguuacauuuaacuagcagguugaucugaagcuuuguuuuaggacuaauaaaagaaugucuuucaagucaacugcugcaacucccaucagcuccacuagcuccauuuucaccucuuucauagaaauuaauuuacaauccaaucccagaauauugcuccuacaaauuaagacaaaacaaaacaaacuccuuaaaacaaccuauugcauguaugcucagaaaaucccccagcaucuuaagcuuuugaacgcauuuuacagcauuacugugaagguuccuuggcaaaggaacuuuaaaaauggaaaaaaaaaaaaaaaaagaaaccagcccuuuaaauccacuugaagguaaugaaugaaagcuggcggcugucucaguaauuaagagccacuuaugggguagaaaagaaaugcuauaagcuaaugaugucuaccuugcucuaauuaucuauuucaacagccucaccuucaugaacuuccuaaguuuaaacaaacaucaaccacauacaguagguggcagcaaugacaaaaucauacggcuccauaaaccacccaaaucuucagcauuuuucuucuuuaucuacauuuccaaaauggcugcauucucaagaauuuucucaauuuuaggguuauuuuuuguuaaagaagaaaucaaugccucugaugcauuuuccugcaucucaaaaucacugcaaauacaguaaugcagaaauacaaaacaagaauccagccugaacccucgaaggguauaaucacagcauuuugcauuuugauggcuuuaaucugaaugccauuaugaagaauaggcguaaauuuaacuucagguuuugcuaaggucuuuugacuuauuugucucuuuaacccauguuuaagugcaaaguauuugacugaaugcaaacaagcaccgcaacauuuuacagugaaaccacugucuacauguaauuuggcagcagauuggggcuuucaauagcagugugucaggaaugcuaacacagugauggccacugugccgaagccagcccauauuguguccugucaacacgaagaagagcucucuacgucucuguguugccagaguaugaagggagcccacaccucagaauacagauaauuggcacauccgucaccugccuccaaagugcuuggcacaugcugagaaacguacccaggaggcuggggggucccagcuuuguacuccugggggggugagaaccauagagccguggauauagaaccauucccuuuuguccaugagaucccacaauugaaaguccccugcagugagugugaaaguccccagguccucuacuggugcuuauuugaauccagcagucaaggacagaaagccccacuccucucagccuugcugaaagaauucuguacaaccaaaguguucauaccaaggugguaugugcccccccauaccuuaugucccccacuaugaugggccagcuuacccagaagcacauguguuccuuuguucugucuccccgcuacagucccuaauccggaaggcagcagcagccagcaucagaaaacccacgcuuuccgcagcuguucaugcuuucacaccccgaaguggugcacacacacccugucagggccugagccuaaauggguuaggccacucaaaccagcaggcaacuugggguccauggggagcauuuaggcauaaaccuuuuagcaccugcuacuccuaccauguuaaguggcugucuccugagacacucccuuggacacagacuucaggcuaugacugauagucacggaagaguccuggggagguggcagcagggugaucagcccugauggguguggguacacugaaagcccaguggucuuuuucagcaaacacccuugcacugugcuugcaaaggccaggagaaagcagggaguggccaacaccugccaggaggccaugcuucccugggugcuguaaagaagacaacugcaaacccaagcuccagccagagcacagcaggcgggugugcagggaugacgugcaccgacacugcagacugcacaaggccacuauccgaagggaccccugcauggcuugcaguggguuuuucccucuccucucugacucaugagacccucaaggaacuaauagcaggaacuggcacuuaugccaggagccauuuggaaguccacaaagucuacucacguaagagaaaacagaauccaucaaaacgaucaaaaugaacaaagauacauuucugauuccuuacuaguuaaaugaacucacuuguaauauguuaaacuguacagcuuagaagaaaagugugugucauguccacuccacuggcgugcuugguggauguaggacagaauuccauuugaaccagcagcagcacuuccucucagaaggcugcagcugguggcacuucacuacucugacccucauaacaugcgauguuuuaaaaaacgaauuucuugccaccuuuuguuucuuuguacuuuuuuuuuuugagacagagacuugcucuguugccuaggcuggagugcaauggugcgauaugggcucgaugcaaccuccgcuucccaggcucaagcgauucuccuuccucagcuuccugaguagcugggauuacaggcgccaguggccaugccuggcuaagauuugcauuuuuaguagagacaggguuucaccauuuugcccaggcuggucucgaacuccugaccucagucccucaaguguugggauuacaggcgugagccacugugcccggccucuauuuuuuucuaggcucuucacaacauaauuaugauauagcccauuggaagaaaaauuuuugguaagaacauuucacuuauugaguacaucauagagauguggugguuuaaguuacagcucuuaacuuaccaaaaaaauuccaaauaauugaucuaagaugcagggaaauaaaaaacacuuaucuuggcugggcgcgguggcucaugccuguaaucccagcacuuugggaggcugaggugggcagaucaccugaggucaggaguucgagaccagccugaccaacauggagaaaccccaucucuacuaaaaacacaaaacuagccgggcaugguggcgugcgccuguaaucccagcuacucgggaggcugaggcaggagaaucacuugaauccgggaggcagagguugcagugagccgagaucaugccauugcacuccagccugggcaacaagagugaaacuccaucucaaaaaaaaaaaaaaaaaaaaagcacuuaucuuagaagcugguguauuauccugaagcaucugaaacaaguacaguacaccccuggugaauagauucccauggugcucuaacacuucuccuuaacucgggauacuuucaaucagaaaaccucagcucucccuggagaaaccuggcuguuucagauggaaaacaaagugauguuuggaggacaaaucccaguagcugcaguauaauuaaucgcuggugaaauuauucccuggaacuugucugugagccagaggugcuggccaacagcacuuacucugugagugggagccuuguaauugaaaacgggguagcccauaaaccccucauccacaucaacuaucuugaucguagcaaaagcuggcuuccucuuuugcuuuacuggaaguacuuauccuggggaaggugacaucugacuuucaguauacaggccacauaaucaauucaaaggauugucaagaugucugcuuaaagggaaaggaagaacaaugugauuucugucuauaaaaaguaagcauuucuaagcuguacugcauggaacccgagugugccucaccucuguuaaggcuuaacuacuugcaguaaaagaaucaaaucucauguuaacuagcccugaguuugaaaugguuaacucucucccagugggagaaaauaaaagugguagagaguuaucucauguagacagaucuauuaggauaaggaaggaacuaucuagacaaggucaagauauguuuuugcagacccaaauucccaaauuaaauuuaauucccagcauaauaacuguaauguuaacgcucauugaaaaugaaaauuccuucccuuuaaacuaggaguauucaagaguguaaauggaccauaguagaauaauguucucaggcaagggcauggauagggacagggaucucccccgacaggggcagacacccucaccccugcacaccuccaucuuccacuaccuggaaccaaaccaaaccauaugaaccuccucaaacaccaaaguguaaacuuuggcaagcuacucacucccaacuuccaucucucuggauuaugugaguuuggggucaccagcugcuuuuaggggaugauaaucuuugaggauuacacacuuuucaucagacaccuguuuagcucagcaaauccugcugaaaggucuguaucagucgacggcacuggguuugcaagccugggaacagacacgaggccagggauuuauggcagcuuuugagcacaggaaaucugaugacucuaaccaaguuaucucaugcuuggagauggcaauucacugguuuguacgcucaucuguuccugguuucuggugcagagcagcacugaccaacuggaugaauggcauguuaucaguuuaaauaaugacaaaugaacuugacaggcuauuuauaucuccucguuuaaauuuuguggugauuuugcaauuagugcagaaggaugcugaaccuuaguucucacaucauuuuaagagaacagccgugcucuaaaugaccugugaccugccugauaucuuacugcuuuccacuuauuaaaagauacaggugccuccuuggcaaagacggaaauuuugaauuuuucauauauuuuacuuuuaagagauugguguugaaacaaguuuaagaccucucucccauaaguccuaugggcaugacauaauuauauaagaacuugaauaaaugcuguuuaucaagaucucaguguggagaccuguggcaucaacaucaccugagaacuugcuagaacuuuaaauucucagaaccuaucucagaccugcugaaucaggaucuuugguggggagaggcagagcccagcaucugugcuuucagaagucccccaggugauucugauguacccgaguuugaaaaccaccacuagaacccugcucugaagcugcuggcuuugaugaggguguggccacuuaagagacaguaggacugaagaaucucaaauagguaagaccucacucagcuccuuggaugcaagauaauuggagaauggacucgccaaagccccaccagacugaaauuuggcuagaggucacugaguugccaaaucgcuucgugcagauguucuacaccucugcuucucaacuuccauugugcagacaaacuaguucugguuaacagcauggacuccgguucaguaggucagggguggggcuugagauucugcaccucuaacaacuuccugugccauggaccacacuugaauagcaaugguuuauacuuuaaaucgguaguuuucaaaugcuuuggccucagcacucagagagcuuuugcuuuuaagggcucuaucuauuaauuuuacugagaaauuugacaaauauuuauuaauucaucuaaaagauaacgauaaacccauuauguaacauuuuuuuaaauuaaaaaaaauccuauacuuucuaaaauauaaauaaaauuuauagugaaaagaguggcauuauuuuacauguuuuacaaaucucuuuaacuucuggcuuaagagaagccaguuagauucucucuuucucucuuuauuuuguucuuucuuuuucuuuuucaagaagacagggucucccuauguugcccaggcuggucucaaacucucaggcucaagcgauccucccaccucagccucccaaagugcugggauuacaggcgugagccacugcacccagcuugcuagauuuucauagauugcuuugguauugagucugcugugauaucacaggucaugacauucuggaaaacuccucuguauacucaugagaaaaugaaaguaaaaaggaaaaagaguaucuuaguacuacuuggaaaauaauuaugaccuuguagacucccugaaccauacuuugagaccaugugcacuaaacaaagaugaguuuuuuaaagcuggguaacagggcacccguauuuuaaaacaauaugucauauauugcauacaauacgacagaucgugagaggcucuauggguggguggaaagcaugggcucuggagccagacuacccagaauggaaucugggguccaccauguaccagcugugugaccucagggauuuuauuuaaccucucugugcuucagaucccucauccauaagaugugaauaauaacuguaccuaacuguuacaguucugguaaggauugaguuaauaugaaacaugcagaacagugcuugacgcaucacaguaauccuaauaaguguuagcuaugauuauuauucaacauacugaaugaaucaagucucaaggugaucauuuggguaacuaaacauccuuaagguaggggaaagaaauaaaauuuggacagaagggaaacaacagagacagacugcucuauagaaucagauugagaaaagcuaacuuuguuuuccuacuuuugccugaggaaccuaaaaaccauuccaugaacucagacagaagcucuccucucaucccacccuuccuuccucuccccuccccccagcuaaccacccagauaucaauugaauuaaagaaagaggcuaugaaaaaaaauucugccucaggaguggucuuaagaaauggcaacaaaguucccagcaaacacaguucugugcccccaaauucccuuuggccccuuaguccuuaacuucaaggacuacccuuaggaaauggcuagcccauccaaccacagaaacaaugacugcuuagggcuucagcagagcccagggacagucccaagacagaugaaagacucaaauauucaacaagacucaagugugucucugggaaaauggccugacccagugaaacccugagcauggacacagcaugucuuuggggaaggaggcuggcugcccugggucacauaccagccuguuacucuaagccccacucuuagaucucucuucucugggaucccacaaguuccucagcagaccuccacugcugagcucuuccccaaagggccacugauuuuucuuacugaauguccccauccuuucaaguccauuccagaguggaauggucuuccuucaacucccacaguggaagauguauggcaggagugugacuccccgaugccguguggugugccugugucucugagcugacugaccaugcugggauuuaccagaugguuccaugguucuguggguagguguggacucccuugcgggguuggucauucugcaugucagucccccagggaaagguacaggugcucagaaagaaaaugaacucacaaguagggcaucaggcagcacgaaaggggacuucccucccucugcaccgccccuguguugagaagcguagaccucuguggaugugcuccugagccggaggugccaggauagcacgugccacauggaagcagccugagggccagagacaucugugugagauggcauuuauaccugauucucuuacccagugagagaauuaauugcuccuuuuucuuuuauuuuuuggacacggucucacucuaucacccaggcuggagugcaguggugugaucuugguucacugcagccucaacuuucugggcucaagaaauccucccaccucagccucccgaguagcugggacaacaagugcauaccaccaugcuuggcuaauguuuguauuuuuguagagaugggguuucaccauguugcccaggcuggucucaaacuccucggcucaagcaacccuccugccucggccucccaaagugcugggauuacaggugugagccauugcaccuggccuauuguuccuucuucugucuucaaguauagcccagugguucucgacccugccugcacaucagacucacuuggggcuuuaaaaagccacagaugucuguguuccacccaaccucaugacuugccugguuucagauauauuaugggucccaguaaggaaagggccuugggggacuauacuugggccagaauauuaaaugggguacagcaccacuucuucauuuuugccaccucacagggcuauagugguagcaguggugccuaaugagaaaucccagcagcaggcaaaucucugaacugacgcaggggaggauggccacuccguaaacaacugugugauacacuucacagaguuucauuucauuaaacauucaacugaggaguauuugugaguguauggugugucaccacaaccgaguuccuggucuaguggauuagaagaauaaaaauuuuuuaauaaggugacugacuaugauauagauucauccuucaauuuccuuguuaggaaaaugaggcaccugccacacagauaaaaugaucauggaaugagagauguuauacucugucaguaucauuuaugcccaaacuaaaauuggggaaggcaagaauuuuuaaaaauauguugauguaagaauagcuuaccaaauuguugaaguaaccaaauuguucacgaagcccauugccuaucaccaaacuaaguuaaugcucugauuugugacccagaggcacuuucaguuagguaaugagaaagccccagugcuauggccuucagcaugacagaaauuagaaaggcaugcagaggaaggucuuccucuuugaccuuuuaaguuuuccacaguucaaaccacuuuuaaauucuaggauauuuuaggaaaaacacauuuauuuuuaaaaauuuaaagaugaaguaauuuggcauuuuaaaauuauuuccucucuuauaaauaggcaaaagucuacauuagagauucauuaaaaaaagaaauaguuuuugaaauagaaaauaacacaauugaaauagaagacaacuuaauucuucaguuuucacuaaaagaaagcauuuuaaauaccuggcucccccuaggcuugcuccccaaguugaaacuuggauaaaauuuucaugucuaaguuacaaaauucugguaacaagaacuuaccacugaaaggcuuuaagauggcaaacuuaaucgaacacauauacacuuuaaauaaagcaucugcgccaaacaaaugacugcaugcacuuaaaaugcuuuaccuuuaagauuguucuccugcugcgaaaacacugcgauugaacauuuuccuuaacuaaaucacuaaaugcaaaaacugagacuucuuuugccuacuuuuauaggucugagguucuacugaggcagcugagacacuucauucuaauaucuagucaucuggucugguccaaccccacagaccgaugguggagggugggagaggggugcuauuuacauaaucauggcaguaccacugauuucagaaccagguuugggagacaggaugguuggaauagcaacuugccuuuccauuugcucuccuacaagcccccuaaaaugcuguguguauauguggaagggaguguuguguguauguaccagcuguaauuuuuaaaaauaggacaaaguauguuguaauuccaauucuggaugaugagcuuucacacagcaaacaaaaauacacagcaagauugaagaaagaaaaaaugagaauacaaaucuccuuagaaauuuucuuuguuuucaaacaaaguacauuucaaaaaggaaucugucaguuuuggagauaacuuucuaaaaucaaaguacagcccaucaccuaaucugacugaucaaccacuguuggaaauguaagagaaacugucgcuaguuguccucagguuaucuagacaaacaaucccacuccacuggucuacuuuucuuuucgcuuauuuuuuauuuaucucccaaaugcuuugaaacgugauuugagguaagaagccucuggagaucaaugguuguguccccccaggguuauugcugagcccccucugaagcugugcagcacaaaggcacccuggguagcggagcuagggugggaggggggccagacaagugacuggcugguuugcccauggacuuggugucauguagggacuuagcuuuuuuaauuugagauggaguuucacucuuguugcccaggcuggagugcaauggcaugaucucggcucauugcaaccaccaucucccggguucaagugauucuccugccucagccucccgaguagcugggauuacaggcaugcaccaccacgccuggguaauuuuguauuuuuaguagagaucggguugcuucauguuaggcuggucucgaacuccugaccucaggugaucugccugccccagccucccaaagugcugagauuacaggcaugagccacugcgcccggccagggacuuagccuuuaaucuuagggaaucuuaaaguccaaacuggcuacaguagauguuagcuguuagaaaaacaaacacauaugcaguaucgucaccagcagcauuaaagacagcaaugacuaccucuuagguuguagaugacacauuucucuaagccccuggaaugaaccgcuauucuguccacuguuuggcuaaauuuuagacuucaguaacaauacauuaauauuagcagagcuucaccacaauauacuaauauuauccccaugagacuuuauauuauguuaaucaaagaaucuccauuccaccugcaaaggcuugaaaugguuuugugcuauguccaacaguugagugccuacuagguacuagguacuuuucuauuuagguuguauacagacacucuauuuuccaaauuuaaugagaaaaaaagcucugggaguuuaauuuguuagcugguaugcaacugcugaacacaagaaccacaaacuacguaaauaacaggaacucaaauagacauguuaacagcuaaaguucauuuuuaaaaaaugaauucaauaugcuacauugcaaggaaucaaucacacugcaaucaucauuuacaaaucaaaguacaacacacauacucauggggguauauacaacuagguagaagugugugauuauagacaaguagauuggaaguguaaauuauguaacugucucuuguaauuacccugcuugagaacugaaacaaacuuccuguauaaguuuugcaggagaauggagauugagauacagaauugcuuuuuaguugguuuuaacccuuccacagcuauuuaauuaugugugaugaggucaaagaaaguuuaugcuuaauuuaugaaaaauuggcagggagguauuucaaaguaaauccucuaaaaagcuuccaauuauuaauuaaaucugguaauuucucuuccucuucaaggaagauuuauauaaauuauuagguaaaauaaacaauguuuaaaacaaauucacgggcaucauucauuuuauuuccucucuaaaaacauucauuauguucuacaaguuuuuaacuggaugcaacucaaaagcuacagggaugaaaggcugucuucagagcaucuucugcuuugguagagaaaaaucuuauuaauguccuuaacuucauggagaaaagcuccaacgcugggugaaccccagggcaggacuccuagucuaugaacagacaaucaccuucuuaagaagaaggaagccuguuuuucugauaaauagcagagccucauuucaggacauuuuaagucaucguagccuuuuucuucccuuucuuaaaaaucuaacuuuuaacaucuuuucucuaaguucuguuucuagugccuaaagaucuaccacaaauuuuagaacugcucagcaaccuaggaggaggaaagagcaauuuuccuguacacaucuuacagugucugcuggugcuguucuucccacaaaaaaagaaaaaugggaaaacaguucucaugcugcagugucucuucuuucucuccucgggcucacaguuaaauauuuucucuguacuccauccucacucugcaucaccauuccuuguccgaauccuccauuucauccucauucuguuaacgcacaacccuucaauuauguuuuucuaaguuuaagagugaaagugaaauuuacaggaaugcuguucucuaaugaacuagacucaacacuucagaggauuugauucaaguaaauuucaguacauuuccuucacauaaaaauggcucugcaaaggcugacauggaguugaugcccguacacuaaauacuugugcacucaaguuuucauuuucaagcagucaaggugaaaacugugucucucuuuaaaacaugacuaguaggaugccaccaauaaaucgaguaaguuuucaguuucaagaguuacaaaaacccaagcacuaagauaccauaggaugucaccucccauuuuaagaugauugcuuucuaaaaaacaaaaauaaaacagagauacauaaaaugacaaaaaacaaauacacagcuuaauggauuauuauaaggcaacuguccuuguaacuaucacccaggaucaagaaauagaaguuugccggcuacuccagaaaacuuucuauccgcuccagccaaucaccucuccuuucucucucauaaguaaccacuauccugacuuucacaauaaucucuugcauuuuuuuauacuuucaucaccaaaacaguccaggcacuagaacagucuugccuauuaaaaaaaaaaaucuuaaugucauuuuaaucuagggguuccaccuucaccccuuucuuuuccuuguaaucuaucugugguugaacuggggccacuugaccuauacuguccucacucuggauuuugcugaucuccuacuugcacugcagcucaguaugcuccucuuuacucuguaucucuugcaaaaugguaacuagauccagugcuugauugauuagacuuggguuccauccacuggcaagacuacaaauauccuugaucagaagauagauaauuucugguuguccuuuuugcaacuguugauguuguucauugucuagauccauuaauucaugguggugguggggauuacaaaaugguuauauuuuaauucugucauuuucuuuucuuuuuuuuuuuuuuuugagauggagucucacucuguugcccaggcuggaguacaguggcacgaucucagcucacugcaaccuccgccucccggguucaagggaugcuccugccucagccucccaaguagcugggacuacaggugcaugccgcaacacccggauaauuuuuuguauuuuaguagagauggaguuucaccauguuguccaggcuggucgugaacucccugagcucaggcaauccgccugccucggccucccaaagugcugggauuacaggugugagccaccguacauuuuauuuucauugguuagcuggaauauguuuauaaaaagauguuucuggccaggugcaguggcucaugccuguaauccuaucacguugggaagccaaggcagauggaucgcuugagcgcaggaguucaagaccagccuggacaacauaaagagacuacagaaaaugaaaaaaucagcugggcauggugguguuuaccugaagucccaguuacucaggaggcugaggugggaggaucucuugagucuaggaggugaggcugcaguaagcugagaucgcaccacugcacuacagccugggugauagagcaagacccugucucaaaaaauuuuuaaaaauuuaaaaaauaaaaugauguuuccccuccuuuacuacuugauuacuucacuguacaguuuauguaagaaaggcaggauaaauguuuuaauugcaauuuuugcagcuuucaagaaaauaaacugguuccuauuauccucuaaaucaguuuguuuuuuaguaucauuaugaacuugugaauuuaaacauuugacaaguugcaauaaauugcaauuuuuuaucuuuauuauuauauuuauugucuggucagaaccucuucaaauugacuccugagucuuuuugacaugacccuaacaauuuuugcuuccuugcugucuaguaugacaaggaggacuuuuguuuuguuuacagaaauaacucuucgacuucauuuaaaaugaugacuguauuugcccccaaaaaaggacauaugcaaauuuauuguggagacugacguccgccuguauuacauuuucucaugauuucagcaacaccuuuucguaccuucugccguguaauugugcugcauauuuauuuccauguggacaaaugguucaugugaaacugaauugcuuuuaauccacccaaccauuuuuauacacuuuagaaacauuaauuuaaaacaauuuugcugaaaaaaagcguuccucuaugauguuaacucaaagcaggacuccauauaaauaauuacaaaaaagguuuuuauauugguaaacaugaaaauguagcaugaauauuagaguacaaacaugcuaaccacaaauccaugggggagaaaaaaaaucagauuccuaacuaguauuuuccuaaacaauucuaaacaaguuaaggaaaaccuuuuguuuuacccaauaugaaauuauauuuaaaaacaaacaaacaaaaaaccaacaaccaaccaaccaaccaaccaaaaaacuaccuuacaaccagcugaaguuauaguuguguuguuuagggccaggcgugguggcucaugccuguaaucccagcacuuugggaggcugagguggguggaucgcuuguauucaggaguuugagaccagccugggcaacauggcaaaacccugucucuacuaaaaauacaaaaauuacccgggcaugguggcacgugccugugaucccagcuacucaggagacugaggcaggagaacugcuugaacccgggaggcagaggcugcagugagcugagaucgugccacugcacuucagccugggcaacagagcaagacucggucucaaaagaaaaaaaaaaaaagaacaaaaaaacgaaaugccaucaugagagggguaaguggaagcaaacuuuuaucuuagaauauucuaucucaaacauaaugucucuauuacaagcuggaauauauguucaagggggaauaguucucuugaaacccaaaugagguauagcacuaauuucaaccaagcagagcaaaaucuuucuugaucuuguuuuaacaacagcucagggcauaguggcucacaccuguaaucccagugccuugggaggccgaggcaggagcauaacuugaagccaggaguuggaaaccagccugggcaacaaagcaagagccugucucuagcugaccccccaccccucccccugaaaaauggccaggaaugguggcaugugccuguaaucccagcuacuugggaggcugacaugggaggaucacuuuagcucaggaauucaaugcugcagugagcuaugaucacgccacuguacuccagccugggugacagagugagacccagucuuuaaaaagaaaagcaaggaaaaaugcgucucuucuauauaucuuaacuggguaaauggaaaauagaguuggaagcauuuccuccucugcacugccacagccucucugaaauuugaaauugcaggacugggaagaauuuugugucugacccucuacuucccuaugggcaaggacuaaaucauucauccuuauguccucaucaccuagaccaucccuggcacaguguauuuaaagcauguuugcugaaggaugggaugaagggauaaauaaaguguaaaaaacaaagacugagaggagaucugaguuuaagcacuacuggucaaaagcuagcuggaugcaucuggcagguguugacagucauacaaagaaguggauuaacuagacucaggcauucauugauuucccccaacaauccuuuauucuguauccucuaugugcuaggcacugugcucauggcuuggaguuuagcaaugaccaaguuccugcccucuugauggucccacuaagguuucauuuuguuccaguucugcugaagauuagguuauucucauaccaauuauuugaauggaauuuguccaguaguggauuucaaaauaacucaaugcaaaugccagucaacguuagaaauccaaacagacaaaaaauuuguuugguaaaaaaaaaaaaccaaccaccugcaugccaaaacuugaaaaaauucugagcuauguaaggcaaaacacuagcuuucagaaaaaaugagagagacugcagaccguauguuucauauuuacaauguuuucauugaggcaaugaauacaaacuauucuauaagagcuauuuauuugcucuuauuuaugacaagcuuagcuuaaaaaaagauacacaaauaaaucguuagccgcacugucucaugcaacucauuucaaugcauucagcaacagucaaccucugaauaaaucacugagagcucaauuuucaaccuugauguuaucuuuagcauauuaaaauauauuguaccucagaccaauauaauaaaacaguaauggcagaagcuuuuaguguaacauauuauaaugagaaaauaaggaaaaauagccauuuuccuuauuauauuacagacuagaauccuauuaaaauaaaugucaucauuauacuugauuacauaggucaaaaugugucuuccaaaacccagcaaaagcccaaggauauagcugcugguccaguauuuuccaacaagugucaugggggcaaaggugggaggcuccuuaucuuagaaaaggcuaugaaguacuugagcaccauuucaaaagcauaacuuauuauucuuuaaugauugccuugacugcacucacccaggagcguagcugcugggaaggcuaagcaaagagaagcuuucuugacagcuucuuauggcuaaagcugguauuuuccuuucaaaaauaaaugcaaucaagaaaugaauuaucugauaagagaaaaaguaagcaaaagauuuaagugucucuucaaccugcuauguacaaauguggauuaugucacagcucugcuuucuccgcccaagguuuagagcaggcagugacaucuucuuucugaugcaacugaaaugaucuuaagauagaggcugcauuucagcaaaaguaccagaccucgaaagaagacagggcauaccuagcaucauuuggaaguaaguaaaccagugcugaugguuuauguucuaauaaaauaaaauugucccuaagaaucacacacuagaagggaaagcacauuuuaaaaguucuucccgucauaauuaauuuaacauuuguucaacaauuaauaagaaccuacuaagcgccaggcucuucuagaagaucagaaugcagcaaagagcaaaguccacacucucaugaagcuuacuuuuggugaaagacaugggcaaucaacaauaaauacagucaugcaccacauaaugauguuuaggucaacgauggaccacauauucaaugguagucccauaagauuauaacagcauauuuuuacuguaccuuuucuauauuuagauauguuuagauacaaaaauaccauuauguuacaaccacuaacaccuacgguauccaguacaguaacugcuguccagguuggucaccuaggagcaaucagcuaugccacauagccuagguguguaguaaccuauagacuucgacuuaggucugucuaaguacauacacuaugauguucacacgacaaugaaguugccuaauggugcauuucucaaaaugaaucucaguuuuuaaaugauaaaugacuguauauaaaagaccuaugcaaguuuauaaaugacucugcacuugcuuagccuaguuuguuguuguuuuuuuuuuuugguuagugccacuaaaaagagagagagagagaaaacuaaauaacacaagucccuaagagaugcugucauggucccuccaaacacauuucugaggcuuguuuguggggccuguaaguggggaaaguggaauauuuacucugcagccucccccagacagacuuuaugauucaagugagugcuucaugaucucccucaucauguauaugacagaauuuacacagcuccugaggcugcuagaggugaggugacaggcacuggagcucuggacacccaggagcaaagggagcaauaucucugcuacccauacccauccucagguccugucuugggaggcacagcccuaagcugaccacacggugcagagacggccagagacccuugcuggagagcacaguuucucaccagggccuugaggcugggaugcagcuccugaggguaagccaugugcccugauacugugcucacccugcccucugggagaagccgguggcuccugcacagcccugguuccagggggcguaauacagucaggugaaacggcuuacuggaauccaaccaacuggacuucuaaaugaaaacuccuguuuuccagaggagauaggccaguggguaucaaacauuuauuucaagaaggcaauuuucagguaggaugaaaccacuuagucucuacuuaaaaacacucuuaaguuucacuuaaauuguauuuugaaaagcuuguaaguggaagcucuuuuaaacaaaauagcccacugaaggcagacugugaaaacuaguaguagcuggcaaccugaacuacuaugacacguacuucuguauuuagccaucauauaauacaacauuuaaaccaguagcuugcaucuaagauucugggaagaagcagcuuucucucugagagaguggauaugauuagccuccugacaugauaccccccuggguagaaaugaaguauguggcuuucuuccuaauucgcuuuauggacuuaaaagggcagagaagcagggagcaggaaaccaaagagaagaugcuuuucucuuccaaugcggugcuuccucaagaaaucagccaagaacuauucagaggcuaaaggagaaacaagcccggggaucucuacggacgugggugguuguggcaccuaaagaagaaaucucugucauuaaaccagaggaggaaagaacgacggugcagaaaaccacacugauuaauacucaagugagaaaggaacuaagguacuaaaucauacccuaaagcaucuuuccucaaaaguuuauuguaguuccugcuuuccuuaaauccgguuggcuguauauguguguggggggcagggguggaggggaguaucauuucuaaaaaaggggacauguagaaggacgcugcaaaccacacugaagacaagagccaaauucauaaccuggaggcacaaaacugggccauuugcaccaucuucuagcagcgcugauuaauuauagacucaguuuuuaaauagcacacggaccucacaaaagcuaaggugaaacccucaacauaugaagagccagcaaagggaauuccccgaagugaaugccuaauucauucaaucacuucugcuuccuauaguuacagccuuguuccaugaaggacugcccaauauuuuaauacugaauaaagaaagccaaaaauugaaacugcugacacauuuuuaugauuauuccacaaacauacuaauuuuagaaaugccugaauguacaauuaacugauauuuaacuuaacugacgaacuugccauuaauuaauauuaauggcaaguuuaucuggucucuaaaaacuauagacguaagucuguagacuuggauccagcuguccuuuacccuuuauagcguuaguuacacguccgucugcccccgauaaaaaagaaaaaguuaaucugagauuuagaacccuuauaguucuaguuaguagguuuaaguauuuuaguuaggagagaauguugaauuucaucaaaugccagaucagacuuuguaauaaaccaccugccuggauguugcuuuuuguuuuccccucgauuuuuuccaucagcgcugcucuuucuuuucccuacugauguacauacacaugcuccaggcucuccagcuuaaaaauaaagacaacuagguuccuguguccccagcccuugacagucaagcuuuuguuuuguuuuguuuugcuuuguuuuaaaaaaagaaaaaaaaaaaaagacagagucuugcucugucgcccaggcuggagugcaguggggugaucucagcucacugcaaccucugcuucccagguucaagugauucuccuaucucagccucuugaguagcugggacuacaggcacaugccaccacauccauauuuuuguauuuuuaguagaaaugggguuucaccauguuggccaggcuggucuugaacuccugaccucaagugguccaccuaccucagacucccaaagugcugggauuacaggcgugagacgcuacgcccaaccaaacagaauaaaacagucaaaagcuuuuugaaucuacuuuuaaucgcacuuaauauacaguuguccaaagaauacuucuuaugacuuucucucuggggcacugaaucucugggggaugaucuuagacaagucucuuagugucucgucccagaagagagauggucacaguaaccuaccccauagggucuccgugaggacuaagugaguaaauguguguaauuccgguaacagugccugacacauagcaagggcucuagaaguggcagcuaugaugauuauugugacuguuacuguugaaauacugaccucuucugguuuuccuaacaccauuaucucccaauuuucuucugacuucugggcccuuugcaaauuuccuuggcgagcuccucauucuuuauuagucccuuagauguuaacacuccaagcacuccacccucagcccuguuucccuauacacuucccccugguugcccucacccacauccaugguuucagcuaccaccgcauguccacgacucccagcugcucccucuaaugcagacccccugcugagcucuggagucugugcaaagugcacguagacauccaaacgcacagugaaagcuacauaaagcugcgcucacuaucucuccaagcucaguuaugcauucaauaaauaccaguauuuucugagcaccacucugcaccaggcaugcuccugcuacggaacgaacaggaccugccucuuuuccaugcauccucacugucaggccuccauugacucuggccucuuuucuuuuuaguuacagcaaaaaguauaaauaagaaaauaaaaaguaucuguaauucuaauuccagaggucaucuagaaauguauuuguuuugcuuugcauauuuuuuacauaauugagaacauauuacauauauaauuuugaaagccacuugcuuaucacaagcauuacaaauucccagauaauuuuuuuuaagaaacagggucugguucuauugcccagguuggagugcaguggugcaaucauaguucacugaagccuugaccuccugggaucaagccauccuuaauggaggacucagccuccugaguaacuggaauuacagucacaagcuaccaggcccagcuaauuucauuuauuuauuuuuguagagauggggucuuacuauguugcccaggcuggccucgaacuccugggcucaugugauccuccugccucagucucccaaagauuacaggcaugagccacugcaccuggucagaacauaauucucagcagcuaauaauauuccauuauauggaugugccauaacuuucucgugggaaugguucucucuugccuuugaaauaucaagucuguuuuaguuuuuuaccuguuguaaauaaugagugugaaggacaaauauaccaaaacauuaacucucugggugacauuuucuucuauuaauuacaccuuuuuuuuuaacuuucuacuaugaguccauauugcuauaaucaggggcugggggagggaggcaaaaagagaaguccacuauuuaaaacauaauaauaugaaacaaaauaauguugcuauauuaacuaugaaaauaauguuuguugauuaaaauaugcugauuucccuagaaugaauuccuuuagaaaauaaccauuggaggcugggcacgguggcucacaccugaaucccacacuugggaggccaaggcaggagaaaugcuugagcuccauaauuugagaccagccugggcaacauagcaagacccugucucuauuuuuuguuuuauguauuacuuuuugagauggagucucacucugucaccugguuggagugcaauggcacaaucucagcucacugcaaccuccgccgcucagguucaagugauucuccugccuuagccucccgaguagcugggauuacaggcacccaucaccacgcccggcuauuuucuguauuuuuaguagagacaggguuucgucauguuggccaggcuggucucgaacuccugaccucaggugaucugcuugccuuggcuucccaaagugcugggauuacaggcgugagccacuguccccagccuaguuuuuaaauacauaaaauuuuauuaaaaaaaaaaaccauuagauguuuuugauacacacugucaaaguuccagaaaaugccuaccaauauacacuuucuucaguguaaauaagguguccauuuuccaccagcuuaguuagauuuggguaaguuguaaacucuuuguuagugugguaggcaaaaaauuguaaucuugcaguuacuaaauuugcauuuuuaaaccaccaacaauuuuuuuuucauauuugaauuagccauuauaccuaagagacuucggaguggaguggcuaacaguuaaagugcuuggguucaauuugcagcugugcaacuuauuuguguaacugugccucaauuucaacacccauagaauggggcuaaaagcacauaucucaacuguugccgugaggacugaaugaaucaaucaauaaaugcaggacucuuaggaaagggguuggcacauguuacucacucaguaaaugucagcaaugucguggccaccagugauuuuccuuuucuguacauucuguguuccuguccucugccuauuuguuuauguauuuauugagagacgagagaaggaggggaauggggggguggggagaacagggggagagagagagagagaaagagagagagauggucuccuuguguugcccaggcugguguugaacuccugggcucaagugagucuccugucucggccugccagagugcugggauuacagguaugagccaccauagcugauccucugcccauuucucuauuaggguuuuuguuuuaaugcuaccaaacuuaaaaguauauauauauuuauuuaaacacuauagauauuaaacuuugccuagcacauauguuguaaacaucaaacaucuuucucauuauguuugcuuuaaauauuaauacuuuuuacuagauagaaguucuauauuuuuauauagucaagucuaucugcauauucuuucauugcuuugaugguuaugauguccuugaccauccaaagaucagauaaauaauuauacauaaucucuccucuagcuuuuuuuuuuuuuuuuuuuuugagaccgagucucgcucugucgcccaggcuggagugcaguggugcgaucucagcucacugcaagcuccgccucccagguucaagugauucuccugccucagccucccgaguagcugggacuacaggugugugccaccacacccagcuaauuuuugcauuuuuaguagagacgggguuucaccauguuagccaggauggucucgaucuccugaccucgugaucugccugccucggccucccacagugcugggauuacaggcgugagccaccgcaccccaccucuccucuagcuuuuuaaguguuucugugugucuguuuuuugguaaucaagucuuuaaucuaccuggaguuucugcuguaguuacccagguauguaacaugcuuccucacgcagucaugcuugugaauaugcugcuccccucugccuagaauguuuucauuucaacuucuuaugagcucucaaggcauacuguccaaaauacuaugcaacauuuguugauuugucagugaacuugacagcccagcaagagcuaugucuucuucccuuuugguugcugauguuuagcagaauguagagugugguaucccaaucaauaagguuaaaguaaagagguaaaaaaugaaggacaugacucuucgcaucuuccuuuauccuccaguuuggcaucagauaaaugcauauacacaaacacacaugugagugauggugccaccucccucaccaccaucuggcacuugguucucucaccuacugcugaaucaguugguguucccucggucucuccugggucagagcccaggagaacggguuuuguauccugcccaucagccaggguucuggcucugcaggcccgaguaaaagacaauucauuaucugcucacuuauuaccuagccaaacagaguccuaacaacugaaaggauaucuaauauacaauaacugcuaccuaaguaucuaucagucaaaauaugcccaagauuacucaugacacuacuuuuuaaacugcaaaauauuggaaacaaccuauaaacccauacauaggaaagcagguaagcaaacuguauacaugcaugcaacggaguagagugcagcugucaaagaaaagaaaucucuaugaagucauuuccaggauauacuggaaaaaucaaaaugcaaaagacuaccuauaguaugcuacauuuuguguuagaaaggaggagaaauuagaaaaaugcacaucuaucugcucauuuguacacaaagaaacaggaaggauaaacuacaagcuaaugagauuggagaccugcaggaaaggaugagggaaugggaauggguagagagggcacauucacugagaauacccuuuaauacaguuuccauuuuuaaaaucauguuaauguuuuacauucuaauuuaaaaagguaacaaguauaaaauaaaaaacaaacagaaacaaauaagccuaauuguauuccaaugaauacuacaguaacacugaagggggagaaaaacuaacucuaguaacauuuaaacacaguguuuugacuaaauacacuugggguaaagccaaaaggaaccauauauaaauauugaccuccacuuaagagguuuguuuuucacaauggcaugaguuaguaauucugaaacuacuuacuguguauucuaggguguagcacauaaguauauuguggguaauggaagucaggguucucacugucagagaaaggaauuacaugggaagagggaaagacagaauacaaccguaugguggcgcagaucuggaauggucugaacucaugaagggaguguguguguacacgcauauguguuuauaacacccauauguauaugugcacauacauggauauaaauaugcaugcuauccuagcucuguccucugagagggcuagaagcagugacacccaagcagcaaugggcacauuuaagugaucagaacuugguuuccuccauuuuuuuuuuuuuuuuuaacagaugaagucuugcuuuuucacccagacuggagugcaguggugcaaucucagcucggugcaaucucagcucacugcaaccuccaccucccggguucaagcaauucucugccucagccucccaaguagcugggacuacaggcgccugccaccaagcccggcucauuuuuguguuuuuuuuuuguagagacaggguuucaccguguuggccaggcuggucuugaacuccuggccucaagagauccgccugucucggccucccaaagugcugggauuacaggcaugagccaccucacccagcccagauccugguuccuaacuacuguucuccaccauaaggaaccaaggcuugggagaaauggaugauuccagggcuggcuuaagaaaaggauaagcuaaaccuggaacaucaugcuguggcagaaaggaaggaagaauccacaggauggaagcauguggaaaaggcacaagaacccacuugaaacauuugcugauaaauaaaucugggacaauuugauguuuggggaacaucaaaaucaaucaugguaaugacagguuauaaccuauagaauaaaauuaaaacccacaauuauacaaaaaaauuaaauaaauggggaagaagaaauaauucuuccuucuagaaugccaauuaguaaguuguagaaagaauggaauuagaaaauuaccauuugguaauuaucauaguaauaauuauuuuagauaagagccauaagugaaugguaaaacuaggaggugaaaauuggaugagaauugauauuuauauaaucccaaaguaucuucucaccagaugcuuacugauuacaaagcgaaaaaugguaauuucacagugaagaagccuggcaguuaccaccuuaacccagugaugagacaaauguauuaucauaugauccugaugaaaugcacugggaaggacauacggucacuucuaugguauuccugccaaaaaauguacagccuaaaucuaaucaugaggaaacaucagauaagcccaaauugaggcacaccauacaaaauaaauggccuguaugcuuaaaaaauaucaaaaucauggaaaacacgaagcaaagcaaaacaaaacaaaaaagcagguacuauuccagauuaaaggaggccccagggacauaauuacauacuccaugugauccuggaguaggagauuuuucuuuuccuccagaaagaacaucaguauaaucucgcaaaauuuaaaauuugaacaaaugugcauaaauuacuuuaauaucuugauuuuaauaauuuguauuguggcuauauaugagagcaucuuuguagaaaaacugcaauauuuagggguaaaggugcaacacaucuucaacuuacucucaaaugauucugaaaagaaaauaugagagagaagagaaacaaagggagagauugagaauaauagagcagaaaacagaugugauaaaaugugaacaugugcaacaauguacgggaaauuuugguauuauucuuagagcuuuucucuaagucugaaauuauuucaaaauuaaagaaaaaaauagugagauggauaaggcauugcugggcagccccagcagcagaagcaguccagggcuugggagggagcacucugggcccccagugcucagcaguggcugggagaagaagagcuccuugccuugacggugugaggcucugaaguaggaacugcaaauguuuugugggcaagggaguucucugaaguucugagaugucugguggggacggagggagagagagauagaaagacuuuacagacagagauggggaagacuuucaaauuuucugacugagaaagggaauccuagaauccaagaggaaggaaugcguucucaaccaauccacgauagucacucucuccuccacccauuccaauugugggcaaagagucauaaaacccacuagggaguuuauaaccagauugggaguuggugcccuuuacucacucuggccaaacucugcaaauggccuccuggggagccuugcucugacaaaucccagagaagcuggucuaggaagugauauacaaaugacuuacucugcaagcagcacauggucccauggaugaccauuccaccucacucugcugcccugaagaacaguguucaaagcccugcauuugcaguucuuuauacagacaguccuuggcuuacaacugguucaacuuacaacuuacaacuugguucaacuuuacuaugguaugaucaguaaaaaccauacuugaucguuuccugggcuagcgauaugugguacaacacucuuacaugagauauucaacacuuuauuauagaauuggcuuuguguuggaugauucugcccaacuguaggguaauguaaguguucugagcacauuuaaaguccaggcuaagcuaugaugguugguagauuagguguauuaaauguauuuuuaauuuaugauauuuucacuuuaugauggguuuaucagcccacagccccacuguaagucuaggagcauguauauacacacagugcaucacauuccacccaugucugugaucaagugugcaagugggcggcuauaucuuucucccugcucguaucguguuucagcuuacuaaacuggcaauuauaaagaucuaccugauuuacaaccucauuugacuuacugaaaauacaucccugaccaaaaggccccaggcucauuuaccaaauagaaauaaaauaaauuuaaccauuaaaaaguccuuuaaaaaaccagagcagauuuuagaaaaccuguaacccuaguuagcuuucuauccugggcuccaaauuaugagaucaaaaaugaucaugagaggucaugugacucaucccuaccuucaaaggcuggauuucaaucauuuuggaaagauauuuaucuacuauuacuuuaaguaacuuccaagagaaggugcuauuaauuucuucagcagccuacucuaucuuccuuaaaacuuuuauagccaagaaauucuuuugguuuuaaacugaauuucuauuggguuuacaccaguucccauuuucuuugagugcuauaaaauucuuccccuaguuuccccuucucugagggaauaacaccagucucuucaacuuuauucaaaucuuucacugcacuucuuaacucacuccaguaggggcaaugcuagguguacaggaaagagaaaagaaaaaaaccacacccucagcacuacuuugccugcucacauccugguggacagcauucaucaugguggccuggagccacugagaaaagguuucaauguguucuguaguuuaauaauacaagguaguuucuaguaacaguuuucacuaaaaugguuaaaaaaaagacauagcauuugaagauaauguauuuguuacccagauuguucucuuauguagaaggccuuagugccagaucaugcuguacaaauaagauacuacugaauuuagagcuugaacuuuuaccuaguaaguaccaguuccuuuuuaauuuuagguagacaaugauuguggacagcaaccauauaucaauuuggaaauuuaguuuauaucaauaaaauuuaauuuauaucaucuaauacauauuauuauaaaggaaacuguccuaguggauacagagaaguuggaaguaugaaaccuccaucaauaauuaucauaaaagggugaacagaguguaagugugauaccauauagaauaugguauaagauaaaauaaagguaugagauaaaauuccaggaggugggaucaaaaagcagagauucuugagcuggcucuuaacaaugggcaggauuuugaacagacggagucuaggaaaggacgaggugaucauuucaaggaagggacugaauagacaaaaaaauagagguauaggaccaugcucagacuauuugagaaaaaggagauuaguagaugaaaaagccuaaaggacaggcuggaacuagauguuggaagacguuaaauauugagcuaaggaguuugccuuauucuguaggcauauagauaugaccaaacauuuaaggcuugaauggcugcuaugcauaccagaaacuauauuuaugaacuacuuaugaaugguagccacacaaaacuagagaacaagauaaaugguuuugcccucagaaaugauuacagcuaggacucuauaaaaauaaaaaugguacacugcauuugguaagguggcccuccuugggauuacugguuucauggauaauuaggucaggaaaguauagauaagacuaggguaauuaauaaauaacuaaaaauauuaucuaaaaagagaaaaauaaucaaaauucuucuuuuaaaagaaucauauucuucaaugucaauaaaucauauaaaucaguccaaaacugcuauucaguuauuuuacacuuuaaucagaccuuaaucuuuuaauaccuaacaauauagauuuagauucacuauauuucuucaugguuuucuguaagcgcauuuacauugugguuuuugcaucugauguagcugaugaagauugugcaaaguccuaaauuuuccuccuuucaguuaauaaucagauaaacugcaaucugguaaucaagaagcaccugguuccuagcgacagacuuuuuuuuuuuuuuuuuuuuuuuuuuuuuuuuugagacagagucucucacucugucacccaggcuggagugcaguggcaccaucucggcucacugcaaccuccaccucccggguucaagugauucuccugccucagccucccuaguagcugggaguacaggugugugccaccacauccagcuaauuuuuguauuuuuuaguagagaugggguucaccauguuggccaggauggucucgaucucuugaucuugugacccaccugccuuggccucccaaagugcugggauuacaggcauaagccaccacgcccggccagugacagauuuuuacaugacgagaaaugacuauuaucauggguuaucuggucaucauguuaucuagauauuuugaauugauucuccaaauguaccccuaacacaacauuuacacauccaguauaauauaaacaaggaggaaaaaaaaaacuaccauuuuuaaaaacauuauccaugugcauacuuuuauauauuaugccgguuuuaacugagaagguucagaagauaugagugcauauaagauaaauauuucuugggaaaccucuagauacaaacacuguauuaauuuccauaauagaaaagggaaauuaacaaaauaagguaagaguuauuucuacuagcaaggcccaggauaagcugccuagaaaauuauuuuucuaaauggaaauauaccuuuucugcuuuguacuguacaagauuauaggcaaaauuucagagagcugaaaauccuuucaaauaauacuuccuuuagcuuuaaucacaaauaauugccucuuuuggugcuaaugagcaugagcaccacaaaauggaauguaauucugucgguucauucaggguaauggcuuugugcaugaggccugcugccgagagaucuagucucaauuuccuagaguacaaucacugagcagcaguacauuuuucacuugaggaagauguucuaaccuauguaaauauaaauagaaagcccauuaucuauugauaaaaacaacaaugcagguuaaauaaaguuuuauauuuuacuguuuccuguaacggccaucagcuuccuggaucaugaaaguaaauaaaguacuucacuuacugaaaucaaugagaaaccguccaaauccuugccuuuggugcuggggcaugaucauuaugcaggagacauuauacuucugcuggcaaagcuuuuccugagggaaggagaaacagaucaaguaugucagagcccugcugaagugggcaauucccugcaccugccacuguccuuguaaaacuguccacuaaagaaagccaauggguuaggucaggaucaagcagaaaaauccuacuauauuaaucaaucaaacuaucaauuaacaacaaaccaucgacucugacaugccucucaacuacaucuuuauucuugaaagucagugccauaaaauaugcauaaagaauccaaggaaauauaugaaccaaauaaaacagaauauagacagcauaaaagaaaugcuuuccuugcucaaauaacuucagagauagagaaaauaacaucccagggagucacccaguggaguaaguuaggauuuagcuggcuaucuugcuaaauauaauaauaaucuacaacucugcaacagcaaucugucuucugccuuugggcaaaugucccagugaaacuaaaacaguaucuguguggguagaugugcacacauauauuucuccuaugaauaaaaagucaauguaaaaagcuagagaaauaaucugcauuucaaaccaggaaaacaaaauaaaaugaaacaaaaagacaacaacaagaaacccuaaagccuccaaacaaagguuagaccaaaauauuacgaacaguuugaaaccaggaggaagacuggguagaacaugguaagaaacagcucuuacaguuaaagaagaauuugcaacuuucaugggauguggcaucagggcaguauuuuuuuauucagaguacaaagaaguugccaaaaccuacacagagaucuggaaaaggcuuuugaggucguggaugcucuggccaaauauaaaccacaaauaagacugaccacaaaugguacagaccacaccaaagaauuacuucagaacacccagaucuuuaaugaaccaauuugaaagaucacaggagaugguuguggaaaaaacccuacagggcagaauugaagauuucuuugugaaaaagauguacucccaacuuuugcacauuuguaguugucuauggagccucuaaaaaaugaggaugaagcaaugugugucaguuuuucuaagaagaugaauugucccucacuggaugugcacaucaauggcaaagguucaaguaauucgucuguuuugcaaaguuagacaaaugggucacucucucuaaaaagaaauguacucuggguuaagagaauucauccuugauaccauuccuugcuuuguccagaaccauuuccaccuuucggaguuuuuugagauccaacauaguagugauccuucuuccccuccgugcagcuuaacauguuacuacagcuaaauucuaagcuaugaauaaaauaacuaauccuucuuuccuuucuguuuacagccaucuauuaugugcuuggaaagucauaugcauguaacaauuugcacugaaccuuuccaggucauuccagcccuucucuggcuauccuugaacuguaguucuaauaaccucuagaaugugguucaagaauagccccaaagggccagaguccucuagauuccagcugacacaugagaauaugguuuaguuucaucuagucuuuuuuuuuuugagauggagucuugcuguugccaggcuggagugcaguggugcaaucucagcucacugcaaccuccgccuccuggguucaagggauucuccugucucggccuccagaguagcugggauuacagggugccacaaugcccagcuaauuuuuguauucuuaguacagacgggguuucaccauguuggccaggauggucucucgaucucuugaccucaugaucugcccaccucggccucccaaagugcugggauuacaggcgugagccaccgcacccggccucaucuagucuuuuaacaugcuuauuuuuuagauuaauuuuuguuucacuauacugccaaggcauauuaguauuccagaauaguaggaaauaacagcagcugcugccaugcuauagaagaaacuaugagaaaaguugagcuaguucugaguaaaauuuuggguacccuggcaggaagagaggcagaaauucaaacuucaagaaucaccaccaacucuacacauggcugcuacucagcagccaacacaagacccaggagugggauggucagugcagcacgaggaaggugggcaccguuaagccuauguuuaaauccacagacaaugaaagaaacaccauuuucuaacagcaaggacgcaaccacuauucuuuuuaaguuucuggagaagaaugaucuugacaaaccuacauaaaagguaagguguuuuauuuauuaaucauauagauuuccuauuuauuguuuuauucaguguuaauucucuaucaucuuuugaauuuguaaugugcaaauuaacuuucuucuuuuucauuuuaaagcuuuaccaaauauguggauuaaaacacugagacaguuuuccaugaaugcuguuacuuauuuuuguuuaugaucuuuggguugauucuuaaauuuaggauagcuauaguuugcaaguaccuucacauauauucuaucuuuugaaacuucauuaaaauggcacuucuauaaagcaucccauuuacauugugcaagagcagauucauuaaaauucauguaucaccuaauauaaaaaaauaucauaaauaagagaguuuggaccuucuaucuaaaagucucauaauuauugucucuauuuauguaccauccugguacauuuaacuauuuccuagguaccucagaaaaguuaaggucauuaccugguaaacaucuccaaacucaguuuuccuuuauugcaaaggaguuauuguuucuuagaagccuuugagcagaagaaugugagugaacugcucugaaccaguaaaaaggacaagcuauauccguccccucaauaugucgauuguuuuccccacucuaacagccagagauacuuaggcuuucuuuguucuuguuuuguuuuguuuuguuuuguuuuugagauggagucucccucuguugccaggcuggagugcaguggcgcgaucucggcucacugcaaccuccaccucccagguucaagcaauucuccugccucagccucccaaguagcugggacuacaggcgugcaccaccaggcccagcuaauuucuugcauuuuuaguagagaugggguuucaccauguuggccaggauggucucuaucucucgaccucaugauccgcccaccccggccucccaaaguccugggauuacacgcguaagccacugagcccggcugauacuuaggcuuucuaaaggugagauugcuuuagaacuuaaaaccauagcacagagaauaagagacaaaaguguaaaaccagucauuuuaucagcuugacuguccaaaugccagcguccuaacucacugagauacuguugaccacagagggaaggcaacaaggagaaaggagaauucucucuuaaaugcuacacuaaacugaaaccuucauguugacaccacuuaaagggaaaacggaaauaagcuaaacacugagaaaaucaaagacgcuaagugguccacaaggcagcaauuagagugucaucaaggcggcacacagugcugagguccuuuacacacuuacuaggcaccauguuuuuuguuuucaucuuuuaaaaugagcucugaacaagaaccugagcuuuucaaaaacacaugucacuuauucaaauuauaguaaugaaaaagcccuguucaaagaauugggcucuaccaaaaacauuuugaaaaagaaaaugaaggucaugcuggcucuuguuuuaccuuagagaaguauccaaccagaugacagcccuuuucaucauuuuuuguaaggacauaaaaaaggaauggcucgacaucauaauacaacguuuugugguccaggaagagcuuggcuaacaagcaaagguuuuggcaauaaauuuugcucauauucccaucaaccuagcaaaaagaaacagacaacauuauuuaacauaaaaauacugcaccauauaaaauuguuucuucuauaugguauuucagaaaguacaucauuuuauuuccaaauccuaaacugagagauuaaaacacucuauuaagcaaguacagcuuuaaccagaaaacagcugucacuggcaaaucagaauuccacauuuucucuuaaauuaggguacauuuaagguaguuaaaauuucucuuuaagcuaccaaagaagggccaaaccacuaguaaaggaguaauuuuuacuuguaauuuauucugagcuaaaaaugaucaggcauguccucucuaucugaaccgaauaaaucuguauuaaggaaauauaaacagaucaaaauacuucucaaguaaguuaaacuuuauguuguuucaaaaggguuucacauaaaacuaaaauaaaugaacuguauuauucugauuccucagaaguguggauuagcaaagagguuuccauuuugguuuuaucccaagcaucaucuuaaauauaauuggaaaagauaaaauaucuauguugggaauacuuacagagaaagugauaugaauuucaaccuacaauaagcacuaugauuacagucuacuucucuucaaaauaaaagaaucaagcugugauacugauggcuauagacaggaggcuaggcacagaugccaauuucuuugaucaaauguaguuacucuuugaaaauagaaaacacagcagauucaagaagaauuucccuagcacuuuucuuaagggaaauggauauuugcuaaccagagcucugaaacaaugaacuugaccauucucaggucuccuguggaccauacggguucucaucuugcacaaauuauuuuuagauuucauauaacuauuucccucggauggaaccuaggucccauacauagcaacacaaucaaauaugggcaaugggcacagaggauacaauucucccuuuaauuaaaggaaguuuacauguauuugagaguauggcccuuuuggaaaugguaguauauuacaaaaaggaaagauggagauauacauaacugugaaccagaaaaauacagagaugacagugcugaagaaaauucugauugguugugaaaaguguaagaggaauaaagaaagggaaggccagaaaaucguaaugugugauuauuccuccuuuauuuuauaaguuuuguaagaaacugcuaggagaaaaguugcccaaauguuauacucuauuaacucagauucuagaauagggaccucgguacuuaucaaauccaacuccuuauucguauaagugaauuuuacauacaugcuucugaugucuccccucucaucucuggaugguccaaaagcaccugcccugaaagaacagcccauucuuaccauccuaacaagacugauucccuugcccaugagaagacguuccauggauuuaugagagcuucaaucccagugcugacucaugcugauuuaugaaauaauuacuuaaggccaacaauguguuuugagcuuugagaaacaauguuuugguuggaagaaaagaucuaaggcaucaaggaaggagccaauaggaaagcugaacuugugacauuagcuaagcuucaacugugagcagcucugucaccucagcuggcuggggcuggcaggauagcauaccaacaggaaggucaggcaacgugcauucagccuuccuucuagcccacugguucuuacugggggugauucugcgcccccaggggauguuuggcuacgucuggagacauuuuugguuggcacaacuggaaggggugguggugcuacuggcauccaauuagcagaggccagagaugcugcuaaacauccuacgcuguauagcauagccccuacaacaaagaacuaaccagcuugaaaugucaaaagugccuagcuuuuaguaagaacuaauauaucaccuaaucuucccagcaacaauacccuucuuccuccaagcuuaccgaaagagcugauagaaaaagagaaagcuuuaaaaaaaucauaagacacaacuggaguuucccauguucucugaucagucuuggggaaaaacuagugggcccagaccugucugagaaggagccugguccaugugagaaaccuacaaccuucccuuuauuuaauaggauggcaagacacugcaggccagaaauaaagagaacuguaaggcagaauaauaaguuucagccugaacaauucagaaaaagaaaauccagaagugaaacuauauuccagagaaagaggacaucacguuugcuguacaagguaggcuuguuucaagcaccuaggaaugagcaccaaugcacaccacaaugggucacagaggagaaaaugcagcagacaacagaagugugcaaguggagggaagagcauaaaggagaaacgugaaaagcccugcagacagacaguaaccugugagaaaggcauggucuccucaaggugaaacugacucagcuuaacggaaucccugaaacugacaacagauacauaauuaaacaaugcaacuauauagaggcaaaggccugcuacgaaaucaauucuggaaauacaaaaugucuucaagaaacccacaaugacagacauauggccacaagggguuccugugaacagcagaguucuucagggguggccaucuacccagaugggagggagucccaacaucugcuagggucucaccaaaaggauuauccacacugccaagaaguggauggaaacacaggugguuguguauugaggagauauguacagcugcucaauucccuggaagagugagcaccugccagacauuggcuggagcugcugaacaaagcucauuucuccugccaaagaaaguagaauuuacaaagagcugaggagaucauaaauucauggugaauauaucuaguguagacagggauuuuggggaagacaaaaauguuaaugugaugaaguagggauucuucaucagucuaaaugguugcuuaauaugguuagauaaacauuccaaaacauggagauguuuuaaagggcagucugaauuucagugccaaaauuaaguauacuuuguaccuucuaaacacaaaucagcacauagucaacaauuaggaguacuagauuucaaaaagcugaauuuuuuuauuuacacgcgcuuaccucaaauacugaaaggucuuuccuucgguaaauuucauuugcuggaggaugaaaccauccacacuucuuggagugucuuagcaaaauauuuuuacuuuucauauauuuaagacagaauucacacagguaaagcuuugguaaucuguuaaaguuuaaaaaucauagaaucuaucagauagauuauacuguuggggggaagauuaaauauuguucaauuuucucuacaucauaaaaaggcuguauaauaacauuggaggcugggugcaguggcucacaccuguaauuccagcacuuugggaggcuaaggcaggcagaucaccugagaucaggaguuugagaccagccuggccaacauggugaaaccucaucacuacuaaaaaugcaaaaauuagcugggcgugguggcacaugccuguggucccagcuauuugggaggcugaggcaggaagaucgcuuaagcccaugaggcggagguugcagugaaucgagauugcaccacugcgcuccagccugggcaacagagugagacaccgucaaaaaaauaaagaaagaaaggaaagaaaggaaagaaaggaaagaaaggaagaaaggaaggaaggaaggaaggaaggaaggaaggaagaaagaaagaaagaaagccagccaauaguaaagacagaauguaaaaacaaccauacauuauuuuuuaauauaauccauaauaugugcucccuuuacuuugugaacaaauaauuuguuuccuuaaaaauauccuauauaaagaaagcuuuacagauguggaaccaccacccuaaaaaaucaacuuaauaaggauaucauccugucaagggaccaagcauauuuuucaaaauucacauuuacuaucuuauuuccaauuauauaugguuagugguauagauauaauaucuuacucagaagugaauuuauuauuuuaaacaaucugcauacauaugaggcugaaaaguccucaaacuuaguuguuaccauuuccaccucuggaagagguaacuuuaaaguuauuaucagagauuuauauauggucuaaaugcaguaaauagcacggcugaaaaucaaaagaccuaauuuguuuucuaccaauuccacuguuacuuugaguaaaagacaaacaccucucuucccugcugacuuuuucuccaccuuaaaaaucagaacauuuuuuauuuccauaucuuaaugaacauggcugguauuuauaagaaaauguuuagaagcacuugcaaggucuuuggaguauaagaauggggaaaaagguuuucaagagagaggcagacacaggugagacuacuuucaaaucuugcacuuauguacaaauuuuauucaaaucuuucagagcacauggcuuaucauuaccuaugcaaauuaaagcucauagucuuuuaaaauuguucaagaacacacaaccaaaugguauaaggaaggagaaaccaaaauucuugacucuuauuuugucacuuaacuuuuagaaaacacuuagcauuuucuccaguuacgugauuggccagacacucacaugcuaacgaaaaaaaauaagaucuauucuauaagaaaaucaaguuuauaaauacugaaaacuuugcagacuaaaaaauuuuugaagauacuaguaaaguguacccugacauacuuuauggaagacaucuauucucaauguacccauuuugggauauauucguucacaggcuaaucuugaguucaagacaaacaaaaacuuggauaccauuauuuucuccuuuuuauuuuuuauuuuuugagaugggaucuuggucugucaccugagcuggagugcaguagugcaaucucggcuuacugcaaccuccaccuccuggguuccagugauucuccugccucagccucccgaguagcugggauuacaggcauguccuaucacgucuggcuaauuuuuguauuuuuaguagagaugggguuuugccauguuggccaggcuggucuugcacaccuaaccucaggugauccacccaccuuggccucccaaagugaugggauuacaggagugagucaccgggccuggccuucucuucaaagucacaaauguucuaaaguaaaaauuuggggaagggucucuuaagacuacccauucccacuuacuuucucccauuuuuccuucuuuugcuaaauuucuauuaaaaacuugaaaauaaaaugccagaaaucagagauaaaaguaacaggccuaauuaaaaaauauaaaagacaacuggagaagaaagucuacccaauaauucaccauggcaaauuucuuuuuuuuuuuuuaauuugguuucauacaaaaccaacauuuccccaauuaaccaaggaaagaaagcacaaucuagaagcuaaauggcaaaauuuauaaugcccauguaacuaaggagcauaaggaauuuaccgagaacaaggaauaccauaaaaaggugcuggcaaaagcaauaguuugggaagcacuuggcauugacuaccaaaauuuauuuccuaaaaucaucccuaauuccugcuuuagaaucaagaauuuuccuuucucacauaugugacauucaaguuauacaccugccagacuuauuccauuaccuugcauauuccuguggguaaggcgaggaguaccagguuuggauuucauauuuaccaaauucaaucacagaaggguaccggccacagucuuccaccccacucucacacucuauuuucugucaaauagaaagaaaaggaaaauaauaauauauauacuucacuuacauuuugguucuuucaccagugacuaucaaaacuuaucaagaucagaacacuaaucuuaauugugaauuugcauggccuuaaaacacuauagacccuuaugaaauagguuggugcaaaaguaauuacuguuuuuauaauuuuuucaauggcaaaaaccacaauuacuuuugcaccaaccuaacauuaccuuuguguaagauucacagcaaacgaauacccuaagaaacaauauagcaaaggaaauaaguaugguauaaauacauacaaaugucgauagaacuggauuuaacaaucuguuguaacagauuagaaauuaggugauuauaaaugauguggcuauuacacaggcuuauuuauuacagaagcuuacaguuuccuauuccuccacgaaguaguauuuaucacaacuguaauuaaauaaucaauugugaaaucugcagcuuagcauuugucuccucuuauuucccuuauuuccauguaguaagccacacgagguuaagaacucugccugccagauucacugugguaucccuggugucugguacagugccugacacagaacaagaauauuucuugaauaaaaaaagccaguuuuaccauguuggaaugaaaaaacuuuagaauuagcaguaucuuucagauaauggccuacuguucauguuuacauaugaaugucagaaguaggccaaaaaaagauaauauuuaaggacuucgaaucuuuuuuuaaaagagguggcauccugcuguguuguccaggcuggaguaaaguggccauucaagggcacaaucccacuacugaucaacguaggaguuuugaccugcuccauuuccaaccugggcugguucaaggacuuccaaccuuaauaacugggggaaaucugacauuuaucuuagccaaaggaaagcugauacaaggcauccugauagaucggggcagaaugaggguuggaaauacccaauagcucugaagguagaaacugucaggaguauuuagcccaacuggcugcuacuaaaaauaaagcguuaagagccuacagaaaaccccuuccccacaaaacaggaagugggguuggguagggagucuaccugaccacacuggucauagaaaccgaauguagucacugacacaacaaauucacaauucauauuagauucgucuuugagaagucugacagccucaccugucaauaucugggugguaauaacuuaagcagaauuaaaguggaaucacuuaaagaaauuacuggacaauaaaaauaaaacugacuacaacugauugugaaacaaaauauuguuuucaucaaugcagaagagcuaaaaauaugagacauuuuucauauggcuggccaucuguguuggaagaaacaucggugaauuuaacagugauguucuucuuuuuguuaaugauuuuaaauuguuauuuucuaaauuuaggcaaaacucaucagaaaucuauuccuucacaccuagaaauguuuuccaaaaucugccucaacuaaugcuacucuguuuuauuuugugagaccagcugaguccauaccuacuuuuaagaguggcgacaauucuacuaagucauugcuuuugaauguacagucaguagaaaugggcaugauaacggcuaaagaaucacaaaggauguugaaagggauucucuauaaaaucaacacaguaauuccauauuaauaguuagaagccacaucuuauacuugcuacuacaaugugggauccucgccuuaccucccaagaaaguuccugggccugcuuaaaaacauccaaauccucuucaguaacgacauccuuguuuccaaucacauuuacaucugcacuuucuuguuugauguuuauuuuuauuucaguaucugucauuuaaaaccagcagaaaguguauucacugacuugaaucaugaguaaccaccauauauuaccaaaauggcaccaaauuagcauacugggcaaauagggauuuuuuuuaaagcuuuauaaauaagcuuuuacaucuaagcacugcucauagauccagcaguauccuuucccugcuauacucaaauuuuuauuugaauuuaucacugucaucuuuuuacagcuuuaauaaauauaugagggaaaguaagagcaauacaaagugaaaucauauuuuucaaccaagauuagaaguuuuaucgaugucuaguuauagcauucccauuaucacuuuugagauaauaaauucuaccacuuuguccaaaugacacaguuucgguuuuuguuugauaaaggguagcaaauguaaugggccaauuuguucaaugaaauuaugaaauccguuuucucccuaagguggauacacacacagacacacucacauccaaaagcacacaucacagagucacagaucaggcuuugcugagacggaagcaggaugaacuuugucaugagaaagcaauggagcagagggaagagcugaaacacccccuguuggaagcacugacagcacacaacugaacagcgcuguggcugcagaggugacaugggggagagcauggcagaagcauggcaguggcuacucaugcgggacuacaaagccauaagcaaugcuaugaaggcaucuggggguccuagugucacuacgaauggaaauaaauaauaaaaggugggagaguauuaguuggaaaaacaacauuuuggagguuuagucagcauuagaaaaaggucaaaguuucacugcuucuguaugaaagugaagugagaacaagagaaauagcuaagaccuaugugacaaauaggaauugauugguugauuuuuuucaggguuggggagaaagggacgggacgcagguuugguuggagcuuugaccuuuugcuuaccaucauccugaucagguuuaauccuuccgucugucaagcuccccuucccuggugaggggguccccaucugaggggucacuuuauauuuuaaucugccuagcauccugugcuuuuuaaggaaaguuguucgcuugaagugagcaauugcuuuaaaaauacuuccucuagccaucccccagcuagaggaggaggagugagaaauaaaccgacuucuaauaucucuuuugccaaagaagugggcuuuagauuuugccguggaagauaauucaguuuuacgacgcauacguuuggguggugcauaacucgggugucccuuuuugcgagacugucccugagugguauagauaugagaaagcccaucaaagagugccuucagcuggcuguuagugguaaggcugcucagggagggcacacugcacuggcuggaagaacucuggggagagggagaagaaguggccgugcuggacuuuugugaacuggggcucugaccggagauggggguuggggguggaagugaagaagguggagguuuuagcuuuugugugguaccuguagccaacacaugagaagugcaugacuguuucugagagaccuuuuuccuuggacgauagugcuuugaaaagucuauaauuucaccucgugaucugcgaccaucaggugaugguguaaaaaacuuaguaaggccaucaaugagcccuuugguuuucuuguuaacuuuaaguguagaggcagaaauguagguggaggugguggugauuuuggugguggcaccaggccgaguggggucuguaacagccaaucugcugcuugaguccuucccagaugcagcaugaccagaugaaggugugguacagacuuuagucuuuugaccccuaccaggugacccccuuccugugaaugcauucauggauccuucaucacugguuacagaccuaggcagaaauuuagagaauaguaucagcauuuaauaaauagaauuauaaagguaucuaaaaacaaauuuauugcaacuagaugcauucaaugggcuuaaacuuaagaacuguauuuuuugugugugccaccaccuagauguuucucuguuggaaaggcagcagcaacugcauuuacaugucaugguucuuccagggcccauccaccagguacuggaagaauccauguggacccaagggcaauauaagcaagaaaaaugcugaagagacuaaaagaacacccaaugcuuuaauuauaauuaaauaaaaacaagcuauccuuugguguugucacaaguaguuaugauuuccugaaaugucuuuuuuaaaguauuaggaggaaauaagucauauguguuauccagaagcaaaagaagaagcuuaucuaaucucuaguuaaaaguaauuuuuaauucaauuugcaaacuuauauaaauagaguuuggauauggcuauaaauuuguacuuuuuuuuaagaaaacauaaaaagacauccucuuccucucagcaguuugugcuuaggaugguaagauaaccaauaauacucucuuaggagagaagacaauuaacuacagcauaaaauauugcugaaaaaaggacaacaauagcaaaaaacugaagaaaugauuaaagaaaagcuacagcgggucagacaugacauggagagucuggugaagaagcggcacauuuaccauggucauuaucagacacuuggcgucagaaucuuuguacccugguucugcccauacuguugaguaguucuagaaacuagaggucacucgcuaacacagcugcuuacaugaacagcggccgacugucuucaccucaggcuaggguuugcgaagcuacccauuuuguagcagaguuuuauacaauagagaaacauuugcagaugaauuaugacaaugcuggggcccaagaauguacuuucaaaaugaucaauuuagcuaaaggugaauaaugacaaaaugaaagccuuaaaaagauacaauacugaauuauaaaaauaucuuaaguaauuacaaauacaagaguauauuuuagugaucaucuuguauacaaagauuuaaugaccagauuucagcuguuaguugaaggggagguaggugcagcuaccaggcucaucugagguggcucuacugccagggacucugccuggcaccaccaauucagccaagucaggugaacgcuagagaucucuagugucacuagagacacagugagaguuaccaacaaggaacucauccaggcaaaaauguuucacaucagaaagcugcauuuggauuguaucuggaaucgauugcccagaaaggauaauaugcuuauaaagcauguaaaaaggaaaacucccuagacugucuuaaaaauuccuaagcucaaaggacaauuuuggacaaacaaaaaguuaggauuggugccagaugcaauuuucagcuguguccucuguuuagaaaguuuauauccuaauuugguuuuuuuaauugggcccugaggauauggacccauguugggaacaaugcuuacacaggaugaaugcaaaaacauauaauuucuacuucaaaugauacuaccaugaaagauuuuauucauaaauguuucauguuugccucuagaaauuuuuucaaaaucuauugaaaaugucuacugguuaaaggguuuuugcaaaguuucauagaaaacucuagaaaggagccugcauuucuuacuucuucuuaggagauaaaggugcgggagaauacuauuuuucugagagcaaauaagauagugagagcagcuucagauaaaauuaggggaaaaggaguaagcaagggagugagauucuuggagucuguucaaggugugugcagagcauguauucuuucuccaucacaaugacccuuucacuaagccugaaaagauggugguagucuguugguagaacugcuauagaugugcaagucuacugaucccauucguaaacaccuuaaugcugauagucaaaucuauacucuacacagguuaaaauaaauucauuucaccucuuaucuuuucucugcuuuuccaacuaacuccugcuaaaugcucuacugggcuuuaauggcaauuauacagcaacaagauagugaaaaugggguuaucauaguagauuuccaggccacugcgaauauauuauuuuauauauaugucugcacuagugcaguugucaaauaguucugucuaacucuucagagguaaguggucaucugcagguuuuucagaagcuccuauuucauaaaagagaucuuaaaaagugguaaugcuacauuacuaucagaagagagagguauuuuucuaaaauguuaucuggagugacaaaagagauuugcuauagacauggacaaaucccucucguuuuaaaauuccuaugaaaauauuuacauaauuaagcucuaaugcucagccaguaauaaaguaggcugaaugacuguuuccaauucuuacauucugcuuccauccugcugcuugaaaaaugucacuuaguaucacagcuacugccaacagaagaccccaaaaugccaaugguaauuaaaaauguuauuuucaaaaaauuuccacagcuuaugcaaaaggaaaaguauuuuucaacccuugaguuugaaaaaaugaugccaaaaaaccccuaaaggaaucugagagaauaacaaucaccuauauuuuaaagcaaaacauaaaugauuucuuuugauaagaucucaaccuacaacaaucguugcuuuaauuuauuuuucggucguccaauggguuuugcauaucgucguuuuauuugugcagcuuucucaugaaguaguuuucuucccuuuuucuuuggucugcagacuuggcaaauccacaucccugaauuaauauauauaugagaaaaauauuuuaauguuucauuuuaagagaagauauuaaauauaaguuguagcuguaauaagcugcucaaggaugccuguaugcugaacuuuacuccaaaaaaugcgucauucccuuugucauuuuccuuaggaagccaucacuaaggucaauuucccuggagugaagguggugagggcagagguggccccucucucagaauccuuccaugaagcuguucccaacaugucauuaagccucucaccaacacauaaacacacaugaaaacucgccccugucagauauuauaucuuuugauuugagggagacauuuucaaaucaguccauuuuuggaauuucuagaagaaaaaaaaauugucuuaucaucucuuucuggaaaguuccaacacuaaaaaaaaauuaucaguauaaaauauaauuuuaaaauuuaaauaaaaguuuugaguacugcagaacuacaaugauucaaacuauacaucuagcauagagaaauaggucaauggauaagaauggaaagaccagaacaaccaaagccuacagaaaaguuuagcauaucaaaaggucauauuuuaaaucaguggagaaaggaugaaaugauucaauaagcaugauagaacaaauagcuaucuaucuggaagaggaauuauuuccuauccuuuacaagaauaaauucuagacagaugaauauuguaauaugaaaaaauaaaauguuauaaguaccaggaaagauauguggauauuuauauaaucuaagcaugacugacauuuaaaacugaagccauaaauaaaaagauucaugaauaugacuacacacaaaaaaagagcuucugcaaaucaggaagaaaaagguaaaaaucccaagagaaaaaugauuaauggauaaaaagagguacuuuagaaaagaugauauacaaacagccaagaauaaaacacaagaaauguucaaucugacuacuuaaaaagaaauaaucagacauauuucuauuaucaaacugguaaaauuuuaaaaauaauaauacucuaaucaaaucuaagauacuguaugaugcaucugacuucaaaaauauuaaaacauuaaaaaaaugugucuuagacucaaggagauauaguaacggugaguacuggucacaauacaggaaaauagguauccuucuauacugcuggacagccugaaaacugauacagccuuucauguaucuagccuuugauccaacaguuccuccucuaggaauuuauuucaaggaaauaauuguggauggaaaaaauuggaaacauuuguaauauccacccuaagggacugguuaaauaaauuagaguucauuuauauagaggguuggaaaaucaaauaccuccaggaaggaccuagauuguauaauguaugugacugaagcaaauuggaacguaagacagcagggaguagugagauuguggcaaacuggagcacacacgcaccacccagaggacucagauucaaacuuguaaaaauauuguaccaacaaagcauaucugugacccauaguugccagguuuguaaucccugcucuauacuauggaguucuacauacuuauuaaaaacuauguuuaggagaauauuuaaugauguaggggaugcuuauaaucuauuaagagggaggaaaaaguacauuacaaaaacauguacagaauguuccauuucccuucaaaggguaugugaaggcagagaaggaaauuuccaauucauuuuuauuuuuauuccuuuuuugucuaucuguacuuuuuaaaucuuccacaauguaaauuauggauuuuauaauaaaaaggcaaaguuauuuuuaaauguuuaauauauugcaaaaugaggggaaaaggcugagcuuagcugauuuacacaauaaacagaagaaaauccacauuccaucagacacaaucagcuauaagaucauucagaugcucguguucaaaauaucaacuaauggccaagaaaauggugauggcuuccuguuguaggacuuuggagucacuaucauccucaaaaauauaaaauuuguuaagcucuuaacacugugcugaauaauauggaaaguguucuaaacuuuugaccuuaauaaucuaaucuuauucuaauaggggaaugguuuggagagagagauggucuuuucaucccugggucugaauuagagccuuuauuuuauauauauguauauauauacacauauauauauguauuuuuuucuaugcuuuuauacuccucuauucacaaccugugcuaaacucagaaguauagggaaggugggagggaugaaaaaaaugcuuaaagaaccuguauaccucugagcugucagaccucaggacaaagcuaaccaauauguaauaaaauacauuuuuaguacaguuuagaaguucaccuuuuggcauucuggaaaguggugggucacagcauuccauaugaaauccucuaucacaggaaucacaaaaaagcauauuauccuguaauauaacauauuagagacuaauugagacugaaaccaacuguaaaaggccaaaaauucuuuuguuacuggauuaacauuaauacaauauaaggaaagugcaccaagauccugguugcaguuugacaucauguguauuuaaagcuuuagaaagaaaguagccauacucuauaaaaaugaaaacaccuuaacacuggaaauuagcgaguuaccuggaggcggauuacgggagccauacuuacagcauuucugccuuggacucuacaggcacugcaugucuugcauucgaugcacugccaccuuaaggccuuuacauuuguuguuaauucaggacaaaauuucaaacaggauggguguccuaugagaauaaaaagcaaauugcuugaugggaauggugccuuugacuuuuuuaaacucccauucccuaauauuuaauagauagcugaugaggcuagccaaugaaccuuaggaacuugaaaaugccaacagaucagagaauccgaauuacagauuuuccuuucugccuuuuccccuugccuucuuucccuguauguaacaaaaugacuguacgaauguuuucccuaagagaacuuaauuuauaccaauuccaaucugaagccuuugagaacuugaagauaacacaggcucaggcauucuuacuccugcaccuguacuugccgucuucaucaaccaccaucuacccaggggguccugguuugccacacacugaggggaguugccaaaguucaaacaauuccugcucucugugugugaugaaaucauaaaacucaacagauaacuaaauaaaaaauugaggcugcuuaacauaacuacagaugcccucccccacccaaauccaauagcacacaaagaacaucccauugcugggcuagacagaggauauuccauugccaucuugccccugggucacugaguuuaaacucuggaagcaggagcagaaaacagugaauuugagagacagaguuaagaagcugagagauccagguuaaacaggacccaccaagaaguguggccucagcagguucccccauuuuccuguuuggggcacacuuuucaccuagcagcgcuccacacaccaggucuuacugcucacuucacagaggaaaacuggagacccugaggggcaaugccauucaaaggagccagccaugagccaguguguaauagauuccuccaagaggugugcggagcgugagccuagauucuuuggaaggcuguacaguuuaaaaucuaauggucuuuuaucacauaaacccgaagagaucuccaaacuugauuuuauuuuuuuaaaccuggucuuuaaauaguaagaacauuaguaaaucccaugugaaagaacuuacaaccaagcugcaaaggaaaccugagggguaauaaaaaaaagcagauucugcaauuucaaaacuguuuuauaauuuccugacuuuggcaggcucauuguuuaaauauguauuuuggauugcugccaaaaagguccuccucccuaaagcuuaacaggugcuucauaaaauuccacccaccaggagauuuggcuuuuugaaguaaaaacauucaaaaucaaucaccaauaccguuaauaaaagcacacuauuccugaguuaaaaaaaaaaaacucuaaacaucuguauuuaagauguugagaaaauaaaauauugucacaggauuaugaccucaggcaggagagacacccaggcagaugcauuuaaccugugacacuguucuuuuaugaggcuucucucauucaaaugaaugcaaggaaaaagucugaauagauaaaaaugguaucaaucuccucuuucugcucaggaacggcaaacaaagacagcuugcuugucgacuucuaagaagcacacugaagcggggaggggagaggucuacuuugaucagagcccuccccucuguccccuuauauagugaggaggguaaaaacuuaacuuuuaaagaacagcaauuuaaauuccacccuuaaaauggaucccaucagcuuaaaaguauaccacuuacuuccccccucuuuuuuauuacuuccuguaaggcauauaucaugggcacauaugaccucaauuucacgcacugaauuuuucucuacauucaaaucugcuuuuguacuuugugacuuaauauucaguaacuaagguaauucacaucauauuacagcuuacuauuuauucucacagguaucuuaugaaagacagacuuuuuaauaauuaugcaguuugaaaauuaguggauuucagccauuuucaaucaggggcaaggaauauucuuucucuuaaugguuucucucacuuuaagcaauacuguaucucaacuacuacuauuuaagcuacccuaucaaauucuaaaaucuucagccuaucuuuccuuuaggcagcaaucuuaccuuuauuuagcucaagagaauuggccauagaucccuuacaguucuaaauuucuaugauucuguaaaggaugcugagggaugaagaaauauuuccauuuuauuuucucauggccaacuuuaaaauaacacaaaagaccguaacgugucuugauauacuacugcacaaucuauaguaauuagauaaaggaaagcaaugcuacugaucaaguaauuccuuaccucugguuuagcgauuucauaaacucaacaauuuccucuaacacuuuaauuuuuuuuuuuuuuuugagacggagucucgcucuguugcccaggcuggagugcaguggcgucaucuuggcucacugcaagcuccaccucccagguucacgacauucucccgccucagccuccuuaguagcugggacuagaggcgcccgccacuaugccuggcuaauuuuguuuuuguauuuuuaguacagacaggguuucacuguguuagccaggauggucuugaucuccugaccuugugauccaccugccucagccucccaaagugcugggauuacaggugugagccacagcgcccagccuauuuuuuuauuuuugagacagggucuuacucuguugcccaggcuggagugcgguggcaugaucacggcucacugcaaccuuagccucccagacucaagcagugcugucaccucagccucucgaguagcugggacuacaggcacgcaucaccaagcccggcuaauuguuuuguauuuuuuugguagagaugggguuuugccauguuggccaggcuggucuugaauuccuggccucaagaauccaccagccuuggccucccaaagugcugggacuacugacacaccccaccacguccagcuaauuuccucuaaaauucuuguucucucuguugacacguuucauggugcuuugucuuucuggaguuuguuuuacuauuguauuuugcaauuuaucagauuugagagccauaauacauauucauucacucauucaauuuuacacaaauacauugucaaguacuaguagcuuacaauaguuuuaucuagcaaaaccaaaggaauacuauuuaaaauuaaacaaguaccaauggaacuacaaaccaguggaaaagcuuuuuggagaaaguacugaggaagaaaaaacacaggcucuguaguaagcacaacaacagcagcgccccagccaucugugcucuaauucccauaaccuguaaacauacuauaccuguuguagcaaaaagaacucugcagaagugacuagggguaccgaccuagagauggggaguuuauccuggauuaucugagugggcaugauugaucuaaucacauuaauccuuaaaagcagagaaccuuuuacggacuugguuagaaaugaaauggcaaaaggaggaggaaggguucaaagcaugagagagacuccaccugcuaucacaggcuuucaagauggggagggggcugcaagccggggaauguggguggccuguagaaccuggccaugaccuucaccugacagcaagaaaaccaggaucucgguccugucaacacaaggaauugaauucugccaauaacccagauggauaagaacauggauccucuccuucccagaacuuugggaggccaaggcggguggaucacgaggucaggagaucaggaccauccuggcuaacauggugaaaccccgucucuacuaaaaaaaaaaaaaaauacagaaaauuggccgggcgugguggcgggcgccuguagucccagcuacucgggaggcugagguggaagaauggcgugaacccgggaggcggagcuugcagugaaccgagaucacgccacugcacuccagccugggcaucagagugagacuccaucucaaaaaaaaaaaaaagaacauggauccucacuuaaagucuccagagaggagccagcccugcugauaccccgauuuuaaucuggugagacccaugauggacuuccaaccuacaacuauaagauuaaaaauguguuguuuuuaagccacuaagucuguaguaauuuauuccaguagcaauggaaaacuaauaacgacucagacacuaagccccucagacuggcuaccugaccauccaucuguccaucucuccucccuucaacuaauauuuaaugagcacuggauacagugaggaaaaggagaggcaugguucccacccuuccagaucacauagcccagcaggaaagacaaacauuaaacaagaaugagcauuaaugccuuacaaugggguggcuuagggauaugggagaaucuagcaggaaguuagagaaaggccucccuaaaaaagagacccaaaagaugaaugugauuggaugggaccagaagaggggaagagcagggaagauggcaugaacagagggagagaugaacgagguauauccaaggagagagaaguuguucaauguaaccaaugugcagaaugugaacagaauagugauguaagaugggguuaaaccagagcccaauccagaaguuuuugggggcuauauuaaagaauauggauuucuccuaagagcaacugauagccacuuaugaaauuaugugaucagauuuauaacuuaaaaagguaacuuaggcuauaguauggaaaauggauuggaggaaaaagggugaagccuagauugaggucauuauaacagcagaucugaguggggcuggcugguggggaugcaucgauaaauuuagcauucaagauacauauuaugauuuagaaucaauguguuuuuggugauuccuuggugugaaagaauaggacagaggauggcuccaaaugucuaguuuguguaacugagugaguagcgaacggugugccacuugcugaauauaggaaauccuccaggagaggugggauacuguuuguuugcugggauuucuguuguuauuguuguggcuguuguuuuggguggaggaagcagugcaagguugaugagcuguucuggauauuaacuuugaggugccucggggguagacucguuggaaaagcucuauaguuauuuguaucuagggucagaagcucaguagaagcuacaaggcaaaguaacaaacacagggccacgacagacaucugaagaaacauuuagggaauggagagaggaccaaggggcuaacaaaaauauguggaaagaagugguagagaaaaaacacagauaauauggugucacaggggccaaaggaaaagaacacuucaagaaaaaagauucucuacaagaucaaauaugacuaagagaaauuauuugguguggauuaaaagauaccaauuagauuuugauaaacacuuaaaaaugaucauuagauuuugcuacaaagaggucacuauuacccagacaagcacaguuuuagugaaguuacaucucuuuggauggucaaucaugcuuugggcuuuugcagggauggggcucaccuucuuucccccaacccccaaucuuuucugcuuuguuuuuuuauuuuuauuuuuugagacagaguuucacucuugucaccuaggcuggagugcaguggugcaaucucggcucaccucaaccuccgccucccggcuucaagccauucuccugccucagccuuccgaguagcugggauuacaggaugcgcuaccaugcccggcuaauuuuuuuuuuuuccuuuuuuuaguagggaugggguuucaccauguuggccaggcuagucuugaacuccugaccucaggugauccaccugccuuggccucccaaagugcugggacuacaggcgugagccacagcgccuggccucuuuucuucuuuggaucauaucuuuagguuucuuucuagucaagagucuucuuuccaaccuaaugauucaaucugcaucuagucaaugugaaacuggaugacuaagcaaccaacuccuggggugaccuuaagaaacuaguggucuuuuaaaauauuuuuauauguccauauauccacacacugccccuaccaguucccuccaugagcaugcaaauuuuguucaggguuaacacacaaauaaagacaaacccagggaagacuucaggucucccgagggugcacugauauucuacuccacggcucuugcucccuuuauuguacaaaagggauuucucucacucacccagcugcaucacagcagccuuucuucugucucccguuucaaugagcuuccacuuagaaugaugcuguaauuuugaacuguacacuuaucuuagauuugcuaauuugaaaacacacaugcacacaacucaucuguaaguaagauuuaaccacccagcaaucugagcagcagacacaaaauuucauuugguauaauaucuaauacuuaugugaagcuaauuaaagauaauuuggucuuaaugaggcaaagagaauauaacaguguuaauuucaaaguaggcugauccaugaaagucaaguaaaaucauuucuaacacuuccacagaccuagacuaucugaugauucccacauucauauuaguggcuggaauaauccuucacauuugucucauguuuuacaguuacugaucaucuuccuaucauuuucucacuggaucccacaauagcucuguggauggagggugcagacauucuccuuuacaccccacagaugaggaaaaccaaaguuacacacccagcaaguggcggaagagaacuggaacccaggcuagggacaccacauucagagcuccgggcacuacauaccucaccucacguuuuuacuacauauaaacuugaaugauuuuuuuuuuuaaagaauuuuuaguagaaaaaaaaacuguuaaagaaaauacugcccauuuaaagcaucgagccccuuuaaaaacagauaaauuucuaauuggcuuuacuuuaugauguaagcagaaggauacauuuauuacucucaucuaugaaaucuaagcggagucuaaaugugacaucauaugaaugguacuucagauagggacgacugaaaagcaucaggcacauaugggaaacacauuuaagaaugauccuccccacaggcugccaucuauauuuccuuuuucugguuuuaugcugcuauggguauuuuuucacauaaacaacuuacauuuugggaucccuuugaacauuaugaacggucucaauucaaucccagaaccaauagacucuucugagagugagaaggcagccauuuccauaaggucaacuaggagucccaacuaaucuguaauucccacuugaaaugcugaacugugacaacagggcucccgccauuauuugaggacacuguugagguaugcuggccuauuguuuucuuuuuuccuuagaauuaccaaggugucaaaacagagccuuagaaccacaagaacccccaaacucccuaaaaugaacuauauuuuauuuugacccuucaauuuaaagaggaaaaaacaacaaagucuauucuucugauuuaucagaugaauaaauauguacaaagcauuucccugcguuaggaacaauaguuuuuuugacuaaagcagccaaauccaggcuggcacagcacacucaagggaagauuaagugaacuucaacacuagagccggaucccaucgcagaguccagagaagcacucugaggcauccuuuauccccaacaaagagacauggugaccccagggcuugaauuucugccaugacccauaccuuggccccaaagccucuggcucucuccacuugaagacuggcucacaaaaccacaccagccacauaaacccucuggacaguauccucaagucauuauucuccauuuguuaaaagagaaaacaagaggauauuuuugaacagagaaaacauaacacuguaccuaaacaccccuggcuuuacccugaaaaagucugagcgaaaaguaagaaacaccaggggaaagaaauuuucagugaccucaaacauaaaggagaucaaccuccccucuggcaggucuucaauccgggaaagacaaagggagauugauuacaucagaaaaucuaagaucuaccuguuuagaauuacaccuuuauacccugugaaggaggccuugaaguuaugaucuagaagauaaugaucucgaacuucuuaucaacucaaguaaguguaucaccagagguaaggaaauauaugaagggaacuuuucuucccacauuuaaguacaucuuuaaucugucuaggcacccagacaaauagauccuaaagaaauaaaaacagggaaggguguuuuuaaaguaccaccuuaaaagccacaaaggguaaacccuagacaagugaacaccacuaaauugaucaggcaguuacacaaaagaauaauucauucagaaugagccucgugagaaaacccaaaagauaacgacagagucagaacugaugagugaggcacuaccucaccagcauaaaacagggauaucguggggcugaaauguauuaaacugaacguacagauaauguuuccaugcccuuuugucacuauccaugaugccauggccagguaaaagaauuuuaaugaaucuguaaagcccaucaaaaagacugucagaaugcauuuuucaagcaggguuugaaaugucuuauuuccaaggcucucccuucuagucagcaccugaaagcugcugaaccacaaagggccuaucacguuaaaccuucauauaaggaauaagaaucauuacacaacacugucauuccucagcaugaaacauuucuucuacccaaccaucaagcagcugucauaagugaugauaagauuuuaaauuacgugcagcaaucaaggauaacaauaucaaacaugcuaaaccauaacacugcugacauuuguaguacacuuaccauaguucugcagaccuugugccaggguguuuacuugugcccucacauuucauucccauaaaacccaagaggauggugcugccauuaucucuaauuuucuaaugaggaaacaggggcucagaaugaucaaguaacuaacucaaggcagaggaacugggcuauggcuggcucuugaguuugcuccuagccaguauaucucaagacuucccaaacaagaauuagcuaugguguucugucgauuuuuguuuuuguuuuuuuuuuuuagagauuacuauaacuagagaaauagucaugaauuuuaaaacaagacuuuggagaaaaaaguuuggguagucuggggaaaaaauuugaagauuaacagaaaaagcuuaauuuuuacuuauuuuuugcuauuaauuuuuaaagaugggguuguacucagcuugaaagcuuagaauucucuacauggaauuuaccuauaaugcagacaucuccacacugaauuaccaaugcugguauaaaauaaaagcuuaaucauaaauauguauaguauuauauaagcauauauaauauccauaugucaguacuaacauacucacgcuuuuuucucuauuccuuacuuuuucuuuuaaaauuuaaagccuaugcuauuaccauauaacugccuuaaauaacaauacaguuuuaauagagagacaaauagcaugaagcuaugauaaugggaagucauuguacaacacauaggaaaaacacaacuuaccacuacugccacaaucugcacaagagaggaguucuucugguuucuuuucacgauuugauucuuuaguccccaaacagaagcuacauauuggaaugggaucagcacggggcuaugacaaaauuaaaauaaaaaauacugucacuuuuccauuucaaaaguaaaaacauuaaaaucaaaagcuuuuuacauuuuucacuuaaagcuucuucuuucuuuaacaaagaaaaacugcuaaauaacguauuuaaauaaacacuuucugcuaguaaaaaaacucuuauauuauuuuugagacgaagucucgcucugucgccagguuguagugcaguggcacaaucucggcucauugcaaccuccaccucccggguucaagcgauuccccugccucagccucccgaguaucugggauuacagaugcgcgccacuaugccuggcuaauuuuuuguauuuuaguagagaugggguuucaccauguuggccaggauggucucgaucuccugaccucauaauccaccugccucagccucccaaagugcugggauaaaucucuuaaauuauuugacacuaaaguacuaccugaauacauuucaguauaauguaugacucagaagucauuuuuauuaaaccagugaaaucuaauaccuuuauauauuauauagcuugccugaaaugaacauaauuaaggauucauuggacaucucaauuguuucuauuaucuauaugcuuaaaauaaauuauucguucagcauuauagucuaugaauaucauguauagacuguuaagacuuuauuaaauauugcagcgcagauugcuauuauucaccuacuaaauauuugacauaaaauaucuauauguuuuuaggugacagaauaauagaaugagcaggauucugugggacacuugaaaaggucauuauuaacaaggcuuuugugccacgaaggucuucaaaaguaaaccacaccauaccaaacaaaaaagauaaaccuugaaucucugacauucucaccuuauuuauuuauuuauuuauuuauuuauuuauuuauagacagagucucacucugucgccagccuggagugcaauggugugaucuuggcucacugcaaccucugccucccagguucaagugauucucuugccucggccuccugaguagcugggacuacaggcgcgugccaccaaacccggcuaauuuuuauauuuuuaguagagaugggguuucaccauguuggucaggauggucucgaucuucugaccucaugauccgcccgccucagccucccaaagugcugggauuacaggcgugagccaccgagcccggccugacauucccacuuuauauaagaaacaacaaaacauuugucuaguccccuagcacccuuuaacucucguaugaaaauugcuuuuaacaauguauaaaucuacauacauuuuaguauuuccauuguuauuuacuacuaucagcaaugcuaguauucccauccauaggaauagcugacagugccuacagaucuggucacauuauuuucaacagccaaaacuacgaaaacuguaauuuuaccgcauauuccaagccuucacacauguugucugcuagccaucugaauguuacuaugaugucucuauauuugaaucucaugaaucaaaaauucagagcaagaacacccaacauaaucacaaauguuuuuaaauguaaauuaaaaacaagauuuugcuaggucuaacucucuaaauauacaucagcauagaauaaacuucauuuguucagccacucuagcccaaaugccuaaugcauuuccuggugcauaguaggcacucaaaauauaucugcuaacugaauacaugaaggaaauauaugcuaguuaagaacaaaaaaaaucaaugguuauaaugauuccaacaaaugccuuaguuccuugggacaacaugucaucaaaaacaaaaaaccaucucaugaccaaacauucacaaauuguuuaauaugacugcaaaucucaucuuacaagggcauucauuaucuucccuuuacuuucagcuuaauuuguucuuauaauaugcacaggcuuuacguucugagguagcuaugcaaauguauuucuguagccccaguuaaaaaguagauuauaaaacauucuguacuagaaaaacgaaaagagacaagcuauaacaaauuggucacugacuguagccacaguuuuuuaaaugccagauaaucagcacugcauaauuauggauccauaguuauuacuugcaacugcucaacugcaguaccuugggaacacuuuuguuccuuuaaauagcaauuaaaagaacaaucuggcuuuaaagugacaacauuccccugauagauuugagcuaaaacccgguccucuuacuaacgggauuccugcuuucauuugauauaacaauguucaagcuacugcugucauccuugcacugauaaauaauuuacagaaugucacauaucauucaugcaaugaaacaaauccaaaucuccaaacccauuuuucuuucccagaugaauuuuuagcugugagagagacauggccaucagccagcauucaugcucauuuuucguuuuuaacuaaagguaacacaaaggacaaagguugcuaguaguucauggccagaaagacugaugucccgcgcucuguccaauaauagaaagcauagauguuaucacuucacgcuacauucaagcgaaccccgccaugcugauguaugcucacaaccauuuauuuuaaggauaacuaucucacaauacucuauaaaaccacugcauuauacagaaaugucugcccugcugaauuauugauaauucaaagcacuuuuugcuaaccuccguguagccaagucuaauuaacuuuuaaaaauugucacuuguacgaaaugaaacuuuuacaguaacgcauguaaaugggucacaggauuauuaugauucacuguucucaaucagacuacauauaaacuguguuuaaaaaaaucccuuauaauaaaguaaaauggauuccagucagaaaaaggucugaguaaauggcaauuugauucuauacaaaucuacuacagguaaguuauauuuaagaugucugaaaaugauaccaaaaaucuccaaauucuuaauuccuuucuuugaaauuucacaaaggcaccuaaccuguugaucacauuuucccaacaacaugccugaauauuuuaaacuaaucccaagaaggaaggcucaugaauaagucuaaagaugaauacauccagcaaacugugcucuggaaggaucuccuugucucccaugcaauggcccuggggcagcugcuaggcuacaggcugcuccugcacuaucucauuuaaucaucuuaacaaucuugcccgguaugaguauuaucucuauuuuagaaaagaaauugagcaucuaagaaguuaaguaacauuuuuaagguugcauagguucagguguagagcuguacucaaacacaagucugucuucaugagagcccauuucuuacuuugcuaccuccccuccauuccucagaauaacaaaugucuaaaauuaucuuuccaucaguggcaauaacucuuuacuaauguguucauaaucuauuccauacaauuucucccaugaccaauggcauaugguuuuuaaaacuauuaaaaagguaaccacuaaacaccauggauuauguauuaauuaccauggggaaaagguaccuuuacaauggagaaaucugguggacacuuuauaaacaaguaugggacaaagugacaucaugugccuuccaagugccuauccuaaaggacugagcaccaccuauauaguauucuugccagaaacauuuauccugaguccaaucauaaagaaacaaucaggcaaauccaaauugggggauauucucuguaacaacuuuucuguacucuugaaaaaaugucauauaauacccaaaaaagggcaggaccaaccugggcaacacggggagaccccagcucuacaaaauaaaaaaauuaggcaggcaugguggcgcaugccuguggucccagcuacuuggggaguugaggugggaggacggcuugagcugaggaaguugaggcugcaaugagucgugauugcaccacugcacuccagccuggguggcagagcaagacccuguuucucaaaagaagggaggcagggggcaggaccaauuaaggugacuaaacaggcaugaaaacuaaauauaaauauaaucugugauccgugguuggauucuggacuuuuacaaaauauccacagcuaugaaggauauuauugggauaauuaggguaauguauacucagaauuaggcaauauauaaacuagauauaauauaaauuucuugagugaacauaauucugauuauguaggagaauaucuucguuuuuagcagauauauguugaaauauaggaguaaaguguuaugaugucuuuauguugaaauuuaggaguaaaguguuaugauuggagaguaacuuacucuccaaugauucagaaaaaaacaaaccuaaggguguucguauguuaaugugcacagagagagagaguaaacaugacacaauguuaacaguuggggagucuauguaaaaggcauauagguguucauuacauuauucuauguaaaaggcauauggguguucauucuauaauuuuuccucaucuuuacaacuuuuccaaacaaaaaguuggggggggggggauaaaauugugucccuuuacucucaaaaaagaucuaaacugaaucauuauuuucaguaggcccucuauaucugcgggauuaauauccguggauucaaccaaccaugaaugcaaaauauuugaaaagaaaaaggaugguuuugucuguacugaacauauauguuuuuuucuucucauuauccccuagacaauagaaugauucacauagcauuuauauuguauuaguuauuguaaguaaucuagaaaugauuuaaaguauaugggagaauguacauagguuauacacaaauacugcaccauuuuacauaagggacuugagcauccauggaauuugguaucaguggugguagaggggugagggagggguccuguacccaaucccccacagaugccaaaggaugacaguaguuggacuacaaacauuuauaaaucaaggucucucaagcccauuaccgacucagaggaaauacagaggacagaggaauauguuaaucuauagagcggggagaugcuaguaccaaaacacuacggaaaaaauggcccaguuucuucaacaaauuaaacaggagaccaagugaauaggcgagcaaaaaauagauacagaagaaucgcuagauuaauagacauuuaaagggcguaucagccaaucacaaugugugaaccauaucuugaucaugauucaaacaaaguauaagcaaaacaaaacaaaauauuaugaccuagugaaggaacaaaggcuacuuagcuuuaaaagacugggguggacucgcugggugucuucauccaggugaaaggguuagauucguucuugugguuacagaguacaaaacuuacaccaauaggagucaucauagagagccuuuccaacagcuguccagcaauggaauggauucuuuuuuuuuuccgcuucauuugcuuaguuuuuauuuuuuuaauugugguucaaauggcauuaaguaaguucacaauacugugcaaccauuaccaccauuuaucuccagaacucuuuucaacuugcaaaacugaaacucuguauccauuaaacaauaauuucccauauucucuucccccagcccaggaaaacaccauucuacuuucugucucuaugcauuugauuauucuagcuaucgcauauaagugaaaucauacaguauuuguggaauggauuauucuugaggcaauaagaggccccuauaaucaagaggccauggagagacuggaugggccccaucaggaugcugaggacacaacaguauacaauuucaccucacacaauuuggggaucugggacucuucaaagguuccuuccagaucaaauauuuuaacgguucuagaguuaaucucuaaggacuuucccaguucuaauuuuuauugauucuauaauacuuuagaaauuuuaagagucuucaagaccuuugaucucaaaauaagauagcauuuucuaaggaaacauucuuuaaaucuaggacaaugcauuuuuaagaagcuuuauuuuacuuugugauuacuucuguuucugcccagaaggaaacuauauauuuguuagccuuagucuaaguaacuggacaaaaauaaaugaaaauuccugcacaaaaucagagccaggaguauuuagauucauauccuccuccugacaaugacacaaaaagggguuuuguaagccauuuccaugguaucuguucacaaugaucagggacauauaacccucucucuccauaauccccuauagauccauacuucuuaagucaucuacaucuuucaugagacugcuuaaaaaaacauaccauuuuaguaaucccaaguguuaaaaacaaaacaguucagcauuuuucauucauauguucauauuugcaccacagaaagacccagauuuaaacgcugcucucuaagccucagguuuccucaucuguaaaagugcacaauagugucuguguugucuagcucucggguuguuaaaguucaaaugugagugaguguggaaaguauuuuguaaacuacaaaguucuacucaaauauuauuaugaguauugcaaaauuuuauuuggcuauaaaaacagaaagagcaaacaaacaacuucaaguccuuaauaagcaucagaacaaaugaauuauucuggaguuuagaauuacucuauaaaagacuuucauuuucugagcccccaugaugaauauuaaucuuagaggauuuuuuuaaagaaugaauuaaucagggaguacaggaacagaguagaaaaugccuccacugagagccaaaaggccugcaacuauuuaauaaaaggaaaacucaaacuaaaugaaaagaaaaagauguuggagaaagaaaagcauaaacaaauacaaaaucuuaaaugaauaauacuacaaaagcaagcaaagaugaauacuggcugggcacgguggcuuacgcuuguaauccccacacuuugggaggccgaggugggcagaucaccugaggucaggaguucgagaccagccuggccaacauggugaaaccucggcucuacuaaaaauacaaaaaaaaaaaaaaaaaaaaaaaaauuagccaggcauggugccuguaaucccagcuacucaggaggcugaggcagaagaaucacuugaacccgggaggcggagguugcagugagccaagaccgcgccauuauacuccagccugggcaacaagaaugaaacuccaucuuaaaaaaaaaaaaagacucuucugugucucuuuaguuugcucucccuuguuacacuguacugaaaugugaaguuuagguaaugcuuugcuguuuaccacaaugcuuuucccaagucccaaauacgaaugccaugcuacaaggccaccucucuaaggucaccuaacuagugagauggaggaacuuccagccugcugaugccaagcccuucacucucuggcuuuccccaugguuugucccuccuuucacuuggagcuugauauaccucagcagaaaggcugucccugaccaucccucucugaaacuguacuccacuggcaccacuccagaaucuccauaccuuuuuuuuuuaggagacaccacucacuuugucacccaggauggagagcgggggcgugaucaaagcucacuccagcucgaucuccaggggcucaagugauccucccgccucagccucccaaguagcugggacuauacuggcgcacuaccacgcccagcuaauuuuuuaacuuuucauagagaugggggucucgcaacauuucccaggccaucucgaacuccuaagcucaagcaauccacccaccucggccucccaaagugcugggauuacagaugugagccacugugcucggcuccauaccuuggcuuuauuuuucuucauugcacugaccauuaucugaaauauugcauaucauuuauuugucuguuucccuuacuaaaccauaaguuccaucaugauggcagagacuguucauugcuguagccccagcuucaaaaguguaucuauugaauaaaugaauaaacaaaugaauaaacugcucugaaguugggaacugguuucuccaauucacaggucccaaaauauugucaacugucuuuuauuuucauguauauccucaaugaccacaaacacgacauguaaagaaaccaucaauggcaagguggguuccaccauugucuaaucugaaaccuuuuuuacucugacacacauaauaaacgacauuuauguuugcuauauacuucccugggcauaaacugacaagacgggaccaaaauuuuaaaaucaguugggaggaaaauuaucugcccaguauucacuauuagggcuugcuuaguaauagucacuauagguuguaauagucacuauauaagacagauuuggagcaugaccaguugccagcaccuaguugugguggcacucccccuccccagucccgcuauuucuuuccaucucuacaaagaauacaagguuauuaaaagaaaaaaaaaaagggucgcugggcgugguggcucacaccuauaaucccagcacuuugggaggacaaggcaggcagaucauuugaggccaagaguucuagaccagccuggccaacauggugaaaccccgucucuacuuaaaaaauacaaaaaugagcugggcaugguggugcgcaccuguagucccagcuacucuggaggcugaggcaguagaaucacuugaacccgggagagggagguugcagcaagccaagaucaugccacugcacuccagccugggcaacagagcaagauucugucucaaaagaaacaaaaauuaaaaauuaaaaaaaaaaaaagaaaaagaaggaagccaaguaaaaugaauacacugcaaugguaacaaaauuauaacaagacuauguaucgguuuagucuuuuuaaauuuaauuuucauuucaaucuauucaauuuauuuugagacaagcuuuugagacuggcuaauuuuuuuuuuauuuuugguagagaugagguuucaccauguugcccaggcugaucucgaacgccugggcucaagugauccaccugccucggcuggugcuggaauuacaggaaugagcuaccaugucuggccuguuauggucuauuuuuaaaagaaaaauauuuuacaaauuuuggugccuuauuacugguaaugaauuauuguccacaaacuucacaacugauggcacugcaacaaaggcugaaaacugcuuccuguuguuacuaagguuuuuuuguuugcuacuucagaacucuauuugacacuuaccuaauaaagaacuagacuuuauuucuugccacuuaacccacuuaugcaacugaugucugucggaacagaucaaguuugcuccuaauuaggauagagaucaugcacacucaggauuuucccucacagcaaucugcuucagauauggucuucggaaacacacuaacucuaaaaguagggauuuccugugaugaucuaaaucaucuuauuuuuuuuccagagcguuauuuuguucccgucugcaucugcaguaacaguaacuguggucaggacagccauuccucugcagggagguucaugcccagcacucccucagagcagcccugggucuacuucacauccuucgggguagaacagaacucuguuuacgacaagucuaucgccauuuucucuauacuccuguacccuuuuguuuuauuccauggcuauucuugcaauuucaucaugaauuggacauaaguagacaccaaacaauuuuuuucuaaaagauaauuggagauauacuuacuauaagacuuuacacaggcaacacugucaucauaauucuacucucccuauauagauuuuuauuguaucaccuccccugcucauuauacuucucuguggguaauugguucugugagggagcacuauaucauccccccgagcucuguggauuaaguaucuguauuacucagggcaaaaggauuuauuauuguuaauguauggagaucuugaaugugacugcuguauuuuuaccuccuugucacaggaugaggguucuccauauuuuaagugacaguaaggaagcaggaaaaucuaauaaaauaaaaauauucaaaagcaucccuacauauaucccuaaaauacaucgcuucuuuuuucauuuaaagaaaucauuuagaaacaaaaaaagauauaaaugaccacacagugggaaagucccaugaucaaaggcugacucagaaguauaaaauaauaaagcuuagccauaacggaguaagacgagagaaggaaagucuuucuaagaacaucaaccacaacaguuuuuaauuguguggacuuaauugaaaugcucacacuguauccuguagucuagaacuuguucuaaucaggcaggugugccauuuauaaaagugcugauuaaggaaagugauucuauuggaaggaaacaaaucuaauccuacauacugcauuuaacaauagcaucucauuugugugguguguguuuucuuguuuuuuuuguuuuguuuuguuuuguuuuccugguagaugaagccuacaaauuucuuagggguggggcgcggggcuggggaaaggacauucaugaaacaauugcuugccccagggccuucaguuucuuaucuggacagggacuucucuccuccacuucugccauuagaaacugcagguauuggauuuaucuucugaagagggaccaaagucugauucaacacagcuggaaauucaacacaugguuacaggaagucuguuuaggauuuacaaacuauucucuuuggcaagcauaucaugauauuagcaauauaaacccuacucuggauuuagaaaaauggaauuuuaaaaucaacuuacauucaagugucacaaaccuuuagucauuccuuuuuaaaaagaaaauuaacaaagugccucucuagugauucccaacuucagugcuguaggaaccuucacuggagcagguccagacuucaagacuauaauuuauuuagggauacaaaaaucgacaaggauguaaauagaaauucugucuuaaagacggcaagaaaaacaguaggaaaaccugggcacuagauucugaaaacaaugcaaguacugccauugguagaaauucuguauuguaauucaucucuaugacuugggaauguuuuccaagugaggcuagaagcaaaauaguaaugcauagauuaaaggauaggcauaacaacaauuuacaagaaacacaagcaagagcugauacuuaguagagcuguguaucagcuagaggcagcuaggagcuucugcaguugccccaaggcauucauuuuaauuuagauauggugcuacaaaacacugccuaggcacacugugaacugaauguagacauucuuacuauuaauccugccaagagaaaccugcucuaacugcucaggagacacaggcaacucaacugaauguaauuagauccaaacaggaaaguagaaugaggagaugggacauagguaagugguuauuaacaagcuagaaaagucagacacuagucacuuucucaauaauauuaucaccaccaccucugacaaugcccugcacucacagagauuuacauggcaguugagauguuaugugcuauucaauaaguuacuaauauuuacucagcacccaaaguaugccacgcagaauauaauugguacuccaagugcuuguccucauagaaccaauaaaaguaguguaauuccauuacuacacuuaauucucaauugcccucugggcacacaaaccaucuggugugcagaauuuccaugcuccugacuucuuuuguuuucccugcuuucagacuaccucugacccuuucaauugcaguauucauaagcaguaggaaaagaggauuauguggauaauuacuaccugaaggucaagagcucugaccuuguuuuuuggaguuaauucuguguagcagaagacucauucuuagacccccuuuguggcagaguuucuaaaucuccuuaugcuuuaggccaggcaccacccugggcacuuacaugagcauuaucuuggacagacucugcucccuggcaccacagcuucacuguaagguguguuggaacugcacaaaaccaaagccccucccugcauacuaauacaagcugcagcaaagccaggagaagaaauaccaggcaugacaaggccuuccccugagggugaagauuuuaaacuuaauuuccuagaucuuuacuaggguaaacaguagaaagccuacuaaggguaaacaguagaaagccuacuaaggguaaacuguaggaagaaggaagaaaaagcccauuauuuuggugacauugguaaaauuuugcauaucuuaaauagcuuaguacauggugagcucuuggaagauccuuguuugguuuaucuuaauuacuauacauaauaaagaauuauacacacaguagauguuugauuaauaucuguugaauauacgaauguaacauuucucauacuugguacuuucuuaucaguuucuaaauuacauucuuacuuuagcauauaaaugguaaauaaauaauaauagaacagcacacgguuauggggggaaauacacauuuuaaauguuugcacauuuagaaccuucacaucuucccauuuacaguuguuguuuuuaguuuguuuguuuuuguuuuuucagccgggagcgguggcucaucccuauaauuccaguacuuuuuugggaggccaaggcgggcagaucacuugaguucgagaccagccuggccaacauggcaaaaccccaucucuauuaaaaauacaaaaauuagcugggcgugguagcacacggcuguaaucccagcuacuagggaggcugaggcagaacugcuugaacucaggggguggagguuguagugagccaagaucgugccacugaacuccagccugggcgacacaguaagacucgucucaaaaaaaaccaaauauaacaaacaaacaguuuuuuuuucaauuguggcaaaauauaaauaacauaaaauuuaccauuuuaaccaucuuuaagcauacaguuaaguggcacugacuacauucccguuguuguacaacuaaguugagccauauuuuacauacaaugaaauguacaguuugaugagcuuuaaauaaaugcauacacugguaacccacaccccuaucaaaauacagaccacuccauaacccagaaaguucucuccugcuaguucccugcucauaccuuuccacuucccuuccuaagcaaucacaaaucugauuucuaccaccacgauuugauuaagucuguucuggaacuucauuuaaguggacucagacacuaugauuuuuuuauguagggcuucuuccacucuccacaauauuuuugagauucacauacauuguuguaucugucaguauuucauuaauuuuuaucacugaguaguauuuuacuguaaauauacaaaauuuuauuuguucucucuauaauugauuagcauuuguuuuaaguucagggcuaaaauuuuaaaaaucacuaugaacauuauuuuuuagaauaugugcuuucauuucucuugauuaaauaccuaggaguggaacaccugggucauuagauggguauauguuuaacuucauuagaaaccccuaacuagacugauuaagaaaaagaaaaugcaaaucaccaauaucaggaaguaaaguagagauauaacuacagaccauuaagacgguaaaauaaugggaaauauuauuaacaacuuuaugccaauaaauuagacaacagagauaagaaauggacuucacugauagacaaaauuaucaaaacuaacccaagaagaaacagaaaaucugaauaacccuaaaucuacuacagaaaaugauucauuauuuaaaaccucccuagaagaacuaccaggcccagaugacuuuagcggugaauuauuucaaagauuuaagaacacaaugccaauuuuacacgaucuauuucagaaaauagaggaggaggaaauauuucucaauugguuuuaugaagccagcauaauucugauaccaaaaucagaugaagacauuauaagaaaagaaaauuaaaagugcagucaauauccuucaugaaaauaaucuccauuaugaaaaguuuuacuuuaaaaaacaacucaccuuuacuuaaguauaauuacauugagguguaauuuauuugcaaaaacacgcaaccuuuuaaaguuugggcaggccggcgggcacaguggcucaugccuguaaucccagcacuuugggaggcugaggcgggcggaucacuugagcucaggaguuggagaccagccugauaaacauggugagaccccgucucuauuaaaaauacaaaaauuagcugggugugguggcuguaaucccucacucaggugaggcagaagaaucucccgaacccaggaggcggagguugcagugagccaagaugcaccacugcacuccagccuggaugacagagugagacuccgucucaaaaaaaagaaaaaaacaaaaguuugggcaaaugauacauccauguaauaauccuaacaauuaagacauaaaucccucucaucaccccaaaauguuccuuccugcauucucuucccuuuucagacccaggcaaucacucaucugcuuucugucacgacagauuaguuucgccuguuauaaaauuucauauaugaaaucauacaauccguacucuuuuaugacuuaaccuuacacuugacauauuuuugagauucauccauguuguugcaugugugaguagauuauuccguuuaauguuacucagugccucauuuuaugaauauaucuaaauuuguuuauccauuuaccuguugacagacaucugaguucuuuacaguuuggggcucuaugaauaaacuucauaugaacauucaugcaagucuuuuuuguguacauguuuucauuuaucuuggguaaauaccuaggaguggaacugcuaggcauacgguuaaguguagguuuauuuuauaagaaacaggcaaaguguuuuccaaggugcuugugccauuuuacacuuccaguugcacuugguaugguauuaucaguguuuuuaauuuuggccauucgaguguauggaagugucucauugugauuuuaauaugcauauccuuuuuuuuuuuuuuuuuuuuuuuuugagacggagucucgcucugucgcccgggcuggagugcaguggcgcgaucucggcucacugcaagcuccgcccccugggcucacgccauucuccugccucagcuucccgaguagcugggaacacaggcgccugccacuacgcccggcuaauuuuuuguauauuuaguagagacgggguuucaccguuuuagccaggauggucucgaucucuugaccucgugauccacccgccuugaccucccaaagugcuggauuacaggcgugagccaccgcgcccggccuaauuugcauauccuugaugacuaaugacguuguucaugugcuuaauggccauucauauaucuucuuuuguacaguuucuguuagaaucuuuugcccauuacaauggucacugcaauauauugucagauccucuuucagugaaaaaccuauugucucagcuaagaaugcuaugggaaaucaguauucagcuaucacucccuccagggauugccucaagcugcagagaaucacacuggccaagauauauccuuccuagcaugggccauauccagugauacaggcccacauuacugagugaugcagaaauaaaaaggcaccaucagggcccaacucagggaaauuccgaagguccaguccagcuucagagcaaucugugaagucauccaaggcuguuccugggccgcaucacugcucaacaucucccuccauccagugcugcuuuguugcccuccuucucaaaagccuuaauaccaagggcaucccuuacuaaauaucccauaccugagcuuuauccguagcugcuuccugaggaacacaaccuguaacacccauuguuuaauuggguuguuugucuuauucaguuguaagaguuccuuacauauacuggauacagguccuuuguauguauguauauaacacauaagauauaaguguugugaauauuuucucccaguuuguggcuugccuuuccauuuuccuaccaauuucuuuuggaaaaacuucaguuucuaauuuugauaaagugccauuuaucgauuuuucuacuuuuuguguucaaucuaagaaauuuuuaucuaucccaaaguugcaaugguuuuauccuacauuuucuucuaguuuuauaguuuuaguuuuuuauaugucuauacaccauuuuuaguauauuuuuguguaugaggugagauaagggucaagguucauuuuuuuucccauauguauaaccaguuauuccaggaucauuuguugagauuuucuucuucccacugaacuaguccuucaacuuuguuguucuuuuucaaaaaauuuuuaaacuauuucaaauccuuugucacaaauuuguucaucaacgucccaauuuuuaggaaaaagcuuuuugggaucuuuacugggcuuguuuugacucuauaaaucaguuugggaaguacuaacauuguaacauuaucagucuucuaugaacaugggacacuucuccauuuacuuagggcugccuuaauuucuuucaauaaugcuuuacaguuuuugggguacaggcuuugccuauauuuugucuaacuuuaucuguauauauuuucauaguauuugaugcuauuguaaauguuauuucagguucugaaucuucauugcuaccauauagaaaugcaacuuuaaaaauaaucauuuuguauccuaggacccugcuaaauccucucuaguuuuagcagcugucuuaaagauuccuuaggauuuuugauauagaugaccauauggucuaaaacuagagacacuauuaguucuuccucucaaucugcaugcuguaagacauaguauuaguauuaucauuaauacuuaauacuguaagagacauuauuauucuuccucccaaacuuucauuucuuuuucauaccuuguuacacuggcuagaaacuccaguacaaugcugaauagaaaugaugaaagggggauauucuugucuuauuucugaccuuaggaagaaaguauuuagucuuucacuguuaauaaugacauuagcuauggcuuuuuuuuuuuuuuuuuuuuuuuuuuugcgauggaguuucgcucuuguugccuaggcuggagugcaauggcacgaucucggcucacugcaaccuccaccucccggguucaagcgauucuccugaaucggccucccgaguagcugggauuacaggcuugugccaccaugcccagcuaauuuuguacuuuuaguagcgauaggguuucuccauuuuggucaggcuggucucgaacuccugaccucaggugaucugcuugccuccgccucccaaagugcugggauuacaaguaugagccaccaugcccagccagauauggcuuuuuauaaaugucuuuuaucagguugacaaaaguuucuucuauuccuaguuugcuaagaguuuauaucauuaauggauuuuuagcuuuguugauuguuuuuccuuaucuuaauaagaugaucauauauuugcuucaugucacaauauuaaaucaacuguauuucuggauaaacccuuuucuagguaaaacucaaaauguauuauccuuuuuauauauuucuggauuaauuugcuaauuaaaaaaaucuguguuuauguucaugaggaauguuccauaguuuccuuuucuugcaaagucuuuguuucguuuuuauuuuauuucuugagacaaaaucucacucugucgccgaggccagagugcacuggcauggucucagcucacugcaaccuccgccucccagguucaagugauucucuugccucagccuccugaguagcugggauuacaggcaccugacaccaugccuggcuaauuuuuguauuuuuaguagagaugggguuucgccauguuggccaggcuggucuugaacucuugaacuccugaccucaagugaucugcccgccucggccucccaaagugcugggauuacagccguggcacccggccaguuuuuggcuaguuuuaguaugaaagcaaagccaaucucauaaagugaaaugggauguguucccuccucuucuauuuucugaaagaauuuaacauuuguauuguuaaagauuugauagauuucaucacuauuauguugucaguugucugagucuggaguuuucuuuguagcuaaguuuuaaauuaugaaccgaauuucuuugcucgcuauagaccuauucagauugugcaugugugcaugcauguguguguguuuguguguuggugguaauuugggcuuuccacaaauucugauuucaucucaguuacccaauuuuuuagcauaaacuugcucauaauauuccuuuauuauccuuauuaugucuucaaugcuaucuccucucccauuccuguuacugauaauuugucuuuuucuuuuucauuagucuagcuacagauuucuaaauuuuauugauguuucaaaggaccaacucuugauuucuccuauuuacuuguaauguuauuggcagaaaauguugguucuaacauagacaucuuauuugguaucaucucugucauuaccauuauuauucuaauucaauagagagaaccaugugacuauucagaauaacauucccuuuuccuuggauguagaggaucugcucauucagccuggugauaugccacaugcacaucacuccugggaucugggggugcgggugcacagauaacagcuggcauuuuaguagaagaagauuccuaccaagaauugcucuccagacagugcuuuuuaaccaggugcgaagaaucuuaaccugauucugaugaauuacccauggaucuucuaaaaaaaaugcacaugccuaagucucacccacagacuuugacucaauaggucugggauuaacuuaggaaucuuaauuuguaaccaaucuucaagaauucugaugguaccccaacuuuggaaucacagcucugaaucaucagaacacuggacaguuuaugcuaagaagagucuaaggaguuggagagaaaauacagagcagugaggcgaccaagaauuuguugccuaccaccuaauuuagggacucaaaggcauaaaugagcuuagguacauaaacauguuuuaaaaaugggggaaaggcugggugcaguggugcacaccuguaguccuagcuauggauagacugaggugggaggauugcuugaagcccagaauuuugaaguuacaaugagcugacugcauaacugcacuccagccugggcgacagagcaagaacuucucuuuaaagaaagaaaaaaaaaaaaaacaaaggccgggcacggugacucacgccuguaaucccaacacucugggaggcugaggcgggcgaaucacgaggucaagaguucaagaccaggcggaccaacauggugaaaccccaucucuacuaaaaauacaaaaauuagcccagcaugguggcacgugccuguagucccagcuacucaggaggcugaggcaggcgaaucacuugaacccaggagguggagguugcagugagcugagauggcaccacuguacuccagccugggcaacagagcgagacucugucucaaaaaaaaaaaaaaaggggaaaaauauguaaguguaauuacgaguacauauagcuuuaaacuccucaaugugagcacuauuuuguugauuuuaauguauacauacacaugguuuucuuaaaaaauuccacacaguacaaagacauuuuaauagaaaguaagugucccucacauuugaaggucuaacaccuucaaauccugucuccaaagguaguuauuguaaccagauucauuaagacacuuucauuaauagccccgacacacacacacaaauaacaccuuaaaaaaagaaguugcagcagucucaacuucucaacccagucccagucucauccuaauuaauauugauguuauuacuacucauuuguuucuacauaaaaauguacacauguacacuuccaugugcaaauacaucuauaggauaaacucuuacaagugaaauugcuggguaacggaaacaggcauuuuaaauugcgacagguuguaucacugcacacuuccaacauauuuuaucaaauuucuucccuuugccaauuuaguuguuuaaaaucauaccauaaacuuguuucucaaaucaacuuuaaaaaauagacuccagcugggcacaguggcucacgccuguaaucccagcacuuugggaggccgaggcgggcgaaucacaaggucagaaguuugagaccagccuggccaauauggugagaccccgucucuacuaaaaauacaaaaauuagccggucgugguggcgcacaccuauagucccagcuacuugggaggcagaggcagaagaaucauuggaacccaggaggcagagguugcagugagccaagauugugccacugcacuccagccugggcaacagagacuccaucucaaaaaacaaauaaacaacaacaacaaaaaaacagacuccaaggucauauuuuaagucaaaaagggguaauuuuccuuagccccuaguaugugauaauacaaauaaagcuguaccuccacaagcacccauaauucauaguuaauaucaaagauuaguguucccauacauccucacagccuuuacauuggaagaaucaacucaaacagcaguagaagcacuaccaaacaggcagagaguaguaaaccaaacucugcucuccuauccagugaucuugcaggaucagcauaggaagcacaccaucuucacacuaaaaagauaacuaaagcaugaauacaaggggacugguguguguguguguguguguguguguguuaagaaaauaaaggggcugggcacggcagcucacaccuguaaucccaacacucugggaggucgaggugagcagaucaccugaggucaggaguucgagaccagccuggccaacauggugaaacccugucucuacuaaaauuacaaaaauuagccagguauagaggcgggcaccuguaaucucagcuacucaggaggcugaggcacgagaauugcuugaacccaggaggcagagguugcagugagccgagauugugccauugcacuccagccugugugacagagugagacucugucucacaaaaaaagagaaaauaaagggugcauaauuuaucugagaccaugaguuaacaggaaacucuccauguauguuugacagaucauuggaaauuacaagggcauggaaauuuuuuaccagcccauaaaauuucaguauuccuuuccauauucagugucacaacaaagaauaaucuaaagacucaaagaauaaucaguaagcauagacccaucuauacagguaaaauaucaguauugucaggcaugguuuuucuuccucucucccuucuuucuucucuuuuuccacuucaucuucucuucuuuccaauuaccugcccuaucuacuuugagggccugguucacaugauacugcugguagucuauguagggagccaucccuaaaucauuaagaugauuugggggauagcugggggguggggaggaugguguagaucagugcuucuuaaacuuuaauaugcaaacagaacaucuuuuaacguccuguuaaaaugcagauucugauacagugguucuaggauggggccaaaauccugcauuucaaacaagcucccagguuagauugauguugcugaccugcgguccacauuuuugaaugguaagaauacaggucauuuaaaaacaacaacgacaacaacaacaacgaaacagccaggugaggcggcucaugucuauaauuccagcacucugggaggcugaggagggaggauggcuugagcccaggaguuugaaguuacagugagcuaugaucuugccaaaacaacucauauucaacucugggguauguuugggguauguuuuaccauuucgauaugaggauucaccaaagaguuaaacccuauagugaaagcccuggaggaggaacuggaauaauaguaauuguagugguugcuggugacagcaauugcaguaguuaguaguaguuaucauagcaguaauagcagaagcagcgacagcaauaauuuaagagcaaaagcaaacauuuaagagcacuuacuaugaacagauauucugguaagcauuuaguuaaugauuaaaaugcaagaagagagguaacauuaucuccauuuacacaugagaaacugaaguuaacuuucccaggguagucaggcuuuagaaccauugcauuacccugucucuaguuaucuaucaaguucaccaucacuguaauauuaguaauggaggucauaauuucucaagcugacacacaggaggaggcaauuauuuaaagaccuucuuuuucucauuccuguaaaguccagcuuggauaaauaaauagaucauuauaacuuaucaguuuaggucaaggucaagaagauuuuaaauuaauauuugacaauacagugcagacagucuagcuuuggguaaugaaggcuggcugugcuuucagagacuauuaugaugaugauguuguuuuaaaccucuuggcuuuauuuguuaacuaaggugugagaguggaacagcuugcuuuuaaaguuauccuaagauuaacuuugguuacaauaugaauuccagcauauuuggcuccgaagcuacauuuuacgcuuuuuagagauuaagcuaaacauacaauucucagucaaaaagcccuguggaguaacccgaucugagcaggggcacuuuaacucacugccaaauaaaaagcaugaucgccuuauuccacacacacaaauaccauucuuggauaggccaauuaaucaugaauauaacuuuucagacauuacauaauuucacauagacuugcuucuaaugcuugccaaagaaaacaucaauuucuaucacuaggaauaaauguacacuucaaaaggaaugaaaguuacaaacaugaaacagugaaacucuggccacccuucucaugccauccuccuucauaacuucucuaauaauuuuauuauacaaaacuggcauuaauaaacaaccuaaaaugacauaaguuguaaaagugcauaaacaaaauaaaaaucgagaaauccaauuaaguuuuauacccauggaaguggcaaccucuaagauacaguagaaaaauaaggucauauacacaccgcacacuccuggaugcuccaauauuacacacauacacacaaaaaccacacauugauauauuaaaucaccauuauuuuuuaaagauucaauuuuccuaucuaaaauuauuuguuuucuaaauaaacaucucacucaucccuggucaauuaggaauaaaugauuaauuugaaaguaaucuaccaguaucuacaaucaacauuuucaaauauaaauaaucaacauaaaccugggaauaguauauuauuuuuuaaaaauaccuguuggcccaggauucccuucagcauguuuuacaaaauuucuuuuuuuuuuuuuuugagauggagucuuacucugucugccaggcuggagugcaguggcgcagucuuggcucacugcaaccucugccuccuggguucaagugauucuccugccucagccucccgaguagcugggauuacaggcgccugccaccaugcccggcuaauuuuuuuguauuuuugguagagacaggguuucaccauguuggccaggcuggucucaaacuccugaccucaugauucgccugccuuggccucccaaagugcugggauuacagggaagagccaccgcacccggcccaaaauuucuuaacagauuauuuacaagcaacaaaacuuggaaaacaaaagcaacaaaucaucuucaugcuaaauaauggcuguacuaaagauagauuuuaaaggagguaugcauaaacucacuacagauuuaucugaauaauccucuucuacaaacauuuuuaggguguucuucacacuauccuuuuaaaaacaaaauuacuuccucacacuauccuuuuaaaaaaaauuauuuucuauuuacuuaaaacugaguagauaagugacuacuuuugaaacuuuccuaaggaaaaucucucacccuaaucaucaucacucaaaagcaugcaaguguccauacauacacauggcgcucuaugcuuuuaaacaaagaccaagccauucaugccagaucuuucauagguguguagaaacaacugguacagugcuucuccucccuuguuuaaacucuugccucaccagccaggauuuuguucaauuuuacuugguauguuuugcauuuaaaaagauguauuuuuggccaggcucuguggcucaugccuguaaucccagcaguuugggaggcugaggcaggaggacugcuugaagccaggaguucaagaccagccugagcaacaacauagcaagaucucgucucaacaaaaaguuuuacaaauuagucaggcaugguggcgcaugccauugcacucuggucugggcaucauagcgagacucugucucaaaaaaaaaaugaaaaaaaaagauauauuguuuucauuuucuaaaaaagauauaauucuaaauacuuuuccaaauuauguagcuauauaugaguacacagauguguguauauauauauauguguguguauguaaauguauguacauauguauaauaucgggugugcucuucauucucuccaauuaauaaauaacaguaaauguuuauugcauguuuacuacaugccauguacuguguuaagugcuuaaauuauuucaacaauccugugaggucaguguuacgcucgagucuugcugaggcacagaaauugugcagcacagaaauuguucaauaaugggcccaaagagaauagcugcaagugacagagcucagaauccaacucaggcaguucaucucagaaccugcuuucuucaccccuguguggaucucuaaauuagaaacaguaaccaggacagggaagggauucugucaguagauauaagucaagagcaagggucauuuuggaagugggaagcagaggugaguauaauugggguggauguuagaggaagaagcuaugggaggucuauuauugucagaccugaaugaagaagagcccaucagcaacucucuaguuaauucaaaaagacuuuuagggaagacgggauuucaagaguuacuuggaacagaaggaaaaaaagagaacagagucuaagaaaacgauagcucuugagaaaaggcucaaggaagaaggugcugccuagaggaacugaaaaugaaugaauggagggagaagacuggagacccacgcagcagaugagggaaaugagacuccagagccugcuggugaucgauucugauguguggcgugaacagccagaguagaugcaaaaggaaaugagaagccacuguaaagauuuaaaggaugcagccggcauggucagucaggaaguucacacggcccauucuaggaauuuggaagagaaggcaaggaaaggagaaagacaagccuagaaggugcugaguuuaguggauuuuaugaagacuggucaaugucuguauguugagagaaaaaaagucauccagaaauuguucuaaauucaauaaaguuuucagaaaaaaauugccaaggcagaaaacuugguagugacucauucuaauaguacagcuaauugcuuagcaauuacuggccaugauuauaacagggauuguaggcuuuuuuuuuuuuuuuuuuuggagacggagucuugcccuguugcccaggcuggagugcaauggugcgaucucggcucacugcaaccuccgccucccagguucaagcgauucuccugccucagccugccaaguagcugggauuauagguaccugccaccacgcccagcuaauuuuucuauuuuuuguagagacaggguuucaucaugcuggccaggcuggucucaaacucuucaacucaggcgaucugcccgccucggccucccaaagugcuaggauuacaggcauaagccaccgcacccggccaauuguaggcauuuuuaaacucuuacucugugaggauguaugucucaaucccuugaaauuuuuauuaguacuuaggugugcucucagcaaaguugucuaccuaugucaccagaauaaagacaauuuuucaaagaaaauuguuguguuuucuccuccauuaagccauuguuauccucagcgaagauguauauaugaauaauuuauacucaccuggaauggcuaacauaugagcauauuguuccaaagauacagcuaguuuucuuaacggccagaucacagaaauuccuaacagccuuucucacuuaaagggauaaaauacaaacacuuauugggggaaaacaacuuuaguaguuuauugauuuagcuuuaggaguauuucacagcugacuccuuuuuaacagcauacaaccaggggcaugugucuaaucaauacugaacaucuaucuugcaguuggggcucaugaauuaaucaacaucuacucaaacucaaaacccaucaggcaaaaaucaacggugaccuacaucucuucgaacaccacagaaccacccaaacaauguuacuguuuaaaaugauaacaaacucaaaacccuaacugcaccaaaacugguagucucuacucaugaguuacuuaugucuaggcuaucucuuuuuuccaaggaacuaauagcaggcacuaagguucucauaacauuuccuacauggcuauacuaaccucaucauacauaaugcuacaaaaguuuagagagggcaggagacuaccucaaggacaugcagcaaccuaggggguuguggggaaucuggcucucuccacucuauucaaugguggaugauuaggccaagugaccuguuuccugaucagcaugugaaacaacacaggaaaaaaugguguguaugcagaaagucuuuccuugugagcucaaauuguauaaagaagguuuuauuucuaauuauggucauauaauuacagacacuuuaaggagaagagccuguuuguucucccugguguaagcaacucacugauucaggcucuuuugaagccagcagccaaguggcaguggcacggauccaggaguuccuggaggagaacagauggacagcuaucccaaaaaagagcucccugaugucacccagcaaugagaugugagagcucauaaauauaccauccucauucaggugguacauguauaaaauaaaaggguucacagcguaagucgauauuuuucucacuggguagcagaugauaccaugcuuggccccccauucccucauuuucuaaugaggcccucccaagacuucccauuuagcagaaaucugcuccaucuaaugauuacuuuuuuaguuuuccauuuaguuuaagggaaaauuccuauuucaucuauguuuucagaacuuguuacaaaaauuuucugaaagguuacugauccaccaggcaugggguaaaggagucaaggcugcagaaucuggaaucagacucacugaguuugauuccugucucuacuuuccuagcucuaucauuuucuggucgugugaucuuggccaaguaucugacuccucuaaguuuuaguuucuacaucugugaaauggggauaacuauaguuguugugggaauuacaugaggugacauauauaaagugcuuaagacaguguacggugcauguuaauugcucaaaagauguuagcagcuaugagucguuacuguacuugauguagauauuuuggccaaucaacauuuuuugagcgcccacuacuuacuucaacuggacaagagcacagacucucuauccauuaugccauaaaagauucaaagaaugagaaugugagacccaagccuuggaggguuuacaaaucacauggggagagaacacacauauacauucaagaacaugcuuucagccgggcgugguggcucacgccuguaaucccagcacuuugggaggccaacacaggaggauuacuugagaucgggaguuugagaccagccuggccaacauggcaaaacucugucucuacuaaaaauacaaaaauuagccaggcgugguggcaugcgccuguaaucccagcuacucggggaggcugagguagaagaaucgcuugaacccaggaggcggagguugcagugagccaagcuugagccacugcacuccagccugagcaacagaaucccgcaaacacacauuucuugcuuucuucaauaguauacucuauggaaggcuggcaaaucauauucuaaaaggccagaucuuccaucccuuuuaaaagaaagguaugguaaacagcuuuaaaaauuaaccaucucaagaauuucauuauuuucuaauguaaguucacauggcuaaagaaauacuugaacacuuauuauaugaguggcagcauauuuaauacuaaaauucagguuuuugaaguuuuauuucauuaaagcuauauagauggaucaaaaaucaucaauagaaggguaaaagcuggguauaguccauccacagggcuucucuaaggaggugagucuugaagggaauuuuaacacggagacugacagagauuucagucaguucagaaacaaacugcagaggaaaaggcaguagacacggguggaaaggggaggggugauggcugugaugaaaauacaggggacuugagcaaagauucacccagggacaggagaggaaaggaggccuuucaguuggagacaagccucagacaaggaaaacaaagcccucuucacugaccgccccuaccagccucaccagcccagagcucuuuacuuccccacaaaauccucaacacuaguggcaaauaagcuauugucuagggcacccaggcacuucugcuuccaucuguugaguucugugcuuaauugcgcuuguucucaaaccuguuugugucaguuaugccuguuacuauaaucaagaaccuuaauuaaauauuguuauccaacauccaauaagcuaugugcacaaaaaaagacuugcagucucuauggacacguagcugaaugcuuuuagauggauuugauuaacagugaaaaaaacuguaaaaggucgagggggaaauuacaaucuagaagaacucuacauucagauucuucacaaaugccuuuaaagaaacugagacugaaaauuauugagaaaaaagauggaaacuccaacccaugcucaaagaaaagccuggaaccuccaucaaacaaguggcaaauacacauacaugauauauuucaaaaguuaaaauauuaauaaauauuuaacacauacagagaguggaugcacauuuuuauucccugcuuuuaaccaacuuucuugacuaaccaaucaauuccugucacaucaaauaaaagaacuaaaaugaaaucauuuucuuucauuauuacaaaaaacuaccugcauacagguggaaagauuucuacucaaauacauacauauuuaaaucuguacuuacuauguuucauuucagcuaagucuaugugagucaaaaucacagguaaguuaaauacaauucuuguuaaauauuuugcccacaaaacuccaaucugaacacugaauuuaaacagauauuugcauuggguacacccaacuuuaauacguugucuucauuuucucuagaccaaaauaaauauaucugguacaaaagaggucuggucuagauagguauuaaguauuuucaaaguauguuaaaauaauaaaaaaagaggcugggcacaguggcucacagcuauaaucccaacacucugggaggccgaaguggguggauuaccugaggccaggaguucgggaccagccugaccaacauggugaaaccccaucucuacuaaaaauacaaaaaaaauuagccagguauggcggcaggugccuguaaucccagcuacucuggaggcugaggcaggagaaucgcuugaacccaggagguagagguugaggugagccgagauuaugccacuguacuccagccugggcaacagcuugagacuaagccucaaaaaaaaaaaaaaaaggaaaaauaauauaaggauaauuuagucugugaaaagcaaucauuuuucaaauaauauaauuugccucugacugauuuuaagaccuaaauaauauuaccauaaagaaugguggcuaucaccuacuugugcucacuuuccuugaauggcuugaaaacacaaguaagaauuaaaccuagaauguaguaauaaauaauuacuugguauaaauucuuuugaauacacacugcuuauauaugugaaacuagcagcccguuagaagccauauauauuuucccauuaauuaaccacagcaaguuauuaaucauaauugcaaacaauuugcccaacugaugguuccuugguuuuuuuugacaugaccauuuuacagauaauuagacuacagaaccacuaaauaaggauugugucuuggacuauguccuguauaugaugauaaauaauacacugguggcauucggucaauguaugacuaauacugccauucguuuauuuuuuaaauacuuuauguucacugaaaaauauuuaucacaagauuucacuguacgcaagagcaucuguaauacaggguagaaacggaauguuuucaaaacagagcaccuggaaacauuagccagaacucaggcggccaguauuuugggauuuuuuuggcaggcacauaaauaaaucagacauucugauuagaaaaugaaacucccagcucuagguagaaaaaacuaauuucauucaagauaaauaguuacuuucaaauucauuaaagaggaaaagaaucuugguggagacaggcauaaauccuggaagcuaugucagauauaagcaaugaggcccaaaccacuaccacgcagucuuauguagcacuucccaguacaaagcccaaaaagcuuugcguacuuuuaucuaauuaauuauaaaucacuaaacaaaucuugaccauggugagaaugcuacuuggacagaaacagucugaacauuuugagcucuaaauucuaccacauaaccaaagagaaaaauauucagcaagagaaaacaaagguucuuggcuaaaaccucaacucaccaucuuguacuuaucaaagucauuguaggcauuauuucaggguuacuuuacuguugucuaaaaacuaaaaaauguacaugccucagaccaaggucagugcucaauaaauacuugcugauuugaugucuuaauuuuucaagaaaaggguuauaaaaccuuuaaagucuuaaaaacuacguauaaaaacuaaauauuucuuucuccaaaaaguucauaugacaaaugacauaagugagcuaagaauuuuaagacacagacuaaaaaccaggccccccaccagugauuaagccagugauucaaauuguucuuccugaugaaauagaaaauauuauaaauauuuauucuguaguaguggaguucacuaaauauuauuuauuuuucaucucccuuccugcacucaucacgcuuauaacuaaaaucacauacuauuacacuugauuaccacccaaaauaucuagcauucucuguuucacaugcauaaaucuuauccauccaaucauacugcuaguuucuugagagaggggacugaaucuugcaccuuuauacucucuucagggccuuaguguaccaucaggauauaagagacuuucaaaaaauuacuuagcuaucaaguaagugauaauuuuaaccagagaaagaaaaaguuaacuccugcuucuggcacagucaaacaauggauacuuacuuuacucaaauauccuaauuuauagaguuggauuaacaauuucaagaauuuugagcagaguaaaaaauguuauauuacagcuauacaaaaugaaauuuacuuuucccugaguuuugcauuguagacugauuauuauuacccuuaaugaaauagaggauugacuuaaaauaaauuuucaaacaauaauaugccagguagaccauuucuuuuuccuggagcacuuuuuguugaugaguucagaugucugacucaugaucugguuuggcuuacauaagccuguggaguauucucuugcgaguuuagggcagcucagagggucuucucuauccagaagcacuggagagucacacaugaguacuuggucugaauacuuccuaggcuggaggagauaggguucaagggcaaggaucacugaggaaauugccaguuuccugacccuacugcagcggugguggaugcuuauaaacaaaggcaacuggguaggaaauacaccauccauuccaagcuagcaugagagagaaaccugaggaagcgugaggggugagggagaugggguacugagauagcccagagcccuuugaggcugccccauuucccacaaucaauaaccuagcccuucacuacuugcugagauucugaaucagaaaggauuuuaaauuaucuggcuuucaaacaggagauuuucaauuuccccaacaagccugucagaaccaaaaaaaaaaaaaaaaaaaagguuucuugcagcaggcucugguuggccaagcagaggcaccuccugcugggccgauggcuccccaguucagaucuccugaucauucaggcucucccgagagguucuuuauacccacagaaacagugaggccccaaucugcagggaucugcuuuaggcagucccuugccagucaaaagauaugacuccuaauucauuacuauacuaugggagcaaagggagggguuugaaguaaugcacagaagucugaauagggccuuugucaagcaccugugcuaggccaacacacuaacugauagagaacuguucauuacaucaacaucuaggucaaacccagaacaaugacauccucagugagauuuugugauaauauuucuggacuguguauuacaaggaacuauaguggugcaguaauaauaauguugauugugaugaucaacauugugaugauuccacugccucccuuuauugaauacgcuuaacucuuacaucauuauuacauuugauccuuaugacccugugagaaaaggaagaaaaaacauccgaaaaugaaggauugacacagagcugacuugauuggaggucacuccuucagcuguuuccugggaaagccagaauaggucucaagaguguacugaagaaggaacuuauuaaauggauacauucacucauuaacaaaaccucugucccaugccuccacgugaagugguagaucaaacucuaggguuucacagacguaauuugguccuugcccuuaaagaaguucugagauuacauggagggaacaagguggcauuuagacuggucuuaaaggguaggugugucuugcuaguaacgacaacuacaacaugcccaacaugugcagaggcaugggcccaagaaaggaccuccgucagguuauuuaaaaugauucaacacauacauaaaauaagugaucugcauuuucuccuguaggcaauauggauacagugguguuauuuuuguugucguuguuguuuuuugagacagagucucagucuguugcccaggcuggagugcaguggugcaaucucgacucacugcaaccuaggccuccaggguucaagugauuauccugccucagccucccaaguagcugggauuacaggcgugugccaccacacccagcuaauuuuuguauuuuuaguagagacgggguuuugccauguuggccaagcuggucuugaacuccugaccucaggugaucugcccgccucggcuucccaaagugcuaggauuauaggcgugagccacugugcccggcuggauacaaugguguuuuuauuaaaauaauaacauaucccauuuuugacuagucuaaaauaucaaguguuuaauuucaaagucaaauucaacaauuauagaggauucacaauacacauaugaggucuaugcauuuauguagguaggggacagucacuguuccugugcauauuggcacuguacugcgcaguuaucuguaucuuguuugcuggguccccugccccccacccugccaugggcuguacgcacaugcgacacaagcugcaucuguucugccgacugcucuggcuccugcacacacucuauuucaagcacauaaugagcacucaauacauuauuucaaggaaugaauggaugccuaucaggcacuguauuauaaaagaauucccagucuagcagaauggaaugaugcccaaacaauagugauaacacuguuauaaguguuauaagaguuacuauuaaagagcuuugaaaacacagauaaaagagcaacuaauccaguucagauauccuccuauacaucaacuuguauagacaauuuucaccccuuaauaauuugcuuucacaacaaauacucauccaacagaaccuauguuuuucugugaagaaaaucuaagcaauaaaaagugacucaauuuccaggcauagguuuuacaaaaugcuucuggauuauggaaaagaaauguucuuauaaagacagacuguaacaaaacuaauccuagaccagcacaggaaaucaucuucacuuguggggggaaaaagggggguggggguggggacuagagaggagggagaaguauggaaugauuaucccacaauaaaaaaagaaauuggccaggcucaguggcucacgccuguaaucccagcacuuuuggaggcugaggugggcggaucacgugaggucaggaguucaagaccagccuggccaacauggcaaaacccugucucuacuaaauaauacaaaaauuagccagacguggugaagagcaccuguaaucccagcuaauugggaggcugagguagggagaauugcuugaacccgggaggcagagguugcagugagccgagaucaugucacugcacuccagccuaagcgagacuccuucucaaaaaauaaaaaauaaauaaaaguaaauuuacauuuugguuuggauacagagacuaaaaggucuccucuaccaccccauaaauucuaguaucagaccuuuaaacuuucagauguuaagaauuaguuuauuccccaaagguucaauuagaacacagcugaaaaaaaaaaaauucaguauagcaaacugacugauuccaugaucugauuucaucaccgagcaguaggaagcauuuagcuggucuacagagagagaggugugugguucucuuggcuagaaggcacaaaauccaacuuucuguucuuuuggcaaaagaaggaauguccaaucagcauaguaggaaguaaguaacagaauuucuaauuuuacaaaguuagucaauuucaugguuaagaagugcuguuuugaugguaaccuuuacauuuuuacaacccaacuaugaguauuaaguagggaagauccaacuaagauaguuauuucagggguaacgucccuuucucucaaaguuaaaacucuuaauauaauucacuuggcuuguaacaugguauuuagucauucucauucuuugaauuguugccuaaugcaagcuuucauuuggauacaccacucccguugauguuuauaggacugccuugcuauuaaccucuaacccaauuagucaccaaacugacagcaugcauugcuauuuggaagccaacugcuuaugaaggaauuuuuuuuuagaaucugaacaaaaugagccguauuauggccacuuuauuuauaguuuuuaacgaaguauuccaggauaucuacagugacaaacucaggguaaaagcaaaucagguccuuugugugcacugggccagggagugagggcuauuuuaaauaaaaauauguuuuaaaaauuuaaagguguaauccaccuucuaccauggccaucucuccccuuuacuucuguuaccucuguuuaucucagugauagauaacuccauccuuccaguuauucaggccaauaaccuugaagucuucucuuuuucuaacacucugcaucaaguucaucaacaaauucugcgggcucuacuucaaaauacauccagaaucuguccucuucucacacucuccaccauuaccacuggccuaaaccaucauaucucuugcuuguuuuguggcaauacccucccagcugccaccuuggugccgccuacagcuuauucucaacacagcagcaggaaacagcuuguuaaaacguuaagucaaaucaugugccuccucuguucaaaacccugcaaaggcauccaucacucucagcaaagccagaggccugaccugugcugagaccuuccucccaucugcucucaccucuuacuacuugacgacucuccccucucucuccacgccagccacacuggccucuuaucuguuucucagacaugucaagggcucuuugcacuugcuguucccuccaucuagaacacuccuucuccaugccuggaaugcucccucacuucccucagaagucaaguuaaaugucacuuucuuagagaggucuuuccucaucaaacuauuuaaaaaagcaaugccuccccaucccaucacuccuuaauucccuuacucugcuuuauuuuucuccauagcauuucucacagcugacaugcuauauacucacuuacauuauuugucucuucccauuaggauguaaaugaauuucaugagggcagagacuugucuguuuugcucccugcuguguccccagugccuacaacagugccugacauacaccaggugcucaagaaauaguggcugaauuaaugaauaaauaaaugaaugaauacuagacuuccucccuucuacuucuccuacuccuuuucuauacuacuucuaauaauagaauuguuugcccaugacucauugauaaaguugucuugcauuuacuucucuaagaucuauuucaaacuaacuuauccugagcccacacccaauaaauaaacaagaacuuaagaaaccagcuuacuuaccuucuaacuaaacauuaggugcuugaaucuuuccaauaaccucuaccuguuucuaagggccuauaauuucuucugccacaguguauaauucagccaguguuucucaauccucaggcauucccagaccauccacggcaauuuugcuucaucuguguaucaccugugcuauuauuuucuuaacaaguuuuaaaccuggcucacuuuuauucuuuaaaaaaaaauaugacuacagaaaugaaguguuuguucaugaaccaccacuggagguuacauauaccaaacucuggauucacuugagccaaaaaguuuaccauggggccuguaauaccuuuaggauguaaaacaaacacacauacauacacacacauccuuuugcuuaacgcuauguaaguuaaaaacugaagucacauuagaaucagaucaucuauggacucaaaauauaucaugaagaaaugucuaaauuccuagucagauuaauucaggccaucaacacuaaguuccuaaagaaaaaaccugcccaauuaucugcuggguccuuuguaaaauauuaccugcuaaaaugcucugguaaagagcacacugguaugcuuuucuagaaaaguucuuuuuuucugaucacuauuccaucuaccuagccaucuuucuucuuuuuuuccuuucuuuuaggagaggauugguugggaugaagggcuccuggagggcacuuccuaaauuugacagguuucuuuauaacagcaauuuugcaguuguuuucuagagcuuuaucaaauuugacuucuaaagcucacuuuucuacuuuagagaaugauauuaagaaucccugauuaaggacaauaaucuucacaaacuaaaaagccauccuuauauucaaacaugcuuuaaaaugugagcaguauucuaaacuugcugcagacaacccauacaaucacaugaguuauuuuaagaaaaagacucaguuagacacaucuacagaagcuaauacuaacgugcuguucuuccaaugaaaagguuacugaccuaucaguaggaguugucuuuucuggcagagaugacagauuugccuugucuuaucuccacccccugcuguguccccauaaugagccauagcuacaugugcaagacagcuggcaagggggagucagggucuguggccaugggccagagcaaagcuuaccagucaacccagagccuggaccuaugaccgaugucucauuaacaccuugcucuaagcaacugagcugucacaaaaaucaacaguggcuuaagcauuuuguuuacaagugaaacaaaucaggucaaucugacaaccaauaguucaagcagccacuagaaaauugccaaaaggacacaaaaaccaauaguaagcaggagugauaagggucuugcaguccuagcuugggagguagccacacaagcaaggaugaguauggaagggaaugagacuguaauaggcaggucuguuucuaacauaccaggcagucaaugcauguuaauuaaagauaaaaagaagaaagguauagcuacaacccccuuagugauguccuucuuacucagugguuagaacaaaugccuugauagaugcccaaaaaacagcaagggacaguucacacucaggagcuacaaguuuaaaaacaucuauacuuuaaaaauauuuagaggccaggcacgguggcucaugccuauaaucccagcacuuugggaguucaaggcaggcggaucaccugaggucaggaguuccagaccggccuggccaacaugauaaaaucuugucucuacuaaaaauacaaaauuagcugggcgugguggcaggcaucuguaaucccagcuacucaggaggaugaggcaggagaaucacuugaagccaggagguggagguugcagugaggcaagaucucgccauuuaacuccagccugggcaacaagggcaaaacuccaucucaaaaaaaaaaaaaaaaaaaaaaauuuagacuacagugacccauacacauuaggaaaccauuugaucuuaaaccaaaauaaaggaaaaaauccacaacaaaucaagcucaaaagaaauaauuauaaacauauuuucaucaccaaaauuuuggauuuaugagcaagccaaauaaucuuuccuuuuagaguacacacaaauuaauaugaagaaaagcucccugggcaccauuuuaugcccaggguuucagugguuagucuaauuggggccaucccaccuugggauggaacagcagagaagaaaagaaaaauggacacagccacuauuaaauuauaacaaguuucuuuguugggguauaaaagcagucuuacgaacgaaaaggagaaaucaccagaguuuggagaauugccccuugaucagucaacuggccaagagaaccaauuauccaccuaucauuguauuaaaugcuauaugagaaggguaaagaaauagcagacagggaccuuauccacaaaguuuaugaucugguugaaaacguauuauuagcaaauguuaaaaaaaaaaucaaacuaaaaauacucagcugucauguuuaggcaauaaaugcuggaggcacucuucuaaugaggacagaauagguaauucaaagagcuaacaacauaggguugaauuuucggucaaaaauuggugaggacaggaaguccaagagguaaacccaacacucagagccacuuuuaucaugggguuauauuuaccaauccaggaaauaaagcugaugugaaauucuggugacaucuggagccuaagcagguggggucucaaggauaccaaccccuauuguaaauggggcuucaaagagggaaagugaacuguaaguaaccagccugcacacagguuugcagcccaacucacaauaccugaaucaugaacuuggcuugaggaggccuuaaacuguacaaccuaggcagaaggcagaagcauaugaaaauucucaaccucaaauuauuucuauaaauacuuuuucaaaaacaacauccaggauguaaucaggcacaggaaaaaacaaacaccaugagucagaaccagcagaaacaagaaacuacagaagaagacccacaggaacuucagauauugaaaauacagguaaagauuuaaaaacaaugacauuaacuauauucaaagagauaaaaaccaaacuaaaugguuuuaacagggaacuauaaacuauaaaagaugacaaauuugauaacuaaauaaaaauucuauaacuaaugacagauuagauauaguugaagagagaaucaguaaacugaguacagcucagaaaaagaagaaaaacacaaaagaggguaaaggcauagagcauacagugagaaauuuuaacauauguuuaauuggagacugaaaaugagauuaaaagaggaugaagcaggcuggguaugguggcucaugccuguuaaucccagcacuuugggaggccuaggugggcggaucgccugagaucaggaguucaagaccagccuggccaacaugaugaaaucccaucucuacuaaaaaaauuuaaaaauuagcagggcgugguggagcacaccuguaaucccagcugcucgggaggcugaggugggaggauagcuugaacccaggaggcagagguugcaguggagccaugaucacgccacugcacuccagccuggaugacagagcaagacuucaucucaaaaaaacaaacaaaaaaagaggaugaagcacaaacaguaugugaagaaauaauggcugcgaauuuuccugaacuaaaauaccaauccucagauaccuagcagaauaaauaaaaauaaaucuguaucuugauauauuguacaaaaacuucaaaaauaagaaccagaggaaaaaaauauauauauauagauagauagauauggaguuuugcucuuuugcccaggcuggagugaaguggugcgaucuuggcucacugcaaccuccaugccccagguucagguaauucuccugcuuuagccucccaaguagcugggauuacaggcaccugccaccacgccuggcccauuuuuuuaauauauuuuuaguagagaugggguuuugcuauguuguccaggcuggucuugaacuccugaccucuggugauccaccugccucagccucccaaagugcuaggauuacaagcgugagccaccaugcacggcccagagaaaauauuuuuaaagacagccagggaaaagacaauuaccugagauugacaauugaagucaaaagacaaugaaauaauaucuucaauguguucuaacuaccuaagaauaaucuccaagaaugcauaugaaauaaacaaaaauuacucaugccagcaaaccucuacucaaugaaauucuuuucuuuuuugagauggaguuucacucuugucacccagguuggagugcaacagcacaaucucagcucacugcaaccucugccucccggguucaagcaauuuuccugccucagccucccaaguagcugggauuacaagggcccaccaccacaccuggcuaauuuuuguauuuuuugaaaagacaagguuucaccauguugggccaggcugguccugaacuccugaccuuagguuauccgccugccuuggucucccaaagugcugugauuacaggcaugagccaccgugcccagccugaaauucuuuuacuccuucaagacccagucauauaucuauucauuuuuuaaaaaucugcugagcaucuagauaacaugcuaggcaguuaacauuugacuuguugacugaacuaccauguuaguucaaacauauugcaacuaggaccacuagaauauauuagaacaagagcaggaguuuuucucuuuucuuugcugcuauaucucucucaccucaaacagugccugccauauaauaggugcccaauaggcauuacagaauaaauucauauucuuuauuaacagaauuuaaaugcuauuagaugcuauugcaacagcuaagcauaauuauuuguucucuuuuucuuuccaaaaguacaguaacaaucuuaauguugugcaguuuaaaacuagaaacacugauuacaauuaaaugcucauuaaguaugaauaaugagauuuaaaaaaaauuuaagccaaaacuuacccuacaaauaugaggauauauuuauuaauaaaaaguaaugaaaaaagguagcuuuguaacuacucuucuaguuucaugccucacuguguucuucacauacccuaugcuccauuccuaucaagugauuugccagucugcaaacaagccagucuuucacacuuucaugccaaaugccccugccuguccaugaugaacuccucuuccacuccauuucuccacaaggaaaaguuuccccauucuuuaagacccagaucaaugucauuucuucugaaaaugcugccucaacacuguuauucagugagucagcaacucucucuucucuagggagauaguacaaaggccuuuuaaaggcacuacauuguuuuagcauuacuugucuauguguuggcucaccucauuagguaagggccaugucucauccauucauuuaucucccuucccucaagcaccaaucucagugacugguauauacuaagcauccaacuaaaacuguuugcugaagucaugaaagacaaagaaaggauuagaaucuuuaauagauugcaggaaauaaaggagaaacaacaacugaagguaaugugggauccuggaugggauccuggaacagagaaaaauacaggaggugaaaaaccggugaaagucaaaaagggccacaguuuaguuaaugguauuauaccagugaauuuccugauaauuuuuuuauaacugugcuaugguuauauaagugguuaucagggaaacugcauaagguuauauauaauuaacucuacccuauuuugacaacuuuccuauaaaucuaaaauuauuucaaaauaauuuuuaaagugcuuggcugacuugaauuauugugucaaauuguagaaacauaacaaagaaguguucagguuuuuugagacagggucucggccugucacccaggccaaagggcaguggugugaucucaguucacugcagccuccacuucccaggcucaagcaauccucccaccucagccucccgaguaccugggacugcaggugugcaccaccacacuugggucacuuuuguauuuuuuuguagagacaggguuuugccacauuuugcccaggcuguucucaaacuccugagcucaagacauccacccgccugggccucccaaagagcugggaugacaggcaugagccaccgugccaggccaguguuuaguuuuuauacaaaguucccagauauauaagguaaauaaauaauuggagggauuaaaggaaccacugccauaucuacacuaucugaauuuuuuuaaccaagaaugaauuuauguaugcacccaucaaguauaauuaagaagaaugcccaccaaaucaauugugugagaaguacaaagcaaauuuaauauaccuacaaauaugucuauggcccguacagucaauagcaauacacaacucucaaccaccaccauaagcauucucuggguaauauaaaaccaguugauacacagaagaauauguaaaucauaauacaugaaauucaauaccacugggcagauauuucauucugacacaucacugcacaugaaacuaagcucuacagaaggcacuguauuaugcuacagaauauaaaaauaugucccugauaaaacuguugagauuguaaaaauacaaauaugggaugaggucaguuuacaacuaugaauuaucaaauaaagcacaauucaauaaaacauuuggaacuauagauguaagugaaaguaaaaacaagacaagcuaucauuaaggcauuaugaugucucacagggucacuauaauagcacaugaguauaaaaauuauagauuuuauuuauuuauuuuuuauuuucuucaagauagagucuugcucuaucgcccaggcuggagugcagugucacaaucucagcucacugcaaccuccgccuccggguucaagcaauucuccugccucagccuccugaguagcugggauugcaggugcacaccaccacgaccggcuaauuuuuguauuauuaguagaggcgggguuucucuguuggccaggcuauucucaaacuccugaccuugugauccaccugccuuggccucccaaagagcugggauuauagguaugagccaccacgcccagccaaaauuauagauuuuuaaauaccaccaucacaagcaacauaacugaauuuuaaaucaucuccagggcaucaauaacaguggcaaugagcagcaauaugggagcuguggauuucaacugguccaccagcacaugcaaccuuuugaaauuguuuuaauuuaagacaaagguaacuagauacuucuuuaucugaaagacggaugaugaaggauggaagcacucuuucauucuagaaauauuaacugcaauuuaacaugcaccaggcacugugguaguguuggggauacagagagauacaguuccugccuuacugggguuuacaaugagacaauacuaauaaaugugaugucauuaugucaaugaaaaacagaaugcaaaggaagcucagaaccuagucagaaaguccucccagaugcaagugacauuucacugggaucuaaaggaugagugagcguuagcuagacaaagggagcagagguauggcagggguucuggacagaugaggcaccuucugugauggaagaucuacaagugcauggaacauggcauauucaaggaagugagaaaaauucagaaugcuggaugugcaauggggugaagagaguaugcauuuaucagccuauggaaugauucuuaaaaccacagagaaacuuacacggauacauuagacaacugauucuuauaagcugcauauaguaauaauguaucauuaugauuaucaucacuaugaagaaacauauauuuuugccaaaguaagagcauguuuuaauaaauuuuuuuuuuaaaggaaacaagguuuugcuccauugcccaagcuaaagugcaguggcucaaucauagcucacuacaaccuugaaucccugagcuccagcaauccuccugccucagcaucccgaguagcugggacuacaagugugggccaccaagccuggcuauuuuuauuuuuuuauuuuuuauuuuaaagagauggagugccuguguugcccagacuggucucaaacuccuggccuccagugauccucccaccccagccucccaaagugcuaggaucacaggcaugaagccaccgcacccagccaaaaagcugggauuuuuaaagauauuuucuuugcuuuuaaaagaacacuauaaacuagucuucgaaaacaaaguagaaugugucaacagaaaaaaauaucaauuugcacugaggggaaacuggaaucauauccuaacuaugcagcccuuuuaaauuguugaauucaaaaaacgauggcucauuauuagagaaauuccuaauuucuugagccaguugcuugaaaaaguugccaauuuuggcugacgucccucacucacaagauccuaaaaguuuccagaagaaauaaaauugcuuuaaccuuuguaguaaauaagaauuaaaugugauaaacaucgaauuaacuaaauccacauuaguuauaagcaucuaauauugaaaaaauuauguugaaagcuacccacauaacaauucuucaguuaaaaaagaauuaauuuaaauaauaagauggaauuugauuucucauauuuugugagaacagcauuuguuuucugucacaggacuuaaaauuucuagauuaaauaauuacacuuugaaacagaaaagcacaaugauacacugugugaacaaaaugcuauggacuuacuaaauaaguaauacuuuuuuuuuuuuucuuuuuuuugugggagacagagucucgcucugucacccaggcuggagugcacuggcgugaucucagcccacugcaaugucugccuccuggguucaagcaauucuccuaccucagccucccaaguagcugggacuacaggugcccgccaccacgcccggcuaauuuuuuguauuuuaguagagacaggguuucaccauguugcccaggcuggucucaaacuccugagcucaggcaauccgccugccucacccucccaaagugcuaggauuacaggcaugagccaccacucccagccaguaauacuuaaggcucaugcuaggcuugaaaacaggucuacuauacuggcacagagaaauagguaagcaugagaccccggcacugggcacagcucucugcuggggaaacccugggagauggcuccccugcagggcgguuuacuccuggccuccagaagcuuaucuguuaguggaccgugggcacacaaguuuucuuuccccuuuguguauucacccucaaaagggcaaauuucuacacuauaaguuguugcuggacuaacaucgaauaauaaaguacuucuuuagcaagauucaaguugaauucaauccuugugaauucuagaagcaauuaacauuaugagaauacaguagucccccuuuaugugaaguuucacuuucugugguuuguuauccacagucaacggcagcucaaaaaugggugaacacacagcacaacaggauauuuugagagagagagaaaacaaauucacauaacuuuuaauagaacauauaguuauaacuguucuauucuuacuuauuuuuguuaauuucuuccugugccuaauuuauaaauuaaacuuuaucacagguauguauuacauacaggggaaaaacauaauauauagagacuucaguacuaucagugguuucagacauccacuggagaucuuggagguggauaaggggggaccaugguguuucaaaaucuuguuuggaguuuacaaagggaaugcuuaauuucugauuuaucuaacaaaagauaccuguagacuuaccugucauacaaaauaaccacacugaauaauagcuugucauagcaaaucuuccccuccaacuacucauaccccuuucucucucuucaaguccuaaauucaaguaauacuucacuugacacuuauuuaucuccaggauuaucauauaacuaccauugacaguuagauccacuuuuuugcaauugacugaacaacccaaucaauagcaacaaggacacucugcuuucacaagaugacagcugcuccagcugcuggcucccuggggcugauguuggggaaucaggccagcacaacaugacacauucacagggacacggacaccagguacaacacuacaucuacaugggucauuagcuugacuauaguuaggcaaugccacgaaauaagaaaugaagaaaagugucccaauuuguauaaaauauaggacuauguauuauauccuccuuuguauuugugauuuugaaagccuaaaaacugaauauggcugcucauauuauaaacuguauucacagcuguuauaacugauguuaaagaaagagggagggauaggagaaagcaaaaugcucacauaauaaauaagcuuucuacaauacagacagagagcuaaauacaagagacauggaugaacuuuggcuaacaauauaggaaguuauauauaugaaugacugcuugauagaaaaucuacuggaaagcuggaauuccuccuccagcccuacccuucaaccuucaucuaucuuucuaucuaucuaucuaucuaucuaucuaucuaucuauccauccauccauuuaaucuauccauccauccuucaaccuucaucuaucugucuauccauacauacauacauacauacauacaugagacaaucaauuaacauucccaaacaaccuagaaauuaggauauuugcagacugaacuugauaggaguugaagaaauguuuaggaggaagccagucuaaaaguccuuuguaauauuaaaaaaaaaauugagcauaauuuuugaaaagcacagcaucugcuuuuaaauuaaucauaaacacuuauugcaccuggcugugauaacucacaccuauaauccuaacacuuuaggaggccaaggugggaagaucccuugagcccaggaggucaaaaccagucuggacaauauaguaaaacucugucucuacaaaaaaauuaaaaauuaggugggcaugguggcauacgcauguaguccuagcuacucagaaagcugaggugggaagauuguuugaguccaggaucaugccacugcucuccagccugagcaacagagcaagacccuguuucuuaaaaaauaauaauaacaaaaauaaauaaaaauaaauuuaaaaaugaaacaguacauuuucccccauguuauaaacacaauacacuaacauucuagaaaauguaucaaaauauuuuucaggaaaaguuaacuugacauagauauaaaaaucucaaauauuacaaaguauuaauuuuuaaaaucaugaugagaagaaagacaggggaggcaucaaaagaaaccaacaacaugcuuucaauaaacauggcauggaauuguaaaaacagaaaguagacuaaaggcugggcacaguggcucacaccuguaaucccagcacuuugggaggcugaagcaggcggaucacuugaggucaggaguuugagaccagccuggccaacauggugaaacccugucucuacuaaaaauacaaaaaauuagccaggcaugguggugggcaacuauaaucccagcuacucaggaagcugaggcaggagaaucguuugaaccuggaggagguugcagugaguugagacugcgccacugcacuccagccugggcuacagagcaauacuuagucucaaaaaaaaaaaaaaaagaaaaagaaaguagacuaagguuuaaagugagugaagacagcugaaaacuauguucaauaaauuuuuuaaagcauguuuacacacacagaaucacaugcauauauaugcugucaucuaggagcacaaaucccagaggaaugcaagcaguguuuaugaaauauccuuauguguaucacucuccgcuggacuacccauagaaaucaaagagaggcaaaguuacuuugaggauuuuagaggaaagauguuucacaaaauacucaaucucaaaauacauuuuuuaaaauauauucuuccaagaaggaagaaaaauacagaagacacuucucuaucaaguaucaaagaaaaagaucuugaaaauggcaaggguagacuagauuagauaaaaauaccucaagcccaagaucgggaaagaaauuuaagagaaugcauauagcuguuaugugcuaucuguauuuacuccaugccuucuuccauuaaaaugaguggugacaucuguuuuauacaaguucaaguuuccaguacuugacaaacuuccucucaaacccaagaggaauuaccagggagguugcagaucuguaguccaugauguuugaaaaaucagggagagugagaaggaugcagauaauggaauauggaaaaauaucaccaaaaaaaaaagaaaaaaugugaaagaagaaaacucaggaaauuaaaaucaagaaaauauugcaaugaccaucagcaaaagguuuagaaaaaaaauuaaacauauuauuugugggugcccacagugaaguuaucucuagaagccaagacagagucccuaagcacuaaaacucaaaaauuaagcucauuucuccuccugauaaggcuguugaaaacuucaacauaggaaaugccacgaggggguauugggauuuugaaaaggcacagaaaaaauucuuuucaugccauuauuauugagaaaagagaaauauuaguuuaguuauuuuuugagauggaguuucgcucuuguugcccaggcuggagggcaauggcacgaucuuggcucaccgcaaccuccgccuccuggguucaagcgacucuccugccuuagccucccaaauagcugggauuacaggcaugcgccaccacgccuggcuaauauuuuuuuuuuuuuuuuuuuaguagagauggggcuucuccauguuggccaggcuggucucaaacugucaaccucaggugauccaccaugcccaguaagaaauauuaguuuaaaggcgauuaggggagguuuuuccuuucaauagacauccuauucaauagauaaaugaccucaagaaagcaggaaagaugaaaaagugagaauguuagggaaaagaagaggcagcugaccacaaaaauguacucacuccucccuugacauacaugacugaaaucuaaaugguuugggguggggcauggaaacugggcacucugcuuacccuauaaauacuacaacugcuccauaagauuuccuucagaacugagaauggguaaugagugcugaguacucuauauagacaaagaacuugggggaagaaauuuaggucugcuguagaacuuaagaagguccuaaauuaugucaaaaacaccuuuugccaaagaacccccuucucacccagaaggccaguauccauccagaacccaagaaagcuaagggaaaccagcgcacagcugugaggcagagaaggugagccuggagcuuaugcacaaaggaagauuauccagaaagauguggcaguucuguuaaugcaaugcuaacccaaacugaggaguucugccugcuauccagcccauaauaagcuggacagggaacaauuuuucuguauacacaaggguaaacccuaaaauagauauaagggaaaaggccuugccuuacauuauauuuauuuauuuauuuagagauguugucuugcucugucucccaggcuggaguacaaugaugcgaucucagcucacugcaaccuucaccucccagguucaagcgagucuccugccucagccucccaaguagcugggauuacaggcaaaugccaccacgcccagcuaauuuuuguauuuuuaguagagaugggguuucgccauuguggcaaggcuagucucgaacuccugaccuaaggugaucugcccaccuuggccucucgugcugggauuacaggugugagccaccauacacggccuuacuuacauuuuaauaaggcuaagauggccauuucuaacuauuacuuuucagauuucucauguccccagugguuacuuuucccucaaccucuucacauauagacuuguggauacucuaauuaagaaaccuugguucagagaccaaaaaggagagaagcugcggaacaauucacaguugauucagggaaaaggagucaaggcagcaugugggcuugcaguaagcaagucucagggggcuaccagaggaaagauacacauaaaauaauuuuuaaacuauaaaggaaaaaaaaggaacgaagaacuuauaucaugauuuaacugacaggagguuaucuaaacuacaaaaguauaugagcuggaaaagcagagaaucagggggaauauacuagguugacccacauaaaauucccauuuuuauaggcuaaaacaauugaauaucagugucuuaguucauuuucuauugcuuauaacagaaugccugaaacuaggcaacuuauaaagaaaaggaguuuauuucucuuucuuuuuuuuuuuuuuuuuugagacggggucuggcucuguugcccaggcuggagugcaauuucggcucacugcaaccuccgccucccagguucaagcgauucugcaucagccucccgaguagcugggacuacaggcacgcagcaccaugcccagcuaauuuuugcauuuucaguagagauggaguuucaccacuuuggccaggaugguuucaaucucuugaccucgugaucugcccgccucggccucccaaagugccgcgauuacaggcaugagccacugugccuggccaggaacuuauuucuuauaguuaugaagacugagaaguccaaguucgaggggccucacaucuggugggaccuucccacugguggggaagaaucugcagaaucucaugguagugcagggcaucacauggcaagaagcugaaugugcugguucaggucucucauacucuucuuauaaagccaccagguccacucccaugauaacccaucaguccauuaauucaugaauuaacucauuaaucuaguaauccaugaauggauuaguccauucaugaaggcaaagcccuggugauccaaucaccucuuaaagacuccaccucucaauacugccacauuggggauuacauuucaauguaaguuuuggaggggacaaauauucaaaacauaacaaucaguaauuuuauaagguucaaaggaauaacuauugcaauguuuugcauuggaaaagccaucauggcugggugcaguggcucacgccuguaaucccagcacuuugggaggccaagacagaugcaucaccugaggucaagaguuugagaccagccuggccaacauugugaaacccugucucuacuaaaaauacaaaaauuaggcgggcauaguggugggcacuuguaaucccagcuacuugggaagcugagguaggagaauugcuugaacccaggaggcagaggagguugcagugagccgagaccaugccauugcacuccagccugggcaacaacagugaaacucugccucagaaaaaaagaaaaagaaaaagaaaaagaaaaaagaaaagucacaugaagcaaaugacugcacugaagaaaagccaucacgaagcagugugacugcacugaagaacaccagaaugaauggagguuuugggcucaauaugaaggauguacugcugacaaacaggacagccaaaucagaaacuggagguguccagaaggaacacaguaacacccucucaagagauuucuguacuggcuagucucuaagaccacccaauguucugaaaaguuccaaauguucugaaaguucuugcccauuaugucuaagcaaaucgugguggguuuggcugguucuguuuguagugagagcagacaacucucuguagugaaaggaauguauccugaaaagagaauggaacaagagaaauucaggaaggcaagaaaauaacuauuucuaccacuugcagcccacccgcugcagaacuuaaauauccugcuuugaucacaguggaaucucaacugacgucugcaggcuggaagaaugagcccuacaaaccagugacauaaauuuaaaggaaggauugacagcacugcugaaaugcaguaaagggguccagaaaggaagcagucacuggcauguggggacuuaaacugcaaagcugugaccagguaggugugggaugggcaguuugggaccucaagagcagagggcacuccagaggcggacgcuccagaaaggcccagcaggaacaggagacaauaaauuuagccggaaaggggucuggguguuaagucagaaaaguggacugaagccaagacuguaaaccaucccaacucccaagcucagguuuucacgaagaagucugcucacucuggucucuuaagcauaguuuauagaggaaacagaagaccaaaguaagaaaaguggugauuucaaaguagauaaaaggguggaaaugauuauuuucuugccuucuugauuuucucuuaucccauauucuuuucagaauauauucuuuucacaucuaccauucuucucuacucuuacuacagagagaaccaaccaaauccaccagaauuugcuuaaacuaaauaugcacaucuuucaaaugucccaauauuuaggauccagacaaaaauauaaaaagggaaaaaaaagauuuuuuuuuugagguggagucccuaucacccaggcuggagugcaguggcacgaucuuggcucaccacaaccuuugccuccugaguucaagcaauuauccugccucagccuccugaguagcugggauuacaggagugcaccaccacguccagcuaguuuuuguauuuuuaguggagacgggguuuuaccauguuggucaggcuggucucgaacuccugaccucaggugauccaccugccucggccucccaaagugcugggauuucaggugugagauacugugcccagccaauccuaugguuuucuauuaaucaguuauugcuauauuuuuuccuauuuuucagaccagauuuugccauauuucacucuuaaugguguacaaaccauauuaaaaagucucaucauuuuuauuaaaccaauuuuucuacauaauccucuuuaaugaaaauauacaccucagccgaaaugugagaagggcaacaacagcauacacuuuugagcccuuaugugcaagacaguggcauugcaaggcauggauggaaggagugguccacucagagugcaggcaauagggagggccuugucaguagggaauuuaaaaauaguaauaaaccgaccaagagucaguuugcuuuuuauuaucacccuacaccggcaauuccagacaauucuaacuccugccugcuggggcugacagcucccaucacagcccucuucuccuuaauccaccgcuagugcccaacaacguauuaaaugcuuuacagagacucucuuuuaacccucauuuuacagacaagaaaacagagucuggcagacugaguuaaaugggggaaugaggauuuacccuaggcagcccaauucccaagcccaccuguuuaaccugcaggccaccaccacucagggaaaaggagcaaaaggcagcagaagcccaggguuggguucagcugagaggcaacagcugaauuuggaugucaucgucuauuagccuaccgccuaccuuuuccaucagucaaucaacaacugccuggagcucagagaacacuuucuacuuauuaauuuauugcccauuucuugacgguuucccuagagagcaggcagguuaacucugccacacaccuagucgcuguggccugaggcaaugaucucucacaacugacaggcaauggcaaaaaacuaccucaugaaaauauuuuggacuccuugguguucacuuuaaugggcaaggacaucuguguuuuuuuguacugucaaauucccauaauagaaaaauuuuuaauugcuucacuuuuagacuaucuaugccuuuuacuggacaucaucauauugagagaaggcaggauauaaauaagaaauaaaaacccuucuucacuagcuaauaauuuaacugugcaaauaacucauuuugucuccccaguuucuacaucuaguaaguguaauuuuaaguuacgucuucaaaauucuagugaagguagaaguucucuaacaaucuaaacuccuuagaccaucaaacuacaaauagaggccacugcugugaagacuucugaaacuaagaugaagaaauuccuccucaucccauuccccaguuacuaaaggggggaggaucacagaaauaaaggugugauuaaguucacaaauuuaaauuuuaaaaaucaauacauacugaaugugagaagaacuauguagucacuucagagaugugaaauauccaaccaagccuggacucccaaagacuggauauauuaacacagcuaaagaaaggaggugucaaacagaaagcuggccagucaucaagggaugcugaggggaaagcaagugugggagcagaauuuuacaaugcccucaagauuugggccccuguacaaucucucccuaugagcauacacagggcuaggcuuuuaaagggggucagagauuguaaagaccaaaagugugugggagauuuuccagcugaccuugaagaagcaaaaugcuacauuguagagagggccauguggcagggcagccucugggagaagaggaccucagucuuacaaccauaaggcacugaauuccaccaacaaccagugagcuuaugagaccacaucccugcugacauuuugauuucagccuggugaguccuugagcaggggacccaguuaccugugccuggacucauagaaacugugagauaauauacuuucauuguuuuaagcugcuaacuugugguuauguguuacacuguaauugaaaacuaauacagugagucuccagagaagcuggcaguacccaucuaaacauuguccagacauagagaaggccauccuuguugugagacagguguuugaugccauggaaacugugcucaucuaacucaugguuuggaugccaugcucacuaauacacaccuggccuccuacacaggucugccuuaagggagauaauguacugaccauccacauggaguaucucagucccuggaacauuuacuuuucagguaaauaaacaaauaaauaugcuggccuccugauuccauacaccaguuucuucagcuaggcuccuguaagucuaccccugagagacagcuccacccuugauauccacagaaaaucaaguuaaaaucugacaaagcuaagaauuagccagacccuggacuauauuagucuuacugccacaaacaguggcuuaaaacaacacccauucaugagcucacagcugagugggucagaaauccagucaggcucagcuggguucucugcuuagggucucacagagccaaaaucaaggugucagccagacucugcucuuauccaugagcucuuaggaaaaauucaccuccaagcucguuuagguuguuagaauaauucgguuccuagcgguuguaggacugaggucccuguuucuuugcuggcugccagcuggggaccaugcucaguuucuagaagcuacccacauugcuuggcacauggucccuuucaucuucgcagucaacaucaaauccuauucaugcuucagaucacucuuucuucccaccugcuggagaauaugguuucuaaggggcuugugugauuagaucagcccaccuggauagucucccucugccaagcaagguaguagaaucaugggugauaucucaaacaugcauagguuccaccuauacucaaaggggaagauauaauacaaagggcagggucacugggggucucucaggauucugcuacccacacuggaccauggcaauccgacaagguaaugaaugccacccugggagggcuccuaaaagagaagagccagucagcuuccuacaggagacccuucauauaccacaauacugccaaaaucccuguucguuuaaaagcaauuagcauauuuccccguuguuuuccaauauucuuagugcuauacauuguuacuuuuuccuucuucugagcuggaaccuuaugaauguauuuugcccacucacagaaaucaaguuucauaaaaauuaagcagaaacuauagaccaaauacugaacaucuacuaaguaugagacaauaugucaaguacugugaaauaugaaaauaauauuaacucuucucaaaggaguugauaaguaaugcaagccaaagugaagauaauauaacaugauuaaugaugccacacuuaauauuagucaaaaggaaagaauuaauaaaagauucacaccaaauuaccacaguuuuuaacguaggccugacagccagaguauuccuacagaugccacugguaacaaguagauaugaagaucuuuaaaauguuaccacuaugauucuaaaauuuugggauguuuacuguguauauuauguuuauguauaaacaagcaaaaaaaaucagaggaaauacaccaaaguaguuuagcuauuugaauagucgguuuacaggagauuuuaacuguauuuuuauuaguuuuuuaaauuuucucauuuuuccccaguaagcauaugguacucuuagaaccagaaaauauauaucuacacgcauuuauauugggcaaaucaugguauuugccccaacuaaucuuuccuucaagccaaaaacugucuuguccacagcucccccugcuuuggaaagcaugggcaauuuggauauggcacaaaaaagaucaggagagccauucagacccagcuaacuggaacgugaacaaggaaacaaacuuguugacagcaagacuuagagcugaaaggauacaagagagcugaaacuaccaagagccccugcaaacugauggcaugagagaacagaaaugauuaguaaagaggagcuaugggcuagagagaaguacacgaaacagagauugagggagccaacagaagaaaggagagagcagacaggcuaucgugcagaggacgcccaagacagagacagagaaaagcagggacggauggguggguggagggauggguggacaggaggacaaggagagccagagugaguaugcaguccuccuagcacuucuuugauuucugacaaguuuccagcucucuuuuuaacaaaugauuuuccauuccuuucaaccaaaaugagccuaaucaaaaugacauuaaaaacauuacuucuauaugucuaaaaauuaaaauaaaaguuuuuaaagaucuucuaaaagacacuuucuuaauuuagauuuguuuuuacuucuucaaaucccaguuccuccccacaaacugaugagaaucucugaaucucuccaaccccagcacucacaaacagaacaaucccagucagaagaggauuugccuauuagcgacacuaucuccaccaagacagcagccuuauuaaauuacaacuguuugaacaaggucaagcacucagaguuuaauucaaaguguuuccagguauaaugcugucaggucaacuuaaacaagccaacagaggcuuggaggcugauuaaauauuaaaacagaaucuuucacaucuguuuuuacccaaggaugaaauuacuguacaucacuucaaucagcucauuaauacacuacacacacaucuugccucaaagguuacaggaauaucaaugcuucagaggccugcagugaaaccugcccacacagccagaagugaggucacuacauacuuuacagaacgucaauauuucuuuauaaaaugugagagauaaucaguuagacauagacacauuuuaaauuaaagcaugaaaaccuccgugaaguuaagccaguugcuuuugaucugaaccuuuucaucauucauucaguuggcuuugacagguaacuggauagcauacguugagcaaaaauuuugauucaacgguaauuauuuuauaaaauggaggguugucacauccaaguagagggucauggugaucacauuuuuuaacuuauaaaagcacaaauauaaaauauaaaagauauuuuaaguguaaaagauauuuaagauuuuauacuuaaaauaucuuuuauauauauaaacauuucaaaggacacacacuuaggacacucaagaauauauacuuucauggaguauuaggugaaugagcaguugagaauuuucugcuuuuaaaacuccuauaacaaggaaugacaccuggacaaacagucaagaaucacuuagaauaggucucuguuuaacccccacucccccaacauuugcacucaaugaauaauucuuacgcuguuuuguagcacuaugugguaggcagugauagcuauuggcugggacugcuaugcacauuucccacccaugccucuucuucugguauaucacccccuuucaucugggaaccucgcuaguccuugacaguugucaaacacagugcccucacccccuagccaguugagugagcacacucuucaaaccacaguccucaugaccugggugacagucuaaagcaugggcacaugccuccaacaggcugcuccuacacgugcgcuggaaaagaaaagucuuugggguugcccaccuggcagaagguaugggcagccauuuucccacccccaacaagacagccaacaagcaaaacgcaaaaccuacucgcagacagagugagcagagcucaagauguacaaaaacagcacugaccacauccucugagcaacuggagccaacugggcccaauccaccucuacuuucuguuuugaacauuaggugucucuagcuaagucugauaugaauuaauuaauaauauauuucaauaagauauuuuaaauuaguucaauauagacaaggaugacaaauuuuaaauauuuaacauuugacuaaaaauaauuguguuaguaucaauguuacuugugagauguuucauugugauacugcccuaaggucacuuaauuaauguuaacauuaucuguguuuagguauguuaguaauaaaaaaaaucagaaaaguuauucugacccaaaguacagauaaaaucacacuuugcucuaagaauccuacugaccucucuuuuuucugaaguucuacagaacuuacuuauacacuauagaacacuuaccuagagauuuuaaucuugcacugcuuucuuacuguuucauguguaauugauuuaaaguuuuauuaauuguuuugcuauguuaaaaacaauaaaguuugcuuaaauauaagguauuucaaauuaguucaauauagacuaggaugacaaauuuuaacuauuuaacauuugaccaaaaauaaugauguugguaucaauguuauuugugagaucuguuucaugguaauacugcccuaaggucacuuacuuacucaggaguagaggacaaacuuacacccaaaaaagggugacuauugaguaacaaaaccuucaaaacccaacuuaaacacugcaggcuaaggaaaaauuauucaagaaccauuugugagaugcuggaguuuuaaaaauucauuuagaggucgggcgcgguggcucaugccuguaaucccagcacuuugacaggcuaagguggguggaucaccagaggucaggaguucgagaccagccuggccaacguggugaaaccccaucucuacuaaaaauauacaaaauuagccaggcaugguggcaggcgccuguaaucccagcuacuggggagggugaggcaggagaaucccuugaacccaagaggcagaaguugcaugagccgagaucgcgccauugcauucuagccugacugacaagaaagaaacuccgucucaaauaauaauaauaauaauaauaauaauaauaauaauaauaauucauuuagaauuuuagaaauaguuguuuccaugaguacaugaaaaacauuuuauuucuuugaauucauugauacuauuuuuuuuuuuugagauggaguacugcucugucacccaggcuggagugcaguggcgcaaucucagcucacugcaaccuccgccucuuggguucaagcaacuuucuugccucagccucccaaguagcugagauuacaggugccugccaccaugcucggcuauuuuuuuuuuuuuuuguauuuuuaguacagacggggguuucaccauguuggccaggcugguuuugaacuccugaccucaagugauccacccaccucagccucccagagugcuaggauuacaggaaugagccaccgugcccagccgguugauucuaaauaaaggaaugauuugggagaugaaacucaaaguuucauuuccccucccccaggauaugauuacauuugaaacugaaggugacuguaagcacagaacugucuuagccuucuuucuucugcuauagcacaguaauaguauuucaguaggaaaaccaugggacacagagccaggacacccaaguggaaguucuuucucugucacugacuggccuugugaaaauaaaacagacaguucaaaacuucuuuugaaccuguucucuuaacugcaugagacuaacgcccacauuauccacuauauaagagggcagugaauaggaauuugaggcuauggugagcaaugaucagccacugcgcuccagccuugagcaacagaguaagacccuauucccuuaaaaaaaaaaaauuguagaaagaaggcagugaagacccacugagacaauguuagaaaaaacaaaaccaguaucaugaguuugugucaugugcuaugugcaaacaugaucuuagucaucuucuaaggagaaaacaaagcucaaaaaggcuacuccuaacuugugcaaagucauagcacagguagaagcagcagcucaguccaaagcccacauccuuccccucaccacacugccuccaguaacugcagaacaaggaagcuguacuccuggacccacugaggauccaaauccuaggugcuuuucccuuuuuguaccaaugccuuucacguuuguuuaaaaaguaaacauucuacaauaaacacuuuguugcuguuuuuuuuuuaacuaaagaaacauauagauuuauuguugacaaagaaaaauuccagcaaacacauauaagggccuaugguguuuugcugaacaaaauaauuuaaaagugugcuugucuguuaugcuugcuauggcuaaaauuccuaauuuaacauggcaaaaauaaucugcaaaugaauuauagcuaauugccuauggcguuuucaaguucuaaagaaugaaacagcccccaaaauuucaauuuuuagagccauagauuccuguuuauagauuccuaguguucauuuacugagcguaagcaguuaugaagacauuuaaauuuuuaauaggauguacuucuuuaaagaaaagcugaaacuuccuguuuagugauuuaaucaugacacaaggugaaaguauuuaaaaaucaaguaucuauuggaugaaguucacugcuaagacacagaauagaugcuggccccaucuuuuauauucuguaggaugcaaacuacaugccuugcuaggggguaacauaaaaaagaaagucaccugguaguggugacuuacugaauuuucucugcccguaaaguuuaaugcagguaaaaugacuuaauuaacuaauggggcugagggauaaggguugugccuaccacuguggcccccacaguggagagggcacuuuugccaccgcucuagguccagcagugugcauucuuccccaggcagaaaacagguacucuaggugcacaaucagauuacuucugggacagacacuucuugucauguuagaguggggagcgggggagaggaagagguggugcacgccaggauuugcgucugugccagggcuuguuucaaggcuggagaaggaugcagugaaaccagaagaagguuaggcucaggauuauaauaaaaacuuucaaauacuuacaaaaagggcucucugaaaucuuaaaccauuaaauuuaaacacuggcaguuaauaaaacacaaagcuauuuguuuaacagaaaauagaaucccaguauggcauaaucuuauaccauacacaaauucacacuugaacaauauaaucaaguagaguaaaccauauuaaauguaaagucaauaaauucuuucuuugauuguugaccccacacacacaccaaagaaaagacuauaagggauuuaacagaaggaaauuaaucaucauaauacuuugguucaaugcugaucuagggugagauaauuugggcauuaguacaguuuacgugaaauaagauuuaaagcagcacauuuaaaacaagcagaauucauuaaacaaccucucaaaaggaucauuuccucuaauuauugcuuuuauaacagaagacaaaggcaacccaauguaaguucauaaaaucuacaauuagcugccaaaaucuuagcagauaaaauuagaagagaaagcauauuuggaagcacaauugguaaaaaguucuguuaucuuauuucuaaaaaggcauuugcucuuucuuucuacccauaaucguuuaaaguacacaaauaggccggguguuguggcucaugccuguaaucccagcacuuugggaggccaaggcagguggaucacuugaggucaggaguuugagaccagccuggccaaaauagugaaaccccaucucuacuaaaaauacaaaaauuagcugggcgugguggcguguccuguagucccggcuacucagaggcuaaggcaggagaauagcuugaacccaggaggcggggguugcagugagccgagaucccgugccacuguacuccagccugggugauggaguaagaccaccaucucaaaaauaaauaaauaaauaaaaaacuaaaguacacaaauauuauggacuagauauuaugguaggcccaugacaaagaggaauaaaaaggcaaagcuaagcuaggugaucuagcagcauaugguccuggagagaggggguuuauaaaaguccucacaauacuuucagacaagugugcuaaccugggcuguaccuaagaggcuauaggagagaaaagcagcugacuggcugacuggaacauuuucacaucugggcugagucuuuaaaggaaaagaaaaagaaggagucugaaaaacaagguuaaacaagagggaaagguacauaucccauauuucaggcaaaaaaaaacaacaacaacaacaacaacaaaaaagcaguguguggaaugguacagagcuagaauauuuuuagggaaucuuuggacauaggaaggggauaagaggaagucaugcuggggaagguaaagcuggaaagauugauaggaacaagauuaagggccaggcaugguggcucaugccuauaaucccagcacucgaaucccaagaguucgagaccagccuggccaacacggugaaacuucaucuuuauuaaaaauacaaaaauuagcuaggcaugguagcucacaccuguagucccagcuacgcagguggcuggggcacgagaaucgcuugaacccgggaagugaagguuguagugagcugagauugcaccacugcacuccaggcugccugggccagaaagacucugccucaaaaaaauaaggaauaagauuaagaagaagagcguuuuggugaaacuauggaauuaauucaagcuuuuuaugccuuacucauagggccuauugggaagauauuuaagaccugaucaaaaucugucauauuauuuccuaaacuuuucaguauuacacaauuaauguuuuaaccauaauaauaauaauaauaauaauaugauuaaagggcaaagugaaaaggcaacuuaugaaugggagaaaauauuuucaaccaaauaucugauaaggcauuaauacccggaauauauaaauaacuccuacaaaucaaaaaaacaacaaacuaaugcaauuaaaaaaugggcaaagcacuucaaaagacauuucuccaaagaagauauacaaaugggcaagaagcauauaaaaagauguucaacaucacuaaucauuagagaaaugcaaaucaaaaccauaaugaaauaucaccucagacccauuaaaauggcaaaaaaaaaaaaaccaaguguugauaaggauaugaagcaaugguaaucucugugcacugcuggugggaauguaaaauggcguagcugcuauaaagaacaguuuggcggcuccucaaagaauuaaaaacagaaugaugauccagcaauccccuucuggguauauagccaaaaggaucucaaagagauuuuugcuuacccauguucacugcaguaguguucacaggagccgaaagguagaaguacccuaaauguucaccaacagacaacuagauaaagcaaauguggucuauccauacaauggaauauuauucauccuuaaaaagaaggaaaucuugucacaugcuacaacauggaugaaccuugaggacauuaagcuaagugaaauaaaccaguaagaaaaaaacaaauacugcauuauuccacugaugugaguuaucgaaaguaaucaaacucuuagcaacaaaaaguagaauggugguugguagaggcuggcagaagcagggaaucaggaauugcuuccuggguacagaguuucgguuuuacaagauaaaaaaacucuaaagaucuguugcacuaacuguugcauacaguuaacacuaccauacuacacacuuaaaaauggcaaagaugguaaauuuaauguuaugugguuuuuuuaaaccauaaucaacaaacaaaccaaaaauaacaacauggccgagcacgguggcucaugccuauaauccuagcacuuggggaggccgagguggguggaucacuugaggucaggaguucgagaccagccuggugaacauggugaaaccccgucucuacuaaaaguacgaaaauuagcugggcgugguggcucaugccuauaguuccagcuacuugggaggcugaggcaggagaauggcuugaacccggcaagcgaaguugcagcgagccgagaucgugccauugcacuccagccugggcgacagagggagacuccgucucaagggaaaaaagagagaaaaauaugauuaaaggcugcaaaguuucaggcuaauucauaaggggucccucaugccaauauggggacgugaccuuuauuauuagcuguauguuacaucaacaaauuuaguguucaagcuaguaaaauuucaaauuucucagccaacacaguaauugcuggcaaguuguaugcuugaaaccugcagaguauaaauaagggaaagugugcuaaauucuaaaauccacuccagucuacugggguugagauuguugauugauuuugucaucauggaaagcuauuucaggauuuaguaacauuaaaaccacuaauuuuggcugggcgugguggcucaugccuauaaucccagcacuuugggaggcugaggugggcagaucaccugagaucgggaguucaagacuagccuggccaauauggugaaaccccaucucuauuaaaaauacaaaaauuagcugggcgugguggugcaugccuguaaucccagcuacucgggaggcugagccaggagaaucgcuugaaccccagagauggagguugcagugagcugagauugcgucaucacacuccagccuaggcaacaagaacgaaacucugucuuuaaaaaaaaacaaaaaacaaaaaaaaaaacccacugauuucuagacaguguuuuaaaaagaaaauauuaucuuaaauaaagccaaacuuucaguuauuaaaaagucuauuuagucuaaauccaaauucauuuuauccaaugucaagcuuuuccccuaagaacagcagugaggaaaaagagagggguccaaggaaugaaaggcggcaagugugaggaaagggaaaggucugcccacuuuucugugguccaguccugcagccuguaaaauaucuuccaccauuugcaggaguccacaugccagcucucucuagugagaccccuuugcugggaccuccaugcugccugaugcaggcaacgggugcccuuugacucagcucucagucuccucucagcuccugccucugugguucacccacaaccucuuucugcugcgggccuagcccuggcaggcagccuucgcaggcaggacaagucuuucaaaaagacucaggccagcuguccuccauguagaccaccaggcccacaggaaaugucaagcguuuuugcuguccucucuccauacacuguccccaggggcagcuccagccacauggggggcuuucagaugagaggaagauacuugccucuguauucacagacauccccaaacuccaggaaagccacaccacacucacucaagaacgcuuucucaggaguccauucuaaucccacagcagcaccuggcugguaccucugugcagcucaaugagaugucaaucuacccucuugaauucaaccguaaucucugaguuauucucuugaggccuuucucuaaugacuaggggaggacagaaagaggagaaacccccaccucccccaggcaagagcucccuaccccuaagaguuccuugcaagcaacugacuuauacucuucucuuacacagguugguuaugcuaugggggguauaauagcugcuaugugcacaaaaggugguuagagguaucagugcgaaauguacaaaaguaaaggcuaaguccaccuauaguaacacugaugugugcaaccaggacuauccaggaagaaaaucuugauaauuuuaguaacucuagugccacuacuaacugucgcugccuuuauaggagacagggucucucuuugucccccaggcugcagugcaguggggcaaauauagcucauugcaaccccaaacuucuaggcucaaaggaucuucccaccacagccucccaaguagcugggacuacaggugcacaccaccaugccuggcuaauuuguuuacuuuguguagagacugggucuugcuuuuuugcccaggcuggucucgaacuccugggcucaagugauccuccuuccuuguccucccaaagugcugggauuacaggcgugagccaccacacucagccugucccugcauuuucuaacacuguucagauucaaacuccagguggaagcagucaacaggcuaagccuaagaagcauguccaccccugcaguuccuaggaggcaagaacagaaaaugcccauuugaacucugcuggcuuccacagcagaagguagaaccuaccaggacucauuauugggcaaccuauaguggacagcagauguccauuacagacauucccuaucugcuuccuuaaagaacugagaauaucugucaaaacaacacugguaaugauaaacaauguuaauucugccaguccacguuacaugccaauauuguuccaacuaaaaaauaauuuauaaaagcauagcucugaucacuaccacaaucugccaucaucagucagagucaacaaaaaaauaaaagcucccagaagggcuaaaauccuuaaugcaaggcugauaacaaagauggcaggagauuauuuaauuuuuuaaugucagaucauguuaacugccaugcuuaaauuugcaaauuguugcuuguuaaaauauccauuuacuaaaaugauaaauaauacauguugugacacauuagugaaacuguuauuuuuuaaagcaucacagacacagaugaauuaccauuucggugcaaacccuuguaccauuuaaggaaaaacaagaggaucuguuaaguuacaucguggcagaaaacucaagaguugccaccacauuucccuaccccaaaaugacccuccacauuucagauucuuaaggucuucucagcaaggcaugugcagagccaaaaccagagcccagaaaguugacugaaggcuuccugccaaaggcagcccuugcaguagcagcaccagcuaacaucaaggucgagcuggcaauggaaagguggccagguuuaaaagaaaugcugucaggaauugccaggaauaaagaagccauuccaaauugcacuauagcaaagguaacaaggaucacagcuuuccccaauguucauccauuucaucccccacuaaucuugcucaguaauuuucauguucaauuuuaccucuuauucauauagagcucagcucuuugcuuuuauugaaugggaauacauacuagaauuuccuuugaaagagaaaugguuauuugcaaaugcuggaaggcagagaguaaaaacaaaguuuguaacacaaauauaauuuugaaauucaaccauuuauaugccaaaaaaaaacccaaacuguguucuauuuaccuuuaacucaagauuugaacauauaucauaaaauccuuagaaaacaaagugacuguauuuuaaaaaucaaaccaaugaugguacaaaaaaaaauugguaaccaaaagauuaaauguaaaacaugaguucacugacucaaggucaaauuucuaaacuuggcauucucagcucuucaugguccggcccuagccuaccuuuuucuauuuuacuuccuacugcuucccuuuaauagacguguacuccgagaaaacuguacuacucagcuccucacauucuccuguguguauuuuuguuuguuuguuuguuuguuuugagacggagucuugcucugucacucaggcuggagugcaguggcccggcuaauuuuuuauauuauuaguacggacgggauuuugcauuguuggccaggcuggucucaaacuccuagccucaagcaaucugccugccucagccucccaaaguaaugggauuacaagugugagccaccacacccggccuccugugugcauuuguaaauggugggcucaccucccuuuucuucugaauaucuccuuaaaaauuacauguccaggccagaucacuugaggucaggaguucaagacuagccugggcaacauggcgaaaccccaucucuacuaaaaauacaaaaugagccaggcagcuggcaugugccuguagucccagcuacuggggaggcugaggcaggagaaucacuugaacucaggaggcagagguuguggugagccaagacuacaccacugcacuccagccugggugacagagugagacucugucuuaaaaaaaaaaaaaaaauuacauguccaaauucucccuuuccuacagugaccagcucaaauggcaucuuggccaaguguccucuccuuccucugccucccacaguccuggcaaugagcuauacuccauacaccuuaucccuucuugaagagucaucuuuggucaaaaagucacuacuaaacugugaguucaucuucacaacacagcuuuuacuuauggggagacacucacacuaugcccuguuuacacaggauccaagcagagccugccuccaaccuauggcaggucaucuccugccugccuuguguaaauuccucagauuuaaaagcccauuuauuccuuuggcucuuucccacuagggcuuagcucucucccaaaacaaugaauuuuccuuucaaugacauuggauaaggcuccuugauuugaucuauuuucugccucccauccacugagccuugcuccaggguaugcccaguccaguauaaaaagccuggcaccaccuuguggggagagaauuucaaccucuuuacacagaugcaaagguccccaugaggcaacuggcccugaauucuggaguucggcuccucccuucucuuggaccucaguucucaauucucucccacugaaucuucacagcuacuuaacuucuuaaugaagcugaacgcucuaucaaccauccaggccuuaaaguucucaaagcugaauaucaagcauaaucacccaaguagagaaauggaucagacaucagagacauccaggcaaccuuaucuugucuaaaauuauaucuugucuaaaaaauauaaauauguauuuuuaaaauuuuucguuacacaauaauggaauauaauuucacuguaaaaaaaauuugacaacauagaugacacagacaaagucuccacugacacuuccucaaucucgucccaugucugucuuagaguccuuuauccacguauuuacauaucauccuucaucaaaucuaagaucuuaucacuuguaaugugcacuaugcuucaccaagaguuuaaauuaguaaacuaugucaccaauuguuagauacgcugauuucagaaauguuaaaaaaucugaaaagcauguuuuagaauuuacaaauacauauaaauuuugagguuuacaaauauaaauguaauaauuuuauauuuuuucucacuaaaaacguaucugagagagccucccacaucagcugcauaaagaucuauaccacacucuuacacacuuuuuagguaucgcauucuauaugcuggcuguaccacuguacauuuaaucauuccaauauuucaccauuccagugcuggaaugagcauguguucagguguauuucacuagacacaaaauuaccaaauuaaaaguaugugauuuuauuuucaaagauacagccaaacuaccuucuccaaaaaggucugaacaauuuauaugcucagaauaugaaaguacacccauuuuuucucauugccgccaaagaauauuauucucuuuaauuucugccaaucugaugggauaaaaucauaucuaguugcuuuaauguguaauucacuaauuauuaaugaaguuaagcaucucuuuguauuuauuggccauuuguucccuuucugucaaugccuuuuuauaucuuuugcccauuuauucuaguguuuucuuauuaauaugcagaagcuucuuuauauacucuguauuuauccuuuguguauugcacauggucuauuuucuccuagucuguuauuuguuuuuuaauuauauuugugauuuugucuuuggugauacagacauuacaaucuuuuaauggucaaauuuauucaucacuucccagcuauacccaagauuacuuacauguacguaauacuuucuucuaacaagaaacccauucuuugcaaacuccacuggguucuggccuggcagugcuugaagggauaugagauacacuccuacaacccacacauuggagaauuuccauacagcuauccugaccccaccucugaaagaggcaggugucagucagugcucugccagccugugggcacuauuucaggaaggaccagccaguucucuuuuuuuuuccagacaggaucucacucugucaaccaggcugggcugcaguggcacaaucauagcuuacugcagucucaaucuccccaaagugccucagcccaaagcacuggaauuauaggcgcaugccccacaccaaacuaccuuuuuuuuuuuugagguggggucuugcuauguugcccaggcuggucucaaacuccuaggcucaagcaauccuccuggcuuagccucccaaagucuugagauuaugggcaggagccacugcacuuggcacuaguuuccuuucuuaacaucaaagccagaagccuaacccauuccaggcuaaaugugccagccuggucagccugacaucauggcucaaaaccagagaccaggcugggcaugguggcucacacuuguaaucucagcacuuugggaggcugaggcagguggaucaccugaggucaggaguucaggaccagccuggccaacaugguaaaaccccaucucuacuaaaaauacaaaaauuagcugggcaugguggcaugugccuguaaucucagcuacucaggaggcugaggcagaauugcuugaacccaggaggcagagguugcagugagccaagauugcgccacuacacuccagccugagcaacagagcaagacuccaucucaaaaacaaaaaacagagacgaaagcccugccacacagagaggcaagcaucccacuauccauggcucagucccugggccaggagugucuggacacccuauggaaagacugucaccccaccccucucuccuguagucucagauguaacauacugccugcagaacugcaucccugaccugguagaaaccaaccccagggcauuggguaacucugaugacuagauccuggucugacaugcccaaaugccaagguguagucccugcgagacaguccccuguccccagagagacgguggagaaaggcuggcucuucucccuucacaccugcacuaugagaucaggucuuugauuccucugcauucugcuccccacugcugacauggucucccuuacaagauaugccauaaccuacugcccagccuguccaaaccucacguaucaggcccucaggacucacccaacuaccagaaagagggcccaggacaguuagguuccgaguucccugacuccaagcagggugaagugagcucugguuccugggucaguguaauacacuggguuauggaugggucagagguuggugggaacacauaccuucccucucugcgauacaugaauuauuuagucaagaacauagcacuuaaugggcagguaagguggaaguacagaguaggagcagaugcagccuauguuucuguggcuuguccuuugccccuggguuuccaccuaagagcaucagccaacuauaacaccaagcucaggugggguccucccagauguggggcacgggggagcggagaggaagcugaaucuuugcuguggcuuuuaaauacucuggcuuaucuacucaucacuauacuuacguuuaaaggaauauuuauauacauuagauacuccugguuggugagucaaacucggcauuuucaagaauuccuccucaccugggaugcaggugggggugaagaaggcucuguguccaggugucccugccuccagcuucccaaucuuuggaaaguccaucucccagaacugugauggccugagaggccugcuccaacacacaugaaacucagcagaacaucgcagggcauaccugggaaaauuccaaucccaccucaaccuucucucagacaaaauuaaucuugccugucagagccaaauguaaccuaauguuccccugauguaaacagcucccccuucuccuguuacagccccaaccaucgugcuugcacaaacugaaauccuacuguuuacagccugaugauaacccaguuggcauucugugcucuaagcuacucccuuagaaagagcuuccccuggccgggcgcaguggcucacaccuguaaucccaggacauugggaggccaaggugggaggaucacaaggucaagagaucaagaccauccuggccaacauggugaaacccugucuccacuaaaaauacaaaaaauuagcuggaugugguggcgugcaccuguagucccagcuacucgggaggcugaggcaguagaaucgcuugaaccugggaggcagagguugcagugagcugagaucgugccacugcacuccagccuggugacagagcaagacuccaucucaaaaaaaaaaaaaaaagaacuucuccuugaccuuucaaggccuccccagcaggacucaaaauaggcagccucaccuaagucccacucaccucugaguccuccacaauauuuacuacacuucuuuauccuagauaacauuuucuaaauauuuguucaauuaauuauauuggaauuauuucuggaauuaauuuuugccuucccaaaguucauaucuagcauauuuaaguuugauaaacuugcaucuuuauuaaagaaaucucucauuggccuaauagcaauauuauccaauaucaacuucagauuuaaccagccucaacugguuaagagcuucagauggcauuauacuaaauggagaguuuccucagauucuaaaucugugcuguccaacacaauaaccacuaaucacaugcgacuauauaaauuuacauuuucuccuuugggaggcugaggccuggaguccagaccagcuugggcaacauagagagaccccauaucuacaaaauuuuuuuuuuuuaauuagccagguauggugguacaugccuguaaucccagcuacucagaaggcuaaggcaggagaaucacuugagcccaggaggucgaggcugcagugaacuaugauugcaccacugcacuccggccuggguaacagagcaagaccuugucucuaaauaaauaaauaaauuaauuaauuaauuaauuuacauuuucaagaaaauuaaaauuuuaguuucucagucucagccacauuuuaagugcucaauagccacauguggcuggugguuaccagaccauauuggauggugcagauagagaaaauuuccaucaucaaagaagguucuuuaggauagcgcugcuccaaaugcauuaaaaaucuugaaaacuggcugggcacuguagcucacgccuguaaucccagcauuuugggaggcugaagauggcagaucauuugaggucaggaauucgagaccagccugaccaacauggugaaaccugucucuacuaaaaauacaaaaaaucagccgggcaugguggcccgcaccuguaaucccagcuaccugggaggcugaggcagaagaaucacuugaaaccaggaagcagguguugcagugagcccagaucacgccacugcacuccagccugggcaacagagugaaacuccgucuccaaaaaaaaaaucuugaaaacccaaagaauccuuagcuuacagcuaguaucagaucuucaagguaccauaauuaaauuuaaaaacacacugcuccuuuaauuaaaacaacauaaggaaacacucucacugauaaaguagggcuuuuauaauaauagauuugucucaucacaaugaaaaauuuaaacacagccuaagucucaucuaucuucgguugccaaagcuaauagccuaugcagagggcaaugcauucuuagaguugcaugaauccuuucuccugacagauaaaauuucugguuaauagucacuaaggaaaguaauuuuaacauaacccuuuauguccugggcuugacuagagcauacaaacaacaccuagaaaauuuucaacccagggauuucaaaagcuaugcauacaaaaccaaaaacaccuaagucuucuaugaguucagaauuugaugcuagguggaaggugucuaugaauaugugaagugaguauauauguuggaauaaaggaacugucuaaguaggcugugucuuuuucucucccaucuccaugaaaugccagugucucuuagcagauaaaauacaaaccauaagggaguuagagaaaagaagucuucuauuccuuuuauagacuccuaggagcacugagacucauucaacagcacauaaguaugaguccuggaaagcacagcuucagcaccucaauagaaaaguuuuuccccucacagugaagcaaugagagggcuaagaagcacauacuuuuuaaaaaucaaaacagaauuggaugaggaugggcagaaggguaggccugggggcagaggaccaggucauccaacagucuccagguauaaagucucaauucuauacauucauaauguguauuugugauguucccucugggcuggccaccacacuguauaaucauaaagugagcuuuaauuacccaagaccauucacuagcucuuaugaaauguguucuaccugaaggacugcucaagagggucacaaauggcucauaauuuuuuucugcuggaucuuaaagccuacaacuuccuacuaaaggaaaggucaaaggaaauacaucuguaaaauacugccagaggggaacaggagaaguagggggcagccaacaacugggaccucggugaugccaaccuuaacugucauuucacccuuuccccuucaaaccaucccaugguccuaaaaccuuuauaauccuuuuauacuugacacuauugucccagaagagcuguuugucauccugaaaucaaacuguaucuucuccucugggagcauguacauucuguaauaagacagguaauccucagacagcggcaagcagaaccguacuaggcucugauacugaccuugacuuuacugaaaaacguuaagugguaaaaauuucaucaagguaagggaagaacaaaggaagaaacuguuuccauguuuucccuuccauuuuacaugugcauuauuucaaucccauagccaauuguuugucaucucuuuauaaacuuucgggaacucaauagaaaacaguacaugagucacucucucaagagcauacaaaugaugaggaauacauucccauauauauauacuauuauucacugaaauuuuuacuuagcuguuuuugaugaagaaagccauauggucaugaaaaauacacuauaggcaaguuacugauucugacaaagcuuucuuaaaauucagaagaaacuaugugaaccaaacaaacacgaacacaucaacccucagaaaagauguuuaaagagcaaugcaaaauguuuuaacuggacuuuaucaggcuucuuaaauacuauagaauuuccuuacugacacauuagggaagaaauuaacuuuuaaagacaauuguuuaagguaagcaaucucacaaaauguuuaucuaacagaauccagccaugcuggcuacagcaucucuauugacauaccuuuaaaaaccacaaauuauuaggaaauaggucuggaaaaacguggcccauguagaaaaagucuuuaacaaagaaagguuuauuuccaaauuacauuaguauucacaaggugaaacaacuuauuauagaugcacagcauuagucucauacacaauaauaccuuuacuaauaagagaauauguccaaaugucacauuucuuuuuuacaaaguuuaauuaccagaggugagaacugauaggcacaggaaugaguuccaggguaucagauaagaggauggcugcagaacgaaauuacuguaaaauacuaacuaaaagucaaacaugcaagaaaauauaaaauaugcaucagacaguuuuaggaugagguuaaggaaaagagucagugagccagauuaauacuaauagcaagaggaagaauaagaggaaucucugguugagcagggaaggggagacagcagggaaaaucuugaagaaggggcagagcuuucagcucuuaagugaaguuaaaguggaagauggagacuccagcagccccagcagacacauccaccucagguggaggcgcagcgggaagagcagguuccuuuugacuguauucccccaucccauggcacccaccaagggugcuuucuaggucaaccucggaaggaagccucuggugucuaaaacuccauccccagccaaguguggugguucacgcugguaaucccaacacuuugggaggcugaggcaggaggaucgcuuugaggccaggaguuugagaagagccuaggcaacauagcgagaccccagcucuauaaaauaauuuuaaaaauuagccaggcacagugacaugagacuguagucccaguuacuuggaaaacugacacaggaggaucacuggaguccaggaguucaaaguuacagugaacuacgauuacaccacugcacuccagccugggcaacacagcgaaaccccaucucaaucaaucaaucuccaccgccaucugugugcugguuaauggcauccuugcaacacaggguuuaacacgaaaauucugcaugagacaacaugcaauuguuuucaguauaaucacucaaaaaguaucaaugaaugguuuuagauuccuguguuucaacagaggguggagcacagaaggcaugggguguuuggagauagccagaagccaaaggcaggaggcaaagggcagugaaaucaccacuacugagugauguacaggguacaggccagcaccuuacuuuauacagauuaccucagugaagccucacaacaaccuuauggacgaggugaaaggagccaacuggggacaacucugauccuuauaacccccaaaucuuagaaaaacgaggcuguccagugagaguccaacuauaaaaccaacagggcauguuagagacacagccuccuuaaggaggcuuaaagaugguugggcacaguggcucacaccuauaaucccagcacuuugggaggccgaggcaggcggauccccugaggucaggagauggagaccagccugaccaauauggugaaaccccaucucuacuaaaaugacaaaaauuagcugcaccuguagucccagcuacuccagaggcugagguaggauaauggcuugaaccugggagguggagguugcagugagccaagacugcaccacugcacuccagcauggaagacagagugagaguccgucucaaaaaaaaaaagagagaguaagauaaggccaggaacaguggcucacgccuguaaucccaacacuuugggaggccaaggcaggaggauugcuugagcccaggaguucgagaccagccuggccaacauggugaaaccccgucucuacuaaaaauacaacaauuagcugggcaugguggcgugcgccuguaaucccaguuacuugggaggcugaggcaggagaauugcuugagccugggagguggagguugcagugagccgagauugcgccacugcacuucagcccaggcgacagaccaaaacuccaucucaaaaaaaaacaucaguaagacacaccugaagaccagcaauuccacugcuagguauacagccaagagaaguaaaaacguguccacacaaaaauauguacacaaauguucauaguacuacuacucauaauagccagaaaguagaaccaucaaugucuaaugaaugaaugaaauaaaaugugguauauccauacaaagaacuauuauuuggcaguuauaaagaaugaaguacugauacauacuacagcuuaaaagaacuugaaaaauuaugcucagugaaagaagccagugauuuuuaaaaaaggccacauaccauaggauuccauuuauaugacaugucuaaaauacgcaaaguuauagagacagaaaauagaugagugguugccacagucuaaaggaagcaggaaaugggcagugaugcuaauggguauaggauuucauuuugggguaagaaaaauguucuggaauuagacaguggugaaugacuuugugaacauacuaaaaaccacugaauuacacacuuuaaaaaaguaaauuuuacgauaacgcaaauuaugucucuuuuuuuuuaaucuaccuuuauuuuuauuauuauuuuuugagauggagucucacucugucgcccaggcuagagugcaauggcacucacaauggaucucagcuauaggugccugucaccauguccagcuaauuuuuguauuuuuaguagagacgggguuucaccguguuggccaggcuggucucaaacuccugaccucaggugaucugccagcuuuggccucccaaagugcugggauuacaggugugagccaccaugccuggccagaucuaccuuuagacaauaacguaucuaaacacuguccauuagaaggggagacuagucagcaccagaagcuuagaaaggaaggaaaaaacaaaaacgacacugucuggggagaagcuucaguaacagggggacuaagaacccugagcucagauucauugaaaggcuucucagaauggcauuagcacuacagaauuaaucccaggcugcuggcaaagugaacagaguccccugaauuuggguaauauaguagcccuaagaucucuugucagucaaaaucucacgagcaccaagcaaaucccauggagcucuucuuccaguauccuccccugauccaauaucauuuauuucucauuguaaauuauuaagcugccuuucaggccuuuuuaagcccagucaaggcagcuccuaugucaagaaaugaccugcuuccauauuuuuggacaacagaggauauggggaaagacuaggauggccaaccauccugguuuuccuagggcuuuccaggcuauagcacucaaaguccuacaacccagaaaaccacuuggucccaggcgacccaggaugcuugaucaccccagaaaagacccugaacuugguaacaauacuaagauaaugcugcccuaacaaagcagauaauguguagagugacugaugcaaaccgauucccaccaucuucuccuuugccuucuaaccaaagagacugggaagcuacuuucuugacaucccagacuaccugccacuagugaugguuguacggcucagcucaagccaaugaaauauaagcagaagccuuggggagucccucauuuccugaauaaaaaggaagacguuuccgcuguuacccuuggcacuuucccucuuuccccugugggaauagagagauggugccuagauaugaagcagcuauuuugugagaaugagaugagcaagugagcacaaggaaggcuucuaugcuaaagauggugaagcagaaagacccugagccacacaguuuggccagacaccacucaccauaacccaaacaugcacccugguucauaccucugaucccuguagcuuguuacuucucuacauaaaaugucuucccuacuuucuggauggacucugacuucaaaucucaaucuagaaguuaccucccucugcaaagccuuccccagccaaaacaaaugucuuuuuuuuuuuuuuuuuuuugagauggagucuugcucugucacccagacuggagugcagcggcaccaucuuggcucacugcaaccuccaccucccggguucaagugauucuccugccucagccucccgaguagcugggauuacaggcacaugcuaccauacccggcuaauuuuuuguauuuuaguagagacaggguuucacuguguugcccaggcuggucuagaacuccugagcuuuaggggucauuuguucaccccaaacccagucagcccgcaacauuagcauuaguuguaugguuaguuacuaaugcacccacuauagucucccuggcugaccacgcuguacuauaccuacaaaaaguacucuguaaaugaaugaguaugaaauauuucauaagucacugacugaacaagucaaccccuuuccucuuugaguuucuuaagggaacaaauaguaucucacucacuguugcaucccuaacaggcaaaucugagaugcccaauacauguuugcuaaacacaaaccaucacagcuccucauaaaaaugucuccauugagcugugauuuaaugccaucccuuucugugggcugagaaaugccuacuuggacagggguuuagcaucauucagggagacugcauuucaauauauauauuucuuauuuguuuaaaauguuucuuuuuauacaaccagcaugcuuuuuuuuuuucuuuuacaaucugguauuucccuuuaguggggaggaugaagcagaaugggagggaagauugccaauguuauuacucuuugaugauaacauaggauuagaacccaaacauaaauuacuccuaaauucagagagaaaaaauaaaaacaaaaaaauuaucuuucuucaaacuucuaugcuucuuuauuugacaauaagaauuuuauaaaccaacaucuuguucuuuucuccuuagcauccaggauguuuagaacuaaauuauucauucuagacauaggguuuaucugauauuucaucuuaauuauuuuugaugcuuugaaaaaaagauuaaccuauuaaacauauuuuaacaaacuaagcaauguaaaaucauuuuuuugauccaggcauaguauaaccaacauccucaacagcugaaauuaagcagucacuuucugcagcaucaaaacugcaauaaagggagucucugagccuacucugguucagaagcugccuacaaaacaauaaaauauuuuuuaaaacugcaguaaagccuugaaaaaaaguaugcaucucccaaauuuuggcaaaaucagccccccuuuuccuaaauuauuuugauacauuuuaacaagcuucaacugagauuuuuaaaucacugcauauuuacacaucuuuaaaaguuuucuuggcugggugugguggcucaugccuguaaucccagcacuuugggagacggaggugggcagauuaucugaggucaggaguuugacaccagccuggccaacauggugaaacccugucuccacuaaaaauacaaaaauuagccaggcgugguggcgcaugccuguaaucccagcuacugggaaggcugaggcaggagaaucgcuugaaccggcagguagagguugcagugagccgagauugcaccauugcgcuccagccugagcaacagagcgagacuuuucugagacggaaucugucccugacaagggccaaacaaacaaaaaaaaaguuuucuuuauuuuauuuauuuuauuuuugagauggagucucacucugucacucaggcuggagugcaauggugcgaucugagcucacugcagccucagucucccagguucaagcgauucuccugccucagccucccgaguagcugagacuacacgcaugcgccaccaugcccagcuaauuuuguauuuuuaguagagauggaguuucaccauguuggccaggcuggugucaaacuccugaccucaggugauccgaccaccucggccucccaaagugcugggauuacaggcaugagccaccacacccagccaaaaguuuucuuuuaucaagcauuagacugcccacauuaacauacaaaaccucagcucuucauuauuuuucucccagaaaccuucugacuggcuuaauuuuguccuggaauaaaaggccuacuuaaauugagaaauaauucuguguaacuaugaaagcaguaacuucucaaaauaaaauuuugccuuucuacuuggagaugccuuagaaauaguacuacaaaaagcaacaaccaaaaaaaugaagauuagcuucugaaacaaaucuuugugagaaaaaaaaguaaugccagucacaaagaaagagcacuuauauaaagaaucugccacauuccccacauaggagagaugugcuccuagaaaguugaaaccuauuuuucuacugccauaguuuaaaagccggcagggguggggagugggggaagaaggagggggugauacauuuacaauuucagagcucuucaaauaguaggcaauguugacaugaaguugcaaguguaaauauuuguucccuuccugguuuauaaauuucaugaugauaaaacucuguguauagagccacuaauuaaaaaggaaucuauuugccuuguaggaugcuugagguuguauguuuauucaagaugaauaaaguggugcacacuagaaaggaacaggaauuagaauuuugaacuucauugguuuaacaaguuccuccugggaaugaaaagagacuucauuugucaaaucugagaaggcuuuucagaugauaauuugugugaagaugcagcaguacauacaguaaaaaauuaucuccccugaccuugaaaggaaagaaggaugauaugugaucaagaaacagcaaauuaaauguuugagaaaaaggaagacaggcugggcacaguggcucaugccuguaaucccagcacucugggaggcugaggugggcaggucacuugagcucaggaguucgagaucagccuggccggcauggugaaaccucaucucuacuaaaaauacaaaaauuagccgggugugguggcguacaucuguaaucccagcuacuuggguggcugaggcaggagaaucucgugaacccaagaaguggagguugccaugagccacugcacuccagccugggugacagugcaagacuccaucucaagggaaaaaaaaaaaaaaagaaaaaaaggaagacaauuuuccauuacuuugguuucagggucacuuaacauuaccauuuaaugguaaucuaguaaugagguccccucacuauucaagauugcuuuaaugugcuacacauaagaacuagcuaaacaaaacugauuacuacauuacacauacagaugacagccaggauugcuauuauuuacuuacauacuaaguggaaucuagaccuuaagccugaauagccaccaccaccacaaacaacaagaucuuauuuugcacuaggaauguuuaaagcacucuguguuuauuagcuaauuuaauuuauccaacauuuuguucuugaaaugacuauuauccccaauuuaucuaauacaaaauauuuuuaaacauguaucucacacccauagaauauacaacaccaggaguaaacccuaauguaaacuaugggcuuugggugauaaggcugugcaauuacaaugugucaucagauguaacaaccauucuggugggggagguugauaauggggaaaauugugcauguguagggguagggaguacaugagaaaucucugccccuuccacucaauuuugcuguaaaucuaaaauugcucuucaaaaaaaagucuacuuuuaaacacacaaacacacacacacauacacacacacacacaccccacacacaccacccacacacaaaacauagaucucacacaaagaaguaacuucuaacccugcacacagcaaguacucaauauuugcuaauggcaagacuggaaguacaggaugacuaugaaaucaacuaagaaaggcugggcaugguggcucacgcuuauaaucccagcacuuugggaggccgaggcagguggaucacuugaggucaggaguuugagaccagccuggccaacaugguagaaacccugucucuacuaaaacuacaaaaaauuagcugggugugguggcgcauggcuguaauccuggcuacucgggagacugaggcaggagaaucccuugaacuaggaggcagagguugcagugugccgagauugcgccacugcacuccagccugagcgacagagcaagacucugucucggaaaaagaaaagaaaagaaaagaaaaaucaacuaagaaaacaacuaagaaacugacagacuuacagccuaucagucacugaagaaauaaacaacauaugacaaccuacaguaaccacccaagugaauuugucuuuugcuuucuuauucccauggggacuacaggaccucugugauaacauaaguuccuucuacaaugauccuguaugugccuuuccaauuuuucauaacuucaaguaagaaauacguucacaucaugaccuacuauacacauaugugaauauuaaacuaaaauagaaguuucaugaaacauuacuuacccuuuuacacaaggcaugcuauauuuuuauucuguuucucuuuuuuuuuucuuuaaugcugauaggaacucauuauguugauuucacaaucaauuaaugagagacaauucaguuugaagaacacugauuucaugccuauauuuugguuuucuggguagaguaaaauuucugucugcaccugauaacucuaaaugagucauuucaucucccugagucucaccucaucugugaaauaaauaccuguauuaacuacucauagaguggcugaauugaggaaaagagagagggaauaaaaagaccuuggggagaagauucuauuggaauucagucugcaaccaucagggugcaccaaguggggaacaucuaccucccucucucuccccuaaaaucucuuccaauccaugagcaaguucuguuaaauauguucuucaaaacauauuucagaucuguccucaucucuccauccccacugucaaaaccccagucuaugccuccauccucacaaaggccuccucccaggcuugcccuccucuacccuugcuccucuauagcuccccuggccacacagcagccucggugaccuuuaaaaaguuuuauuuuauuuauuuauuuauuuauuuauuuauuuugcugcugcucagacuaaagugcaguggcaugaucauagcucacugcagccuuguauuccugggcucaagcgauccuccugccucagccuccugagcagcuggaaccacaggcacaugccaucacaucuggcuuuuuuuuuuuuucauuuuuuguagagaugggaucucucuauguugcccaggcuggucuccaauuccuggccucaagcgauacuuccaccucagccucccaaagcacugaaauuauagccgugagccaccaugccugggcaaaaaaguuuuauuuugaaaaaauuucaaaccuauagaaaaguugcaggaauaauucaauaaacacccauaugcccuuuaaaacuggccacuuuugcuuuaucucucuuuugugaaucauuugagaauaaguuguaaagaccaugaucauucaccccgcuuaagaacaaggucauucucuucauuuccauaauguauuaucagacuuaggacacuuaacauugauauaagaguaucaucuaacagucaguacauauuccaaauuugccaguuuuccccaauacuguccuuuacaguaaguuuucuuccuccaaccuaggaccauuuaguuuucaugucucucgaugacuuuaaaacauaaacuaagacagguacaguggcucaugccuguaaccccaacacuuuggaagaccaaagugggaggaucacuugaacccaggaguucacccagccugggcaacauagcagaacccccucucuacaaaaaaaaaaaaaauuaauuagccaggagugguggcacaagacuguagucccagcuacucaggagccugaggugggaggaucgcuugagcuuaggaguucaaaaucagccuggguaacauagugagacccugucacuacaaaaaaacuuuaaaacuuugccagccauggugguacacaacuguagucccaccuacucgggaggcugagguggaaggaucacuugagccuuggaggcagagguugcgcugagccgagaucgugucacugcacuccagccugggugacagagugagacucugucuaaagaaaaagaaacuuacagaaucucaggguugaaagagaccuuuauuuaggucauguagcugagcccacgcuacugcagaauccucacaaguugucaugcaaccucuauaccagcugcugcaaggaugggagcccaugugccuagaagccgcuucucuugucuccagguucugugaguauguaauacuugcauauuuugagcugcucucugucuggguucaaacagggcugagcaagugugagaagggaacuacugaguaucuagucugugccagacacaaugccgggcauuucccuuagguuacuguuaguaaaggauaauuuauuguugcucucguaugugccauaauucacuucuaucucacaccuauccaggagccuguuuuccuuugauuuuuaaaggaccugcugcucacugucuuucuugaagcauccuguccucucaggugggcugaagaguagguuguuauccuuauuaaacauaugaggaaauugaggucuagagagaguuaggacaccacacaugggagccagucuucugacuccagcuccaggcuuucuuguauacuguucugggcguuccuguuugagcugaggaugucuguguuucuagcaccugaaacuuccuuguucuggcaugcuaaaccauauuguucuuacucaucuugguauaccucacaaugcuccccuuagagugaguguugcagccuauucuuaaauuucuuguagagacagaguaucucuauauugcucaggcugcuuucaaacuccugggcucaagcaauccuccugucuuagccucccuaagugcugggauuauaggcauuagccaccaugcccagcuuguaauuauuuuuuaaauugaaucaaacaugucuuaaguacucauaaaccauaugagggcuaggcaugguggcucacgccuguaaucccaacacuuugggaagccaaggcagguggaucacuugaggucaggaguucgagaccagucuggccaacauggugaaaccccaucucuacuaaaaauacaaaaaucagccggguaugacggugugugccuguaaucccaguuacuugggagguugaggcaggagaaucacuuggacccagaaggcagggcuugcagugagcugagauggcaccauagcacuccagccugggugacagaguaagacuccauaucaaaaaaaaaaaaaaaaaaaaaaaaaggccaggcuugguggcucacaccugucaucccagcacuuugggaggcugaggcaggcagguggaucacgugaggucaggaguuugagaccagcccggccaacaugguggaaccccgucucuacuaaaaacacacaaaaaaauuaguugggcguggugcugggcaccuguaaucccagcuacuugggaggcugaggcaggagaauuacuugaacccgggaggcagagguugcagugagccgagaucgugccauagcacuccagccugggugacagaguaagacuccauaucaaaaaaaaaaacaaaaaaacgccaggcaugguggcucacaucugucaucccagcaauuugggaggccgaggcaggcagaucaccugaggugaggaguuugaggccagccugaccaacauggaaaaccccgucucuacuaaaaauacaaaauuagcugggcgugguggcgcaugccuguaaucccagcuacucaggaggcugaggcaggagaaucgccugaacccaggaggcggaggcugcaaugagccaagauccaccauugcacuccagccuggacagcaagagcaaaacucugucucaaaaagaaaaaaaaacucuuucaauagacaauuuauauuuaaacaagcaaaaugaaaaugaaaagaucaaaugcauuuauuugaaauuagucaguaugugacugggagacuuguuggucauuauuaaauaaagacauccuuguugcugcucauccuagauuaagauguggaacagcccaaguuaagaagcuacccaacucuaaagugcaaaccaaggucugccaucuugacaaucugcccuugggcccuucaauauaggucucauggucucauauuugguuuuucgugggguuuuuugucuuuugagacagagucuuguucugucucccaggcuggaaugcaguggugugaucauggcucacugcagacucaacagacucaaccucccaggcucaagugauugauccuccugccucagcacccccaagucgcugggacuacaggggcaugccaucacaccugucuaauuuuuguauuuuuguagagguggggucucgcuaaguugcccaagcuguucucaaacucccggacucaacugauccuccugccucagccucccaaauugcugugauuauaggcaugagccacugcacccagccaggucucauguuugaaaucucuguauguuaucucagacacaggaucagaaaauauaugucaugugucuccugaucaccacagaugcccuucaaaaaccuucuaaguuuggugaaaaucuguccaacuguuucugacagaugagguaacagauaaacagaagcuuaaucuuaguuaauaaauaacugcuugcauccauacagcagaaauaaggucccugucuucaugaagcuuuuccauuuagaggggacaacuuaaguuacaaaauagccagacaaauaaauacauaauuagacuauaauaaaggcuaauaagaaaaagcauaugguccuuuguucgaauuauaaaagggaccucguugagauugggaaauucaaagaggugggaaaagucuuuuuaaagaacaacauuuaaagccaggcgugguggcucacgccuguaaucucagcacuuugggaggcccaggcaggcagauugcuugaggccaggaguucgagaccagccuggccaacauggcgaaacccuguaucuacuaaaaauacaaaaauuagccaggcauggccaaucccagcuacaagggaggcugaagcaggagaaucaccugaacucaggagacagagguugcacugaggggagaucgcaccgcugcacuccagucugggugggcaacagagugagacuccaucucaaaaacaaaaaagaacauuuaaaaagaaaauauguauaaaauaacacuauguuuaaaaaaaaaacugcauagcuguauauaugcuuugauuauaguugugugaaaggacacgcgcauaaacaaaucuggaaggaaauaagcaaaaacaaaacgguuguauuaagguggcaagagucuaaacaguguuucacccuucaaaauuuuucuuuaauguuguuacauuauuuuuaccauuaauaagacaaguauagacauagaaucugaagcccuaacagagaacuugagcauuuucaguuuaaucuuaagcuucauuguaaaacugugguucagaacaaggcugauuuucauuaaaacagcagcagggcagaagggagcaugagccugagagucugaaggcccuggacuccaauauggcccagccauuaacuaucugcaugauaccagacaagugaaugaacaucccugggaggcugcuguaucaucucuaacauggagcuaacaagaccugccucauaaaguuguggugaggacaaaaugaaagagcauauauaaacggcgacacccagcacagaauaugugcuuaauaaauacugguagacauuaugauaguuacuaggauauaaaugcaaaugaaacagugagcucugaaucgaaaggcucuagggcccaacaggugacuaaacuggagaaauuaaacaguuccucaucaaucacuguuaaaugauuucucucugacaauaagcaaaucaacuaguggcuaaagucacuuucucugagguuaccuauauugcaccuucaguaaaaccaaaaggaucagcucaagauaaaaaucucugagaagagaaaugagccauacaauuucagcaauuuacuaaaaacaauuaagaaccucuuuauuuaaaaugaagccuccugaaagaguuucuagaaacugaaauggaagccauauagaaaaaauauggcagauuuauuccaguuauuugggaagcugaagcaggaggauugcuugagcucaggaguucaagacgagccugggcaagacagggacaccgucucuuaaaauauaauaaacaaacaaaaaacugaucuuaaaacaacccuacaaaccaaaaguuaugcagcuaguauuugucaagaugauguuauuaagcaugcaugauaaaaaagaaugcuuuuuaguuucuagauauuuguaaaaauaaacuuuaaaaacucuaccacguaucuucaaacauaagaccaugccauaaaaguagaauguuucugacaccaaauauuaugaaaguguauuuucuucaacuuaaagcacuagguuaaaaaauucuuauucggccauuccauaaaccuuugcuucaaucauuuaguuaauugagcaaaaaguaaaaauauuuuugcucauucacuuccaucagaacagaaaacagugucaaaaggggaagaaggcuuucaauauugcuuuguugaauaccuggauuagacugaccacccuuuaagauaguuuuuguguacuucaaaacccaaaccaagccacauggagcagcugcucacugaccaacuggucugcagaauucaaugaaugacaaaagguuaccuuaauucaauaagauaaucagcauacauucacccaccacccagagucuaaccaucugcaaggcggcagagccaaaugccucuaaaacaacuggcagugugcagacauguccucgugucccucaugucaaugaaauuucucucuuagcaacagcuaaaaagaagcugaacuuucagaaaaucucaagauaucaugauccaacaacuuguuaguaaguuauuuugagugccacugagauuuccaggccagauggguaauauguuuuauucaauugagucuuguacugggauaacaaaaugugagacagacacgaucuggauccuuucauuguucaagaggcaaaauguccuagugccuuccaaauaacagcaggaacaauguagcaagaaaaaaagaaggaaagaaaaaauauauauagcaaaaacccacuacaagagcaacuucagaguaagaaaucaauaauaauuaauuuuuuaaagaucucaauuggcuuuauuaugcuucgagagucaggcaacacugcauaucauaaaauagaauaaguauaccccaauaauaauuuagacugcaauaucugacaucugcccuaagccaggacaucacgcagcuaaccaugcagcuagcucuaguuaucgagacuaccaaauaauaauaaugaugaugauaaaccaacauacaagguuuaaaaaagacauaaugggcacuauaaacaguauuuaauauaaaaauuuacuuucauucuaacacauuacacugaaaucaccugauacaguauuuccccaagugugggauucuaucacuagugguacucaagaugccuugaggugagacuugagauguuaugaggugagcugaaucacacagaaugagaaacuuguucccuuuucaauuuucuuucauaccuucccauuaagucaagaagaaagucucauuuuggugcuaauauuguguuuaacgccucuaaugcuuguuaaucuucuuuugagagagcaggccucaggcucagagccuuggcagacaacaauauccagcugaaacuuuuuaaaauaauaacuuuuacaguuaucuucuauuuauggcaaggaaugcuuguuuuccacuuacaauaaugauauagacuccuuuuuuuuaguaaaucuacuaagauaaagaaaaugaggcaauuuaauuuuaaguaaauauucuaauuacauuuauuuuuccaaguuuacacuuugaaaaacuuucagcccuacagaaaaguugaaguagcauaaugaacacugguaugcccuucaccuagauucaacaauuagggguccuaucuuuugccucauaucuuuaucuauaucugucuauauucacacauauauuuauacauacauauuuuaguaugauuuuugcugaaccauuugaaaguaagcugcaaacaucaagacacuucaccauuaaauacuuccgaaggcaucucccaacucauaaagacauccuagauaaucaaaaugccauuaucauauugaagaacaauaacauuaaugccauuaaguucccuuaauauguaauccaaauucaaauguauccaauuaucccccaaauaaguaauuuuuuaauauugucaucccuuguuauacaugagggaucaguuccaagaccucagacuauaacaaaauccacacauacucaaguccugcagcuggcccugaagaacccacagagacaaaaaaucagcccucuguaugugugcauuuugcauccaugaauacuguauuagauuugguugaaaaaaaucagcacguaaguugaccagcgcagcacaaaccuguguuguucaagggucaacuguacuguuuuccaugcacggcauuugguuauuaugccucuuuagugcgguaaugugaaagcaaguauuaagaaaauaauacaggggcugggugcaguggcucaugccuguaaacccagcacuugugggaggccaaggcacgaggaucacuuaaggucagcaguucaagaccagccugggcaacacagugaaacucccucucuacuaaaaauauaaaaauuagccaggcgugguggugcacgccuguaaucucagcuacuugggagacugagccaggagaaucgcuugagccugggagguggagauuacaguaagcugagauugugccacugcacuccagccugggugacagaguaagacuccaucucaaaaaaaaaaaaaagauaaaauaauuaauacagauuguauaaaacugguaaaaauugugauugaggcacacuuugguuugggaaacucugagcuuuuggcuugaaggcaguagagaggaagcaauccaaauaauuaauucaaaaaagaaagaaaaacucugcuauuaaacuaaacucauauuuacagcauacaaagcuaugaaggaaaacauguaagacucuccuuuucuucuguaagacccugaaaaaggacugagcaaaucaaaagaccacugucaaacuauacaguaauaugccaaaaugcucuucauuaaaaauuccaaagcugauacauguucaaaauaacuagcucauuuuuguuauugaauaggcacuguguuaggccaccuaaaugcauaauuucauuaaauucuaauuaacaacccuaugaagaauauauaauccuucccauuuuacagauaagguaagugagacucagggaguuugugugacacuuucuuucugcuauuagaacuuuuucaagaagaauguacucauauaugucuuauauaucuaaaaacuuuucaaaagaaaaaauaccaaaguccgaucccaauuucuguuacaagaaauacauaaacguagguauaauauuagcuuacaagugcuuuaaaaagcccuguaagaauacauacaaaccaccaaguguggcugccuuuggaaagcuguuuucagagaagaacacacagggccaaugagguaaaacuuuuacucuuuacuuuauauacaguuggaccucuguauguguggagucaacuaaccucaauucaaaacaccugggguagucgaggguugggguggugcccaugccuauaaucccagcuacucaggaggcugagggggaagaaucacuugaacccaggaggcggaaguugcagugagcugaaaucacacuacugcacaccagccugggcaacagagaaagacccugucuccaaauauauaaauaaaauaccugaggggaaaaaaguggaugguugcgucuuuacagaacauauacaggcuuuuuuauacagacuugaggucaggaguucgagaccagccuggccaacauggugaaaccccgucucuacuaaaaaacacaaaauuagccgggcguaguggagcacgccuguaaucccagcuauucaggaggcugaggcaggagaaucgccugaaccugggagauggagcguugcagugagccgagaucgcgccacugcacuccaaccuaggcgacagugagacuccaucucaaaaaaauacaaaaaauacaaaaauuagcugggcaugguggugugcaccuguaguccuagcuacuuuggaggcugaggcaagagaaucacuugaacccaggagguggagguugcagugggcugagaucgcgccacugcacuccagccuggcugaaagagagagacccugucucaaaaaaacaacaacaaaaaauuuugauggcucaagugugaauaauauuuacaaacucauaaaaauauaagcacugaauacauauacuuaccuacauaaaaguaguguauauugagauaagaggggcaaagggaaagagaaaaguguauguguaugagggaccuuuauccuuaucuacacucgcaagaagucaacagauaaugucuacaauuuaaaaauaagaaacaacagcguaagaauauuacagaccuccaacuucccuaagaagccagacuaaaugugguugaaagaguugaagaugcuuaucugcagggcauaggaauaaggauggggaaauaaccacaacacuguuauuuagcaauggccauuaaucauuuuaaaauguccaagucauuaguaaucaaagaaaugcaaaguaacuccuaaggauccauucuucccucuacuacauuaacaugacaaaagguaagcauuaagaaucaauuagaugcccacacucccuuauacucugcccauaaguauaaauugguacuaucuuuuuggaacaguuuuugauaauaugcuuccaaagcuuuagaaaaagaauucauagucaugccucaguauuaccuccuuuaguaaucuauucuaugggaaauaauuauccacacaugcacaaauuuuuaguagcgguauuauuuguaauagcagaagauuuaggagcaccuuaaauuuugaaggauaaagacauaaauacuaugcagcuauuuagucagcuucaaagaauaaucaagaauaugggaaaaggcucacaacagauuuuaaauuuagaaaggaagauacaaaauuauauagcucacacagucuucuuuuuauuuaaauauagcauacauauuuacauguaggaaaaaaggaaaaaagacuggaagaaaauacacacuuucaacaguaguuaucuuuauagucaaauuugcagugauaauguaucaucuccaaaucuuucuguuuuucaaagucuguacaaggagcauguguuacucugaaaauaauagacuccuuuucugauuacuuaaauaacaugaggugggguggaaggagccacaaagagaaacggauucuagccauucuuggcguaagagagcaagaggagaggaggucuucguuagaagguaaugaggacaucgguuuacagcuuuuccuucccaaacaguauggcagaguggagugcugggggcugccgucccuccacugccuuggagucuguucagcugaccuuucuguugaggcugaggacaagcucaccaccucuguagcucaggcagcgacuaucccaguguggucagugcuauauuaucaucccuauuagucagcugaggaaaacuugggauuugaaccuaagcauucuagcuccagagccacuuccccacaagacuccuucagaacgaucucuaaaaucucuuuuagcaggaagcagagcccugaccaauuaacaucucuagauugcuuccucagccacauaaguagauccuacuuguucaucuauuaaagaagaaagcaugugaugcaugcuggcaucacaaggaaacuucaaaaaguucuaaugccugacucccacuccaacauuuuuauuuaagcagcauggaggugugaucugggcaucuaacguuuaaaagcuccuccaguaauucuaaugugcagcaaaguuugggaaccacuggccuaggucaaaugaccugcugaaggagaggaggggcaagaagcuccagaaaaauacucuuuuugcauauaauuucagaggucuacaaaccccagaaaaaagggcuccuugaaccuuagccuuaaaacccuggacuuggugaucucaaagaucuccugcaacucuaaaguuuuauacuacauuuaaagaauuacauaaauauuacuaaaucaauacauuaauagagacaaggggugaauuugaugauuuuugguuuucuauucugaaggacaaacuccaaguuuaauuaaucaaugguuucccuugggauguguauuuagaagaaauaagcaaaggaauuagcacuauaaccuuacaucagcacuauccaaacugcuuaaccaaaugcaaagauuucuagacaagugaauggcugcuaugaagacaaagaggagagaggcccaucgucaaaucaucuuggguuaggcaagguaaauuuuagaacuacucagguacuguaaaucucagacuauuauuagcaucauuaauuucuuguagaguacuuccuucuuccucagaacaucauuugggaaaagcuacuuuaaugauaucauauuauaaauuuuaacaaucuucucagugacgucuauuauaaacaguaaaaaggcacuuaaaggcucauguuuauaagaaccuaauaugaaacuauuuucaauaccuucucauuaaaagaaguuuucuucaucaggaaaaugagagguaauguaguauaaugguuacauguacagaucaaggagcuuggaugccugggucuaaauccuggcuccagcucuaccacauuaauagcuagguaaucuugggcaaguccuuucaccugacaugccucagcuucuuccuuuguaaacgaagaaugaauaguccuaccuuacaaacagguuauacacaaagcacuugaaguagugccugccucauaguaaagcauuuuauaaauguugguuguuauuauucauucuuaaaauuucaauugcucuaaaagugaugaucacuccaaugaucguuugaaaaggaauaacagcuguauguauuagcauguuucuuuuuuuuuaccuuugagacagagucucgcucugucacccaagcuggaaugcaguggugugaucucugcucacugcaccuucggccuccggcauucaagugauucuccugccucagccuccugaggaguugggauuacaggugugugucaccacacccggcuaauguuuuuuuuuuuuuugagacggagguucacucuuguugcccaggauggagugcaauggcacgaucucagcucccgcaaccuccaccucccggguucaagugauucucccgccucagccucccgaguagcugggauuacaggcaugugccaccacgcccggcuaauuuugcauuuuuaguagagacgggguuucuccauguuggucaggcuggucucgaacuccugaccucaggugauccacucgccucagccucccaaagugcuaggauuacaggugugagccacugcgccuggcccagcuaauuuuuguauuuuugguacagaugggguuuugucauguuucccaggcuggucucgaacuccuggccucaagugauccuccugccuuggccucccaaagugcugggguuacaggcgugagccaccaugccuagccucaacugaucacuuuuauuaccauuuagauaugugguaacuuccauauuaugugccuaauacaguguuuuauauauugcaagaauucacuagguauguguugauuucgcccgaagaaaugagaggcagaaggugauaaagugacuacacuacacucugccugugcaccaggauugaaacaccagcuccaauacuuccuguguacucuugggcaagucaccuuauuuggccuguuucuucaucuguaaaauucaguuaauaacaguacuuaucuuucagaguucaugcaaaauuauauuguauauauuaaaugcuuaauauacacaauaagcacuaaguauuuaauauuaauaucuuuuugcauguuuuuuguacagccuucaaaucuaguauuaacugcuuauaaugcacauuucacaaggcacaaauacacguuuuaacuaugcuuguuugcuuuugcuaugugucacauacuaaauggggaaccuaaguggucagagacacaaaucauggauuucaggagagagaaggcacuuuccacaagauacaugucaaaauaaaaaacaaccuacaaaccagcauggcacauguauauauauguaacaaacuugcacuugugcacauguucccuagaacuuaaaguauaauaaaaauaaauaaaaauaaaaaauaaaaaacaacugaaaaaguguucucaaugcuagcucuuuauuucauucugcuauaaaauuuuuagaagcgagaaaaauacauacaauuuacaccugaucaauguucuccaaacugccugcaggcuuguguucauacacuagcaagauuuacugcuaaccaacaugccaugcuaaauugaaaucaagauauuacacaauuuuccaacaaaggggugauuuuauaagcuaguauacaugcuccaugaggauguaauuguuggcaucuuguuacauuucuguagcugguggaaaaugaguuaaguuagaagguuuauagagggucagagcucaucagaugaaaaaaucaucuuuuuuaucagcucuagaaaacauauuuauuaagcuaacuaguuauucuucaacaacuggauuagucagaauuuccaaaaccuuccaacuaacugcagaagacugcugaaacauugugaaaugaaauaaaaugaagaauucuagaggcucguuaccucaaguucauguuuauuuuucugaauuuuuacuaaaaacuaaaagaauauaauauacauccaucugcaugucauuuuucuuuuuuaaauaaaugaguuucuuuuucagccuauuuagacuucucugauugaggguucuaauuuaaauuauagauauaugcugggcacaguggcucacgccuauaaucccagcacuuugggaggcugagguggcuggaucucuugaggccagggguucaaaaccagccugaucaacacagugaaaccccaucucuacuaaaaaaaaaauacaaaauuagcugggcaugguagcaggcaccuguaauuccagcuacucaggaggcugaggcaugagaauugcuugaaccugggagguggaggcuguagugagccaagaucgugccacugcacuccagccugagcaacagagcaagacguugucuaaauaaauaaauaaaagacauaaaauucuucagauguuacuuagucuuugaaauaucaucaaaggcagggcacacuggcuuaugccuauaaucccagcacucugggaggccaagguggguagaucacuugagaucaggaguuccagagauggagucuugcucuguugcccaggcuggaguauaguggcacaauauuggcucaccgcaaucuccaccuccaagguucaagcgauucuccugccucagccuccugaguagcugggacuacaggcgugagccaccaugcccagcuaauuuuuacauuuuuaguagagaugggguuucgccauguugcccaggcuggucucgaacucuggaccucaagugauccaugcaccucggccucccaaaaugcugggauuacaggcaugagccaaagagccuaucuugauaaaucaccuuguauuuuucaugcacccugugggcauuuaaaugaaagacccuucucuacaacuuuaaauguacuucucaaaaaucauuuugggccaggcauagcggcucucacuuguaaucccagaacuuugggaggccaagguggguagauugcuugagccaaggaguucgagaccagcccgggcaaaauggcaaaacccaugccuaucaaauauacaaaaauuagcugggcaugguggcacacgccccuguaguuccaggacccugaggugggaggagugcuugagccuaggaggucaaggcugcagugagccaugaucacaccgcugcauuccagccugggcaacaaagugagacccugucucaaaaaaaaaaaaaaaaaaauugcccauccaaacuucuauuguuaaaaacucugaagcuauuagugccaaauccauucuucaguucuucaacuagugaguaaagggacaugaaguggaggcaagagugcacgcccccguuccugcucuccuggaaaugacucaggauguaccaugagacucaaaacucaggccucuugacccccggccuucagcuagcauuacucccauaaacugugauuaauuccuuucugguuauuuuuuccuuuuuuuuuuuaauuaagaaauagaguccugcucagucgcccaggcuagagugcaguggcacgaucauagcucacuuacagccucaaacuucuggacucaggcaauccucccaccucagccucccaaguaguuaggacuacaguucugugccaucacacuuggauaauuuuuaaaaauuuuuucuagagaugggaucucacuauguuguccaggcugaucucaaacuccuggccucaagugauccaccugccuuggccucccaaagcauugggauuauagaugugagcuaccugcaccuggcccucuuuccuuucuaaacagacuugaucaugguucaccauagcccaaaaccuucaaugauuugcaacccccaaugcaaaauuugauuuaggugacaauacuaaacccuguguggcaggcaaaauaaugggcucccccaaaaaugucuacuuccuaaugcccagaaccuuaccuggcaaaauaaccuugcagauaugauaaaguuaaggacugugagauaagggcauuaucuggauuauccaaaugggcucaaucuaauaauaugcauccuuuaaaagcugaaaaacuguccaggcugugguaagaggcagaugugacugugaaagaacagucagagagaugcaacauugcuggcuuugaagauggaggaagggaucaugagucaaggaauaugcgcagccucuagaagcucaaaaaagcaagggaaaagauucucuccuagagccuccagaaaagaacauuaccuugcccucaccuucauuuuaaccuaagaaacccauguuggacuucugaccuaccgaacuguaagacaauacauuuguguuguguuaaaccauuaaguugcuguaauuuguuacagcagcaauagaaaacuaauacacacugggugaaagguuacucacaugcuuucaaaguaucauugcacagauuacuuguuaauuacaaaagggaaaaggcgccuuuauaaacgaagaucuagcagaugccaccuuaaccaacugauaaacuaagcaccaccaguaaugagacaagcugaaauuauuuaucuccugguaucucacaagaagaaauauacaacaucccccauacaguauuuuuucuuuucuuuuuucuuuuugagacagagucucacucugucacccaggcuggagcgcaguggugugaccuuggcuuacugcaaccuccaucuccuggauucaagcaauccuucuaccucagucucccaaguagcugggacuacaggcacaugccaccacgcccagcugauuuuuuuguauuuucuguagaaacgggguuucaccauguuucccaggcuggucucaaacuucugagcucaaucaguccacccaucuuagccucccaaagugcugggauuauaggugugagccaccacucccagacccccacacgcuauucuugucaaaaauguuuacucugaaucuaaucaugaggauacagucagacaaauacuaauugugggacauccuacaagacaacuacccuagacucuucaaaaaugucaaugucuucagaagcaaaaaggagggaaaacuguucucuauuaaaggugacaugacagccaaaugcaauauaugaucuuugguuggauccuggaugaaaagucaaaaguuggccaggcgcaguggcucacaccuuuaaucccagcacuuugggaggccuaggcggguagaucaccugaugucaggaguucaagaccagccuggccaaccuggcgaaaccccaucacuacuaaaaauaaaaaaaguuagccgggcaugguggcacgcaccuguagucccagcugcucgggaggcugaggcaagagaauugcuugaaccugggagguggagguugcagugagcuaagaucauaccacugcaccccagccugggcaacagagcgagacuccaucucaaaaaaagucaaaaguuauaaaugagauuuuggggccauuuggggaaauauggacugucaguuaacacucauuccacugccgaauuuuuugcguaauaguauaguauauaagagaacauuuuugauauauuauuaaguauuuaggggugaaauauaauauuuguaauuuaguuuccaacaguuuagucaaaauugugaauauauaaaugugcuguauauauacgcacacccauguauaaaaacauauacauauacacacauauaggaagagaaagaauguggcaaaauguuaaaauuggugaaucuaugugaaagaaauagaguguuuacuguacuacucuuuuaauauuuaugaaauacucuaauuuuauaaauuauaaagguuaggagagaaguauuuuccuagcucccuccaugccugccuuucccaggucugcucacacacugccaggagucuaccuggaacagcugauguucuucaaacagccaauacucuuccacuagcagauccuguuuucugcugcuuuacucacaacucaaggcucaacagcuaaagcuggguuuuguuauaagacagaaguguuuacaauacuaauuuugaaaacaaguuggucaaauaucaaaugggagucaucuuuuaauggccuuauuacuagauuuuaauauguucuuauguuucucuuucccaagauaauguuuaugaucuguuucuuaaacuucaucauacccauaggguggcaagcaugacagggaaaccuuggacaaaaagcagggcuggucacaucagaaacuacuaacagaaacagucaagcucugccucuggcucucagcccaugucacucugaacacccuaggcagcccagaccaaggcucaccuccuuccugcaggccucacugcucuccauauggcagcucacugacaucaaagaagacggaagaaauuaucuaaauucaccaggcuaguuccacuccuucccuugaauuguggaagagucgcugauaucucaauuaccucuccugcaauaguaccuuuuucccugcaugcuaagauuuugcaaugcuaaaaagcagggugagaaguguauacuggacuaacagauggaagauuaacaacaaaagaccgacuugaugggggagacaaaacuacaauguuuguauaccuauaauaaaaauacugaggaagaaaaauugaacuuguaaguaaaguuagguugcucuucuguaacgccugucgagcuacagacaggaaaaggcccagcaugguuucuguguacgccuaugcuguuucuaauagaaaggacaaaauagagccaaaacaucuguugaccaguuaaguuuguuaaugaaaccaaauugcagcugguuuaucacagaucaaaagugaggcaaauuagagaaaggauguaugaacaaagcugguuucuaaaaaauaguggcuaaagaauucuaaacccacuugucaaauuaacaaaaauccuuccuggauuuugcuuagaccagugauuaguauuuacuuuguaucuuugcagagaccagccucauaguuuaaaucuaguaucauucacucuaaaauguugucuauauugcucauuuugcagauuuaucaaaauaucaccuuucauuaaaaaaaaacagaaaaaacauacacucuacauaauauuacacuaauuaaaagauucacuuauauaaggaaaaagaauauguaguuugcaacuguuggagacuucucugguaaagugcuucugccccaagcagaggcauauguacaguuagcauuucacauauccacugccacaacuccuucucuuacauguacaacuuuccaucaccaccugaagacagagagauaagcacacccacucacaaaaacauacuucccucuuggcccugcuaacucaaaaugucacaugcaaauuacauggcugacgcauuugcuaacuuuaauuuggugagcuaauugauguuuauguacucagaaacauuaauagauuggagagaucaaaguaccugagaagauucagguucauauuuuaaaugcuagugugaucagagaacaguuucaccuaaucuacuguaguuuaaggcacagggccaagaaaaggaaguuuauaaacaaaacaaaaagucaagaauuuuacaauuaaaacacauugcuacugucaugauaaaacaaugggcugggcgugguggggcaugccucuaaucccagcacuuugggaggccgaggugggcagaucacaaggucaggaguucgagaccagccuggccaauauggugaaacccccgucucuacuaaaaauacaaaaaaauuagccaggagugguggcacaugccuguaaucccagcuacucgggaggccaagacaggagaauugcuuuaaccugggaggcggagguugcagugagccgagaccaugccacuacacuccagccugggcaagacagcaagacuccaucucaaauuaaaaaaaaaaaaaaaaaaaaggcauuucuuauauauuaaaaauaaaaggcugagcacgguggcucacgccuauaaccccaguacuuugggaggccgaggugugugaacugcuugagcucaggcguucaagaccagccugggcaacguggcgaaacccuaucucuacaaaaaauacaaaaauuagcuggguguaguggugugugccuguaguccaagcuacuuggggggcugaggugggaggauggaucauuugagccugggaaggucaaggcugcagugaaccaugauuacacggcugcacuccagccugggcaacagaguaagacugucucaaaaaaaagaaaaaaaaaaauuagccagacaagguggugcacaccuguagucccaguuacucaggaggcugaggugggaggaucaaggaucacuugagcccgggaggucgaggcugcagugagccaugaucaaaccacugcacuccagccuggguaacagagugagacccugucucagaaaaaaaaaaaaaaaaaaaaagaugaaagaaauaacauacaaagauaaaacauauaaaaagaauauagaccuucauuuuugagaaacauuaaaacguacauuuguuaaauaauguuugaagagaaaggaugaauaaaauauuugucauuuaagacaaaaucagaauaaaccagcaaauaguacuuaacuguuaaauaacuucaaagcuacagaauauagauuuucuuagcacugaaaguaucacaaauguagcugggaauacaagaguaacuccugaaagcugcugaucauucaggacaggaucauguguuacauacaguaaagguaucacaacuaucaaaucuaucuaagauccaaagaguuaaaagaauguuuaacauucauuugaacaaccaaaaauccucuugacauaauguuucuacuuuaccugaagcccauuucauuagaagucuagacaagucccaucuugauaaaagcucaaaaguggaacacgcugucaugccucagaguacaauagaaagacucauucacccuucauuuuaucuuucccuugacccaacuaacuaguuugagacaauucaugugcucucucaacaaugucucaacaacugguacuaccugcucacaaaagcaguccucagacacugcuauugugaagaacuucugaagcuuaauuauaagaagaacaugaacugcaauuuuuuuccuuccaugacccuggaacagcaaguauuugauccaccucgucuuucacauuacaauagguuucugucugacuuuagugauucuaaaacugacuuuauccauaccaauuccaaaaugcagguuauuuugaagagcauauuuuacaauauuuagagauuuauucgauuuucaguuaaauacacauaaucaagcacucuucaagaaagaugacaucugcaacacaaaggauaccaauucaaaggaaaacuaagaaggucaacagagaggaggacauucaggcucuauaauuagcagauaaaaaauauacacauuucugccaaaaaagauccagaguugccugagacuaugaacaauuccccuagggcugagagacuucuggaagccugccacaucaaagaacaauauggacuaaugaauaguccuucauaaaguacaggcuauuggaaaagucccagaacagaugaggagggucugcucuagggcaggguuaaggggacugaagaggagaaaacagaauggagaaaacagaagaaaagaaaaucuaaaaauaaacuuaucuaauucauguguguaaacaacucaagcaacugcuguaggauguacauuuaucuucuauuuguagaaauauuucauauuaauaacagugccaaaaacccuaacaacguaucucucuaaaaggggcaggagaaauagaauaaacaacugaauaagccaagaccacacauaacaaggguccuacguuugucuuucaaccccauuucugaucaucugaacuccuuuuaaaaaucauuuuguggccagacacaguggcucaugccuguaaucccagcacuuugggaggccgaggcagguggaucacuaggucaagagauugagaccauccuggccaauauggugaaaccccguuucuacuaaaaauacaaaaauuagcugggcgugguggugcacgucuguagucuagcuacuccagaggcugaggcaggagaauugcuugaaccagggaggcggagguuguagugagccgagaucgcgccacugcacuccagccuggcaacauagcaagacuccaucuccaaaaaaaaaaaaaaaaaaucauucuuaucagccugaccaacauggugaaacccugucucuacuaaaaauacaaaaauuagccgggcaugguggcacaugccuguaauccccaacuacucaggaggcugaggcaggagaaucgcuugaacccgagaggcggcagcugcagugagccgagauugcgccacugcacuccggccugggcaacagagcaagacucuguauccaaaaaaaaaaaaaucauuuugauuuuuuucuuauugacaguaucacuguuuuuguaauuuuguuuauguuugaaggcuuuuuguaagauucuaauacaaauauuucuucaacagaaaaaacaucagaagcccuacuugauacugaaagugucccaccuuccaauuacgaugccaaccuagaaugagaauucccacauuauguacuacacuggaaacagaccaagacuugacacuuaauaaauuuuaugaagacauucucacuaaagugaaauacuauggaauuuauuuuaaauggaacuaaacugauuuuauaaaaaugcuaaagcucaaauguucaaauggaaucuuaaugcuacaaagugcgcagugauaauggaagucucucuuagaauaugugacuuuccaaaguccucauaaucugaccuaauugagcuuuacuacuuuuaaugagaaacauuaauacuauccuuuaggaguucccucaccaagucaaagauaaaguuuuaucuucagugguuuaauucauuuccauaucaccucaccgaagagagcuuucuuaaauaaauacaaagaauuuaugcuaagaagccagugugguaauacccaauuugaauuccagacuaucagaagaugugcaauuacauuucagaaaggaaggagcccuucuauuuuaacuugcauuguauuccuccuagcagucaugcaucggaaugaugaugauguucaaucuaauuagacacagacuuacuacuuucucuacugccuuuccauauugcuaauauuauaaauaguaucuacuuuaaaaacuauaauaagcucauugcaucuaccaaauuuaaaaugcuggaaaucuauuuguuggggcaaaacugcuucuaaucauuugaagaacuggaagagauacuuuuacuguuaauaaaaagccaccacaggccgaggcagguggaucacgaggucaggagauugagaccauccuggcuaacacggugaaaccccgucucuacuaaaaauacaaaaaauuagccgggcgugguggugggcgccuguagucccagcuacucaggaggcugaggcaggagaauggcgugaacccggaaggcggagcuugcagugaggcgagaucaugccacugcacuccagccugggcgacagagcgagacucugucucaaaaaaaaaaaaaaagccaccacuguugaccaguguacugcccagugguaaagagcucugaggucagacugucucgucagaaucuuggcuucaccacucacuagcucuaucagugaccuugggcaaaucacuuaagcuuucagccucauuuuuucaucuguaaaauaaggguaauaaucuaccucccuugcaguuauugugacaagucaaggagauaauaaauguaaagcacuuggaauagugccagcauuuaacacuuacaaaacguuaguuauuauucuuacuauuuuuauuuuguuuuacauuuaauguaacugcucaaaaaaguaaccagaauaaacagcuucuugaaagucauggccaggcacgguggcucacaagccuguaauccuaccuagcacuuugagaugccaaggcaggcggaucacuugagaucacgaguucgagaccagccuggucaacauggugaaacccugucucuacuaaaaauacuaaaauuagccgggcuugguggugcgugccuguaaucccagcuacuugggaggcugaugcaggagaaucacuugaacugggaggcggagguugcagugagcugagauggcaccagcguacuccagucuggaugacagagugagauuccaucucaaaaaaaaaaaagucauuaguuaggccaggcauggggcauaguagcucacgucuauaaucccagcauuuugggaggccaaggcaggcggaucacuugaggccaggaguucaaggccagccuggccaacauuaaugaaaccccaucucuacuaaaauacaaaaauuagcccagugugguggcacacaccuguaaucccagcuacucgggaggcugaggcacaagaauuguuugaaccugggaugcugagguugcagggagccaagaucaugccacugcacuccagacugggugacacagugacacucugucucaaaaaaaaggcauuaguugacuagauuguaauugagaucacuccauuucugaacuguuuucacuuauaucauaaauuuccucccacaaugcaaggcaaauccuaugacuucaagcacaucaagaacaaugauaaucuuuucaaauauauuagaaaaagucuuauauauaggaaauuauaguacaaucaaucuacauaugaauccaaguucagcagccaaaggaagaaucaucauaggucgacaauuagcauacuaugauuuaguauaagaaacucaaacuauuuuaaaauggcuacuaggcauuuugggugccuuugacaaaagauguagaccaggaguguccaaucuuuuggcuucccugggccacacuggaagaagaauugucuagggccacauauaaaauacacuaacaauagcuagugagcuuaaaaaaaaaaaaauuaaaaaccacaaaaaaauguuguuguuguuguuguuguucuuguuguuguuguugaaacgaaguguugcucugucgcccaggcuggagugcagugccucaaucucagcuaacugcaaccuccgccucccagguucaaacaauucuugugccucagccuccugaguagcugggauuauaggcgugugccaccacgccgcaagccaaaaaucucuuuauguuuuaagaaaguuuacgaauuuguguugggcugcauucaaagccauucagggccgcaucuagcccaugggccauggguuggacaagcuugcuauagacccuagccauagaaaaacauguggaggccaggcacagaggcucaugccuauaaucccagcacuuugggaggcugagguggguggaucaccugaggucaggaguucaagaccagccuggccaacauggugaaaccccgucucuacugaaaaugcaaaaauuagccaggcaugguggcgcacgccuguaaucccagcuacuagggaggcugaggcagaagagucacuugaaccugggagacagagguugcagugggccaugauugugccauuguacuccagccugggugacaagagugaaacuaugucucaaaaaaaaaaaaaaagaaaaagaaaaagaaaaaaaaagaaaaacauggauacacacacaugacuucacacucuauuucagaggauuugugggauacccacccaaguucauuuguggaucccgggcuaagaauuucuauuaaauuuacuuagcgaguuuacaugguuuuaaacuauuaaaucacuuuuaauuucaaaggguaauauauuauguuguaauuuucucacauuuuuuaaggaaaaaugcuauuuuauuuauuuauuuuuuuuuuugagauggaguuucgcuuuuguugcccaggcuggaaugcaauggcgcaaucucggcucacugcaaucucugccucccaaguucaagcaauucuccugccucagccuccccagcagcugggauuacaggcaugcaccaccaugcccggcuacuuuuguauuuuuuuaauagagacgagguuucuccauguuggucaggcuggucuugaacugcugaccucaggugauccacccaccucggccucccaaagugcugggauuacaggcaugagccacugcacccagcuggaaaaaaaugcuauuucauuaaagaauacaaacauguugccaacuuuguuuaaacugauuuuuauuuauuuuuguuuuuuaagaaucaaaugauuacuuaauagaauuagucuccaaauuucaucaaguaaaaauucuagaaaacauuucucagcuuuccucauuauagcaugaugcuaacuaaacaauuuaaagaucagcaucauaaaaagagcaguaacaauugccugcuaagcaauaaauuacucugcucucaauccuagacacuuucagacaugaauuuuccuuuagacuaaaaauacuucuguacagaugcugccugaaaaaaauaugauaagguuggcaagaaaugacgggcaagguuaaagcgaaggaucagaagauacuguggaaaauuuguacugacucuuccaucacaaguaaaaaguauccccuggaucacaaaauuauugaaacauacuauuaaauugccuaaagcuaccugaauuaguccacguaccuguucauuauaaaaccuuaacauaccuuaggguaguguacauauuuuuaaaaacaaagauauccaaauccaucaagaaauggcucuauagucccuuaaggaauuucuucacaguauaagcuuuuauaaaaaauauuuaauuaaggcugggcacaguggcucacgccuguaaucccagcauuuugggaggcuaaggcagguggaccaugaggucaggagauugaggccauccuggccaacauggugaaaccccgucucuacuaaaauacaaaaaauuggccaggcaugguggcacgcuccuguagucccagcuacucgggaaguuaaggcaaggaaaucacuugaaccugggaggcagaggcugcagugagccaagaucaugccacuguacuccagccuggugacagagcaagacuccaucucaaaaaaaacaaaaaaacaaaacaaaaauauauauauacauauguauuuaauuaaaaacagaggucccugauuuggcugugucagacauaugaauuaggauuuaaguggcuuuuuguauuuucuuuuaaacaaauguuauuaagaagaaaauuucauaacuuuacuucuuucuuuaugcccacauucugccacagagaacuagagguugguuacacaaacacaacaaccaccuaaggaucaaauaaauguggcagaagacuaacaaaauaaaaauauaguuaacaaauaaauguuggccaggcacaguggcucaugccuauaaucccagcaccuugggaggccgaggcggaaggaugucuugagcccaggagaucgagaccagccugggcaacaucgagaaaccucaucuuuacaaaaaguacaaaaauuagccgggcgugguggugugcaccuguagucccagcugcucggguggcugaggugagagcaucacuugaacccgggagguggagguugcagugagccgaggugacaccacugcacuccagccuuuuagaucagcccauggaaaggcaaaccaccugguccuauccaauuuguaggaccaggugguuugccuuuccaugggcugaucugaucuaaagcauugaggaaaacagguuccauuucaaggguucaugguauccaaacaagaggagcauaacuuuuccuaacaugcauguuucaauuguuucuaaacuguacuuagcccaggcaacauggcaaaaccccaucucuacaaaaaauuuaaaaacuuagcugggcaugguggcauacaccuguauucccaguuacuugggaggaacacuugaucccaaaaggucaaggcugcaguaaaccaugaauaaaaccaccauuucuuuccuucuuuuuuuuuuuguuuuuuuuuuuuuuuuugagacagagucucgcucugucacccaggcuggagugcaguggcacaaucucagcucacugcaacgucugccucccggguuuaagggauucuccugccucagccucccaaauagcugggacuacaggugccccccaccacgccugccuaauuuuuuuguauauuuaguagagaugggguuucaccauguuggccaggcuggucucaaacucaggcaauuggcccaccucagccucccaaagugcugggauuacaggcaugagccacugugccuggccaaaaccaccuuuucuuucuuccuuucuuuaucuuugggacaggaucucacucuaucacccaggcuggaguacaaucaaggcucacugcagccucuaccucccaugcucaagugauccucccaccucagccucccaaguagcugggacuacacaugugcuucaccaagccuggcuaauucuuugauuuuuuuguagagacaggggucuuacuauguugcccaggcuagucuugaacuccugggcucaagugauccucccacccuggccucccaaggugcugggacuacaggcaggagccacccugcccagccaaaaccaccuuucuaucaacaaugauuaauguuuuauaacauguauuaauaaaauuaacugauaucaauauaucugcucacccaaaagacagagaauaaaccccaaaacuagacaugaacuauaaauaacuuucugcugcucuacuuuguguuuaguuugggaaguaaauacuguagcuuugaaacaaagacaaaucuuacucaaccaaaaacuuaaagugguagcaguaauguaaggagaauucugccauauauuuauaaauacuauagaaauaacauaaggcccaagaaaucagaguauuuuaaaaagauacuguaugagacaaaauaaacauucaccuacaacacagagaaguggacaauaaaaaaugacuuuuuauugaaaugagggauuuaggugacguauuaaaauaacuucuuacaugcauagauuaucagccaggcauggugucucacgccuguaaucccaacacuuugggagaccaaagcggguggaucaccugaagucaggaguucgagacuagcccggccaacauggugaaaccuggucucuacuaaaaauacaaaaauuagcugggcaugguggcaugugccuguaaucccagcuacuagguaggcugaggcagaagaaucacuugaacccgggaggcagagguugcagugagccgagauugugccacugcacuccagccugggcaacaagagcaaaacuccaucucaaaaaaaaaagcauagauuaucaccauuaaaauaagaagucuagcugggcaugguggcucacgccucuaaucccagcgcuuugggaggccgaggcgggcgcaucacuugaggucaggagcuugagaccagccuggccaagauggugaaguccugucucuauuaaaaauacaaaaauuagccaggugugguagcaggugccuguaaucccagcuacuugggaggcugaggcaggagaaucgcuuaaaccugggaggcagagguugcagugagucaagacugcgccacugcacuccagccuaggcgacagagcuagauucugucucaaaaaaauaauaauaguaaaauaagaagucuguagauucuucuuugaaaauaguaauaaagagaaaaauauacgauggccuuuucguagauuucugaaauauauaugacccugccuggaugaagaaagaucaauauuauccuuccuggucccuucagacaccaaccaguuagcaauuagagcuuaaaaacaaaccacaugacucuuccauuaaauucuuggccaaccagugaggaaguccuccacacaaugcaguacaauauauacauuuuaaaauacaaaagccugcucuaaggcaaaacauucaauuuuaucaaacuuuauucagaacuuuuguccacauaaaacuuaagugaaaccguaaaagacaaaaggacaguagugagaaugcacgaacauuacuccuucgcuuaccuggucuuucucaugggguagaaggcugacaggugggagcgaggaugggaaugcacugggauacugaggugccccuuugccaucuaagcucccauaauugacccuguacugcgguccgucuuucaguaaccucccauuauucacagcgcguuuggcccccagucgcagccgcugcugaaaggcuggguuguugguggugcuugugagaucacuuugacuucugagauacuucucuauguucuucagggaggagccauucggcuccucaaguccuucaauugcucuccuuaaaaguuuauuccaauccacauugcggagaucauuacaugauccucuagaccccuuggcugacuuaggaaaagugccugguuuaacugaugaaaagcgcccaggguugucuggguccuuauaggaggcaaggccuuuguuggugacuuugagaacugagccauccugaacacugaguuccagcuguucagagacugucuucuuauccaacccaugggaaguacugaccgcauggcagauucucucuucagagggccuuugcuuuugcuuuuuuauuuucuguauagcuucaagaauccacucuguauaaaguggguuugcaaguuuuaccaugguugacaaaugacuucuucaacacaaaaguuacccauagagguucucuuuguauuuaacagaacuugcacauuugaaagucauuuacaauucaacaaauggacagaguauuccagacuguauuaagcaacaucuuacaaacauccauccuuaagagauucaaaagcagacaaacaggcaauguugaugguugucuuauuuuaccaacaggaaagacugcauucgggugaagaacaucuuuaacugggaaaucaagaccuuaaaggauaaaaagaggggaaagucucuuaauaaugaagcuuacacaaauaaacuaaaagauucuuuagcaugacuuuuucagacacagaaugaccacaagaaguaaugacaggcagguauuacauaacacagccacagugacuauauuuuucaacaagaaauugggucacagucugagaagaaauuguuuuuagaauguuucacuucucuauaugaagucauuuaugaggcauaaucacaucuaaauuauacauuuaauuauauuuauugaaauuaacaaaauuauaugaaagugguuugagguauaugucugccauaaacauaaaauacacaucaaagaauaagucuaugauauaaaaaaucugaugaaaguacauuaaacuuauuucaaaaaaucuuaaacuuaaaaaaaagaguaaauaauccagcuuucagcuagguauuguauuucccaagucucauacguaaaaaaacuucccaucuagcuacuucuauggaaucacauccccaucccuuuaacagaggucuaugauacccucuaacccacaaauuggaaaacugaaaauaauacaguaacauaacccuucaccuuuaaguaguagagcauucuaguuaucuuaauacccaguuagcucauuaaacagcucaguacaaagaagauauauacaaaucugauuccagguggacaguggcauuuguucugagagaugcuugguauauacaaaaaccacccuagaucuccaaucugguauugaguacaucuacaaagaggcuacaaggagaaagagccuuggccugggaauugggccaaaccugagcucuaaucuugguguccaaugauaacauccacuucuuaauucuuuuuauaguuuaaacuguacagagugugcucacauauaacuugucacuuaaacugcagaacuuuguggguaaacugaggcucgggagaagauggaauucacccaagggaagagucaauaacagauuaaagggucgaacaucauuaauuuuuuuuauuaauuuuuuuuuuuugagauagagucucgcucugucacccaggcuggagugcaauagcgcaaucucagcucacuguaaucucugccuucuggguucaagcgauucuccugcacagccucccaaguggcugggauuacaggaaugugccaccacacccagcuaauguuuguauuuuuaguagagauggaguuuugccauuuuggccaggcuggucucaaacuccugaccucagcccaccucggccucucaaaagugcuaggauuauagguguaagccacugugcccagccaauucuaaaauccaacuaaguccaucacuguucucaccugagccacaacugccugcucuagcuaguucugccucugcaaagagaccaaccugggucugaaccccagcccuaccacaauguccaguggaggaacccuggauaacuuaagcuuccaucacuuuacuuguaggcaauacugguauaucccuuacaggacuacugagaggauuaaauaaacacauuaucuaauauucaauauauaguuaucacuuucaucaaaugcaacaucuauauacuuugaaauuuuuauaacaaaauacaaaauuaaaguuaucucugguuauuuauuuagacagacuauaccuaagagaagaaaauaauaucuuuccuuaaaaacuuuagccagacauacugaagaauauaguauuugcucucagagauccuggaauguugcugaaaaacagcugggucauugaacuauacuuguucaaacaguacaguuuuaaaugccaacccaaaaugccaccuuaaaggaggcaauuuaaacaagauugucccugugaucaguaagcuguaaauucacucuacucauucuccccucagauucagaaacuuggggcugaaggucauccaguccaaccucuaguuauccaauaaaagaucccugcccaauaucccaaauagaugggcaaugagucuuuacauuuuuaaaauacuuccagugauugauaauuugucacuuuuugaggcagcucaccccacuguugcacagcucuagcuaaauuucuugcucagagaagcaaaaaucugccaccccauaacuucgacccuauuccuauuccuaacuaguccuauucccuggaaggaucccaagacaauucuuaguauuucuucaguaugagaggccuucaaauguccaaaaacaaguaccuuuugaaaaccacuaacgacaaaaccccaugcuaccuccagccauaacuuagaccacucauaucccaguuucuuaacccuuccacauaucacauuguuucaaagcaccacuuucucuugguugcucacuaguuuggcuauuggccaucuuaaaauaugacaguucaggcauuauccaauuauaaaugcaacccaaauuacaggaacuuccucaauaccccugccacacaaguggucauggugagcaugcaguccaacuaaaaaucccagaucuuuuuucaaaaagugcugucaaguugagucuuuccaccccuuuccuucugcaaauugaaaugcugcaauuuaacguuuauuaccguucaauuucaucucguugauuuaagccuaucuuccaaccugcuaaagauuguuuugaaucuugauucugucaucuaugucaucuacaaaucuaauaaguacucacuuuuguuucauuauauaaacccuugacaaaaauguuagacuuggaacacaguguguuuaggaaugaaaucacuggcuuucacagugcaaccacuuucaggauagaacacagaaucauucucugucaguuaguuuagaacaggaaauugaucuuucccaaguaaaaugguuucgggcaaaauuucauuagaagauauuucacuguauccaaguaauuauuuaaucuuucaucauuuauucaggaugaaucacaacuaauuuaauuugauugcacaaaauacaacugcagaaaguagaagaggucacaggaaaagugcccaauauugccaaguugcuuuuagguguuuuguuacacaagcaaacgaacguacauuaaaacaaaaugcauagccgggcgugguggcucacacccguaaucccagcacuuugggaggccaaggcggguggaucacccaaggucaggaguucaagaccagccuggccaacauggugaaaccccgucucuacuaaaaauacaaaaaauuagccaagcaugguggcaugcgccuguaaucccagcuacucaggaggcuaaggcaggagaaucgcuugaacccaggaggcagagguugcagugagucgagauugcgccauuguacuccagccucggcaacaagagcgaaacuccaucucaaaaaaaaaaaaaaaauguguuucauaacuaauagauaccuaaaauauaccuucaugacaagcuuuuaccacaaucauuuuuuuuuuuuuggggggcacagagucuugcucuugucgcccaggcuggagugcaauggcaugaucucggcucacugcaaucuccaccgcccagauucaagcaauucuccugccucagccucccaaguagcugggauuacaggugcccaccaccacgcccagcuaauuuuugaauuuuuaguagagacaggguuuugccauguuggccaggcuggacucaaacuccugaucucgugauccgcccacuucggccucccaaagugcugggauuacaggcgugagccacugcacccagcccacaaaucuuuacccacaaucauuuauauccauaaaacaauuguuuauauccauuaccaacacauuucaauaagauugucauuuuauaccuuaaaaauguaauaaaauaagggaaaguaccagaauuggaacuucaaacguuuuaacaguccaugacaaaaauggagauuauccaggucuucaggcaaaucugccaaaagaaaaaaggaaauguucauuuggacauaaggacauccuuaaauucagcaaccauccguguaucuccacaaccauucaagacaaacagcuccaaugaguuauuauacuacauuuggugauauaauaauucuuuuagaccacugaaggauucuuauaaauaugaaacuugagacagaaaaugaagccccaaggacccagccaagugccuauagaaguaaauuucaucccuaagcccagaccuguucaaauuuuaaaaaucagguuugugauagauuccuaagaaaaaaucucaucauggaaaaacaaaacaaaaacaaaaacccacuacuacucaaauagccaaacagauauaacauuuaucagaaaaaaagacagucaaaaguuguuuuaaggucagcauucacauuccugggcagcauucgcuguuugucccaaaggccaccaggcaccuagguacugaauggacuacccagauaugaccaauaagcucaccuacaagaaaaacguaccaguuuacauaauaguaaauauguauugacacaagucacauuuuaggacagcagugauuauuuuuacuugaaaagcaaaaaauaaauuuaaaagaacaauugugaauaacugcauuuugaucuuacguaaaacaaucaagcaaccuuggauccuccuucuccccucccccagccacgacacacaccccacuccucgauuuaaucucaaaauuagcucucaucugacaccaaccaacagaguuaauuaggcagaagcagauguaacucagcagcucuuugcuacaagcagaaucacaguguucaaaaaaaaaaaaaaaauacacagcuaggagaggaacaaaaucagaagucucuuaucuguagccaauucucaacuaaacacauguauauuauccacuuuguauauuauccaccgcaaauuuuuuaaucuuaggcugauuuguuuccaacaucccacuggccccacuguaaauucauauaagcaagagaauagauugaaaaccaauuucauuuuagccuaagcaguaucuaacuggaaagacaaauccacaggaaaaaaaaaugcauaauucauucaaaagccaaauagaaaugauuuuuuuuuuccugauuuggaauuauccacacuauuucucuuuuucagagcauggggauuugcuucacauguagauaggacauucuaucacaagcgaaaacccuaaaaucauuauucucuuuucauuuuuuuucuauaaaaacuugaagguuggacuaaaaggcuaucaaaaagguagcaaaucauccuaaauuaauucuggggauuugugcuacaucaaauuaaauuauucuauuuucuaagguugugaaucauuuuauuuuuaacuacaaaauaucaguaaauuauaugguuguaucauacggucuuauaauauaacacuauuuacaucauucauuacaaauauucuaaacauaucuagagaaaugcuuaguccagcacugagcuuuuagcuucacugguauuacauaaacaucaacacuauucagaaauauucaugucagcauaagaagagucaaaauauccuggaucauaaguauuaugcgaggccuccucuaagcuuuuacuaaagcuguguguguuguuucaaaaucaaugucauaacacucaagucaugagauuauggaugaggcaaaaaacagugguagaaaaaaacaaagauuaauaauagaguuuacacuuuugucauccugaguuuuacuugcuaacaguuauuuuuaacuauuuuacuuucauaaguccuggcuuuuucuuucuuuuuuuuccccaaagggaucacuguuggaaaaccuggauuuuuucaaagcccauuguguaacugagugagcauccacaaaucuaagcaguaucuuccgaaacagaacagaacuguuuaggggaagggaccuugacuuauuuuucuucuaucagcacccagcucagguuauuggcagaguugcucaaaauaguguccuugguuaacaaauaucuguugucugacaacaugaaacgccauccauauggugauauuucuuaucuuucaaauccuggaugcaucuauuuccucugaaaucaaugcuucaggcccaaaacaugugaacugggaggugagguuauaaauacuaaucaaagaaaaaccaacaaauauuuagcgagcugaugcucccugcaugcagcccugugguagguacuauggggaauacaaagcaaagcuagagacagaacauauaagaagcaauuaagaaauagcaaagcacuguuuggcgguuccucaaaaaguuaaacacagaauuaccauaugguucuguaauuccauuucuagguauagacucaaaagaauugagaacagauacucaaauaaguacacguacacccauguucauaacaaaacuauucacaguagccaaaagguguaaacagcccaaauguccaucaacagaugaacagauaaacugugguauauccauacacuagaauacuauacaacuauaaaaagcaaugaaguuucgauacaugcuacuacaauguagauggaccucaaacacguuaugcugugaaagaagccagacacaaaaggccacacaucauauaauuucauucauaugagacauccagaauagauaaauccauagacaaaacacagauugguggagucucagggacauaucuagagaaacugcuuaauggguaagggguuuuauuugggaucaauaaaaauguuuuggaacuugauaguggcaguggugacacaacacugaauguacuaaaugccacugauuuguucacuuuuuaaugguuuuuucauuuuauguuaugugaguuucaccucaauaaauuguuuaaaaaaaaagaaauaacaaagcacuaaacuauaauaauaauaauaauaccaaccauuuccugacaccuacugugguccagguacuuuacauagauuaucaguaaacuuuaaaacaacucuguaagguagcauuguuguuuuuacaaaaggaaaacaggcuugacuuagccaagaucucagagccauuaagucaugaaggauuuuaauucagaugccaaagcccaaacucuuucugucucuccagagguuuucaaacuaggcucuuuagaucucugugacaaggaguuacuucggguauuaccuucagguaccccuuguggguuaaacuuugggccauugcagcaccuugaacccaacagugcagcuccacuuuaacuguuuuacauauauuugucuuccccauaagauucgcuuuaaaggaaguguuccucugauuacagaaggaagaagucuggaaacaacugugacuauacuaccuugcugaaaccacguggaggauggaugaacaucucuuggauggaugggacugaaacugaaccuugaaagauaaugcugagccuggauaagugccccaccgucccucugcccaaauucaaauccuucauggcccagugcaaacaacuucucaaaagccccaaacaucuuugucuaacaggaagcuuuuagcuuuuuuacuguuuugacauucauuucccacuuaguauuaugcuuacuuguguauuaaccuugucaccccuacuagacuauaaaauucuuaaaaacaggauucaugcuugauucaucuuuguauacccuaagauuucccaagaccacaacuugaucauaagaggguuucaaugccuauuugcuaaauaaauguaucggggaaugaaugaaggaaaucaaagugaaauaacagaagcuaagaaugagcugucaaacaaaagggacaccaaguccaugugccugacuagaacagguauaugcucaaaagggauaaagaaauuaaguugggccaggcacaauggcucaugccucuaaucccagcacuuugggaggucaaggaaggaggauuacuugaggccaggagcucgagacaagccuaggcaacacaacaagacccuaccucuacaaaaauaaaaaauuagguggcuguggugguguacaccuguagacccagcuacucgggagaccgaggcaagaggaucucuugagccgcccaggagguugaggccacagugggcuaugauugugccacugcucuccagccuaggcaauagagcaagacucugucucuaaaaaagacaaauauaauuuaaaaaugaaaaacagaaauaggccaggcacaguggcucacaccuguaauccuagcacuuugggaggccaaggcgggcagaucacgaggucaggagauugagaccauccuggccaacauggugaaacuccaucucuacuaaaauacaaaaaauuagccaggcgugguggugcaugccuguggucccagcuacucggaaggcugaggcaggggaauugcuugaaccccggaggugguggaugcagugagccgagaucgcgccacugcacuccagccuggcaacagagccagaauccaucucaaaaaaaaaaaaaacagaaauaaaguuggcugugaaaaaagccaagcuguggugugugaacgugacagaugaauaggaagccacugcaggagcaggugacaccauaaugcacagggaagggcaugcacauacacacacaaaccuguugaauguuugaaucacucuggcaauaguagccaucuacucuggagggaagggugauugaaagaaaaaacaaaagcaaccaguauuucaucucugcaaacaucaaucuuguucaacuuauauuuaugagccuaacucagcagcaagcccagagcaggcacucaauaaaacgcugguugaacugaauauuuaauuccccaucuuuuuagaguaacacuaaguucuuucccacuacucauuaacaaagagaguuuucaauucauaagcuaauaauguuuuccaaggauuucuaagaggcuaaaucaccauaaaaauuaucauuucaacuaauacauauuauauuaauugcaaguuuaauuuuucaugucaugcucuccuaguugacaauauccuuguuaugucauuaaacuauaauuguguaaaugugcuucaacaaacaauaacugaaccaucaauaaacuauuaugguuuccauaaucccuagcaaagauuaguuucaacaucaucaucauaaauuaguagagacaggucccaaaucuccuggugaaacccaugaauuagguuugcauaguuaucccugcauuuaagugcucaauaguuucagucucuaaaauuuaaucacacuguuaggaaccucacaggaaauuugaucccuuguaaaacagaggaauuuagagacaagaugaaaagucauuugaagucaucaggucuuuggagccaggguacacugauuaguaaugauguauuauaacuaagcacuuucacuuaagaaauaaucaacuaaauuuagagugucuuuuuuuggcauuuaaaaauuccuauucaauccuagauuucucccuaauuacaaauuagcuuuaguugguuuuugaugacaaagaccgagaauaauguauuaagggaaaaaaugugauuuuuuuuuuuuuuuuuuuuuuuuugagacagagucuugcccuguugcccaggcuggagugcaauggcgugaucucggcucacugcaaccuccgccucccggguucaaacgacucuccugccccagccuucugaguagcugggauuacaggcacaugccaccaugccauuguuuguuuguuguuguuguuuuuauuuuuaguagagacgggguuuuaccauguuggccaggcuggucucgagcuccugaccuugugauccagcugccugagccucccaaagugcugggauuacaggcaugagccaucaugcccggccaaaaaaugugauuuuuaaaaaacuuuuuaaaauagagauacaaggccaggcuugguggcuuaugccuauaaucccagcacuucgacaggccaaggcagguggaucaccugaggucaggaguuugagaccagcccggccaacauggugaaaccccaucucuacuaaauacaaaaaauuagcaggcgugguggcgcaugccuguaaucccagcucuuugggaggcugaggcaggaaaauugcuugaacccaggagguggagguugcagugagccaagauuacgccauugcacuccagccugggcaacaagagcaaaacucuaucucaacaaaauaaauaagauaaaaugaagauaccaaaaaaucuaaauaaauaaauaaaaauagaggcgggggucucccuauguugcccaggcaugucuugaacuccagggcucaagggauccuuucacuguagccucccaaaguagugggauuacaggcaugagccacugcaccuggcugagaaaaaucugacaucuuaacuuuuuuaugauucuuuugaaagagagauuauuacaggauucuuuguuaacuguauuacagaugucuucagaccagauauccagauacccugaaaaauucagguucccuuuugagaguuucauaaauauuauagcucuacucuaaaaaauaagcacauguacccauauacacugguauacauuuuuaaggguuaacagaccuucugucauccagccauggaccacuuaagguccacuggcuauauacagagagguauuuuauccaguuucacaauaguuagcuuugugugcuuuacuuaaggcauguuacaucaagaguaagaaaguuauucuuuuugguuuuggauguuaucaaaaaacagguuucugacauuuuaaucaacaaguaggugugcugugaugggaaguaucagagucagggauccaguccccauucugcuagcuaccuaggcuaggggauauuggacaugcuacuaaaucaaucuaagucucuguuuucucuucuguaaaaaugagaauacuucucuguuuuacagaaccguuaagaggaaucacugagauaacaaauaugaaagcagcaaggaugauggcagacacauagcaggaacacaauaaaaugcuagcucauaaaaggaaaaagggcaauacagucagcuggagaccuguaaaaucuaaucuggcugaacuucugucuauaugaccauuuucuccuaagagacaggagaagucagcaccuggcucuuaguuauagcugcagagaaguaaaaauucaagacagagaacagaaaaaagugaaggaaagcaaaaauagauuguaauggugaggcuggggucaagaagaguguauuuuacucauaguuauacauuguuuaaggucaacaaagcuuuaaaaagauaguacugcauaggagaauaucuuauugaccucaggguaggaaaagucuuaaaacaagacacaaaaggcacuaaccauaaaguaaagaccaauaaauuugacuccauuaaaauuaagaacuucuguucauuaaaagacaccauaaagagagugaaaaggcaagccacaguauuugcaacacacacacaugacaaaggacuuguauucacaguaaauaaagaacuucuaaauagcaauaaaagauacaaggcccaacuuuuaaaagcagggugggaaagacuugaacagaacuuuauaaaugaggcuaucuaaauggcuaaaaaaguauaugaagagcuggccgggugcagaggcucacgccuguaaucccagcacuuugggaggccaagacgggcgggucaacugagaucaggaguuugaaacaagccugcccaacauggcaaaaccccaucucuacuaaaaauacaaaaaauuagcugguugugguagugggcaccuguaaucccagcuacucaggaggcugaggcaggagaaucgcuugaacccaggaagcagagguugcagugagccaagaucacgccacugcacuccagccugggugacaaaagcaaaacuccgucucaaaaaaaaaaaaaaaaaaaaaaaaaaaaaaaaaaaauauauauauauauauauauauauauauauauauauaugaagagcugugcaaucugauuacuaaucagguaaacgcaaaauuuaccauauuggcuaaaaucauaaaagcuaaaaaggcugagauuggagagggcgagaagcaagggaauucauauauugcuggagggaguguaaccugguacaauacuuuagaagaguuugguacuuaguaaagaugaagacaagcauaccuuaugacuaggugaccauacaauucaucaucuaacccuagauacuuuugaaaacuaaaaguguuacaguuacgcugggaaaauaagcaaaaaccaggacaaauggucacccuagcuauaaaccggcaauuucauuccuagguguauaccuuagagaaacuugugcacaugggcaccagaugacagguauaggaaugcucauagcagcuuuguucacaauugccccaaacuugaaacaacucaaauauucggcaacaauggaauagaugauacgaaaauugguguauucucuuucuggggucugcgagaagacagguaucagaagaucaugggaguucuauaaaaagaugcuuaaaggugcuuuggaaaugcaaauuaaggcauuaaagggaagaaauaucccaucaccccacuucucucauccacgcaucauuuaccauucugcaacaaagacugaucacuacagcuuacacaucccuacuuacauaaaauauuuuucuuuuuuuuuuguuuuuuuuuuuuugagacagagucucgcucugucgccaggcuggagugcaguggugcaaucucagcucacugcaaccuccgccucccagguucaagugauucgccugccucaaccuccugagcagcugggacuacaggcgcccgccaccaugcccagcuaauuuuuuguauuuuuaguagagaugggguuucaccauguuggccaggauggucuugauuucuugaccucgugauccauccaccucggccucccaaagugcugggauuacaggcgugagccaccacacccagccacauaaaacuauuuauuuaaucccagcacucugggaggccgaggugaguggaucaccugaggucaggaguuugagaccagccuggccaacauggcgaaaccccaccucuacuaaaaauacaaaaauuagcugggcacaugucuguaauccuagcuacccgggaagcugaggcaggagaaucaccugaauccaggagguggagguugcagugagccgagaucgugccacugcacuccagccugggcaacagagcaagacugucucaaaaaaaaaaaaaaaacuauuuccuuuucucucaguacaaauguaggcauguguaagcacguggaaaacugaggguacacuguagagaacuaggagacugaaagccagaucacuuaguuacgucuuuuacuaauugauacgugaaaguccaugagagcuuaugaagcacauuaaaauuauuaaacuuccucaucuacuuucuaauacucaugcuauuuaccuuucauucaugcuaugccucacaucugacaguuuccacccaaucuucaaaagcagugugugaaauaaacacaugcuauaauagcaaugacauaauauccacucuacucagaagccuaaguguggcuaguaagcaaaacuuccucugccgaccgugucaugaccaucagccauucccuaaauuccucuuuuaauguuaaaaucuuccucugucucucucuuuucuuuucuuuuuuuuuuuuuuuaaaccaucacuucaccacuccaaccuuuaacucucaguagaaguucucggaaaagaaaaaacaugugcauuauccuuuccuucuuaaaaacauaaaauacuguccaaauucauucugauaaauguguaaagaacuuaugaauggccgggcgcgguggcucacgccuguaaucccagcacuuugggaggccgaggcgggcagaucacaaggucaagaguucgagaccauccuggcuaacacggugaaaccccgucucuacuaaauauacaaaaaauuagcggggcgugguggcaggcgccuguagucccagcuacuccggaggcugaggcaggacaauggcgugaacccgggaggcggagcuugcagugagccgagauggcgccacugcacuccagccugggcgacagacugagacuccgucucaaaaaaaaaaaaaaaaaaaaaaagaacuuaugaguaagaaaaaaauggaguguuuuauuucaaggcuaugccaaaaaaucuaggguauacaaguaagacaggaagaaugcacuuuaaaaaaaaaaaaacacaaaaaaccuucuuggggccccauagaacuaagacuguucgaacacaacuaauuuccauuugcuauuuccaccuucuguccauauaggaggggcccucauaugcucuacccugaauuuccuugguaccuccaaccccaaacauacuugguucguuggucuucauuuccuauuucccacaucuguaauucuuuaucacuaccccuucacaacuucugucuaacacucucuuuaacacgucccaacaccuucuaccaauuacagggcuuaaacuccuucauggggcauaggacaccauuuguaaucuaaccccuccucugccuuugccuggucaucuccuaccacucccugcacucugcccacagcaaaguacuagcaaauucaaagcuaugcaaaauguccuaucccaagguauggugcaugucucuuccugggauacccugcugccggacacucccuugaagacuccagaucaaguuuaacauaaugaauccagcguaucacgggucgccauagcucacgucuguaaucccaucagucaggcagaggugggcagaucacuugaggccaggaguucgagaccagccugggcaacauagugagacccuuuucucauuuuuauaaaaaauaauaaauacagccuaucaaacaacuugucucccaaacuaacaccuuucucugccccauccucaccccuggcacaguccaccaaaucacauucaccgaaaauuacuguacagcuccacccacuuucuucacaccugccgccuugucccaccccuaccaaucccuuguccccaggagauuuucugccacagauuuugcaaguucuaagcagccucucuccccuuccuucauauuuaaguuugcucugcugucuuagcaucaucuuucagaaacucucccaagcacaaccaucccauccuuccacguuuuuaaaaaauacuucauaccccaaagcuagcaaaccuccuucuuauuccaacaugcgauccacccagauaccucuuucccaucacugcaaucguaccugcuccucacaugcgccucaaugccuccccaaaccccucaacgccuccccaaacccaacacucugcaccgcuucaacucuacuccacauccaccacacccaaacccaccuacucugcgcccagacaacugcaaucucgccuucgguaucaucucaccugcccucacacaccccucgguccgccuuccacuucucucaaauugcaucccucccuaacucucccucugcaccugcuucuacaccuucagcuucuccucccacccaacccucacuagucuuccucacacccucgccggccccccaccgcuccuaccaguucacucccacucagaaauucccucucagcccccgccuuccgacuccccgaaccccgcccccacccgaucccgccccgccccccuccgcccucgagccccgcccccuugcccuagagcccugccgaggggcggggccugucccuccuccccuuucccccgcccccuaccgucacgcucaggggcagccugaccccgagcggccccgcggugacccucgcgcagaggccugugggaggggcgucgcaagccccugaauccccccccgucuguuccccccucccgcccagucuccucccccugggaacgcgcggggugggugacagaccuggcugcgcgccaccgccaccgcgccugccgggggcgcugccgcugccugagaaacugcggcugccgccuggaggaggugccgucgccuccgccaccgcugccgccgccgccagggguaggagcuaagccgccgccauuuugugucccccuguuguugucguugacaugaauccgacaugacacugauuacagcccaauggagucucauuaaacccgagucgcggucccgccccgccgcugcuccauuggaggagaccaaagacacuuaaggccacccguuggccuacgggucugucugucacccacucacuaaccacucugcagcccauuggggcagguuccugccggucaucucgcuuccacauaaacacaccccucgacccaucaucccccccuccggcaccaccccgggggaggguccacugccaauaccaaucaacagaccgcuggguccgccucuuccgggcaccuauugguccagcccuuuuucucucuccuagauaccgcgccaccucuacuuccaccuacccgcccccuccaccucuaggaaaggauugggucuacucgcagcagaggagcguagccuuauuggcugcagacgacgccaaucaggaggccuuuucccucuccccucccccacucaaccccaaacccccuagcccgcagcuaaaguuugugugagagcugaucgcuggcggcggccgcaggauuuaggggugggcgcgggcgggcgcgcgcgggcgggcacgcgaaguuaaaauucgagguucucagucgccagcuccuucgguggagugugcggacgggcgcgccgcccggagcguuccaucccgcccccuccuccacccucucucccgucccgucccgucccgggcgacuacucgcccgcccccuggcucgcauccuuccccccccaacacaccccuacccugccagccccaggccgggugcaggcagaacgaugucgcugcagccuccucgccaucccaugccucgggggagcaagccccuacccaccgggcgugcaccccccggcuccacacucgcccgugucugcaagcacgugcaccgcucgccgcugccuccggccacccggguccccggcuaaccucgccugcagcccggccaaucgcucgcugcccuuuguugcugcagccugggucuccccgcugccuuccucagccuccgccucguccuuugccagccgcccggguccgcagcgccgcgcuccccccgcccgggacccaccgccgccgccuccuucuccuccuccgccuccuccuccucggcuccgggcugcagcgcacagagcccgaggcagcgccgcccagccccgcuccccccgcgccgcccgccagcccgcccggccuggccgggggcgcagcccggaccccgcccgccccagucuccgccccggggguaccugccuccgccccggggggcuccucucgccgcccucgggggagggcggagacgcugguguccgcgggaggauggggacgccugggccguuuggggcggggagugugcccgccagggcugggacugaggugcgguccucgccaacgcguccccacucccgucgcugugggccccaaacuucguccuucgcccaggcuuugcgccuucgggcgaucgcggcaguuuuggggugggggacgccucgggagcugugucuacccugaucgggaggaagagggagcagugacauucagcgacugcggacagggcacggcggcggcauccuugugugggaguggggaugucagacgcgggcuggagggggaagcugccccccaggaugcucucucccugccugcgaggagcuggcgagcucagccgcguucugggugcuuucuugggcggugcaggcggauggcagaggggcugaggcgggaggggggcggggaagaccgcuggggggcccuucccccccucucuuuuagccagcgcuguaaggaaggcugauggcgaaguucgguuuuccaggcuuccccugggccccccgaguuccugaggcccacuugagggagacugggggcuccucuggccgcccaggcgaggccacucugacgcugcccacaugccucccagagcucucuggacucugaagagagcgccccugguucuuuccggaggugaaugggaugcuggcaagggagacuucagaaaauaggaaaggugggcugagaaauggcuccuagagaguuugagcacgaaguuucccucccaggcgccauuucuuugagagggggaggagaacuauggcuuugcaaaagaaccaaguuucaggcaugguggccuggguggaaaaccaccuguugccugaagucugucccuggagucagggccaucuugggccugggcauggcuaugccgggugccagggaggggaggccccaggcuuccugcccugguugacuccugcagccucaugccacugacacugcagcggcaucuucaccuucccauuagaaaccacuguacaacuagguagguacuuuguuaggacaacuuaucuucguccuuaucucagacaaaacaagcagcacacgcagcccugucuucaaaugcagaccacaacacacacuucauuuuuuaaagauggucugcugcuuuggggugugagcucccucuccuccugagcuucuuggcagcaaggugagaaaggaacuuagacaaagggcacagaguuggaugaaaggauagagaaaggucgagggggagcagaagaauuguaauacuacacuacaaacugucaccgguuccauuauaaacaguuuuuauagguguuuuauuacuugguuguuaguuuuuuaaaacacaaaccucuuuagauuaaaucuuggcauucacaggcucagcccagggaaacaaaacacagagaaaacuccagccauccgcuuggcuacuuuugaguuacauuacugauaaaacaaacagcagguuggguuuccucagacucugucucagccucguuuauuuaguaucuucaauagcuugcucaaggcgaauuuuuacaaaccauuaguuaguucauaauucaguguaguucacuuagguguuucgaagagaaggacacuuauaaggugugcuuuuuuauaaugcaggugcugggauuuuuauucuccaagaaguuacuaaauaaacuuaagaauccuggcccacucuuuauuuaggcuuucuguucuuuuuuuuucuuauggucugcccagaugcacuuuauuuuguaaauuacauuugugacccucagacugcauuuuaucucaagcaauaaaaauaaaccaugccuuaauuaaaaacaaguuugaaaaccccaaaucuguacacucaaacuaaaguauguuaaaagaagcagcuaaagacaauaaaagccaaaaaguccacguuuaagaugccuucagccaaugaauugugggugauuugugagcacccaacacucauuaucacuaauguauuauuccacaaggaucuccagugcaucaagaagugaagagacaccuuagagagaaaucggcuauguuugccuaaaccugugcucuuguaaccccaggagaucaggaauacagaagagagaaaugucuucauucaaccucuugauauguuuucuugagauucuguucuuaacaagcauaguucuguaacggggauguggcaaggaauccauagcuuucccauugauacuccccucuaggguuacuuguccuuugagaaaucuggcucuucagauaagugggacuggaaaggauaauaagagacacagucagagauauuuaaugcuuacuccuaaaccgcucucuuaucugugguaucucagguccucugcugagcuaaauagcucaauuaagaaauuaaccuagaaauagccugaauugaaaaccaagcauggugcaaauuuugcaagccuacugggcuggaggauuaugaauggagaagcuuaucugaccugucccccacaaccccaaaacagcugccagccaccaccacagaccagaaccacugacuaguuauacugcuccaugcaaucuacagaucacuggaaucagaaugaucugggaaugaguguuugaaagacaguuuccuuggcccaaccccagagauucugauucaguaagucugaagcgagucucccaaaaauauauuuuuagcucaugacuagucuugaagcuuacagucacuaaauuugagaaccacuggccuaggcuaaaucuucuucuuccccaaccgaggaaguuacuucuucugugagugucuuagccaaaagguuauagucccuaguacugggcugauuucaugaucugaccuauuuguccuugaguucugaacaagaauaauaaagugcagaggagcugcaggaaccucugggaacccagaugguuugaucuuuuggguuuguuuacuugcucugaagcaagucagacaaacagccugauaagagguaccacauccacagaggcacuaccaaguccuucuaaaggaaauuggguaaggaggcacaggcaaggacgcuaaacguauuuguccagggcccagcccauggugaauucuauuuacauucaauuagucacuuaaaaaacauugaucuacaccucccuuccaacugccacauggaauccucucccuucauugacuagaaacugaccccacaaggucacaaugucugguuacuucagucaagggcagaggggaugggggaugaucagucaaagcauuaaacugguuaggaaauucuagcuacagcugccuuuaugaacagcugggguuaucucaaauaccaguauucuguacccacaucuaauuuaugcauuccugcuuuaaaaccuuuaacgucuuuuaaaugcguucuggaccaagccuaaaccccuuaguccucuaaagguaugcauaucugcaccucacuaguaucucaucuccagcuucccgagccugccacuugucugugcccagcacacccuguccucacugcgaugcccucacucccugccuuaucugauaaagaccuuggcuaagcacuccucccaauuccugcuuggcugcugccuccucugugaaguuuuccugguuuuugcagguagcccacaggacugagagccuggcuucacuccagcacuggcgcuuguuaagugcuuagcuaauauuuguugaauuauggaauaaauaaaagcauuuacccuacucucuugucauauuuugccuguuuuccuaauuagcuuuucuacugcauggaccaguuuguucaucuguguaacugcccuagugccauaaaagcuacuuaaugaagacacaccauucauaccugugguuugccucccuggccacacguagcaaucaccugaggagcucuugaaccagccuagagccuaagucccacguaaggccaauuaaauuagaauauuuggggagaggggcccuucaucagcauuuuuccaaaucacccugugcagucagggugaacaaccauugauuuauuucuuauuuauuuauuuaucuuaagacagggucuuguuccuguugcccaugcuggagugcaguggcacaaucaugccucacugcagccucaacuucccaggcucaggcgauccucccaccucagccuccgguuagcugggacuacaggaguaugccaucacacccggcuaauuuuuuguauuuuuaauagagacaggguuucaccauguugcccaggcuggucuugaacuccuggguucaaacagccuccaaaaguacuggaauuacagggcccguaaucccagcacuuugggaggccgcuugagcccaggaggucaagacuagcccgaccauugauuucuauaaaccagaaacaugccucagccucaaaugagagauucugaggaagacaggagagugauaagagauuguagaauuagcuaaagauuguugaagaacaaaguugucggggaucuuuugguuuuuguuuugagacucaaaggugagguggccuuucacuaaucauaucaauuagugauguccaaauagucuuaauaaagacaguuuuuagcaccaggcuauaccaaagaaaauuuggacaggguauggugacucacaccuguauucccaaugcuuugggaggcugagaugggaggauggcuggaggccaggaguuugacaccagccuaggcaagauagccagaccccuaucucuauaaaaaauuuaaauauuagccagacauggugacacacaccuguagucucagcuacuggggaggcugacgugggaggaucacuugagcccaggaguuggaggcuacagugagcuaugacuccaucacugcacuccagccugggugacagaguagaacccugucucuaaaaaacaaaaauuugaaccaccccaguguuuaacuuugcgauucacagucuuuuggauuuuguaggagaguaacacuucaaaaagaauuugaggaaacugagaguugccaacuuuuuuuuuuuuuuugagauggaguuucgcucuuguugcccaggcuggaguacaauggcacaaucucggcucaccacaaccucugccuccugguuucaagcaauucucaugccucagccucccaaguagcugggauuacaggcaugcaccaccaugccuggcuaauuuuguauuuuuaguagaaacaggguuucuccaugucagucaggcugaucuugaacuccugaccucaagugaucugcccgccuuggccucccaaagugcugggauuacaggcgcgagccaccgugcccggccaccaacuuuuaauuuugauaauaaggacauuuuuaaaaagaacuaauggcuaucuacuaucagcaucauuucacagaauaaaggacauuuuaucccccaaaauaguaagaagaacauacucccugaauaaaagauagcccuucccaugaaaaaagagugggcaacuuuauaucaauauguucauuuucucacuuuuuucuucuuuuuuuauuuucuauuucaauauagacaaugaaacuaucuucguaucugguuaacugaccagaguacauuuaagaaucacuggacuacuuuauaaauuuacagggguaaggaaguauaagucaaguuuaauuuaacuacuaacaauuuucuccaguuuuugcaaccuaaugugcgcaucuaacuggaaagagguuuuuuuucuuauucuuuuuuuuuuuuuuuucgagacagagucucacucugucgcccaagcuggagugcagugguacgaucucagcucacuggaaucucugccuccucgguucaagugauucuccugccucagccucccaaguagcugggacugcaggcccaugucaccaugccuggcuaauuuuuguauucuuaguagagaugagguuucgccauguugccgaaguuggucucaaacuccugagcucaaagugauccaccuuccucggccgccucagccuccuaaagugcugggauuacaggcgugagccaccacauucggcuaacuuuuuuguauuuuuaguagagacgggguuuugccauguuggccaggcugaucuugaacuccugaccucaggugauccgcccgccucagccucccaaagugcugggauuacaagcaugagccacugcgccuggccaauuuuucaccauaauugcagacaggggcccugaauuugccuuuccagcuauaagguaaccaaugcagacagcaucaggucauucaaguuggcaaguucauuauuuccucuuuaaauguauuuuuuaaaaaugagauaaaguuggcugggcgcgguggcucacuccuguaaucccagcacuuugggaggccaaggcgggcggaucacgaggucaggagauugagaccauccuggcuaaccuggugaacccugucucuacuaaaaauacaaaaaaauuagcugggcgugguggcgggugccuauagucccagcuacuugggaggcugaggcaggagaauggugugaaccugggaggcggaguuugcagugagccaagaucaggccauugcaugccagacugggugacagagcaagacuccggcuuaaaaaaaaaaugagauaaggucucacuauauuauccaggcuggucuugaacucuugagcucaagcgaacuucccgcuuuggccucccaaaguggcagguucauuauugaacuucagguuaaaguucaucuuucaaguugcaucccaaggaaggccaaggggaucagucuggugaaccauuucaccagcuugauaccucucugauaccuacugguaucaguaacgagacugcuuguaagagggcauagcucagcuucauacagccuuguuuuuuuuuuugagacugagucuugcucuguugcccaggcuggagcgcaguggcacgaucucggcucacugcaaccuccaccucccggguucaagcaauucuuugccucagccucccaaauagcugggauuacaggcaccuaccgccauacccagcuaauuuuuguacuuucaguagagacaggguuucaacaucuuggccaggcuggucuugaacuccugaccucgugauccacccaccucagccucccaaagugcugggauuacagacguaagccaccacaccugagccuuuuuuuuuuuuuuuuuuuuuuuuuugagacagagucuugcucugucauucaggcuggaaugcaguggugcaaucucagaucagccucccagacucaagcaauucuucugccucagccuccugaguagcugggacuacaggcgugcaccaccauacccggcuaauuuuuguguuuuuaguagagaugggguuucaccaugcuggccaggcuggucuugaacuccugaccucaagugauccgcccaccuuggccucccaaagugcugggauuacaggagugagccaccgcacucagccuacaaccuugccuauaaauugcuucaggguugggauugggguugguucaucuuuauauucuccaaagugucuugcacauaguaguaauaaauaauguuaaguaaaauaaaagguuaaggaucuguuaucuguuuaucuaagaucuaucugucuaaauucagaaauuagacuguaaacuucauaugcuuacagauuucuuguaaaugucaaacacaucauagacauucauuaaauacaugaagccugcaugaauauauuuccuaacuaccguaaaguaguacuuccuguuacccagucuaaaaccacuuuuucuacucuguguguguuuguugaagagugacuuuaaacacguagcaucuuagcauuugaccaauggaguguucuauuuuuauuacauguacuacauuugcuauuuuuuucugugguauauauguacauacauagucuuggaacuguucccauuguaccuuuucucuuuccaaaaucaaguaucauauuuugaggaccucuuaucugagcugccccuucugguguuugcagccuauucaucugcuccaugugccucacuuccauggccaaugugacuuggcauaucuguuaccgagacugagaucuguuuucuaccaauuccaaugccacacauggagucauaaccugugguaaacagucuguaauaauuccuagauuucguuuccugaauugcaacugaugacaugaaauaacucuaaguucagcuuauuuguaauuuguaauaucuuucucuguagcagaaaaauuaguguucaccaaauagucccugugcaccccugcauuucauagccuuccccuccauuagguuagaaccauguggcuaguuucagccaauggaugagaagcugaaaugauauguguuacuucugguucaaagaguuaagaaccagagugagucauucuccauuccucucuuccccuucgguaguaucucagaagccauguguuccagaugaugagcuacaaguuagcagagcugccauuagcguggaccccuaaguaacugcauggagcagacuccucccacuuguucugauauguaacaggagaaauacaccuuauuguguuaagccgaagagaugcugaaguuuuucugcuauagcaggugguauugcuuaaccuaaauuaacaaacaguaguguucaggggauauguuccaagauucccaguggaugccugaaaccacagauaguacugaauccuauauauacuaugguuuuuuuucuauauauacauaucuaugauaaaguuuaaucuauaaauuaggcacaguaaaagauuagcaacaacaauuaauaauaaaauagagccagggcaacaaaauuuauuguagcaucucuacaaaaaauuuaaaaauuagcuguucacaugccuguaaucccagcuacuuagcaggcugaguugggaggacagcuugagccuggaagguugaggcuguggugagcaugaucaugccacugcacuccagccugggugacagagugagacucuaucucaaaauaauuauuaauaauuuaaaaacagaaaaaauauaauaauauacuguacuaaaaguuaugggaauguagucucccucucaaaauaucuuauuguacccuucuugugaugaagaaaggauggagggauggugugagauuucaucaugcuacuuguuuauuucuggaauuuuucauuuaauauuuuuagaccacauugacuucagguaacugaaacugcagaaagcaaagccauggauggcagggagaaccacuguguucccuaaaugcaauacgacccaaauaucuuccuuuuucauuuuuuugagaugcagucucacucugucacccagacuggagugcaguggugugaucucgacucacugcaacuccaccucccagguuccagugauuguucugccucagccucccaaguaguugggauuacaggcacccuccaccacaccuggcuaauuuuuuguauuuuuaguagagacaggguuucgccaguuuggccaggcuggucuugaacuccugaccucaggugauccguuugccucggcucccaaaaugcugggauuacaggggugagccacugcacccgacccaaauauuuuucuuaaagccauaccuuucugcccuucugccgucugccaugugaggacguagugcuccuccccugcagaagaugcagcauucaagccuucaucuuuauuuuauuuuauuuuauuuuauuuuauuuuauuuuauuuuauuuuauuuuauuuuugagauggagucuugcucuguugcccaggcuggagugcaguggugugaucuuggcucauagcaaccuccaccucccagauugaagugauacuccugccucagcuucccgaguagcugggauuacgggcaugcaccaccaugcccagcuaauuguuguauuuuuaguagagacaggguuucaccauguuggucaggcugaucucgaacuccucaccucaggugauccgcugcccucggccugccaaagugcugggauuacaggcaugagccaccucacccgaccaaggcuucaucuuggaagcagagagcaguccucaccagaugccagcaccuugaucuuggacuucccagccuccagaacugugagaaauaaauuucuguucuguauaaauuacccaguccuggauauuuucuuauagcaacacaaaauggacuaagacagaaauuggcuuauuggcuuccaaauaauuagcuuucucauaaguguaaguagaauuuuuuggaaacaaggauguugcuugggaguacagcuguaucugaagagaaagaaauucugcccaguaucuguucaguggccucuuugcagcuuccucagccuagucuggagcucuuaguaacaguuaaugaccuaugagcugauuuacaggguggcuagggaaagaacacuuuauuccugccaauuaaaggaguuggggacugauauuggggauaguguuguguaauucuguggcuccacucaaaaccucugaggaagauagugugggaacucaagaugcugaaguggacugagggagcauauuugcugaacaugucuuuaguguuugguagaacaauauuauuaauaauagcuaacacuuuuggagcacuuacaaccuaagugaguucccugaauuggcucauguaauccucauaaccauucucuuuaaauauugcuauuaugccccauuuuacagacaagaaaacugugcucugagguguuaagcaguuucagggaggucagaauucccaacugagcagcugaucauugcacuccacuugccccucagugaggucugaauucagaguccaggccugaagucacuguucuguaaggauggcccuugggggcgguucaggaguccaggccggcacugccaggacaggccuuuggaacccaugaccucucccaggcuggagaggaagcuggcaccaccaaggaggcacaaagauggggaagccagggagagcgaaguggccucggggacagaaggcaggagaccuggcacuuaauggaugagauagagagaaggugcuacuggcagcgacagaaaaagaacugucagggccaggacaugcagaagccugagaccccaccaucuccagccugcgaggacacuggaaguaccaauuuuuggacugcaaaagccucucacuuaauucauagaagcauuauuuuagagggagguggaaugggcgacugggcaccucaggcggcugcuggaugggggguccucagagcugcaagccuccgccaucccuugccauccccugcugccaccgggccuccgaugcucugcgccuuugucauuccgcaucccacggugccagcuaagucacucagcugucacaaugaggccuggagcugcaggauacaaaauaacucuggggagaccucucagaggcgaggcgggggugggggcggggugggaggcgguggggaggggaagacugggccccaggggcgcggaaaggagcaccagcugccucuugcaaguugcuaaauuaguugggcuguuguuuuuccuuuaauuuuugugugaauucaagaauaggucgcggaugucuuggcagcuugugaaugagacccuuccucaaagaauucaccuugcugaagggcugcugucaggcgcacaaaacuaagcgaaguaggcuuugcccgccgccuccugcucgcccucccggcaggcgcgcucggccuccuuccccgcgccugccucccggaccccgcgcuccaagccggcuacccugccucgcgggccaugcccagccugcccgcucccgcccggccucaccccgccggagcagcgaccuaagcaggaggcaggggaggcgggcggagggcucuggaaguugccagacucgcuccuggccccgcgucucagcggcgagccccgaagccaccccaggcgcggacaaggagaggggcuuuccggugaccguggccccaggcauuuguuacgcuuacagaaggcaaugcacggauggugaguauuagcguugguuuuugucucaguggcacauccaacuccuugcugccaccuuucuccaucugagugcacccaaggccccuggacuugggucuccaggguaaagccaaggacccggagccucaacaacgcgucugauggccucggcaggagcuuuugcccacgcaagcgcacgucucuacugggauuuauuaagaaucaacaguuuaccuggcgcgguggcccaugccuguaaucccagcacuuugggaggccgaggcaggaggauugcuggagcucaggaguucgagaccagccuggccaacauggugaaaccccgucucuacuaaaaauacaaaaauuagcugggugugguggugcacaccugcagucccagcuacucaggaggcugagacacgauaacugcuugaaccugggaggcggaggcugcagugagcaagaucgcaccacugcacuccagccugggcgacagagcgagacugucucaaaaaaaaagaaaagaaaagaaaaagaaucgacauguuacaguuuucagaauguuuugcauauuuuaaaaauacguaguccaacaugaacaguuaauaaaaguacaaacagcgaauaaacauaugaaaaauggucagauucauuaguuaccaaagacaugaucaucaaaacuaugagaggcuauuuuuuucccucccaguuggcaaaaugaaaauauugccauucuccacacugaccugaguguggagaguuuggcaaucucagugggagugugaggagcauaaacugauacuagguuucuggagaguaauuugacauuguuuaugaagagcccccccgcuuuuuuuuuuuuuuuuuuuuuuuuuuuugagaccgaguuuugcucuuguuacccagguggagugcaguggcgcacacaaucucggcucacugcaaccuccaccuccuggguucaagugauucuccugccucagccuccugaguagcugggauuacaggugcgugccacuacgcccagcuaauuuuuucgguguuuucuuuuuucuuucuuuuuuuuuuuuuuugagacagagucucucgcucuguugcccaggcuggagugcaguggugcaauuuuggcucaccacaaccucugccucccagguucaagcgaugcgauucugcugccucaaccucccaaguagcugggacuacagagucaugccaccaugcuuggcuaauuuuuguauuuuaaguagagacaggguuucacuauguuggccaggcuggucuugaacuccugaccucaugauccacccaccucggccucccaaagugcugggauuacaggcgugagccacugugcccgcccaauuuuuuuguauuuuuaguagagacgggguuucaugauguuggccaggcugcugucgaacucuugaccccaggugguccacccaccucagccucccaaagugcagggauugcaggcgugagccaccaugcucagccaccaagacccuuaaaaaauacaccaaguaggcccugugcgguggcuuaugccaguaaucccagcacuuugggaggcccagguagcaggaucacuugagcacaggagacagaggcugcagugagccaugaucgccacugcacuccaaccugugcaacagagccagacccucucucucucaaaaaaagaaagccccgaauagaugaagggccucuaaagcagggguuugggagcuguaaaccaaaaauaauuuuuuuuuuuuugagacggaguuucgcucuuguugcccaggcuggagugcaauggcaugaucucggcucaccauaaccuccgccuccuagauucaaacaauucuccugccucacccucccaaguggcuuggauuacaggugugugccaccaugccaggcuaauuuuguauuuuuaguagagacgggauuucuccauguuggucaggcuggucuggaacuccgaccugaggugaucugcccgccucggccucccaaagugcugggauuacaggugugagccacugugcccagccuuuuuuuuuuuuuuuuuuucuuuuagacagaguuucgcucugucgccugggcuggagugcaauggugcuaucuccgcucacugcaaacuccaccucccggaucuaagccauucuccugccucagccucuccaguagcuggaaucacaggcaucugcuaccacgcccgacuaauuuuuguauuuuuaguagggauggggugucaucauauuggccaggguggucucgaacucccaaccucaggugaucugcccaccucggccucccaaagugcugggauuacaggugugagccacugcacccggccugaucccaggacuucagaaaaacucaaccaauugucaaccagaaaauguuuaaauuuaccuacagccuggaaguaccccaucuacccccaccccucgcuuugaauugucuggccuuucuggaccaaaccaguauauuucuuaaauguauuugauugauguuucaugccucccuaaaauguauuaaaccaaacugcgccccgaucaccuugggcacauguucucaggaccuccugagggcugugucacggaccauggucacucauauuuggcucagaauaaauccaaauauuuuaaggaauuugacccauuucaucaacagagccaagcagauccaggucugcucucaccacuccagcugugugcccuggaacaagucacuucaccuccuuuaaaccccuuuccucaacuacaaaacggaggugcuccucccuaccucacaggacuguugagaagaugaagaaacaaaacaaaacaaaacagcccacuuaacagauggugaugguugcugcaaugguugcuauuguaaauucauuuugcuaucuccuuggcccaguaaucuggacugucccaaguaaacagcuuuagguguagacagaaauucaugcacaaaagaugucuaucacagcauuacaauauaaucacaaaaacacgaaaacaacauacccagcaacaggagaaaguuaagaaaauuauggcuuaaccaugggauuuuacauauacauucaauggauagcauaugauauacacugcuuuguagcuugcuuuuuucacuuaacagugugacauguugcaaguuuuuacugugucuguaggauaaguuccuagcauuggaguuguugggucauaagaugugcauuuuagaucuugacagcuguagccaacuugcccugcauggaggcuggcccaaugcacacuucccucagauauagggcagagccuguuuccccagccuuccgcaaacauuaucaacauuuugcucuuggccaaugugaaaguaguauccuguugaaauuucaauuugcauuuuucuuucuuuuuuuuuuuuuuugagauagacuuucacuauccucgcccaggcugaagugcaauggcacgauuuuggcucacugcaaccuccgccucccagguucaagugauucuccugccucagccucccgaguagcugggauuacaggcaccugccaccaugcccugcuaauuuuuguauuuuuaguagagaugggguuucgccauguuggccgggcuggucucaaacuccugaccucagaugaucugccucccuuggccucccaaagugcugggauuacaggugugagccaccacgccuggccgagucuaauuuuuaauugacuuagcccuucagcuagcacauaugcaauuuuuuuuucccacuugagcacuugucuuuugacuuuuuggucaauuuuugcuaagguuuuuuguuuuuuuuuucugagacagagucuuacuguuucacccaggcuggagcacaggggcgcaaucucggcucacugcaaccucugccuccugguucaagcaauucuccugccucagacuuccgagggauuacaggcaugcgccaucaugcccagcuaauuuuuguauuuuuuaguagagacgggguuucaccauguuggccaggcuggucuugaacuccugaccugaggugaucugcccaccucggccucccaaagugcugggauuacaggcaugagccaccaugcccggccuccaagguuuuuuuaaucaagaaaaaaauacauauuuuuucuuuuuuauuuuauuuuuuuauuuauuuaaguggagaugaagucuugcuauguugcccaggcuggucuggaacuccugggcucaagcaauacucccaccucagccucccaaagugcuggaauuacgggcaugagccaccagacauggccaagaaaaaaauuuuaacucaaaauacuauugucuagggccuagguaauuucucguucuguccuuagacucuauugugguaauccauugaccuuucuugcucucuaccuccuugagggcaggaaccuugacaaccuaguuuaccauuugaacuccagcagacacccaacagauacuucgugacugcacuuccauuuuguaagugagugccaagaacuucuggucuccuaggcaaaucugcauaguacacaaggagaaaacauucuuguauucuaucaaguucugccacgaaacagucguguucaacuggugacaaaauguagugaauuuucaaaguauuacccuagccuuauauaauagguuucaaggggacaugagugaguguggacaauuuuacccccaaccuuggcugggcccaacccuacuuccuagcccccauauucaacacacucuccuggcccgccacaccuccaaccccugagacucacugggcuccagcucuccacuggugggcugacaggcacguccccacccauagggccugggcagcuucaaaagacccucaacuuauccucucaggagucaagaaaagucccuuuccaacaggaaagaacagggucacccagauuguuaugcaaauguuaacucaucuguggaaacguuagaguauuccuggccucaacagcaagaaacaaacaaaccaaaaaaaaaaaaaagaaaagaaaagguaaagcaagaagguacagaauaacuuccagcuucuaacagaggagggucagaccaggcauugcugacacggucucauauguucucauauguugcuugauguuuaggggcaaauuugggacaaaguacaaggugaacccuugucccccacacugauuucguuuuggagcccagccauugguaucaucuuuuuuuuuuuuuuuuuuuuuuuuugagacggaauuucacuccuguugcccaggcuggagugcaauggcaaucucgguucacugcaaccuccaccucccggguucaagcgauucugucucagccucccaaguagcugggacuacaggcgugcgccaccacgccuggcuaauuuuguauuuuuaguagaaacaagguuucuccaaguuggucaggcuggucuugaacucccgaccucaggugauccaccugccucagccucccaaagugcugggauuauaggcgggagccaccacaccuggcccaguaucaucuucuacagaggcccuuuccaggagugagggacaucaguguggcacuggagggacaucaguguggcugugcucuggcauacaguaccauucuauuggcaggguuaguccucgauggagccccuuucagcaaucaccccuacccuuccuuuacauaucuuaacaggcuuucuuaauuuuaaauuuuuauuuugaaaagcaugucaaauuuacagaaaaguugcaaaaacaccuuaaggaacucccauacacgccucaccuauguucaccaauucauauuuuugcugcauuuacuucagcauucuguauacaauauauaucgcuauuauuuuuuuuuuuaucaaccugcuuaccaaauuauuuuuuauuuuucacuuuuuuuucgaaauaaaaucucacucuuguugcccaggcuggaaugcaauggcgcgaucucggcucacugcaaccuccaccuccuggguucaagcgauucuccugccucagccuccugaguagcuggguuuacagguacccgccaccauguucggguaguuuugggguuuuuuuuuuuuuuuuuuuuugagacagucuugcacugucccaggcuggagggcaguggcaggaucucggcucacugcaaccucuaccucccagguucaagcuauucuccuacuucagccuccugaguagcugggauuacaggcgcgugccaccacgccuggcuaauuuuuguauuuuuaguagagaugggguuucaccauguuggcuaggcuggucucaaacuccugaucucagguguuccgcccaccucagccucccaaaguguugggauuacaggcgugaaccacugugcccagccuaaaauuauaguuuaaaugaacauuugagagcaaaucauagauuuuuacccuuaaauauuuccaucuucacugcuaacaugaaggacauccucuuaaauaaucacuguacaauuaucaaaugcagaaaauuuaacauuguuaaauugcuguuaucuaagcugaaauucauauucaaauuucacuaauuguccaauuaaaggccuuuauagcuuucucuuuuccagaccaggagccaguccaggaucacauguugcauuuauuuguc

SEQ ID NO: 17461 - RNA, 12622 nt, Homo sapiens
agggcuaguuaacaugagauuugauucuuuuacugcaaguaguuaagccuuaacagaggugaggcacacucggguuccaugcaguacagcuuagaaaugcuuacuuuuuauagacagaaaucacauuguucuuccuuucccuuuaagcagacaucuugacaauccuuugaauugauuauguggccuguauacugaaagucagaugucaccuuccccaggauaaguacuuccaguaaagcaaaagaggaagccagcuuuugcuacgaucaagauaguugauguggaugagggguuuaugggcuaccccguuuucaauuacaaggcucccacucacagaguaagugcuguuggccagcaccucuggcucacagacaaguuccagggaauaauuucaccagcgauuaauuauacugcagcuacugggauuuguccuccaaacaucacuuuguuuuccaucugaaacagccagguuucuccagggagagcugagguuuucugauugaaaguaucccgaguuaaggagaaguguuagagcaccaugggaaucuauucaccagggguguacuguacuuguuucagaugcuucaggauaauacaccagcuucuaagauaagugcuuuuuuuuuuuuuuuuuuuuugagauggaguuucacucuuguugcccaggcuggagugcaauggcaugaucucggcucacugcaaccucugccucccggauucaagugauucuccugccucagccucccgaguagcugggauuacaggcgcacgccaccaugcccggcuaguuuuguguuuuuaguagagaugggguuucuccauguuggucaggcuggucucgaacuccugaccucaggugaucugcccaccucagccucccaaagugcugggauuacaggcaugagccaccgcgcccagccaagauaaguguuuuuuauuucccugcaucuuagaucaauuauuuggaauuuuuuugguaaguuaagagcuguaacuuaaaccaccacaucucuaugauguacucaauaagugaaauguucuuaccaaaaauuuuucuuccaaugggcuauaucauaauuauguugugaagagccuagaaaaaaauagaggccgggcacaguggcucacgccuguaaucccaacacuugagggacugaggucaggaguucgagaccagccugggcaaaauggugaaacccugucucuacuaaaaaugcaaaucuuagccaggcauggccacuggcgccuguaaucccagcuacucaggaagcugaggaaggagaaucgcuugagccugggaagcggagguugcaucgagcccauaucgcaccauugcacuccagccuaggcaacagagcaagucucugucucaaaaaaaaaaaguacaaagaaacaaaagguggcaagaaauucguuuuuuaaaacaucgcauguuaugagggucagaguagugaagugccaccagcugcagccuucugagaggaagugcugcugcugguucaaauggaauucuguccuacauccaccaagcacgccaguggaguggacaugacacacacuuuucuucuaagcuguacaguuuaacauauuacaagugaguucauuuaacuaguaaggaaucagaaauguaucuuuguucauuuugaucguuuugauggauucuguuuucucuuacgugaguagacuuuguggacuuccaaauggcuccuggcauaagugccaguuccugcuauuaguuccuugagggucucaugagucagagaggagagggaaaaacccacugcaagccaugcaggggucccuucggauaguggccuugugcagucugcagugucggugcacgucaucccugcacacccgccugcugugcucuggcuggagcuuggguuugcaguugucuucuuuacagcacccagggaagcauggccuccuggcagguguuggccacucccugcuuucuccuggccuuugcaagcacagugcaaggguguuugcugaaaaagaccacugggcuuucaguguacccacacccaucagggcugaucacccugcugccaccuccccaggacucuuccgugacuaucagucauagccugaagucuguguccaagggagugucucaggagacagccacuuaacaugguaggaguagcaggugcuaaaagguuuaugccuaaaugcuccccauggaccccaaguugccugcugguuugaguggccuaacccauuuaggcucaggcccugacagggugugugugcaccacuucggggugugaaagcaugaacagcugcggaaagcguggguuuucugaugcuggcugcugcugccuuccggauuagggacuguagcggggagacagaacaaaggaacacaugugcuucuggguaagcuggcccaucauagugggggacauaagguaugggggggcacauaccaccuugguaugaacacuuugguuguacagaauucuuucagcaaggcugagaggaguggggcuuucuguccuugacugcuggauucaaauaagcaccaguagaggaccuggggacuuucacacucacugcaggggacuuucaauugugggaucucauggacaaaagggaaugguucuauauccacggcucuaugguucucacccccccaggaguacaaagcugggaccccccagccuccuggguacguuucucagcaugugccaagcacuuuggaggcaggugacggaugugccaauuaucuguauucugaggugugggcucccuucauacucuggcaacacagagacguagagagcucuucuucguguugacaggacacaauaugggcuggcuucggcacaguggccaucacuguguuagcauuccugacacacugcuauugaaagccccaaucugcugccaaauuacauguagacagugguuucacuguaaaauguugcggugcuuguuugcauucagucaaauacuuugcacuuaaacauggguuaaagagacaaauaagucaaaagaccuuagcaaaaccugaaguuaaauuuacgccuauucuucauaauggcauucagauuaaagccaucaaaaugcaaaaugcugugauuauacccuucgaggguucaggcuggauucuuguuuuguauuucugcauuacuguauuugcagugauuuugagaugcaggaaaaugcaucagaggcauugauuucuucuuuaacaaaaaauaacccuaaaauugagaaaauucuugagaaugcagccauuuuggaaauguagauaaagaagaaaaaugcugaagauuugggugguuuauggagccguaugauuuugucauugcugccaccuacuguaugugguugauguuuguuuaaacuuaggaaguucaugaaggugaggcuguugaaauagauaauuagagcaagguagacaucauuagcuuauagcauuucuuuucuaccccauaaguggcucuuaauuacugagacagccgccagcuuucauucauuaccuucaaguggauuuaaagggcugguuucuuuuuuuuuuuuuuuuuccauuuuuaaaguuccuuugccaaggaaccuucacaguaaugcuguaaaaugcguucaaaagcuuaagaugcugggggauuuucugagcauacaugcaauagguuguuuuaaggaguuuguuuuguuuugucuuaauuuguaggagcaauauucugggauuggauuguaaauuaauuucuaugaaagaggugaaaauggagcuaguggagcugaugggaguugcagcaguugacuugaaagacauucuuuuauuaguccuaaaacaaagcuucagaucaaccugcuaguuaaauguaacaagcaauauagacucugagucaacagagguccuucucuuuuuauuaagacccagcugucaaagggucauuagguccuuccuguggaaaacaacuugcccauuaauguuggggguggucccucgacaggauuucugaguaagugccugacauuucguuuuugaaagaaucuaaagcugugggagacuuagauguugagacuuagcaggaguaaugucuucaaccauagcuuuuagucuuuguuaaauaugucacaauauguguuuggaaugcugcugcuagcugcgugaauugacuuagagugccacugucaaagauucaggagcguaaacuucacggagaucaaaucacuauaacugggaagaggcuacauuccuaaagcgaaugcacuucucuguugugauguuuuuaccuugucacuacucauauuauuucuaguggcuccuguucuaagcucugggaaugccacagugaggaaugcccauuuauuuuuucugcccuaggcuauuugcuuucuagaagagaaggccaagcagggucuccugaaaagccucucuccgaucugggccgucucuccuaccuggcauauuggaagagcgucaucuuggaguaucucuaccaccaccaugagaggcacaucagcaucaaggcaauuagcagagcgacgggcaugugcccacaugacauugccaccacucugcagcaccuccacaugaucgacaagagagauggcaggugaguccugggacccugggcagcuccguggcucaggcaucccacaccagaaagggucccuggagauaggugcauucauuccaguuaaagacugagguucccuaacaguauuaucaaaccuuuucuccuaaaaauaacacaugaaaugacacuuuuuuacugguuggauuccaguguucuguacccucucauugaggugcuuucugauuuuuccuaacgcagauaacauuagugcuagcauauguccguaugugaagcugaagugaaauuucagcuugugauuacaucuuguucugccuuaucacauuacagauuugucaucauuagacgggaaaaguugauauugagccacauggaaaagcugaaaaccuguuccagagccaaugaacuugauccagacagucugagguggaccccaauuuuaauuucuaaugcugcagugucugaagaagagcgagaagcugagaaagagguaaugauugucuuuaucauccuaaguuguguaacuucaaucuuguagcauucuuaagcuaagaaagucauuaagaucguugucaaaagcuugguuauguagagauagcaugugaaaugauauggcacuaauuuauccuaacugagguugcaugguaagacaugauaauuuuauugaauugaguaugaaaaaugaaacauuuaucauugauuacaaagcagcauuuuucacuacugagagcauguaaucagaucaaauucggugcugagcuccaaggcugcagugucaauugauucuuuguguuuaugaacuugcuuaaagugcuccuugccagugagcauguaauguagugauaaaggacucaaaucaauucgcugcaucauuaauacuguuaaauaucccaugaaacccaaucuucuuugauuuguuauccuaacugaugcaaaagguuccugagaugaugcagcuggaaugugcuuggcuggcuggcuguccugaucagaaccgacuuagagacacuuugccauugauccucagaggcucuggcuguguaacugcccucucacuggccaccauuuuuacccuccccacuuaggcugagcggcuaauggaacaagcuagcugcugggagaaggaggaacaagaaauccugucaacuagagcuaacaguaggcaaucaccugcaaaaguacaaucgaaaaauaaauauuugcauuccccggagagccggccagucacaggggagcgagggcagcugcuggagcugucuaaagagagcagugaagaagaagaggaggaggaggacgaggaggaggaagaagaggaggaagaagaggaagaggaugaagaggaggaagaagaggaagaagaagaagaagaagaagaaaauauucaaagcucucccccaagauugacgaaaccacagucaguugccauaaagagaaagguaggugucuguuuagauuuucugugagucgcguucaaucaaaucuuauuugucauugcagacauucugucuauuaguauuuguuucacucucuguucuuuagucguaguuuauguguacccagucccgcugaucauauaucauaaucguuuaucucacagucaugauuauguuuacuuuucagguuuguuagugcggugacaggaaaccagggacaggccagccuccuagucuaguagucacugccaccugcuggucugcaggaguagaguaacugagguuuaugggaacaaaaaggggccccagaaagcacuuaaaccacccuccaagaccuagaggccaggagacuucucuaaggucauaugacucauuagagauggaagcagaaccaaaugcgugcucaagacucuaagccuggguugggcgcaguggcucacgccuguaaucccagcacuuugggaggccaaggugggcagaucaccugaggucaggaguucaagaccagccuggcuaacguggugaaaucccgucucugcuaaaaauacaaaaaauuagccagacacgguaguacgcgccuguaaucccagcuacucgggaggcugagacaggagaacccagggaggcagagguugcaguaagccgagaucgcaccauugcacuccagccugggcaacaagagcgaaacucugucucaaaacagaacaaaaagacuccaagcccagugcucuucaugcuguuucuuucucuuguucuuggcacagaauuguuagaaagcauuuuaggcccuuaauuuugauggugauauuuugcauuuguggccaacugcgcauuacugaaucuccucagaucuuaguagcccagugaugucucuagauagaccauaucaucuccaaugguacagaaaguaaagaauugacuuuguuuuuagguaacugcucacccagaucugauaucuuugucuucaguaucuaucugggacauagaggagagccaagacugauagagauaucacaauacaagcuaaggcuccgccccaaggccaucugauguggcaucuguuagggaacuugcuguucuaacucccagcucagcgcucuucuaggccuggcagucuucuggaagggucuccauggggaggugguagaaaggagcaucccacaaaguagacuucaggcuuaagaauaauguuuccauuucuuaggaggaguguguauucauguguuguauauauaauaaaagaaauuuguucuaaaacuaucaaaaaccagaaucauccaaggcaugaucugaacuggacucaaccugaagaaaaccaguucucuaccuuggcuucccucauauuagggaaaauucucauggauuaaagagggcaggcagacuggggggaauaauaaccguaaauguuuaauuacagaauaugauuaacuggcuacgugugugcuucagugagcauucagagcguuaacaaaaguaagacacaagaauucuuggaggccggacacaguggcucacgccuauaauccccacacuuugggaagcugaggcaggaggaucauuugagcucaggaguucaagaccagccugggcaacaaagcaagacucugucucuauaaaaaauaaauaaguauuuuuaaaauaauaauaauaauaauugaauacaguuuaccugaagguuagcuuuuaaccaagcauauugaacccuucuuugcaguguauuuucaauaauuuggggggcaacaauuacaucuuagcagcaaaucuaccugcuauuccucuauuugaauuuugugucauuaaaaacuuuuuugcugggcgaaaaacauuuuauaauuacaauuauggacagucauuugugccaaccuuuagugcaaacagaaaaaauauuuuuaggccaggugcgguggcucacaccuauaaucccagcacucugggaggccaaggcggguggaccacuugagcucagggguucgagaccagccuaggcaacauggcaaagcccugucucuacaaaaaagaaaaauaaaagaaaaaaauauuuuuauaucauacaaauaagacaucuggcaugucuuuaacauuuuuagauuccuucuauuaaaauauuuugccagguuaucaguugcucacaucucagcagccaccaauacuugacuuuguuaacauuuuaaacaguaauccuuucuucagguaccuuuccuuuccuuuucauagcccugaaguccuauggaaugagaaaaaguaggcuggucuuguaucauauuucccagugcuguccacauagugggugcuccuucaagaguucucaaguauuaaauggguuaacccaguggcuaguuaauuacagcaccauuuauaaagacauuagagucugugaugaccuuaaaugucugugaugugaggaauauugaagccagcaaguaccauuggaaaaauauaugcuagaaaagcaaagcuuaguuuuuaaaaucuccagucaagcugcuaggauguucccucucagagcaucugcuugaguaaacaacuguuuuauuuggaaaacacuugccuguguaguuggagcccgagagggauguuagacaucaaauggaagguuaaguacaaaggcauuacagaagucaccacguguaagauucucagacacgcguucaguacaugucuacugcauaucgacucaaccauuuaauuucucaugagcucuuauguguuauguuuggaauuaauuucagaggccuuuuguacuaaagaagaaaaggggucguaaacgcaggaggaucaacagcaguguaacaacagagaccauuucagagacgacagaaguacugaaugagcccuuugacaacucagaugaagagaggccaaugccacagcuggagccuaccugugagauugaaguggaggaagauggcaggaagccaguccugagaaaagcauuccagcaucagccugggaagaaaagacaaacagaggaagaggaaggaaaagacaaucauugcuucaagaaugcugacccuuguagaaguaaguagaggaaugauaaaaaccuuacccuugagaaugucuguaucugacugggugccaaagagcaggccucuggcgugaugcccagaggcaccugcgaaguggugcugaugcaccuggagcaagugcccaucugcccuuucccauccuuacaagcuucucucccuucuuccuggaauuggauuuuauguuaaacaacuucuaaggccagaacauuccucuagguggguucaucuuacuuaccagaaauuggcuuauccccaaaaacuuugaagucuguugacaagaaacacauuacauuucuuugauucuaauauguacuuuuuuuuuucacauuuaguuauuucugaaaucaagguauauauuauuaucagugugagcauugaauggaaucguuucuuuuuuccuggaaaacaaauauuaguaaaucaauaguacauuuuauaaucaguagugucguaguauauacuacuauaaagauucaucuaaacuaagcugggcaugauggcuuacaccuguaaucccagcacuuugggaggcugaggcagguggaucacuugagcccaggaguuugagaccaaccuaggcaacauggcaaagccccuacucuaaaaaaaauacaaaaauuaaucagauguaguggugugcaccuguagucucagcacuuuuggagacugaggcagcuggaucacuugagcccaggaguuugagaccagccugagcgacauggcaaaaccccaucucuacaaaagauacaaaaauuagucagcagugguggugugugccuauagucccagcuacuugggaggcugaggugggaggaucaccugagcucagggugagccaugaucgugccacugcacuccagccugggugacagaaugagacccuuucucaaaaaaaaaaaaaaaaaaaggaaccaucuaaacuuacccacacaucaauauuagcuuugauaauauugcauaacauaaaaaucaguaaacugacuuuccuuuuaaguugacagggacaccucuaccccauccucuaaaaaauacacugaacaccagugaaucgucuuuaaaagcacccauccuugccugucagguugagaacgugugcucccagcugaaucaugaggguuuaugguauacucucucuauucccuggccaagaugacucuauucagaacuuacuuuaaucuggggaacaggccaucucauuucccugggaaccacaggaucacucuagcuuuugaaaagccacaguuuuaagaacauaugcaagcaucuucuugauuuucuuaguucacagaaaugcuauuccugcauacaguauuuugcugaaggaaugacuucuuacccuggguauagagaaaccaagccuuauucuuuggguuuuuuuuuuuuaaacaaauaacaaacugcagugagcgaucauuuugugugugaaaaugagguuuauuuccccuucuuggcugucuucucauauuaugccugauuccuuucaggauguccuucuuucuuaaaaauaauugucagaaagcucaucuucugauuuugggagguguuccaacaaaagccgguagguccaguagcacguagaauaagaaugcagaauccagccaggcaugguggcucaugccuguaaucccagcacuuugggcggccgagguaggcagaucaccugaggucaggaguucaagaccagccugaccaacauggugaaaccccaucucuaccaaaaguacaaaaaaauuagcuggguguggugaugcaugccuguaagucccagcuacuugggaggcugaggcaggagaaucgcuugaaccugggagacagagguugcagugagccgagaucaugccacugcacuccagccugggcaacagagcaagacuccgucucaaaaauaaaaagaauguggaauccgggggcacuggcauggcuauuaccugccauugugaauagaaauguccugagaugacucuuaacucgggcaugguacucggcacuucucaaggaaacauucuacaucacauauguguucuuuucagcuggucgguuugaauguaauacuugcagguaaguuuaucuguaauccuuuuauuaccuaaaucagccagugcuuacucugcuguccaccaguuggacuagaacucacucuauucuggcagaagggauaucuguuuuaugaugauugugagaucuuauuuuuauucuccaaaauagaguuucuaauaagacuauuguucuauauaaagcuuuuccuuuaaauugaccacugauucuagaagauugguguaaucuaaagaucuuaagaauacuugggugcuucaugcauauauuuauuaauauauauuuauuaauauguauauagcuauucaucugcuuguauaaauauguacauauuuacauuuauauuaacaugugcauauagguucaguaaaaagcucaccugaacugaaaugaacuucacaauuaugguuuguuucuaagugucuuuaauaugcaaaccuuacaucagcaacauauugauccagaauucaguguggacagaauuaguguuaaaaagaauaccuguauuuuaaauguucaggaauuugcuaguaauuacauuguaguuuguaucaugcaaaaaugaugauccuaaaaaugaugauuacaaaugcauuuguuuuggguauuuaguuauuuacugauuuguuucagagguacacagcuuauuuuuaugccagagagaacauucaaaucaaaguaaauaaaucaugucuuccaagaucauuuacauccuauaaauguccacaaacagagguuuacuuucucuagguagauaugagaguuaaggcuucuagucauuuuuccaggacaguaaugauuuguauauaagcuagcauuaauuccuuuccccuauauuuccuaauuuguaaauguucaaauugauuuuuuuuuuuacacuguggaacucugggcuuuugcaucagagaaugucuuguucauuaaauucaaauaagcacauuagcauugccuauauccauguguucccaauauguuacucucccaggccuagguuauuuacuugguuuauaacacaauauuauuacacauuagccuugauuaugucuuuaccaucaacuuuuaacaugccaaauugaaagcaguguuugcuaauuaauuuagaggaaugaauucaaguugcccaugguuaugcuuucuaagacuguuuuuuuuccuucccguuuuugucucuucacuaagacaauaugaaugaugauucaaguaacuugaaagaaggcaguaaagacaaucccgaaccucuaaagugcaaacaaguguggccaaaaggaacaaagcgcggucuaucuaaguggaggcaaaacaaagagaggaagaccggauuuaaacugaauuuguacaccccgccagaaacacccauggagccugacgagcagguaacaguggaagaacagaaggagacuucagaaggaaaaaccagccccagucccaucaggauugaggaggaggucaaggaaacuggggaagcccuguugccucaagaggaaaacagaagggaagaaacaugugccccuguaaguccaaacacaucaccaggugaaaaaccagaagaugaucu

SEQ ID NO: 17462 - RNA, 17807 nt, Homo sapiens
cuuuaugacgaugaauauuuuauuauagagauggacugaacucacuuuugcauaaagaaucucugaauugggucagggaaauccacccgcuaagaggucaccacccagcuaucccugccucugccucagcccccacuugcuguuuacaucucagggucacuagaaacagcagagccugcuguucccagggccaggcuggugggguugggccaagggucagggauccuggcugccugccagaucagaaccgccccgucucccgccccagucgguuguccagaaccuggagcugccggaggaagccugaguuagggcagauauugcggugggccugcaccgucuggauggccucuaccagcgucauguucucacagaucaugaggaaggccaggacaaguguggcagagcggcuuacccccauggcacaguguaccagcacgcggccuguagggagaaccaacuuagcaucagcuaccugcccuugaaccacccaccccuuugggaagaagagacacccauggccauccucuacaguauccuggaauacugacacugucuacucugucaaauggggcaacugaagcccaaagagaggaggcuggcucaaagucacauagcaaguuagaggcaggguuuagguuagcagccgggauuuccuucuuccaguccaggugcuuccucaggcauccuuugcaacucugggccaggggaaggggguuuacugaauuccugaggucacuggguuugcaucagauuauaggggguguccaucuaccucccuuucccccgaguucugcccucucgacugccccugcagcucuaugccaaggccucaucuuagaggaacccgcucaagagcuucacuggguccuauaccuucuguccagugccuggccucuuauggagggauguggugaugcugaugaccacacugcaucuuaguuaugucugcaauugcuagccuccagggugucccugaaggggacacucacugaaugguaguagcuauuuucccuauggagugggaggguuacugaaaggguuugucucucuggacucccacccaccagugcuacuggaauaauggagaguccuaaagcacacccuccacccuccaccaugccugauccagaagugcaccuuggggaacacugagggcagcucggauguaucgagcaacaggcagaaaguagacacugaggucgaagaagggguugucguccgccucgaugccauaguacuccagggacauuccacgguagaauuuggcaccuguguccaccuggaacuugccugcagcggcauucacaacgugggugauucccagcuggaucagcuugcucuugucccgggcugcguaccuggaggagagggcacaagggguuaggagaguggagguagaucucacuguggcagcucuggcuggguugaaguuugcaaacacccccgcccaccacccaccaaggguagagacaagagccugcaaauuggcccagggugaaggggcuccuccuguuggaguuuaagacuccuuuucgggcugggugcgguggcucacgccuauaaucccagcacuuugggagaccgaggugggcagaucacuugaggucaggaguuugagaccagccuggccaacauggugacaccccaucucuacuaaaaauacaaaaauuagccaggcaugguggugggcaccuguagucccagcuacucagaagacugagucaggagaaucacuuaaacccaggaggcggagguugcagugagccaagauuaugccacugcacucuagccugggcaacagagcuagacuccaucucaaaaaaacaacaacaacaacaaaaaauagacuccuuuucaggccaggcacuguggcuuaugccuauaaucccaacacuuugggagacuaaggcgggaggauucauugagcucaggaguucgagaccagccugggcaacauggcaaaaccuuaucucuacaaacaaugcaaaaauuagccaggcaugguggcauaugccaguagucccagcuacuugggaggcugaggugggagaaucaccugagccugggagguugaggcugcagugaguggagauugcacuacuauacuccagccuggguggcacagugagaccccgccucaaaaaaaaaaaaaaaaagaaaaauuagcuaggugugguugugcaaaccuguauucccagcuacuugagaggcugaggugggagaauugcugagccuaggaauuugagguugcagugaaugaugauaaucccugcauuccagccuaggcaacagagagagaccuugucucuaaauaaauaaauaaaaauuuuaaaaugaaauauuacuaggaucacuguucauaauagucaaaaaguggaaacaauucaaauguccauauucaguaaaauggauaaacuguggcauaaucauaugaugacuccagcagugaaaacaugaaugaacuucagguacacauaacaaugugggugacucacaaauuugagcaaaugaucccaggcacaaaacacacacaacaugauuccacucauaucauuuuaaacaacaggugaaacuaacuacacuguuuagauauauaggugguaaaacuuuacagaaaauaauuaauucaacagauagugauuaaccacagagaauagaaaaguuauaaugagaaggauucaguaggggcuucugggagacaaguaauauccuuuuucuucacugggugaugaagcuguucauacgugcucugugcacauuuccuuuuuccuuuuuuuuuucuuucuuugagacagaguuucgcucuuauuguccaggcuggagugcaguggcacgaucucggcucacugcaaccucugccuccuggauucaagugauucuccugccucagccuccugaguagcugugauugcaggcguccaccaccacaccuggcuaauuuuuuguauuuuuaguagagaugagguuucaccauguuggccaggcuggucucgaacuucugaccucaagugauccaccugucuuggccucccaaagugcugggauuacaggcgugagccaccgcacccggcccugugcacuuuucuuaugugcauucuaguuccacaguuaaaagcaguaauaauauaaaaggaaagaaacauagggaaagagacggugggaggcaagcgugccaccucugcccuagagggcucugagagaggcucaugcccccauucccgugugaaccucacacccuuccgccauccccacuccuaacgugggucuuacucacgcaucucccaggaagaggcugggccagaccucaucgauaugguucaguguggcagccugacggacccacagcaagcgcugcagcgaagccaaugugggcggcugguagggagaugccuggacugccccauggaucuugggccuccggagguccugcuucugcagugaguccauccuggaacagaguggacaccgcaguggcuggaggcaggcucccagaggguggauccagcugauggggaagcccauggugcagugccuaggugccacggggaugcugcaggaagggcuucaucuauuucacaugagguauuaacaagcucagcuggggcugaggccuagaacccuuccccagggaacaagggaaucaagccuuugucacugcuauggagcugggcagaccucucuccugcccucugcugagcugcagauguaugaagcuuuggccaaggggcccuuggaguucccuguuuguggcacuagucagugcagaucucaucccuaaaucagcuuggacuuuguagggaugaaagccccagauggcuguggcucucagggcacccaggaagcccccaccaaccuaagcagcucaucucaagcccccucaccugcuacuuccaguacucauccucagacccccguccccucccacuuucaggggcuuggagaucagagccuaucuccagguaagaggccaggacugugaacugguauuuguuagcaacuccgcauggaaugagcuaaugccucuuauaagccugaugccucuggcugggcacgguggcucacacuuguaaucccagcacuuugggaggcugaggcaggcagaucaacugaggucaggaguucgagaccagccuggccaaugaggcaaaauccugucucuaccaaaaauacaaaaauuagccagguguggugguccacuccuguagucccagcuacuagggaggcugaggcaggagaaccuuuugaaccugugaggcagagguugcagugagcugaggucacaccacugcacuccagccugggcaacagagcgagaguccaucucaacaacaacaaaaagccugaugucucacucgugggauaucuguuccuauuuuacccaggaggaagcugaagcucagaauguuuuaaaagugaugcccaaagccauacggcucaugaguagcaaggcugggguuuuaguccauccccaagccuuucaguuaccaucuuuggggccuccagagaguggucacuaacccaucugcuuccucaagggagccugguacugcugagccacacaccugccuacaggcccuggguuuuccuccuuacccccacgacucaggccagcacuggaugucaggccccacccgggucagguagcuuguuucaggcaucugcuggcugaaggagucagggacccugcggagcuggauuuucagcggcaccagaauaugggccuggugccguguuggagaggggguccugucuuugcuaacugccccugauccccuggaccagugacuagggaaggugcauacugggaagaacaucuuuucccuuugguaggcagugccaggaccagaaaaagaaacaggcacccaggaggcugccggcuuggccaggcucacccagugggaggcugucgggcaaggcggaagugaagaccaagcuguccuccucaucccccacugugaccucuccagguggcugaguggccugccaccuaccuggggcauggccuggggccgggaaugggggagugggugcaggggcaggacucugccugagcggaacagggcugggcagguucugcccagaacacaaacacugugaagcggcuagaauuccaggugcuggcuggggcgcccaugggggguggggccugagagccgacugaggccuuguggacugcagugggcccuccggucccucuaaacccccaggccuccucucugcuugguaucuguuugggauugaagaccguugguuccauaaaccuccaugaagaugggagucuaccugaagaggugggaagagaacuucugaggcagggaggagagccuggcucccccagcacucugccauaacucauucuguggccacgagcaagucuuugcucccaucuggaccacaguuuaucuucccaugcuagggaugcuggacuuaauuuucaggaugcucugggggucugacccgagaaugagagaggagugucuggauaugcggucacugcagggcagagggcaguguagugugguggaguuggggaagcccccaggacccagaggaguccaacagccacacuggucuggagccaucagguggggcugcaccaccccaggcaggagauggggcuuugggaagugggacaggcuccgggcucaggccugcggagcuuggcauggggugaggcugcccccugguggccaaugggugugucacagcccagccuugccagggagcaggcagccaggcuccacccccaggaggcuccagaggggucaaggauuugggggcugguaggccacagugcaugccucugccuccgaggggaccuaggcccaggucugaagaacggggcucuccccuggacuuagcgcuaugccuggucaggcuccaccuaaugccuugcucccgaugcucaggguguugccccaccuguccacucuaacccacugggacccagcccaucccaucagucagagucaggcccggccacccccccagggacucguccuuuaagccccagucccucccaaggaggggaagucggugguuguggcagcuccgccgguuucugacaccugagacuuggucuucggagggcccugccugacacuacauuccaugucuccuuguccccagcugggugaagcacaggcccaacguccagcagggccagggcccggccgagcuccccucccacucccugcagucuuccuucucucccugaucccgugcuccuccucgcccccuuccugccucccccgcucagcagagcagcugccucuguaggcagggcuuuuccuggcugcuccugugcugcugcuguuugcaaguccaugcacuucuuuucuguguuugcaucucuccucccugggucacucccccguuugccucugucucccauccucccccaggaagcucaugugccuuugcagccucccaugacgcugcucugugugcccaagacaucgggcagaggcacaggcuuccuuggggcagggggcagcuguuugccauccaccucucagcugcaguuucagauaguccccuggacuuucuuccugcccauccuuucugacuccacuccagggaggccagacagaaguguggccacaggccauguggggcuggagaucucagggcaggaccagugaggaguguggggagaaggccugcagaaggguggcguguggcugccaguggggaacagcugugggucucugugcucagccugagggucuuggggagggcagaccuggguagaaaucucaggucugguacuugcagcuauguggucuugucuucaccaagccaguuucuucaguggggcugcugugagaauuccauguaauaauuaauguaaagcaccucccacagggucugucuuaugguagaugcccaauaaauggcacgucuuacuauuauuaucacuacuauaauuacucuuacccuuuccagccccagccauauccuauguggaggguaacuucccuacgggacagugagauuucuucucuaucucuguauuucuugauauuucuuucucuguccagcaauaauuguuauauuuagcacucaucaaggauguacuaugugccagacagagcuaggugcucacauuuucucauugaauccucacagugccuuuauggagcagguaauauuaucauccccauuuuacagaugaggaaaccgagacucagagagguuaagcaacauacccagagucacauagccaauugaugugggagucaggauucaaacccaggucucucugacucuacuauaccuugucugcgccuucaucucugacccagucgguucucuacccaacccaaaccccaccccuccccacacaggcacaaguguccuggcccucauuacccagcaugcucagggaccacauccuaccccccccaaauuaggagcacucacccaccugugggaguaucuggcccaggcugugcacuucucugacgggcaguucgugcugcuggcuuucagccgccugucuccgcacacuugaugcuguuucuauuuuuugauuugaguuuaauuauaaagcaugcugucuacuccccucuuccagccuccccugccacucccaacuuguccacugguuccauggcauggccagugccaagcacagucaggcaccuuucccuccaggcccaggccucugucccagcacugcuaagaaucaaggcagcucagcccaggucugacuguggcauauuguguacauguauguugauagugggagaaggggccgggcgcgguggcugaagccuauaaucccagcacuuugggaaaccgaggagggugggucaugaggucaggagaucgagaccauccuggcuaacaggcuagccgggcguggugguggaugccuguagucccagcuacucaggaggcugaggcaggagaauggcgugaacccgggaggcagagcuugcagugagccgagaucgcgccacugcacuccagccugggcgacagggcgagacuccgucucaaaaagaaaaaaagaaaaaacaaaaagaaaaaaagagauagugggagaaggaagaucaaauaaaccauuuuaaaaggucccuuggccggaugcaguggcuaaugccuauaaucccgacacuuugggaggcugaggugggaggauugcuugagcccagggguucaagaccagucuaggcaauauagccagacccugucucuacuaaaaauacaaaaaauuagugaguugggcuggucgcgguggcucaugccuguaauccuagcacuuugggaggccgaggugggcggaucaccugaggucgggaguucgagaccagccugacuaacauggagaaaaccugccucuacuaaaaauacaaaauuagcugggcgugguggcgcaugccuguaaucccagcuacucgggagccugaggcaggagaaucauuugaacccgggagguggggguuguagugagcugagaucacgccauugcacuccagccuuggcaacaagaacgaaacuccgucuccaaaaaaaacauuagcugguugugguggcacacacuuauagucccuccuacucgggaagcugaggugggagaaucaccugagcccaggaagucaaggcugcagugagcccuaauccuugaccaugccauugcacuccagccuaagcaacuggagugagacccucucccuuggccuucaaggguauuauagaagaagggcaggaaguucaaguuggaaggauguucuguggaggaggacagugaagaggcuagccaaaaaucacauguaaacugguggcauugccaacagcaggacccagguccggggcccucaguuaggggccaaggccgaugggacagguccaggauaaagaccuagaagacucaggcugagggaagcagcacaggcccacacacagacacagguguagagcaggucuucagacagcccugggcugcaggcagaagcaguguguccagggccacucccacccucugccaagcuccucccccaacccaaaaggcagggacacccaggccccacuguccccugaggccagagagauggucuuuaaggucucuccccaugcuaacuguggucagcuaggaccuucaauugggccuacuagaaaucuucucugucauccacagaccuuugucauacacacauaccuugauacuacuccccgcuugcacucccagauggugggaacagggcacacccaugccugcagccauaccugcacugggucucugaggucugagcuccagggagcuaaggcucagccccuccuggggcucucugagcccugaggggagcugcuggagacagcuguggccaacagcuaucacaaauaucuggaacccccuuccucucuccuccccuccccacuuucccagggaacuuggggucccuggccaagaagccugagggcuuggcugagaggggagcccacucccaccuguggagacugaagacaguggcugagaggggguguaggcgccaggaggagccagauggaguagcaggcucuagggccgaccccacgcugggcuuccaccaucuucuguguguccgccugggccagagccuccagcagcaccagcaggaucagugccaggguggcaaaguggcagagccccauggcagggaguaaggaccagcucuggaagagagaugagcucuguguuacaggcaggugaaccaaggcccaggcuggcugggacuuguuggggcagggauaagagcugucaccuaaaccugcuucugccuugagcccugugcauaaggucaagugagugcagcugcugggagagaugaggagguagauuugguauccauggcuuagggacagagaugaccucuccccaugggccccuuaucuuucagaguaccuggacccagagcugcucuguauggcugcacaggcugcacacugcauaacuccuggggccuccaguugcacaguuugguggaugacaccuccaugaauugugcaaugcuguaccccugccuauccaacuuccccaaagucagcugccugaugggaaagaugcugaggucagaggucagggagccuaaggccccaggcugagggagaagggugacugggcaugguccgagaucugaugcuccgccagguuccuggguccugucuagaggagagagagcaggcagggaaucugccauuccaugggaaacaugcccccuucagaccuucuacccacagagcuccaugccacagcuuggcuacaggccaaucucaagcccagcuauaacccaaaguuucuuaucacagucacccccaaacucuaaacuuagccccugauccuucccuaauccugcuccucaagaugcuuauccuccagccagcacaggggaaggggucgaugcugcugaagggccucccuucugcuugggcuggcuaugccuucagagacaggaacugcucuuaggggugggaggcagggagagagucaggcccugcccugggagguuucugggaggaaaaagcuacugcuguuccagcucccaagcaugcccaggccagucacccacccccaaauggcagcccgucuguggcauggggugguagggacagccaaagacaggcuugaggcgagacaggcaaggaguuguagaggaagcagagguggaggcaggcccugcuggguggggagccaccguggaggccuggccuuagcucacugaugagaauuagcuaagccuggaaaguuuucucuguggcacuguaccugggguccagaccuagggggaaggggauguggagguucaggaggguccaggcuggcugugcagaugccucagugagauuuaggggagcccccacaggcuuucagcugaggcagggcagguuggccccaagaccagguaggaaagucuccccucuuccauuuuaugcuuuccacacccucgcauccuaguccuucucuucucuuuggggucugaaggauccagguggggugggggauauggguuggggguccuacaggagaauugccuaggccaggcccuugggugagacccuggguagguuaagggaacccagcaguuuggagagagggccaggcccccuuuaauccucacuuccagccacacacagcccugccaaccaauccuggaagaauccaauccuaugucugcagccuaggcccucaccuggccucuuccggccaaccacauccagcuuugcccccugaggccucaccuggccccucagcucuggccggcaccccgcaguugcugguccagccugcagagcuggugcaggaagccucgguuggggaagacccaucggugcugccucacggugaucaccgccuggcgcagggacagccgcuggugcagcaugagguaggccaggaccagcguggcagagcggcucacgcccaccacacagugcaccaggaccuuggcugaggaagacauccuggugaaaaacccugucccacacaccggcccacccacgggcugggauggggacccaaguuccuuuccugacccugccuugggugcacucugugauccugagcaagucacucagccuuuauggaccucaguuuccugaucgguaaaauggguagaucaacaccuguucugccuacccuugggauaggguccgaauuucuuuuuucuuuucuuucuuuucuuuuuuuuuuuuuuuuuuuuaguagagacaaagucucacuauguugcccaggcuggucuugaacuccugaacuuaagugauucucccaccuuggccucccaaaguguugggauuacaggcgugagacaccgcuccuggccuccaaaccuuuuuaacacuucaagagcuggccccugucgccucaucucagauugucccucccccaccuucagcucgagaaacauggaggaacuugcaguuccuugaggcugccaugguuucugaccuccagccuuaccacaugcuauuccaaauaccugcaaauuguuuccccuggucucggucugacuaacuuccacuacucauccaccagguuuuggcugagacacggcuuccuccacaggcuuucuugaccgcucaaaguauugcuugaaucacaaagcagcucaucuuuuuugcauauuacccauggauaccuuuguagagggaaguccccccaccuucccgauccucugggcuuagcacccccgccgugugcucccagagcccuccacacuggcccacucuuaugaguagcucucacuauacuauucgcaauuuggcugucuuuccaccaguuccaagagggcagggauccugcuucuuaaagucuggauucccaguauuuagcucagugccaggcacguaguggauacucaguaaauagcuggugaaugaauggauaaauagcaaaagaaugucaaaguguguuggauacuaaaaagucaugugagcuguaaucuugucauuccugucacauagaugaggaaacugaaguccagaaagggacacuggcuugcccagggucacacagugagggacacagcugucuucuaggauggacacaaagccaggacaccagccucccugggcuccuaugcuguauccugaguauuugaagauauauuucuuuucuaguuaaaaguacuuugggggccgggugcgguggcucaugccuauaaucccagcacuuugggaggccgaggcagacagaucacuugagguuaggaguucgagaccagccucgccaacauggugaaacccugucucugcuaaaauacaaaaauuagccggguaugguggcggaugccuguagucccagcuacuugggaggcugagacacgaaaauugcuugaagcccagaggcagagguugaacccaggaggcggaggagcagagaucgcgccacugcacuccagcuuggguagcacugagacucugucucagaaaaaaaaaaaaaaggagaaaaaaaguacuuuggggcagacaucuagguaccaaauggugcuuucccaaaguugaguguugcagagaaagagcuguucugcuguuugggagaaauggcuuucagccucaggguugcuccuaacucauggcaugaccuuguauuccaggccucaguuuccccaucugggaaggaaucggguucgacaaaaugcuggagcacuaagcagaggacuuuuuuuuggcggggggggauggaguuucgcccuuuugcccaggcuagagugaaguggcaugaucucggcucacugcaaccuccgccccccauguucaagcaauucuccugccucagccuccagaguagcugagauuauaggugggugccaccaugcccggcuaauauuuguauuuuuaguagagacgagguuucaccguguuggccaggcuggucuugaacuccugaccucaggcgauccacccaccucggccucccaaagugcuaggauuacaagcaugagccaccacacacggccuaagcagaggauuuuuaaaaagcagggaugggagggcacugaugacugagaggaaaugaggcauccuccccaugaaugagcaagaugggauaugggcuuggaccccaaguccuacccccaggcguguugagggcacgguggaugaagucagccgcagaggagaaguaggcacugaugucaaaaucagggaggucgugggcuggcacccccagguagcucacacugcugccguagaagucagggccgcccugacaguagaggcccuugugggcggcguucagcacgugggugaugcccagcuuccacagcucaaagcgguuguuugccguggcccuggggagggcaggaagggcacuugaugccggccaagccaugggaccaggagggaggcugugccuggcccccugcugcagagggaccgagccauuaggguccaaagagaguccaaccccagcaagcuccaaguggggucugacuccacagcccuauacccagagccccgcacuuucugguggcugagccggcggugugugugucgggggaucuuuagacccucuuugcuuccucaaugcaucugucccugccuuggccaggacaggaaggaagggauugcuucagcccuggaaccuggcugccccucccuucuugccccauguccucccacgcauauccguccucuacuggcuaccaccucauaccugcuucuaaccuacaaauguuuagaggcaacaccuucucugauucaccuucagucaggcuucuccaccgucuguauccagaggagggaggcugggcccagaaacagggggcucucugucuaccuuaucucaugccccaaauacuauuuccugggccucugccucuacacuugacaguuguccuggaaauguuuccuggaacuccugggagacucccugcuuucaggcaggcgaagucccugcucucccugguggccauaccuggucacugcacugaccucagcacccccggggguccuggagaaggucccuggccugggauggucagagcagagcuauuucuccuuguuuccacccuccugugucugguaaagcgaccaagaacugccucuccacguccccacccccaugccccuuggccagcuaccacucacgcaucuccuaugaaaagguugggccaaacuucguccacacggcugcaagaagacuucccugcccgcaggagcuccuccagcuccaggaugcuggggcaaggcguggcuuuguccucuccccccagcucugggagagaggucucagccaugggccagcccgcccaccccucugccucuguggucacuccucucugccucuccagugucauuucuccuucccagagauugacagggacaggugacagaagcaagugacucagcaagucacaggggccucuggaguggacaagaccuuuuccuccccaagccuccccccacccccaaacuccaugagaacacagaaucagagagaccucugcaagucagcuaccacccugaaccucaguuucuucaucuguaaaguaaggauaaucacaccuaccucagagaauuugaggauuagaugaaacaaaggacaugcugggucugacacauaguaggugcuuagaaacaucuguggaauuaguagauguagagcccugccuaaggcuauuagguucugaggacugaguuaaaguagagauccagggugcagaggagguggcugguuccaaggaugaaugauagaaagaacugaaagaaguguacagucuaggugggccacaaauugggcaggagcuggauuggaugucuguuggaugagucucugaauuacggaggucagggacaguuuucugaguuguagagucagagaaauauggguaagagacauggagagcuuccuuuaaagggugcccacaagauucauggggggagggggaagguguuuuuuuuuguuuuguuuuguuuagacagggucucacucugucacccaggcuggagugcaguggcaucaucuuggcucacugccacuaccaccucccagguucaagugauucuccugcuuuagcuuccugaguagcuaggauuacaggcaugugccaccaugccacacuaauuuuuguguuuuuaguagagaugggguuuugccauguuggucugacuggucuugaacuccuaccucaagugaucagccugccucggccucccaaaguacugggauuacaggugugagccgccgugccgggccaauggggcaagguuugaacaaugguccuguagugaagauggcuaacuucucagaagagaaggcugaagagggccuuguaugucaaauggggagacgggaggugaguguugcccuagacuuugagagccaaaggggcuaacugucaucagaaacagugggagggagauuccucugccuauaagggcuuugggucccaaaauagaaacugagaaaggucaaccuguccuucugccagagcugguuaucagcaagagagaugagaugucucacccucucucaugugacuucucaguggcccuaauggagcugggaaggguaugagcugcaguggggagguucccagcugcccuuggccuuaagaccaguuugaagggaaaggccacaccagggcaucccauggaagcagucuacacucaugucuaucccauucagaaccauugaagucggcccggcacuguguggggaggcaagaccaaggaggggcucguguccagguuacagcuggguuuggacuugguuuaugccaaugcuagaccuggcuugggaggagaccuucccucaggguggugcagcaugguggagugaggaaaauacaggaucugauguuagagagauuuggguuggaauaucaguuugcaauaugucaggcaguauguuucuuuacuuuucugugcuauaggaucccccuugcagaauuagcacuaggauuuuuuuuuugagauggaguuugcucuugucgcccaggcuggagugccauggcgugaucucggcucauugcaaccuccauuucccggguucaagcgauucuccugccucagccucccgaguagcugggauuacagguaugcaccaccacgcccggcuaauuuuuguauuuuuaguacagacgagguuuccccaugcuggccaggcuggucucgaacuccugaccucaggugaucccgccucagccucccaaagugcugggauuacagacgugagccuccgcucccggccuuagcacaaggauuaaaugagauguuuauauggcguuuggcauagacacugucaaagaguaaaugggcaauaaauuauaacaaugaucauugggggcuggcuauuggagaagagcuggcucucuccagaggaauucggauuaccuccuucuaggcccuaaccccauuuacugaucccacaggccccgccccggcuccgcuagccccgcuuccuccugucgcuuuggccuccggcaugacgcaugcgcccucgggcuccuccgcggcagcaucucgguucuccucucgggcccaucuggagccucgcgucuuuuccagugugggccccgcccccugccgguagaaccccguccccggccgguagggccccgccucccgaagcaguuccgguucggcuccgagcagcugccggcgcggcggugacggcggccgggacgaugccugcgcgcagucgccaccgcccccgccuccacuccggcuccccgccccgggcuccgcccccgccgcuugaggcgcuucacuccggcgaggcggggagggccccggacuccgacggcggcucggacgccgacucggagguggguccggggagcccgacucggaccgcggaggugagcgggagcugaggcugaggagaggggagcuuggggggcgccugcugccaagggugaguggggagucugggauggagccgggggcugccgagggaccgcgaccuggaggggccccggggagacgguugagggaaccgggauagucagcucuggaauggaaucugaagcaaauggagguugucgaacugagggccugaaggcugagggauaaguggaggccgaggaacgagagggagagagcgagagggggaggcuugaagagcccagagcuugggggcuuuugaaagcugcgcagugggggaaaaagaucgaagguccugcgggaauguggacccggaagaagagaugcucuggguuuggcagcggggaugaggagucagaggagcaagaccugggccgguguucccuucccagggcgagggagggcgaucggggcugggacuggagcccucucaugggguucuccucuuacggagcccucuuauccgccucccaccccggguggggcugguggug

SEQ ID NO: 17463 - RNA, 5147 nt, Homo sapiens
aggugugaagcuuacacucucugcucugguagaugggaagagcauuaaugcuggaggccacaagguugggcucgcccuggaguuggaggcuuaauccagcugaaagaaaccuuugggaauggauaucagaagauuuggccuuaauauauuuccauugugaccagcagcaggcuuuuuucccccaagaagaugaucaaaacaaaggaugaucucaacaagagcuguauuuuaaguauuuagacaguucuuuguuagcugguuucuaguugguuaucuaguuaccaaugcugcaguccugcagucaccuauacauuauuuaaauguauuuaacuguuaaaugcgcuacccaccaauaaugaaauagaccuuuaugaaaacugugcaauugugugcauguuuguuuuuauguuccuuuagaaaacauugacuguuaccauugaaugagauggaucaguggauauuaagaugagguuacaaauuuuguuaaguucagccauuauuacuuuugguaucccagaacaugacaaauuaugaauaaaacaaguauacauaauuaauggcuccaaguauuugcggaguuccacguuugccagcuaggaucaaauccccgugguagcuagccaauacuugauuuuuccagugaguauuuugcucuguaccuaaaucugugccacagaaucuucugugucccuagauuccacgagcuuuuuaagacuacaauaagaggauacaugcuuuuacacuuuuacaugcacaguuuguaagucugugcagaauugcccugcaucauugaaaggaaaaagagaaggugcugaaaaguuacacaaacacaccauaccccugugagcuacugcuaggaacauaaaguaggcccugguuuggugagaugguguuaagcauacagaagaggaguaagguguagacagugaggguaaccugagggacugugagaggucauuacucauuuccuucuaggcagacacacugaaagguggguauagguaggagaccagagacaaccccuuuaggcugcguggcauuggccuucaucugggcaugaaugagacauuaauaggugguucuggcuggaaaaguagguaagaguacguuuucugaugggagaagauaauuggauaugauuaaagguuggagaagauuuguucaacaaaucuguaauagaccugaagaaugguagaaccugagugauaagaaauggguaagaaaauggaaggacuuaucacccaagaaaugauacaugcuacaaacuuccagguugagaagaagcuggugagagaccagagcucaagcaagcucuccacacaggaggguugggggcaugaagaccccucuggucccacuauuccuaggggacuggcuugaauggcccaugugaaucaugguucucuggaaggcccucuccagacagacaugacuuaagugacagaggguuagaauuugagccagcuugagucagguaagaggagaaacaugaaaagauguccaugcaggcuaggccugaaagcaacuccagcagugugaaguagacccgcaggcaacuaaccacugcuggugguccuucaaagagaaaaacccuagucauggggacugcugccccuuagcuaauggguggcccuuuauugggcaguggcuacaguaauuuggacugagguguggcacgagugaguuaacuguuuugucaaggauuuccuuagaguaaauugaaccuauucacccacaugcauccuaauaugcuuuuaugaguuagaaaaggguagguuuccagccguggucuugcguaguguccaaaaugcaaaguuugucccaggagcugugagcucguguggcuuuuuuuuuuuuuuuuuuuugagacggagucucacuucguugcucaggcuggagugcaguggugcggucucggcucacugcaaccuccgucucccggguucaagcaauucugccucagccucccgaguagcugggauuacaagcguguaucaccacaccugucuaauuucuguauuuuuaguagcgaccggauuucaccauguugaccaggcuggucucgaacuccugaccucaaaugauccaccugccucagccucccaaagugcugggauuacaggcgugagccacugugcccagccucauguggcucuuuuagcucugcuuccaucagucuccagggacacuucccaccaccgaggcuuaccagguaguggcaaaagcugcuugaauuccaggcuaaugccacuuaugccugaggcagugucaguggaaagaauuugaccaucugccaguggagauaagaucugugagguuggggagauuuaaauaagcagagcaccugggucgaaggugcuccaugaggccugguuccuucuccaccuccccucauaggcagaugguucaggaaagccugaaguucucuucauccucuagggaguguaguaacaacugcuguaccuauaggcuugucugcuucacgccucccuggccagugaucccccucacuuaagaauuucaaggagacggcaggauacucaagucaaccccacggcaggauacucaagucaaccccgagguccucagguccaggccaacuggccuggcucuuagaggugauguucccccaccagggccuccacuggagaggugaggcuggggagcugacugugcugugaagacaugagcaagccgccagcagaacuggcaucaccuacaaaagcacacaagugacacccgugguccccugcaauccucuuucauguugucagacaccagacguggcucucuaccagucccagcugcucagaaccagagcuucgccugcccugagggagagauguaggaggcagacaagcccgaggugcuggggucucuggccauuacacguggccaggccaguuaaaacuuuauaaccugccuccugccagcuggagguuccugcaguugggccacagaccuggcgccagggaggggacgaaucucaaggccccuuucacugaaggcaggagcugucugugcugggccuucccucccuuccccauccagcgccacacacggaggcucaggaggucgugugucccagccccacuuuauuuucgaauuuaaaacucagggucaauuccugggguucccaggcaacccucccucgagcccacucacuaggggccagcccuagaucuugaaggccaaggugaguccaucgcccaggggcaggaggcugauguagacccugacgucccgccggaugcguucguuuagguuucgcacacacucggccgccacguccccuuucggagguugcagcaccuucccgcgccacaggaccugcgggagggcggggccaaccgggccgugggaggcggggcuucggagggaggugcucgggcggaaggcgggggacugggagggaggugcccgggcgggaggcggggucuuggagggaggugcccagacggaaggcggggucucggagggaggugucugggcgggaggcggggccucggagggaggugcccgggcaggaggugaccagagcuggagacagaaccaaagcggaggaaagccuggguaccggggccggagccccggaggggguguagccuacgugacuggacuggguggggcuuugggguauaagaggagucaagggaaaagauggggacccggcccgacagggugcuuucuccucccccgcaguggaucccuuacucugaggacggcgaggaugccuccgggucgcagcagcugcaggcagcgcucguaguaggcggagcaguucuccuuguccgcauccaccacggccacgucgaaggugccggccucgcccgccgccagcagcucgucuugcggggggagggagggcaggugcggcugaguccgcggccccggcggcccugaggccccucccaggccggcccgggcucugugacaaccggcccugcccuuaaccugcccggcaggcccagucacagcucggccacacagcagccucguuugcaaugaauggcuucaaagcccuucccgcuucggugcucacccagggucuccaaggcgggcuucagccggaggucgaucuugugcuccgccucggccugcggagggagcgggucagccguugcgcccccgccuggggcugcagagcuaggcgcgggcgcucaccugccuccacaggggccgucccagcuccgggggcugcgcguccaccucgcaggucaccacgcgcccguccgcgggcagcgccagggccagggccagggcggaguagcccgugaaggugccugggaccaggacacagacgggcucagcccagagugggggucggcccggaaaccucggcccuccgggaucccggccgcgugccccuacccagguccagcgccuucuuggccuggaugagccgcgccagguuggccaagagcugggccugcucgcaggucaucauagaaucccccugcggcugcuccagggucagcugcgugaaaggagaggguggcaccagccaugcaggucacccaccuucgcccugggggucccaagccccaggggcgcgguucugggcguggccugggggacuggcccuucggaacgcccaccgcacccggcccagggaagccggaagcccagggagggccagggcccagcccaaggucacacagccacgugggacccgcaggggucgagagggacgcccguuuccgucccgcgcccugcugaccagccucaggcuucgcagcgccgggugcucccgcauggagcggcucagaagauacugccacaggcggcuguccucggggggaagcaggcacugcucucgccggccucgccauggggggcaccgccucccugacggggagaggguguuggauuaaccugagccacgccgcgcccuacucugcgcccgcccacccgcccgccgggaccagguccugcucacccaggaagaggccaguggcgaaggcggcgcccagugcggcugagcccagggccagcgcggcgggcacggagagccggggcaccggcugggucauggcgcgggcaggaggcggcgggaggcagugacaggucacgugagcuggagcuccugggacaggucucggacucgcgggcccgccgggcuccaccuugucggggcacuacccgcg

SEQ ID NO: 17464 - RNA, 16380 nt, Homo sapiens
ccgacagggugcuuucuccucccccgcaguggaucccuuacucugaggacggcgaggaugccuccgggucgcagcagcugcaggcagcgcucguaguaggcggagcaguucuccuuguccgcauccaccacggccacgucgaaggugccggccucgcccgccgccagcagcucgucuugcggggggagggagggcaggugcggcugaguccgcggccccggcggcccugaggccccucccaggccggcccgggcucugugacaaccggcccugcccuuaaccugcccggcaggcccagucacagcucggccacacagcagccucguuugcaaugaauggcuucaaagcccuucccgcuucggugcucacccagggucuccaaggcgggcuucagccggaggucgaucuugugcuccgccucggccugcggagggagcgggucagccguugcgcccccgccuggggcugcagagcuaggcgcgggcgcucaccugccuccacaggggccgucccagcuccgggggcugcgcguccaccucgcaggucaccacgcgcccguccgcgggcagcgccagggccagggccagggcggaguagcccgugaaggugccugggaccaggacacagacgggcucagcccagagugggggucggcccggaaaccucggcccuccgggaucccggccgcgugccccuacccagguccagcgccuucuuggccuggaugagccgcgccagguuggccaagagcugggccugcucgcaggucaucauagaaucccccugcggcugcuccagggucagcugcgugaaaggagaggguggcaccagccaugcaggucacccaccuucgcccugggggucccaagccccaggggcgcgguucugggcguggccugggggacuggcccuucggaacgcccaccgcacccggcccagggaagccggaagcccagggagggccagggcccagcccaaggucacacagccacgugggacccgcaggggucgagagggacgcccguuuccgucccgcgcccugcugaccagccucaggcuucgcagcgccgggugcucccgcauggagcggcucagaagauacugccacaggcggcuguccucggggggaagcaggcacugcucucgccggccucgccauggggggcaccgccucccugacggggagaggguguuggauuaaccugagccacgccgcgcccuacucugcgcccgcccacccgcccgccgggaccagguccugcucacccaggaagaggccaguggcgaaggcggcgcccagugcggcugagcccagggccagcgcggcgggcacggagagccggggcaccggcugggucauggcgcgggcaggaggcggcgggaggcagugacaggucacgugagcuggagcuccugggacaggucucggacucgcgggcccgccgggcuccaccuugucggggcacuacccgcggagccgcggucucgggcaucaucuggcggccacacagccuuacugcaagccccgcccgagagagccgggcgcgaucugguggccgcgccgggaacugcgccccugcggggagcaggccaagcgccuagaucugaauuuucccgccugugcccgcaguccaggugccugccuccauuccccuccugccaaugcuuuuuucuccucgccaccauuuauucugaggccccuugggggcauaugugaauuguguauggagggcgccaguguaaguuacaagauagucacaaguacaagagauagagauuaaagggggaaggccuccuggacaagaugccccaaagcaucaggcugaaggagugagggaacugguuugagggcaugcagccucgaauugggguucaggagcccuggggugggccuguggaacugagaccauauucuuagcuguuaaaauccugcuuuugggggccagauggauacgagugucuaaucuugguccugccagucucucugagccucaguuuccuuccuguaaaaugaggccuacaaucuuaccauaaaaggcaccagaucccacagcuucgcacacaguagcacaauacauaaguggcagcugcuguuauguugguagguuggaaugaagacaucuuggggagaaagccggugaagcucccuugcaagguuguucuguugaaacacuguccagagaacacugauugaaccccuaccaugcgccaaacuccggaggaggugaaagacgcugacgcuguccuuuuuuuuuuuuuuuuugagacugagucucgcucugucacccaggcuggagugcaguggcacaaucuggucucacugcaaccuccaccuccugauucaagcgauucuccugccucagacucuggaguagcugggacuacaggcacgcaccccuacacccaacuaauuuuuguauuuuuuguagagacggguuuugcuauuuuggccaggcuggugucagacuccuggccucaagugaucuguuugccucguccuuccaaagugcugggauuacaggccugagccauugugccuggcguugguguucuuuuuuuuuuuuuuggcaaggucucuggcaaggcugaagugcaguggcaagauuacugcuuauugcagcaucgagcucccaggcucagcaauccucuugccucagccucccaaguagcugggaccacaggcggucaccacugugcccagcuaauuuaaaaaaaaaaauuuuuuuuuuaaagagaaggggucuuacuauguuguccaggcuggucucgaacuccuggcuuuaagugauccuccugccucagccucccaaagugcugggauuacaggugugagcccccgugccuggccucugguugguauucuuagugaagcugguuucagagaugcaggucacacacagcuggcggguggccuaagcuucacgacuucugccucugugaaauggcguuaugaauagucccaaccuccuaggggaccaaaugagaaaauccaggcugaggacuuacacaggggaccaaaugagaaaauccuggcacuuagugagcugucauguuaccuuuaaaaggagucaaaguccgaagggcagccgguuaucuuccugcugcacugcagauguccccugggguggaggcuguaagagccuuuuuuuuuuuuuuuuuuuuuuuuugagauggagucuugcucugucguccaggcuggagcccaguggcgcgaucucagcucacugcaaccuccgccucccagguucaagcgauucuccugccucagccuccugaguagcugggacuacaagcgccagccaccaugccuggcuaauuuuuguacuuuuaguagagacgggguuucaccauauuggccaggcuguucucgaacuccugaccaugugauccgcccgccucggccucccaaagugcugggauuacaggcgugagccaccgcacccggccaagaauccauuuuaacaacgcugacuaggcauugagcuccacuggggggcuucccaggcgggggcucaaccugagcgaggcccagaggccagcuuguugaguaguuaaugagagaguggcuuggcugaggaugaaggccagaaacuugcaguuucuugaucugagcugcaggaaccuugggccuagcggaagcgaggaaggaggaggcggagcucuggggugaggcuacgggccggccucuaaucagagacaggguggggcugguucuuugaccaaccagccggcagcccccgaagcacauggcugugugggggcagaaccugcugucuccgugcaugcgugcccuuucggcccuccugggacuugccuccgggcuagcagcacugcucgaggacaagcuccuugcccuuuacucuuugacccucuacgucccgcuuggccucuaacuugaccgugaaucucauucugcggguaaggacugaggcugcuggucucuccuucccaggccugagcauacagcaggcgcuaaauaaaugcucuugacuagaguucuggcgcugccuggcgcuccuugcugccaggaguaaaaauaguaacagcagggccccuuuauugaggaccugccgggcaccaggcacaaugcauccaggauccgggggcggcugugaucuuguucccauuuuccagagcaggaaagcucagagaccaccgcccagacccugcagccaacagaggaaacgcgcguaccucucccuugaacccugggacccagagggaacaggccuucuuggcuccucugcugggacgagggcccagcucgagcuggccugagggcccugcgcucagguggugccgcugaccgcucucucccuucagcccggggguccagguugcagcaggcccccagcucacacugaaacucccuccuacagccuggcuuuaggccggagcgguggagguugagggggagcggguggggaggggaggcaugucaccaucuauccccgucagauuaaaaaacuaauuugaaaagauuaauguauuccauucuuguuacgcuggcucugauaccucugggccggcggccgcucugcuuccugauuauugaauuuuuauggccugguaauuaauugcagauucccuguuuuguucuauuucuuuuucucugacauuuuaauuucaacaaaaagcaguggucuccaugcagguucucucuggagauccuaauggucuauaaaacagaaugacuuauagacguggcacccacuucaguuggcgagcgauuguuugaaaccuugcugaugacgcagaauuuaauuuuuccacccccuccccuuuuugcuacucauuucuugucucuugcauggcggcaccaguaucucagcucaccaggaagggagcaaagugucgccuccgaaucuguucuagggcuuuuuccuagaagccugggggcugaagacagaguggguuuugauucuucuccaggcagugggccugguagaggguggggggagcugagccuccccaaagggccuuguggaugugggcagcagcccccaggggagggaaugggcaggggaggucauuuccaccugucucaggugcguuuuggccaaaugccauugccccauuaagcaccaaggaaccugaagccucaucagggcagagaaaaugggcaucagcaccugcacuuaggcccccaccaggcagagagggggcaggcugaguagacugauacagacagacgcagauagccugacagucuuagcugaacugggucacugggaacagcucuccacacaaacaggucuggaacagaccccugaguuuccauccuacuggucccacuccuauuucucauagcccugcuagcaucacacaggcugggcgcugucgcccgagaucccccgggacugagcagggcaggaggcagaagguaaggucguagaaucaauccuaagggauuggaguucagauguuuuuuggggccaggcaggugaaguaagcagggcaaggugauagggggugguggguacuggagcacuccagagcucacccuccaccaggggacaugguggccacuuggcuuuagccuuggaugccaagugggaagaugggcccaguauggccagagcuuccgauuccccaacagagguuggcaauauggcuuucagugugaaacuucacaauuuuaaacaucgggguguguguguguauguguuuaaacacuguuggccaaacugaacacauauuugagcuucaugucugcucuggcucaugaggcaccaguuuccucugacucugagcaugaaugagagaaguuagggcuugaaguggaguccccuagagugagaagggccucaguggccagcagaccaccgccgaugucugggugaggucuacugggcuccccaaggaggacaguaccuuuuaccuaagacgucgggaggcagggcuguaacuccaggggcuuuaggacgguucaggccaagugcacugacacagguagacacagacagauggcgacuugggggcuccuggggcuccucacaugagcugggagcaugacggggccacaaccuggucccaccuccucugugcugagauccuggggagcugacccuggcagcgccccuagugacucacuuuccucaucuggagaggcugaaugggaaagcuacagcaugggcuuuagaacagauggacuuggguucaaacaucugccccaccacucacuuugcagcugaguaagcucagaguuucugagaaacucuagaaaacuaggaaaugggcaugaaccuucugucuucguuuuccauugcuguacagcaaacugccacaaaguuaguaguuuaaaacaacacccacuuguuaucucgcagagcguaggucagaagucugacaaggccggguuggauucucugcucagggucucaccagguucaagacaaaguucuccccuggggcuguggggccucugccaagcucaccaguuguuggcaaaauucaguuccuucucuugaaaccuuuccaucuucaaggccagcagaggcaccuggcaucuuucuggugcucccaauugcugucuuccucuuuugcuuuuuuuuuuuuuuugagauggaguugcgcucuguugcccaggcuggagugcaguggugugaucuuggcucacugcaagcucugccucccggguucacaccuuauccugccucagccuccugaguagcugggacuaccggcgccugccaccacgcccagcuaauuuuuuuguauuuuuaguagagacgggguuucaccguguuagccaggauggucuugaucuccugaccucgucaucugccugccucggccucccaaagugaugggauuacaggcgugagccaccgcgcccggccuuuuuuuuuuuuuuuugagacugugucucugucacccaggcuggagugcaguggcacaaucucagcucacugcgaccucugccucccagguuccagugauucuccugcuucagccuccugaguagcugggauuacaggcaugcgccgccaugcccagcuaacuuuuuauuauuaguagggauggggcuucaccauauuggccaggcuggucucgaacuccugacuucaggugauccacccaccuuggccuccaaaagugauagcauuacaggcgugagccacggcaccuggccccucuuuugcuuuuaagggcuccugugauuacauugggcccacucagauaauccaggauaaucucccuauuuuaagagagcugccuaguaaacuugguuauaucuuugaagucccauaccuguaaccccagcacuuugggaggccaaggugggaggaucacuugaggccaggaguuagugucuagccugggcagcauagugagaccccuucucuacaaaacaauuuuaaaaaaaauagccagguuuaguggugcauacuuguagucccaacuacucaagagggugaggugggaggauugcuugagccugggaagugaagugggaggauuguuugagccugggaggucgaggcugcagugagcuguggcuacaccacuacacucaagccugggugacagagcgagacccugucucaaaaaacaaaaaacaggccaggugcaguggcucaugccuguaaucccagcacguugggaggcuaaagcacauggaucacuugugcucagaaguucgagaccagccugggcaacauggcgaaaccugucucuacuaaaaauacaaaaauuagccaaucgugguggugcacgccuguaaucccaguuacucgggaugcugaggcaucagaauugcuuggacccaggaggcagagguugcagugagccgaaauggugccacugcacuccucccugggcgacagagugagacaaugucucaaacaaaacaaaauaaccaaacaacacaaacaagggagugacauugguggcagagauuauggggucaaaauacugccugccccagccucuaacugcuugggaugauuggaagggugaaaaugcaccaccuccaucccgucccccauccuugagaagugcugguauuagacauuuaaauacaugguccuugcuccugcauaaugcacuggguggugggacuguuccucucagcaacucucuaagggagcuagcauggucuccaucuuccagaugugcacaccaagaucccagccaucaaggaacauagguggcagagccaauaugugaaacugucucugucucagcuucacauaaaggcuugucaucucaccaugggcccaaguccagggcuccugaauccuuuggaaauuuaguccuucugggaggcauccaccauguaccagcaauguacaugugaugcagcuucucugguucaauucuguccuggcacguagguguuaauaggaguccccaguggauggcuuacauguguguguuuucugguugugcuguuuuuuuccuuucuuaccuggagguggccagggcugcauaucacggccacucuuggguaucguugcuucugccggacaccucagcugauucucaggcaccuuccagugguggagacuucauggggcucuuugaaaauuaacaaagaaagucuuacagcucuguuuuuguuuguuuguuuguuuguuuguuuguuuuuuucccagauggagucucccucuguugcccaggguggagugcaaagguaccaucucugcucacugcaaccucugccuucuggguucaggcgaauucucuugccucagccuuccgaguagcugggauuacaggugccugcuaccacgcccggcuaauuuuuguauuuuuaguagagaugggguuucaccauguuggccaggcuggccuugaacuccugaccucaagugauccuccugccuugaccucccaaagugcuggaauuaccggcaugagccaccaugcucggcccccuugcagcacuuaucucuccacauugagacacgggacuacauugugagucccuccuucccccaaaagaagauaaacacacuuugcagacuccccugcaggcacaugaccuagcuuccaccgaucagaugcacaagacuuggaagcaaguaaacgugggcaaggugagcuagcugggcguggaggagagugaucucccggcaagcagguaugacgcggugcaggugccuguuuccacugggguggcugugguggagccucuaccaagaggcaggcuguggcgguagcuguguuguaguuaggacaguccuguggugagauuggguggggcuccccggcuguauuguuccugguaguggaucauccaagccugcuucucuggucuucccagagucugcuguuuguaacaaagugaacuugcuguuuguaacaaagugaauucuguuguuugcaacaaaguagaaucuguccuuuaccacugaguggcuucuguggcuuauaauuaaaagcccugcccgguccacucccauugauagaacucacuggaguccuggaccuccagcccacacuguuacuguucagcucggagccauuccuccuccugccuugccaacaugggccugauauuguuuaagcagcaacaugugcaacucugugggggaacuaugaucagucucaggcugccauaaccauccuaguccuuuucccaggauacuacuuucuuacccacauaguugcuaggggugacugugugguucguuccuggccacagauaaaggggggcuucucaggacauuuuucuuucugauaauaagaaauccucuuuuccugcuuagucucuucuuaccuugaauggaguuguauaaagaugaaaugcuugcagccauagcagccauuuuguggccaugaggcaacaaaguuaaggauuaacaacaaacaaacaaaaaacaccagugaggauggcaagaggaaauacgguuuauugguucucaaagacauugucaagcccuugaaccaacaucagcagcaucuaccuccacacucuguucuaggagaaaauggagcccuuuguguuuaaggaaugauuaacuguauacauauccuuuuaguuaaggcucagagcuguccuaacuuauuccaguccccaggcaguguggcucaugcccacagggaugguuuagaguuggugcuggauaacccuguuugcuuuuucuucaggcuagaguggcagauuccacaaugaacuuuggaaucgugcccugcaugagugaggccuccauuuccucaggagugaguuugcccaguccccuugcagacagauuuauggcaagccagucccuccccucccugagaaacccaauugccagcccugggcagcccacccucacccuauggcaggcccguggggucucauggccccucuggaucucccugugggugagaugagauccccacauucugcaggugaggcccuggcggagaagugacuuauccaaagucccacgggcaggguguaggggcuggcuccaguuuuguaggauccaagcuugggggucccacuccaguaggagucucucuauuugccccagggccagggucacagggacuucugggacaguggaugaccagguggagugggcgcuuccgggcagcaagcugaagcgggcuugaggaagccuguguucuccugggccugagaaacagguuucuguugcaacagugcuguaacagcccuggaccucaguggcuuccaaaauaaucauuuacuuucucucuccugguucaggagucagcuggcaugguuuugcuucaaguuguggguccagaucauuugggaagcagcagagaccuggggaugcucuugccuggugggcagcacaagcacgagaggugcaccacacaggugcguugaaagccccugcccgugccaagucugcugaaguuccauuggccaaagccacucacuuggccaagccuguaguaucaggguaagugaguguguucuacccgcucugugggguggcccugcaaggccaccuguguaauccuauuacagguggaugagugaaaggucaggaugaacaauccaaucuaacaggucccacaugcuccacagugaccccaaagccacaguaacacucuaaccccaccuacaccacugggcaggaucuccucagggcaggggggcgggggugcugccucacgcaggagcugccuucaggucuggcuggccccagggccucugcagauccauucuugcucaauuccuaagaguucaggguuucccaucuugccucccaucagcucugggaagccaaagacuccgucuguuucucagaggaagaacuugaaguucagggagccaggguguggcugaagauugcagggcagacucccugccucugcccaacccccacugccauccugagcccagcagggaggugcugaguggucaggcucgccucccugagcaccugccucccaggagggacacacucccagccacuugccccuuuccuccaugccacccccacgcucagccuaugcccucccugcagaaaugcagggaaaugcagccguggacugcagggugcagccugcccugcucgggggaccucucagcucuuguuugcauuuggcagccccugagcuggccuggggacagauuuuuauuugccuugcucaggguuuuauuuguuucaauggagccaacacuaaacagucagauuucacaaagaauucagauuuaauuucuauuccuuuugaaacagugaaagauuugccuacauggggcccacuuagcugcggagcaggucugcuggggcugccuggugccccaccccccaccccccaccucagauggguuaaggaccccugccccagcccccaccacucccugcugccucacacccaaacaacuucacucauuuucuauauuggucuuuaugcugcuggcauaugagcugugaccucugauuuaauccaguucccagaggcccagagaggggagacuccugucuggggucuauggccagucaggagaccuuauuucucuuucucucuucccaagaacuucaucuggaucccuccuguggacuccaacccagaggcccagucucugcuuccugcccccaguggcucaggcuaggggcuuucucuccaggcaaagcuguuuguguccuggcuuaauaaagcucccuggcauugcugccccagggguacacucacccgaggaaaaaguccagacugacaagaggcucugggagacauggggggcaggggggcucauaucucugagcuauacagcgaagcccugcagauguuuaauauuggaucguuggcugggcaugguggcucacaccuguaauccaaguacauugggaggccgaggcgggugaaucaccugaggucaggaguucaagaccauccuggccaacauggugaaacaccgucucuacuaaaaauacaaaaauuagcuagguguggugguggugcacaccugcagucccagcuacccaggaggcugaggcaggagaaucacuugaacccagaaggcacagguugcagugagucgagaucaagcuacugcaacccagccugggugacagagugagacucuguagcaagaaaaaaauaaaaauaaaaauaaaauaaaugaaauaaaaugguaucauaacagccgacacauauauuacacuuccuguguaccagccacuucuuaugaagccuuauuccccaugggacgaggcuucauauuaacccacuuacuccucaagucagcccuguaaggggggagguaccacuuuuaucccugucuuacagaggagaaagcugaagcauagagaggcuaagccacuugccccaaguugcacagcuuauaagugguagagcagggauuugaagccagguccucugguuucagggcccacaguuccuaaccacugaacuauccuggaggacaugccauccucaucaugugacuucuccucauugaguaagauagcuguuugagcucuggccuuacaccucacuccaguuuucagggaaaaggcaagggacagcacaggacucaccccuuccuuuaaggauccuugcugaauguuucacagggagcuccugcuugccucccuuugacuggcauuuagucacacagcaacaccucagccaagaaaaggucuuuauuccagugauuaugagcucaaugaaaaaaucagcucuacucuuacaggggagaauggagauggaaacuuuagcaucauugcugcauuucacggaugaagaaacuaaggcucagaggggugcaugaccugcuggaggucacgcagccaggaagaaguggagccuagaucuucugucccugggcuuuuaggagccaguggggccccaaaggcacacccugcugauuuccugggggugagaaggacugggcuuuggugcacaacccccuccccugccccaggaacaccuggggcccaggcccugccagccaaagccuccugugccuuccagcccuggcagccucucugggcccagauccgucacacuggcacccauccugccccgggccuggccugacuccauccagucugcucacaccagcauugacugugcuugggcagguuacugaagcagccucaagagcacugaauaauucaggcccacguaaugggauaaugaauuuaccgacagccugguguggucucuguacuuacauuuugagaaauacugacuccguaggcccacuggcaggcaagggagguacacaccccgagaaacuguugcgucugccuauucgugggguucaggccugacagaguggggacccaacuucggucucagugguucuuccccugcuuggggaaguggggagucuggggcagggggaggccugaguggaacuuuggggagagguggaagcagaaucccaggaguucagaaaggcagagcuugaagggagccuggcugcccuugguccugcacgcccauuucaugaacagggaaacugagguggcaggcgggacugccuaugccccuggacacuguucugugcugacaauaccagggaugacucguggcucuggggaagagaccuguguauuuuccuucuagucugcaguuaccugucccccagcugcuggggggaagggggugucacugcuaaugccccacagcugccccuucacuggagauguguccuuagccaaacgagagccaccgccacguggaaggccacgcucugccugccaaaaccugggcacacuguggcugacuuccauggugguacaagagcgggaguaacugugugacgcucucuaugcuccagaauccccggggaauaaggcuacugugggacuccagcugagaccacauuccagcuucgccuucacccccuucccuacccuacuucucucacuccccuucuccuccaaaccuccacagcagaucauuugaauggaguucggucucagagucugcuucugggaguccaccuaagaccccauauuuccuggcccaagccucccuucugagcaccgccccagagcaccaacagggcucagagccaggacuccuuggcccuggcccuggcuccacuacaugacugugaggaaaucacuggucugcccugggccucaguuuccccaucugugugauugguuggcaggaggaucuuucagggucccuuccagcucugaaguucugugacgugaccugaggugccaggaagccuucucccucccccgccuagccccacaggcacauggaauucugccacuggggcaucacuuuuuccucgaaggaguuuucacaaugcaaaagcaucugagaugagaaugagcauccaaucaggugaucacaccacagggcagaauuucucagugugggguucuuggaucaccugcaaugaguucuucaccugaagggguguuuauuauuauuauuaauuucccucuucugucucucuuuuucuuuuugagacacagcugucucccaggcuggagugcagugaugcaaucuuggcucacugcaaccuccaccucccagguucaagcaauccucccaccucagccuccugaguagcuggaacuacaggccugcaacaccaugcccagcugauuuuuguauuuuuaguagagacgggguuucaccauguuggccaggcuggucucgaacuccugaccucaagcgaucugcccaccuuggccucccaaagugcuaggauuacaggcgugacccacugcgcccagccuuccucuccuuuucuuggaugugauaccuugggcuggcugcagcagcuagcuuucaaccaugaggaaagagcauggcaugcaaacaacaagcuaagaauagugaagcagaaacauaaaaagaagcuggguuuucgcuggcauuucugaaucauugcaccaagcuugaagacccuuacuuccuauaugaaauaauuaaauaucuauauugcucaagcaagucuugguugacucuucugcuauuugcagcccaaagcauuccaaauggaaucaacuguccuuaucacacugaauuguaauagcaacccucuagggaggggauuauuauuggcucagagaaaugaagugacauaguuaaugucagcuggcaaguggcagugccucuuugggcaggagcuuuuagguugggaugauuugauuauugguaagaauuuaauuucugucuccuucauugcaucuguccuaucauagucugaccauggggcauaaccuccucccuugccauucuggucuuuggccuucucucuuucucuauccaucccacucugggucucagacuaaagacccaggaaaagccauuguggaguagaggggaggcagcaagucaccauggugcauuccucgauggacuuucccuaaugaguguggccagauucugguaccaaugacuguggagaaacccaaacccaacucagagauaauucuggccucuaaacagccccucuuucggggagguguuauagcaaaagaaagaaagagcucagggacacaaaaacagacagacagaggaaaggagggaaaaacagcaggagaaagaguagagaaggaggagggugagaagaugggagaagagaggaucucagguuagaguuugacaggccugacauugaaucucaguccagacacugacgaguaggugaccuaguaggguagggagauucgaagagguccuucagaaggcagagaauuugagagccacaguggggugagcagggggagaguaacugcuccagacccugcaacugauuccccaaacccugggugguuguuguguguguagggagcccucucugagggcugccccagauucauggggaaggcaggggcaggaauggccuuagacuagggaaaaaaaggagggccuguguccuuuuucuagcccaggugucggauacacucaugaaggcacagaaagcaccugagcuucgccuccaccgccuuugggcaguggccagagaggagccuagggaugacc

SEQ ID NO: 17465 - RNA, 5690 nt, Homo sapiens
aagaagaaguaaaacccuuuaauacaucaaauauacggaauuuuaaucuuuaaagcgauacauugucuauuauuuuaguacaugacguaaaccuuguccccuucucagcggguggacuuaaaaauuaaaaauaguuaaguguuccuuuuaaagaacaaaauaaggcaaaugagguuuuggaauagaauuuuuucuuuuucuuuuuuuuuuuguuguuuucuuccagaauacauacaaaaaaauacccauucucuucgaugguauacaccuuaaaaauaauugcaauuugaaaucagagcugacaaauugugacuuuuuuuuucauuuuuuuuguaacaaacaugcauguaaauuuguguuucaaucagacauuaaauaacguacaauacaaucauagcaauuuuaaaguaacauuaaagagaagaccucuaguucuguggcgguuuugcuuuuauuuauaaucuacaagggaugggaggguuuguuuuccacauuuuuacccucaaguuuuaaaauuuuucccaccuccuuuuuaccuacagagcucaaacuaaauaaugcacuuuugaaccaccgguccgcuuggagcuaacauaaauaaauaccaguguccaccgaugcaguccucagaugaacacuuucucaauuauuuuuuccuuuuuuuuucuauaaaaagucaaaugauauuuuuucaacuuuuauaaaguuuggguggggaggugaaaguggggagaaggggagugucccaccgggucucggucgcugcugucggguagauagauacgguauacauuucuuuccuuucguggcccgaguccuccccacgcgcgggugucagcagccugggccgugaucccgccucucccuggacuccuccccucccccucucccuccucucccucgcucgcccucccggccgcccucacugauaccccagcgccgaggcgguggucagucucuguccguagagggcguagggggaguaguacgguccgguggcggcgggcaccggcacgggggcgccaggcgugggaagcgggcucuuggaguaggggugguagcggcugcugagucccagcgcguggugggggcugcgcagcgccagcgucccagggcugcccggugcgcccgagguggggaugugcauguggcaagccauggcggccgcggcagcgcuggccagagacgacgagcugggguagcccgacagcaguuugucugucccgggaaaugccguauggguccgcaaguggcucagcagcucuucggacguggcgaagcgcuugucgcacggcccguuggccgacacccaguugcagaugugggggagugggucguuagggagcauaaagccguagggguagaggggguggccggccagggagggcgguguggcgccagcagccgcggcggccguuagcgaggagugcacaccgugcagcgggugcgugggguacaccagcggguauccggacuucagcgccgcagccgcagcagccggaucaugugcgcaagaagcgcuggcggccgccgccccugccagguggcuagcgcagugguagcugaggcaguaagggucccggcacaaacuggcugucaucacggacggcggagacgcuccggccaaagggcuggagccggccggcuuacugcagcccagagacccggccgcggccgccgccagcugcgcccccaccaggcugcccggcuugguggggucaagugccacgccguguggcaggaacuggggcggguagccggcguaggccccggccaggcugccuggguaggucauacccgcgggaggcagagggaacacugucuggcccggcuuguagggugacacgggagccaccagcccagagcccaacacugaggaggaggugggcgcgcuggggccggagccggagcuggagcccgaugaaccgccgcaguccgagcccagagccuugccucccgggcccccauccggaugcugguucacauccacauuaaucccgccgccgcagcuaauccggccgugugccagccccgugggucccccuucggccgaggcgcccccggugcccuugccaccgccgcccacgucggugucuuucuugucguccuugcccuccggggcacccccggccgaggacagcauaccucccggcgagcaggccgaggcgcuggagcucgggcugccuguccugggcgugaauggcuggcagguggcgcucgguacccggaaucccgacuucuccgacgaaacacccccgccgccgcccccgccaccgccaccgccuccaccgccgccucccggcuccuucuuauccgagccggguuuggaguacggcuugaaacucgacuuguccuccacgccgaugucgcucagcuucagggggcccgauuugguguccuugucgcccgcagcaccgccgccggcaccgcccgcgccgcccccguuggaggcaaccgaggagaguuuggaggagggcgaggggucgggcuucccgaucugcgaacauguuugcgccaacagcgccagcgggcucuucuuggcaucgagcugcggggucagacgauggggggggagcgucacacagagaaagaaguggaaacccuuuagaauccuggcuucugggguucaaaugccucuccgcaacagcccacgaagauccucccagccccaaggcgcaauucuaggcggcacccccucuucaacacccacucacaaacauucucgccguugggaaaggcagcagauugcuccccccgcccaaccaccacccccagcagcaucuuuccugcccucucugagcgcuaacuagauuuuuaaagagcaaaauguuuugguuuucgguuccuagacccagaacuguacccccuccccacaaacacuccuuaauucuucagaguaagggcucgggcggcuggcgccucagaggcugugugcacacacuggcuucugcggauacgaaggacggcgacuuuggaaccguauuucagaccuccgccugccuucggugccgagugaaggggccugggucgggguaggggcuuucauaucgaaaggagaaacaaguauuggcagccuugcucccuagcaugcacgccccauuccacuuccucccccuuuuccgcccuaguuuugagguacggaagcaguagccucuucccccauucgggagcugaaucacuccgacccccccaccuccgcccagaucccgagaaaaagaaagcccuaggguggcagccaggguaguggucccagugcgauccagagagaggguccuuaccucgauggggcugaccggcguggaaggcaggggcugcagguacucggggugcaaaauguggccaguucgugccgucagcaucuucagcaccuugauuggcaggcgguuggccuggcgcagggggucagaggggggcacggcgugcacaaaaggcuuggugcugccggccggggacgagccugggccggggccggagcuauuuccagagagcgcgcugguccaggcagggucugcaccgccgccuccgccuccgccgccgccgccgccgcugugcuuacugcuucuuagggcagaaagcgagggcgcugugcucaugacccacccgcgcgcaugggagcagcgggggggagggcuccgggaggcgcggggcgggcucggggcugcgcgcucgccccgggagcaggagcagcgggaggaggaggagcuggcgcggcggccacgggcgcccagcgcgccuucucggcgccuggagccagacgcgaguaauccuggguggcccgcagcggagccguggccgggcuagaggagccggcuggacugcgggagugccgggcggcucgcgguguccgccucgggcugcuccccugcgcugcguucucgcggccccgcgccggcgcugcgcucugcgaugcgagccgcugcguguccagccggggcucuggcgaggaaacucacuucaaaagcagcugcaccaagggggagauuaaagccuuugccgccuuccaaucaaaugggagcccgaggugauuggagggucaaggggaugugacgcgucccgcgccgccgccgccgccgcugccaggacucucagugccgguuuuaaugggcagcucccucuucgccgccccccuguguguccccucccucgauuucgcugggaggacgagauggacauuuauucuacguuugccauccgccgccucccucuuuuuuccuccucgucguucuuccuuuccccagcucgaaaauaaacugaaaccuucuuuugaaggggggugcgcgugaggaacagacugcgggggguguccagaaggagcaccggugggaguguggacaccggccggacugucaacuccaggggcgaagggaaccugcacacccaguguuuuuuccuucgcaguaaucgagaucccgcgcggcgcagcgcagccaccaggguaagaaggcaagguggggagccggagcuggaagaagcccgcccgcccgcucuaauuuccucagauuccgcggcggagaaaccagaagcuagaugggcagucgcagcggcggcggcucaacaccgcgaggagcgcugggcucuccgcccuucccggccacgugacgcccggggacgcguagauuggggcagcagcgggggucacauguuuccucuguuucacccucagucugucccccaaccccccauucuuacucucccacccuguuuuccucccucccccccuucuuugggcaucuccaccccuccaucaauugucaauguuccucgaccgcaaucaaucaguuauuugucagcucuugucaauccucccgugauuuaugucagcuuuuguugcugauuacaaggcgggugcgacuugaagggaaaaagagagagggagagagagacggagaggaaggaggagauugagagggaacuggaggaggggaaaagaggagcggccuccugggauggggguggggugggggcucuaagaaaaagaaugaaagaggcgcacggugucaggaaaaugaauagcgagaguaaagugcgcaggugcgcccagggcgccgagaggggcgcgcaggccuggagugugcgccugcccucucggugucggagagacgcccuuccaccucugggagccucggucuguuggggucgcggaguucgggcgcggcuccggguacccgagaccagcggcggcaacuucuaacacgggagauuucccgccaccccaccccgccgccgcgaguccucgcggggcguguugcgugcggaggucaggcugccacccucuguaguucccuaaccccaaacucggagacuucuaagagccacaccaccaaggaacuucuaguccuggaggucaaugguggggcaaaccucgccucaauucuuugacccccucgggucguaagcagggcuaagaggcugcgaagaagaggccuggccauggguguaugggggaagaaacaucucaggcucacucaugcccccuccccgaccuucucccaccugccgccauccccgcaggcuggggagccaggguaacucggggcugcucucucgaauuuauuggaacgccgagucggaaugagcugcgcuaggagagccgagggaaggagcgagagagggagggggcggcugccugugggaacgcggguucuuccagggaagcggagcgggacugccgcguuccccucgauuugcac

SEQ ID NO: 17466 - RNA, 1409 nt, Homo sapiens
cgcagaaauuagaggggguggggaggaggacacacccccuuccucggaacgacuuagaagacuuugaaucuccccuccuccgcuuuuccgccccggcucuucuuuuguugucaaguccuuuugauaaaugguggggcugggagcucugggagucgggagccagucugugcccgcguggggggcgggggccgagccuggagacccgguuucgaccggcgcgcaccuggggcugagccgggugcgcgcgggggucgggucuggaacugcccuugguaugcucgcccucuccucuuggcccaucucacuccccucccccaccugacuccccuccccggcuucuuucucugucucccacuccgcacggguaccgagaacuuuccggggugaguuuuagaauuugcuccuaggcauucuuuuucugcguuuggauuuuaucccuugauucuuuggguugguaaacuuuaugaaaugguaacuugacugaagcucauuuggagagaagaggggagugaggcggugugugcuuggggcugguguuugucagugugagcguguaagagcacaccugcauucaaggggguuuguaguguccgugcgacaucugagggaggugagucggcgagcggguggcgaggccccacgcugagggaggcgguugucuggucuccggggagcaagucccaggugcgcguuucggagggcgggacaguccuacgcugucucugcggggcagcgcgucugugaagcacucuuauccuucggguguguccaugugugccugguuacugagugcgcggccgucuaggugucgacccaaccaaugguagugcuccuaacgccgcgagcccaccuuugggccgcuaucgccgcggccuccccgcgaggcccgggcacugaaauucuggggccugcgacagggccgggggggacgcagccaagggcgucccuccccagccuccagacucagcucuucccccucuccucuaauuccagcagcuuauuacgccggcggcucaggggaggcagccucagcaccugaagccugggggggccguggaguggcuccugcgucccccgguguggccacacacgcucguggggcugcgcugugcugcgugggugcgggucguggucagcgugcguucgcuuuucucaaaacuccacuccgaggguccgagcgcaugggggcgccugggggccugcgcgcccggggcuuuugggaggcgccagcguccgagccugcgcaccucgcgcaggaggccaaacccccgaaggccggcgcgggcccgggagugggggccauuaauuacucugcgccaggccuaaagccuccaacccccagcagcaguuggcguggauguccugcggauuuuauuugcaaacaauggaaaugauuuguuuucucuaaa

SEQ ID NO: 17467 - RNA, 3046 nt, Homo sapiens
auguauuuguaggaaugugauuucaauagauugacuauuuugucuacugugauaaguuuguguaggggaacugaggaaaacugagaugagacuucauggaaggggcuacaaaguacagucuaaaggccuagauaaaguuugaaacuugauuuagaaagucaugaaaagccacucagaguuuuaagcaaagagugauggggcagcaauggcugugcauuuuucagguugaaaguagugagaugucaguucuuccuggaagauaucaugagaaugcacacaaaacugaacauuuucucagcagcaaggagugcuaaagggugcacacuccaagucaacaacucaccgugugcagcaccuuccucacacauuuugcuuugcuuucugucacaggaccaucagacguagaacguccugacucuccugaauuacuagaaugucagcaacaaacucacaaaguagauuagaggguaggaauagauacauaaauuuuuaaaaaccugccaaucauacuguuuucuagacaguaauauaauaagaacaugaggcaggacauccacaaauaguagagaauaauuaauaguccagaacugccaaauaggaauuccccuuaugaaaacacccuugcagcuaaucagguagcccuuguuuagaaaccaauuagcacucauaaaauauuuguacaaggagugagugggggagaaaugagcacaauauggguucugccaucaaucagcuuauaauacaacuaaagaaagaaaacaugcucaaagcaccauuagagaaagggugagcccuaaugacauaguuucacauucaauaugguaggaguugaaacaagggagaaaugcugugguuugaagugguucaacaagguaggauuucuagagaaagggggguuuaggaguuagauaaguagaggaucagcauucuagguaugaaggcaggauuaucuggcauguggcagggugaaugauguuaaucaguaacugcuaauugauauuuacugagcagcugcuguguccucacgaugguaagacuauuagaggaagacagcccaccugccuaacugggaacacaaggcacacauauauuggaaagaucauguugcacaaaacagguguucaauaaauaauuuuugaauaaaugugaacacugaauagcaaauaaauguuauagaucguaauaguuguagaagauugguugggauuguagggacuggauguggggcaauggcugugggucuagaguauauucauugugcaguggacacacaccuaaucuguccucaaggacagaaccauguggaggaauaggaaaacaagagaagcaggcaagaagcggaggcagugaguacagcagcuaagaaauguuacauuggguucauccagagcaagaaaagcugagagcuguccgugagggaaggccacacaggcaagaggagugggacaggggaguaaaggagugggcuacaacaggcccugcagauguggaagccagacccacagaggcacuuagaaagugaggauccuggaugaauuauuuuagggagaaaguguagguuuagaucagcuggcagauguguuugugggcuacagccaaguuuuucaggacuaagaaggagcaaaauaaguagaacuucuugggacaggagaucuaggguacuccagaaccagggaaaugagaaacaagaggggaauuuuaagaaagagagggaagaucaucuaugagguuggagaugaaagguguuggagauggugaggcacaagucaaaagacucacucgaagggcaggaacucugcuuauuuguccauauucccagaguuugucaugaggucuggcccacgugggcagucacucggccacuauguaucacuguggcugccaugguggauggaggcuggacagaaccuguggugaucggcagucuuucuggaggacucaccagggaggggucucagggugggcaucuccuuucaccuuccugugcaugucacugcacuguucuucuucccucccugaacagcacacacacugcauccuuaguuucaggggucugaaaacaaaugcuacgaccaccuugcuuugguggcuuuucugaacaggcauugugagaagagauguucuggccaggugaaaguggacuuuauuuuuagguagguuuuucaguuuagaaagguuuccuuugcuuaucccuugaggacuucugugcugcugcuucuccuccaucuugcuaguuaacagaacaggggcagaagugacaccaaugcucucggccaugccugccuugggaagcacuaccgggccccacuguuuagaaucuuagauggaaauguacacaaggcauugacacacgccugcgggagugacccagugcuucccucccaugggacucagggucagcgugggaaggcagcuggcagggacaggagccccgcccgcaagguggacugagccucacuuccacacaaaaccagagucccaucugccccagagcgcucgcucuccuccccuuccuuccgcucaaugcagccugacacgccuuugaccagaacugcaacauuucaaacacaaacccagaucuguugggaaauccuaauuaaaaacguugcauucccagguggcacaaucacauccugccuaaaacuucuggcccacaucccaccacccagauguugaaaagaaaccuuucucugcuuaacaccaaaaccugcacuucaagguuucuuuaggggacaaagaaaaaaaaaguacacacaugcagaguucagccuacauguucauugaggaaaaagagcguggcuuauucaucuuucaaucuuuugauuguuggcauuaugauuaugauuaugauuaauuacucugaccugacaggaauugaagaagagacuauaugcuggugcucugaaaugaucuacccaacucugucaucuguaacaaccagugauaacucucuugucuuguaaaaaggguuuguacauaacuuguacaugguuucauuuuguauuuuucgcagauuaaaaauuuauguauuuguguucuaaaacaa

SEQ ID NO: 17468 - RNA, 5842 nt, Homo sapiens
ucaagucucaaguuuaaaaauaaaaaagucaccuuugggcugagaucaagaauggaaaauuucagggcauagcguaauuuuuuccccaucuguucugggcaagggaugauaaagcauucuguuggaagauuguguguaagcaucaaccaugagucucacuacuuuauugcguugcaaugucuacuuuguuaagaugucuugaaagaaagacuucuuccauccuccuggcacaacugaaugugcuugguauggggagacgugucuaacugaaucuaagcaacuaauuggaauaggcaaaggaggaagugaugaaagugaagcugcaguuucugcaaagguggcuuuauuguauaaggugcagguuauuaccccaaaugaucaauuacuaaaguucuggauugggcagugacaagugucuagagggaaugcugggccuagggaauugcauugucaugugagaauaaggcuggggccaccuuuacauuuucauuaaaaaaagaucuggacaguacuugacugugguaguagacuuuguaaagguuauuaugguuacagcuuuguuugcuugagauccucuauuuuuauaguucaauauuauuaagguaugaagaaacuguuuuauggaugucaguuuuacuguuucugacaacagcuugcgaggaaguauacauuugugcaacagaccgcuuuggauguuaauucuaaauuuagaagccgccuucaauggguguggaaaucaguuacacaaaauucaggugcuuacuaaaaaaaaucugaauauccaugaagcuuguauggucccugguggaacuuugagcagcugagccucucugaagauccugagguugucaggguguggcacagcagcugggggcugggccccgugcaugcacaucagcaucuguguauugaauauaaucagcacagauagggaagaaacaaaccaccaccaccaaacacccuaaguaccaaucugggcaucugggcacccuggauuuucauuuugacucugucauuuacuaguucucugaccuugggcaccaugcuuugcauagcagccuugguuuccucauugguaaaaugaggcuguugaauucuauauggcucaagaguucuuuccagccccgaaacaugcaaaaauucaguuucgacuaagagcuuuagcacugucuuaucuuggcuguuugcaguggccaaaauugauaacauauuggaaaacuucccugcugauuaaaauagacauugcccuaagugcugugagugucccuguuaccuuaucccuucucugaaacccucuggguuuccccuugaagcagccccuaaaauggcucaguuuccagcauagcaggaggucuccagccuagccaauggugccccuugugaaggucauggaccugccuuacccauuguuaaauguuuuccaucccucugguguacguggagagcuucuggguggaguggacacaaaugauuuaacuuucccgagucucugcuucugcgccagaaaguggaaggaaucauaaccaguguaguggagguaauuaggaggguccaaagcuuggaccaucuggguucaaacccuggccccaccacuuaguaucuaugugagugugggcaugucagguagccuuucuuaccucaauucauaauccgcaaaguggggaugagaauagcaccaacuguaucaagcugaugaugagaucaaauaacacacaaaauucuuagaauagaauaagcacuguagaagugauagcucuguguaugucauuaauacauucacugguaucacugaacuuuauuuuauaucaagugagauaacuacuauaccauccagggagauaaugugugugaagcccauagcacaaugcuugacaaauaguuuucagggaauguuagcuucuaucuaagcaggucccauuggaaaaaaaaaaaguuguauuuuuauauaguucuaguuaguuucucaucugugaucuaugcuauuuuuaauugaaaaaaaaaaguguuuccauacauugucaggaggagccguuccccugucccagccucucacaaagcacacccucacucccucauuuuuccaguagucccagggcuagaccaccuguagagacaggaagccugccuaaagagcagaagcaucugcucagaaagaucuaguuguuugcuggagccucagcuugaagaaggcuccaaguuuauuauaaagucccagccacacaguuugcuugagacuuuauaaagagagaaugagauguagaggcugggcccaaacccacuaccaggcugugggaaugggggauggggugcuuggcuggcaucucuucucagggccuccuggucagccucaggagaucuagugcuaaggguuacucugcuggggaaaaucucaauggcacuagagaccacuugagcacagcucuuaggaacugaggagccagcuacuuagcaucccagaaucccaaugcccauggccagagccagagcugcuuagaagaaaagcaaaguccgcaggcugcauggacugagaaccaccucaccuggcugcacauucucugaguggccuugaccaugcuguucucugagccucaguuuccucaucaaugauagaguggaguuagcuagaucaggggcuuucaaaagcuuuuuccccugaaacccagaauaagaaauaccuuuucuuucucaacccaauacuuauguucauguauguaauuaaacaaaaguuccaugcagcaacccuuuuaauaugcaguacucuguuuucugugcuguuguuucaguugaaaaaugcugauugugaaugauucaguugauucugugaccugcugaugggucauaaccugcaggguuuuuguuuuauuuuguuuuguuuuuguugacagagucucgcacugucacccaggcuggagugcaguagcgcgaucuuggcucacugcagccuccaccuccaggguucaaguaauucuccugccucagccuccugaguagcugagauuacaggcacccgccaccacgccuggcugauuuuuuuuuuuuguauuuuuaguagagacaggguuucaccauguuggucaggcugaucuuaaacuccugaccucgugauccaccugcuucagccucccaaagugcugggauuauaggugugagccaccaugccuggccauaaccugcaguuuuaaacauaucgggcugaauauaguugagggugcuuaaaugcuaugaugcugugauucagcugggccaggaauauagagaacaguggcacccuacucuguguugggccagagauugcugaaaugucuagcauauuagaucaaccagauuuuuaguucuaaaggugaaaccagaagcauuuuuuuuuccucucaaaaacacacauagacucagagguauggauacaauaccugaagggcuauaguucuuuuuccaggauugucccucucagcaggaauggaggaucccuagcuagagaggagagcugggggugacaccuucuugcccaguggaggacagcuggugguguggccucaacagguucuuaggaaggugaguuccuuagccuuucuacuagugagguguuuggguuaaggugcagcaccauugacugggcccguguggggaggauauucaaagcauuucacaauuacacagcugccugggcaccgacagaguccuagagaagugucgacugugccagguccaacccuucagucgcuggaucauggggaggcauggagucccauuguagaggcuggguggugguaguaggcaugcaggaauucagggaagcugcuacuuaccaccauguaaaaaggauuucaauauuuucacccugguagggaugcaccagugugugcuucucagccucaguccuggacguaugccccauugcccuaagguugucccaaagaggccaccauuagaccucaccuuuuauggacaggugggagaugucugaacacaaccacauguugcccagugacaggggcugggcugaccaggacacggagagugacuugccuucuggggcugagccagucacucauacucccagcguagcccuggagcuucacugcaacugcuauguuacaggaaguuguaccagcagcucuacacuaagguguauagucggugaccacuuuaaagaaagacucauuagaaagaggcauuguuuggggaggccaacaggccagcuguuggggaccaugccagagguacugugucaagguaccuggcuugaugcuuacuucccauugucuguuucuugaguuuauuuugcgccaucugccuucuuccaccugauuuggaauuccaggacugcuguguaggcuucucuucagaugagaugcagcaguguucucaacuggcaggggcagcuuucuugggggcagggacugggcaucuguguuaucuauccugggcccaucuguuucuuuccccuugacacccaccacaggggucuguguacaagaggguugguugauaccaguuuuaaugagggaaccuaucuucuuggaaccauccagaagcuguggucuuuuucccuggaacaccccacccccgacaucccagugcuggauucaagcuggugaaccacaggucaaaauuuucaguugcugucuuccagggccuugguuguuccauuguccccucucccuguaccaggaucaucgugauccaauggauuugauggaguugcuacacccagcuuggcgugcagagguguuuggcacaucccugccuguggaauucuacgcucuaagggagaugcugccaggguauuaccugauucacgaggcauguccuaccaucuguguuauauuuuuuuuaagaucagaauuaugaauauuucaggagucaucugggaucugaagaagcaagaacccacuuucugagucuuuuccuuaaccauucauaggggguaagaaaugucacagguuuguugugaaggucaaaugaaagagaacuugagaaaauuugcaaauccuucaguucaaggugaaagaagguaauuuauuauuaauucauauuguuauuauguagcauuucuuagaauauguauaccaaaugccuuuuuugacuggugcaaucuuucuauaauuccauucugggauguuagcuuauuugcuuagagaaugguguaaagaggggagcccgaggccggcagaucaccugaggucaggaguucaagacuagccuggcuaacauggugaaacccugucucuacuaaaaauacaaaaauuagccagguaugguggcgggcaccuguaauccuggcuacuagggaggcugaggcagaauugcuugaacccaggaggcggagguugcauugagcugagaucaugccauugcauuccacucuagccugggugacaagaacgaaauuccaugcaaaaaaaaaaaaaaaaaaaaucacuuccugggcagucugaauuucuuaaccugccccagagagcuuaaaaacuuuagaaaauguggaggauccacuuuuuaaaaaaauauauauauccucuguucauuucuggaagcccuaaggaggaugagaguuacauucucugucacugcccaagauucucucaugaacuguauaaacaguguugaacuacaugcuugucucauaaacccaguugggcaaauauuauaggccuauuucugucaccucuggcugguggaguguuuguauuuguccacacauccuuuaugcccagggcacgcccuggauaggagaagcuugugcccucccagauggaaaaugcccauaacucaucagcccaacauuggacugcuaauuguaggccuggauucauaguguucuugaaagcuucagggugagauuaaa

SEQ ID NO: 17469 - RNA, 908 nt, Homo sapiens
caggacgacccaggcgggaggggaggaggcucgccgcgcuggcucgccugggcuccgggcugggcaggggugggcagggccccucggcagcggcccggcaagcgccccugacccccagggcgcaagguagagcgcccccagcccaggcgcggggccaggcgccucucuccaaggugcugcgcccccagccgagagcggugggguacacugggaggacggcggggcgccccggucaggccguuuuuuuccccaaagagcccccaguggggaggggaggaguggccagcugucaacuggauuccacaggcugagcuccccaggacccucgggcuucgggagugaggaggaccccacgccaggauacacacagcuacccaccccuacuucgcucuuccugcuaccuaugugcccagggucccgcguguggcuggaggguagagucaggaaggccagcggguggucuguggccucugacagcagcaggugguuucucuccuuuuuccuuauuagcaacagaggcugcccaacaaagaguaggcagaaaugaucaaggacgaccuggccuggggauagugcaggccccgauagacaauagaguucccugaaggguugcuuuccucucauauagucucagacuccauccaucccgugaggagggcagaugggggaagagggacuccagacuucauucuggcucaccguuccccauuuagggucuucccuucuccccacuuaagaugaagaaggaguccguguuuguuccguagcgugucuccguacaccaccaggggaaucccccuucugacacuuucagaaacuuugcgcccccugaacagcguccguccucgugcuaccagcuggaccccaaguuuuuccagcgcuaauuaaaucgaggaugaucacgcucu

SEQ ID NO: 17470 - RNA, 953 nt, Homo sapiens
ugcgugcaaagggaggguccuuagggcagcguggggcugaaguaucugugugaguguaucugugacugcguagucuuacacaccgugcacacgcacaggaaaaucuuaauucauggaacaaccuucuauaagugguuccaguuacuggcauuuuccgguuaauuagagguuaaccugcaaucgcuuauuucaaccuccuuguugaagugcauuaguuuaauuucacccuuaccaucaugccugagcucuggauguugugucugguaggaacagccucuccugaagucucuaucaaaauccuaccccauccucccuguccugagucaacucaaaugcugucuucccugugaggcuuuugcugacuucucacccuaagugggaaaaauuucccuucugaacuuuccuaguccuccggggaauccccauacaguguuuaccacugucuuacugggucacagaguucuggguucuuguauuuucucccuuaggaagcuccuugguucuucgaggucauuaucaguacuuugccccugaagcccaggugccugggacacacuaggugcacaauaauugcucauuaaauaaaugaauuaauacaaccuaaagguuuaggaggcuggguuugauaaaaauucaauacuuucaaaauacuaaaaauuuuauaguuucaaaaauauauuccuacuuuucguuauugucuucauucucauaaagggauuaaacauuaugaaaaaguucaauuaauuggguguguguugaucaagaaugcauugucuguaaauccagacacuugguacacacauauccacaagacacaccaaaauaugcauacacaccuaaguauauauguacacaaaaauauacauggcauuacuguuuuuuaaaaucuucgauauacaaaaauucuaguuugcaaaaaagagacagccauuauucaucuucuuaaaaaguuc

SEQ ID NO: 17471 - RNA, 3910 nt, Homo sapiens
gggccagaacgagcacuuucuuugcagguaggcagccagugcaggcccagcagcaagagaaggagcaggagaggcuggaauauucuggcuugaaaacagcagcuguguaauaaagccgggcugguuugucucagggccccgcugucccuucuccccgccucaaaguagcagcaugaaucaguucacugcggcaaugguccaggcgaugugacuugcauccccaucagcuaccugauugcggucccuggaugcaugaggcgcuggaugugccuggcauaccaaacugcccgccucugugccgcagcuacugguaaugaagaucaccggccccgcccagcacugcggacagagccgggcauucuucaaggccaccacuggucuuuuaucuuguccaaggcucugggauagucaccgaaauccuugggcugcuuuugacgggggccaccagccugucucaaagaugcccugacaagccccuccagcccugggcagacaaaggcuugaaaggagaggaauugcacacgguccagacgcugcuguuucuaauacguuauuuugacacacaauuaacugcaaaauuugcucuaagcuaagagcucgggcccucacaggauucguacagcacaauucaagcaggauuugguucugugaaaccucauuuuuccugaagggcuagggauugccggcuccccacggugaugccaccccucucagggcuggcugugggcaccgaucagagaggaagcaucagcccgcccacagcccagcauggggccaggggaaccauggcacgagucaugggaggggguggauaaagcuugcacaaaaccguccaacagagcucccugaacaacaacccuuccuaaaauggugucgcuuauccuccgcugacaaaagccugauuugagcucuccccggaggugggaugaagcgaacacauugccuuuuaucuccccgucgcuuugagaggggaagacaacugguacagagcaugguggggagcccuggagaaggcacucuugaaugaaaggcauaaucuccggcucccccaaaccaggaggggaggcagcuuucaucccccaccgcggcccgcuccccccguccuggaggcaucugaaugggaguggggagcuuggaaggagaggcuccugccgcugcacaaugccacacaauauugcuucucuccaggagcccagaggaggccauggguguacagcaucuuacuuugaaaccaauucuccaaucagcuauuuaaauaagaaauauaaucucauugaacacccagagcuguuagucugagaugcuuccauuuacaaggcacuugaagaaaguccccaagcccccgguuuaucaggacagccagcuuaggaugacuuacugggggaaagagaggugcuagagagggaggggagagaauugaaguuggccguuagaaauccaggcugucgacugcuugaguggugaacccaugccgcaccugucggugcucuaugcggaggaggugggagaggucuguggguuuucagaaaaccauccgauagcaggcaaugcccuguaaaguugugaagggggaagaaggggcacaaagcauugucuaucucucuuuuggaaacauuguuuugaguacugaagucauugccacagcauuuuuuugucagaggccaaguggcuguuaagacccagugggugaaauuccccugacgaaaaccggcccagcaagaagugggggcgauagccuugacugacccuccccugccugagcucacggucugccuccggcaccagccauguuucuaggcauucuggagagggaggcuugagagccugugcugaccacugugggaauccugagaaagcucguuugccacgugcuagcuuuuaaucuaugugcagcucacucaccugaggccucaguguuuaucacuugcaaaauggguuguaaggaccaggugagcugaauguggaccgugccugacagguggacugugccccauacaggauggauacgauucuacugugaugauggcacacuccgucucacucacaacuucggggaacauggcccacugcucagguucuggcaugucauuucuggucaguagccccgccccuccuugcccuguccuguucugcccaauucugccccacucuaucuugcucccuucaaaaucuauggugcugaugaccgccugugagaggugauauccugugagaggcugggaaggggaguguccguuugagcuggaaggcugccuggaggagguguggcuugaacugggcuugagcagugggaaggauuuggagagcggaggaaugaaggagagcagagaggagaggcuuggagguaagaacgagcagagagggagggcuggggaagccagucugcagggaggggaggggaggugaggcgcuaugcuggggagaaggaggggagaaggaugggagguggcggaacccugccacuccuuucuugguugcuuugcacccaucugacguccuugcuggucagaggaugaaucuggcuagagcggagcagaacugaagagcagagcuaugcagcccuggaagcauccuagagaccaagacccucaggggcaagggcagggugcucacucagccacaccguggaucagcagcagggcaggaccccacccugugccuccugucucuuucucccguuaugacagcuagcucugaugagcaccuacugugcaccaggcacuguucuaagucuuggaauggguuuccacaguuaguccuaagacaagccugucaaguagggagcauugcuauccccauuuuagagacgaagaagcugaggccuggaguagucuugaaccuugcccgaggucacacugccaggaagagguagagcccacaggccaccagcauugagcuccuuucugaccucuuaucuuuggggaagguuggcccaguuuccuucuccuuuccugaaggagcgugugcguccuugcugagaccaggaaaggaggucucagcuucauuugguauucccucccuccuuaguaaagcacguaagugccuucugcgcucccggaacgucagggaacaucagcaaacaucagugaagcgggagacgaaugcccccaaacccgugccccguggugcaggaagggcuggcucacucggcugacuuccauuaaacauuugaugcaucacagaacugccgaaaaccauccaucaggccaucccccuccgccugccucccugcccugcucacagaggggguucggccucagccugcauucccuggcuccagggaagagagaggagaggggcaacacccagccauggcugugaugcuaguaagagcaccauguauugaaugucagugugcccaggcagaccucagcacauuacagauuuuaucucauugaaccccaugaucgcugauagguguggcuguuaucguucaguagauguggaaccugacaucaaagagggccauagucacucugaaggagcuagggccgcacugagcccagggauaugaguugagagcccccuccgcccuucugcauuccucgaugggguggagcagaucagguacugcacagugggauggggccagagcagcacagugcauuuagugauuagugacccguggaggucagccccggccagagcagguugggggaccccagcacagggugaguugcaggacagcgguccauggguaguccaaggcacucuguccuucccuccacccgguuacugcagccugaccaaguuuuccgggcucccccuucucccuggggaccccauucaaucagaggccagucucuuugguucucccagcuagauguuccugaauucacaaucucacccccuuuccuuccauaucauggccccucucgugggggacugccccagccuccugcuggucucu

SEQ ID NO: 17472 - RNA, 7964 nt, Homo sapiens
caaccaggcccugggcauuuacaccugaaaaucuugccuagcuucagggaagaggcagcagucagaacagguucaggcucuuuggcagggcucgccagccuccagguugaagucuuuuuccucuugcuuccuaguccccacuucucagccaguugcugcuuucuuccauuugugacccucugccuucuugccuugaauguccccuuccuucucuguacuugaccuuagcucugcccuuuggaauacugcugccucugguccuuugagaacucugucuccuccauucaaggagaggaaucaaauaaucaagggguugugugucccugaaaagaaaaaaaaaagcauguugcuuucugcauugaucacaggucagcaccuuuucuuucauaagauggaugaagcacagguccaaaaccaaaggagcccagagaagcagcagguucuguaaaaggcagagucccuccuggccccagaauauucacagcuaagccaccaagaugccugccaagcaacggaguauuuuuuaaucauuauuucucucuuauagguggggggaaagagucauuuguagccuggcaacagagaucggcauguucucccuucaugccaagcuguaaacacagccuucccucuguucagccuaaugaugcuaaaaggccagugaccaggagaaauuagggugaugguguugaugguugcaggcguggguggugcaaacaggccaguagugagugucgcagaauuggcacugugacccaggggcuuucaguagaacccaagagcucauuggaagagucccagaugaagggcaaggaguuccuucuagacacaaggcuguuuccugcacuggucagggaugagguccuggaguccagugcaggggaagugugcuauggggaagggcuguaggugguagggacagucuugcugcucccuccuggggcacccucacuggucccugccgaugccaccuccuaccugucccccauguaccucuccucuguguuuuccucugguccaggcacaaacucuucucagugugccacagcaggcuugaauggguccaaggaacauguucuugaaacaaaggaaaaaacaggccagaaacacuaacucaggugaguguacccccaccccuccccccaccccacccccuucccaccccccgccccauuggcaucaccuuagaaagauuauaugaaggaguggcuaagaagguggccuuggggacagacugccuggaugcaaauccuaauuaccagcuguguggcauggcaaaugacugacuucugugccuuggauuucuccucuggcagguccagguagaaauaauuuuuauaaaauagaaguucauguaaagcacugaaaacagagccuggcaauaggaaauaagugcuaaaaggauguuagccauuauuauuauuguuguuauuauuauugcuauuucugaaacaucugacuguaggcaaguaacguauucauucaguuuucuccuaucaggguugcggucagguuuaaaugagcuuaugcacugggaucauugaguacaguuccuggcaccgaguugguucugcaaucacuguuuucuaugggucccuucugugggcuaagccugugagagauguggcugugccugccuggcaaaccauuggccucuguuugccacacagagccaggcacacagcaggugcucaggaggacacguuguuagucuacgagucucuccuuaccaguaacuuacucagcacaaagggagaaauagugauuucacaguggagaggccaagcagacaccacccuaaccaaggggucaaagcaaacagggccaacaucaggacagaccugcaugacgugcccugcaaugagauaacuuagaaggacacagcagaacugcagugggauucccuccugccaccgacguggagcucgaaccccaccuugagaaacgaccagaggaacucaacugaggcaccucuuacaaagcagcugaccuguccccagaaaugucaaggucaagaaacaaaaaggaagacuaaggaacuguuccagaucaaaagagauuaaaagaugugacaauggaaugcaaugcauaaaccuggacugaacuuggacuggauccacaacugggaaaaaaauggguaucaccaacauuauugggauaauugaugaaauuagaaugugggcuguggguuagaucguauuauuauauuaauguuacauuuucugauuuugaucacugaacugugguuauauaagacacagucgucuuagaaaauaaacauuaaaauauuuagauauauacugaaauauuuagguguaaagggucaggaguucucaaauucucaaauaguucagaaaauuguauauacuuauacacacacacacacaccccacacacacauacacauauagagaaagagagagucuauuucaucccagcuauuauuuucuuaagguuaucuucuuucuuugagcuuuuucaguuuugcuuguuuuuggacuuuauuuacaugagaucacacuggauguauucuucguaucuuuucuuucuuucuuucuuucuuucuuucuuucuuucuuucuuucuuucuuucuuucuuucuuucuucuuuuuuuuuuuuuuuuuuuuggcagaaucuccaucuguugcccaggcuggaguggaguggcacgaucuuggcucacuacagccucugccucccggguucaagugauucuccugccucagcuucccgaguagcugggauuacaagugugcaccaccaugccuggcuaauuuuuguauuuuuuaguagagauaggguuucaccauguuggccaggcuagucucaaacuccugaccucaagugauccuccugccucagccuuccaaagagcugggauuacaggugugagccaacaugcccagccuauaucugauuucuuggcucagcauuacaguucugagacucaucuguguuucuguguagagaagggauuuguucauuuccacugguauacagaauuccauuuuuucuguauccguucucccauuggugugcauuuugguuguuuucucuuuuuagcuauuaugaaugauguagcugugaacauucuugcacauuuuuggugaacaagguauacauuuacgcuguguugauucauacgaguggaacuguugauuuauauaguauacauguguuccacuuuaguagauacugacaauuugucaaguuucuuggacacuuuauacuuccaccagugguguauaagcauucugguugcugcacauccuugucaacacuugauauugucagccauuugaauuuuagucauucaaacagguguaucuuauugugggguuauaucacauuucucuaacgacuauugaaagugagccccuuauguuuauuggccauuuaaauacacuguuuucugaaguguuuauucuaauccuuugcccauuuuuuucugugggcuaucauuucucauugauuuggaagaguccuuuauauauucuagauagaaggccuuugucagauaugcuuauugugaaugcuuucuccugcuccauggcuuggcuuuucaggcuuuucguagugucucuugauaaggagaagguuucauuuuuaugagguccacauuuccauuuuuuuucauaaacucauauuccaaccuuuauucucuuaaagaauuaaacugaaaagacugugaaggugaaggcuaaaaucaggaagauuccaauucuagguuccagcuagaagguccuacccaggaggucccaaguuaaacuagcucacccuccuuccuccucaggcccugccagguaugugugugguaucguggagugaggugcuuagggaagacugguggagagaggaacaacuccaggcagcacauaaaaucugggauucagaaguccagccuccuucuccccugacucccccaucccagggcuccaggaccauucuuuccaggcucaggcacaguccucccagagggauaccucagaguggacagagaugcaguauugcaguucaugucucagggucaucugcaaaggugggugcuaagugacuugggacccagaggaugagaaaucacucuacuggcaggaugucagggagagguguagaucagugaagacuucacagaggaggggauuguugggauugguuuuuauggguguacaggaaccugccagauagacaagaggaagaagggcauuccagguagacaagcauccaggacccagaaggaguuaaaacacuuggggaaacuguagggucuaaaauagggugugaggaagggagcagccauggcccucaauuuucccaucugcacgugggauguuugaaucagcugaucucccugcugacacauuguucauucuucauuggugagugugauggauguggagaagacucagauauaggcuccaucuuugacgaggagaaagggaggggcacagauaagagaucugagaguugaggagguagaauccuggaagguugcacuggaccuaggccuugaaaacucuccuauccccucagcugugaaggaugcgucagagggucuugcuacaggucacuagaaaauucugagcugguccccaguguggcaguuagggcuugggacucucuuccugauucaaaguccccaaguggggacccaguggggcaggggagaagucugguucaggugggggagcugaccucugcuccucaaagaggacacacccauggacuaugcagcccuccucacaggucgugcagaagacgcuuguauaaauugccuaugccaaaagguaguauaggguucuaggugcuugguagagagcuugcugccuggacccauucugauaugccucucaccccugagcagggaggcuucgugcaggucaauaaaagcaagcccucucuguagaagucaaauaccaaguuuuccugcagaacacagcgccccacaccuaugugugcaagugugcacagacacaaauaugcacacgcaccuugcacaguguuucuucuccaagcuuccuuaagcaaauaaagcuugaaauugaaguuggaauugaaggcuaaaaugcuuuaucaccaacucaccucuaucuccuaaugaaguuggguuuaaaaaauuuuuauaccguuuuaacaacucauuuucagauauacauccucccagcagaguguacuugucuguuuuucucuccuucuuucucuccaugucugugucucccucuuucucucugguuucccuccagguaguggggacaggacccaguccuguugcagaugugugauggggcuggcucauacagauuugugagagcacuucuuucagcuccauagucaacaacauaaagcccaauagugaaaguguuuacaccacagaaauuggcaaaugcuacgaauccagccuuuuuguuuuucugggacagcucguuguauaaauuuuaccaccuggcugggcugucaccuauauuaccagcagcagaagcugggcccugguuugaggucuaucccucuguucccuuguguguugccgccccagauauuuuggguuggccacagaccuuugugacaucuauuuacuauaaccauaagugucucauaggcagagguugaauaugcgagggagucugggggugacugaucuuauggaagccugauuccccaaacaccucucugagccaauugagaaauccaggcagaucauaaguaguguaauuucacaccagugcuuuucaaauauugaccuaaugggaauuuggaggcaaggcagaacucuguagggcagagaaugcagaggaagaagacagagguugcauuaguuuuuggaacucucuugccucguuuucagcucugguccaaacgugcacacuccccuuagcagucauaaguucugcugcuaaugcugugcuggcccuccuuagaaggcaggggagugaggauaugugacuacacaggccuacccugggggcucucucugcuccaacuccccacugcucacaggugcucaaaguuaucuucccaaaccacaggcacuagccccagggagaaguccauggaacaguauuuccuguaucuucuugcauucccagggauggcuuagggcuccucauagauuggcacucuaugcuguuguccagcuggccuggcuuucaaaccucccuguagucucagaauggcuggaguggucuugcccucucugacugacccuuugaaucaggccagcugaccugaggcuguaccuuuccucccuaccucuuacuucccacuccaucuuccaucuacccacucuacccugccgguccucccuggauuuguugacaauaucaaacauggcugagaaaagcuccaauccuggcaaucucaguccugaucaggcccuuaggcugggccauuuggcagaugucccaaaacuacauuuccugaccccugugucaccuuggugccagggaaacagcccagugugaugaggacacccauaggagugaucagaacccaagggucaccguggcuuagauuucagccccaggagcugacuguacacugugagcaagacaccuuaccucccugaaucuuaguuuucccaucugcaaaguggggcugcuaauucaccucuuugguuuaccaagagucuuagaugaaauuauggccuaaaggugucuacucuuuucuuaaucaauauuuuggggcagcucuacgugccaggcccugagccaggagcacaguagguaccuagcugauaauuugcuuuccuaugucccuuccucucauacaaaaaagacuacagagauugcaaaaaggagcugaaaaaaugacucugcauucuggucuucuggacagugcuggaggggaaauuguguccagcauagcuuuggugccacugccacaaaagcaaguguacauaacaaaaucucaggccagcacuguuaggcaaggcaucccuuggguggcccaagccucuggucucagcagccagacacuggguugcaauaaggcagggaaaacaaccucaaauuccuugaaagucuaaacccucagccagugcuuuaccagcagguuaagaucuggcccaaguucagaauggacagucuaggcagguuccugggcuugaaggcuugaggguggggccugguggggcagaagauaggugagcaggguaguggugaaugaaacauaucagcgucacucaugggguuucuaaacagcccuggggcccaggcugcaaagggugggaauaucuacugugcucuguacuuucugcacgcuauuuuagcuaaucaugagcccauuuuacagauagaaaaacugaggaucagcuggagucaacagcuuaccugacaucaccuugaguggcagagauguaauaacucaaguuggccagcucuucuuccuauucagcacugaaccgggccauuggcaaguguuccaucagcaccuuaacaaaaacuggacugugagccaaaaccuagaacuauccauagcuagugaaacaaugagaacagaaccagcccuugucccuccccacacagccuaauuaauguguacagacaagaaccacugcacaucacuuauuauuuaacuggcguauaaguaccaucaaaggugccauagucaugcgugguggcucacaucuguaaucugagcaccuugggaggccgaggugggaggaucaccuggggucaggaguucgagaccagccuggccaacauggugaaacaccaucucuacuaaaaauacaaaaauuagcugggugugguggccagugccuguagucccagauauuugggagccugaggcaggagaaucacuugaaccugggaggcggagguugcagugagacgagauugcaccgcugcacuccaggcugggugacaagagcgaaacuuggucucaaaaaaaaaaaaaaaguccccugcuccccaaagagcugaggucaagucgguugggcugacaagagcucuuaagagaauggucc

SEQ ID NO: 17473 - RNA, 7202 nt, Homo sapiens
agagcuggauucuagaucugugggaccccaagcucaguggagagagugauuugcauacagucacauagcaaguaggucucagagccuggacuguaaagcaggacuucaaaauaaucagaacuauuacaugcagagcccucaugagauggcaguuuaugcuacauacuugguaccuaucauuucaugagaggcugggagaugaggccggggauacauauagcauggaagcugcagagcuaaaccaggcccacgucagccugaucuugaagcccaagcucaggucccuguccuaggcuacccccaauucugguuuccagcacugggcucuacauagccugagacuagccccauaccagaagcuagcuggcccugacucagggaacacugaaaugguggaggcaaggaggggcuaggggccugcaggcagagacccauuuccagggccugaacccucaccuccgagcccuugcucugccaugcaugcugaccugggcagcucacaggggcaagagggcaggggucuguuggccugagccuuccucccugccccugugugccagaugggcccugggaacaggcaagaggcacauucacaaugagucugaucccagggaaggaggaagagaagaaggcacaaccauggaggaggagaaggagcaccauauuuggaguuggggcaggcccagguccacaacccuccucccccagucucuugauucuuccuucuucucuucagacucaagggcccacacauccauccacucagagccaugucuucacucaucccuugccuuguuauacaaaggguugagcuacuuuggacaagugaauaaaucucuuugagcgucaguuuccuaaucuauagaauggguuggauucucaugaggaucauaaaauacccagcugcaaugcauggcaugaagcaguagcucaauaaaugguacuuuaaauguuacuuucucuuccuccuaccaaucuuugaauaauuuugagcugggcugcugggaagacuuggcgagacagaagcccucaagguuucccucacccagggcacagacaggaugggaauggugagacagaggccuucaaacaucccuugcccagggcacagacagggugcugugggcccuguccagccucccucugccagcucucuacuuuccccuucugcagggcugccugccuccugcacaguggcucagauucuuuuuuggggaaaggggggaugcauucuuagccccaucuaaaccucugcugucuuggagaccccauuuaccccaccuuaguuaacagggucccacucaucuccacacccuuggagguggugugacuggcauuuaccuuggcccuaccuacacauaaggguuccauauuuuuacaacacuagguuuugugcuaccuccagguaugagaggcauuucagagagcaugaaugccaacaggcuggaauaaaauuucucacgcauauacagcauguccuauacaccuggcccuguuccaagcacuguauagaccuuaacccacuuaaaaccuaugauguaggcauuauuauaauccccuuuugucaaacgagagaaccauggcacaaaggaguuaacugacucuuccaaggucucagaacuggugauuagggggcugggugggauucacacccagacaggcuacuccagaauccaugcuuuuuaaugaccacccuucucuaugaaacagcugaauggcuucuggaaaaaauaucugaaauuggggcugacccaggcucucugcuauucaucauccaugggacccugaguguugaaugagcccaaagaugggaggguguuuaaccuaccagcaaggacaaaucauugucaaacacuuaaggccuccacuugcaagcaguucaggugaucuuuggcagcucucaaaucauuacugugucuuucccaagacuucauuuuaaccuguucauagaaagcaggggcagcugguggcuuugggguugaauguucuuguuugaaucacaauuuuggcucuuuuuggccagaaagcccuggucaaauuauuuuauuuaucuaaaccucaguuuccucaucuguaaaaugggguagauaugaguaccugggaucaccaugugggauaagugaguucauggauacucaaggcagugccuguuacagagaaaaugcagaacuuaauguugguugcaucaugacugaaaggggcuaggaaucagaucuuuuccuaauccagaugcccuucccugaccuguccuggcucuguaugucuaaagaggcaaaacugaugauaaccguaccaucauuaaugccuaucugucugucuaacccagaagguacauacuuugguauuuacaagguauuuacaaggcuguggcuugcaacacuugguuaaaaaaaguuccacaaccagccugcccaccuucuaccgaggcccugcuccauuucacucucacacccucgaauccccugaaaucccuccucugggggcgagaaugcuaagcuccaucuuaaaaccaaagcucuggcuuccuuaauccucuuaccuggcucuuuccucuacagaauuaauugcugccaauggcuuuuuuaacuccuugggcagccauggcauccucagggcaaccuggggcagugcugguggggguuguuuuggcaggaccucuguccugggugcaccuguggauaggguggcuagaggcagaugcaggaaggcucgggaaggcaggcauggugauaccuguggcccugcaucuccagagaagcuguuccagcuccucgggagcaccacugagucccuggugaccugcagagaugcagggauggccuggccagagcucuggucccacuucugcccuugccgagaccaccuccccaccccucagagccucuauuuuccccuuaaaaugggaacaagcucaucuggaggagucauaggguuggacauguaagggagggugaagggcuguguggcccugcacgguuacugccaucucccacccacagaaugggagcauucacuuauuucaaaccaggagagaagggacugcguguauugcauguguauguguuuguaggcccugugcuuagcaugaggugggccuggcacaagaagcuugucaucccucgcccuuaaaauuccaguuuaguauuuuuuauuuuaagaggcacucucacacccacggccucaucauucuuccugcagccgugaaggcagagaaaugguguagauggacagacugaggaugagacggcugcugggcagggcacagccuaccccaggccccagagccuccuucagagcugcacuucuuaacuagggcacccucaaguguggucuaggugauauggccccccagguugcuuagguagucacaggucccagugggagaaccacugcaaccucagcugucuuuccaucauugggaugcuguuguuucuaagaagagaggcucaguaguuuggugcucacuggucuuuaagccuuuucuaaaccccuucacccuuuaccuccccuuuuuuuuaauuaaaaaaauuuuuuuguagagaugucucacuaugauguccaggcuggucucaaacuccugggcucaagugauccucccaccucagccucccaaaaugcuaggauuacaggggugagccacugcacccggccaucaccucccuuuuuaacuagcagagaacuggcucacccuccaucauugagcagucaccuguagcuaaacuaggagacaagguaugguuucuacugucuuuguuuuggcaguuucugaaugugguaagggagacugaucugccauuuaaggaagcaauauaaaauuuccuuuaagaaauauuaagaacucaaucuuaauacaagcgguacugaaauaaagcagagaugaugggggugugaugccagugacugagucuggaaagcaucuuguugcaggcacugugggugcuucuucuacacagccucugcuuacugcaugcacugggacucugccugggcguuuucugcuaacucgagugccaaggguucauccaccugcuccccgaccucaagcugaccuugcccaauaaugguggagagaugguggagaaaugccuccuccuccucgccucucagguggguaaggggcacauucuagcugccagcacucccagcaggacugagccccagguguccacagcagguuacgugcuuccuaaccacucuuuucacugauuuccuucccuuccccaucucauuuccuccacuucucgaucagugcuuucugggauccuccugaaggaacaacuugcacuggaauccucaccgcaggcucugccugugggaacccacacucagacacacaucaucuaguugcaaugccugcagcagccuggccuuccccuacuacagaccucguuaaugccuacuccuacucacugugcagauccccuaucccaaucagguggccguggggcggcauagggggugggcugcugagggcccuggugacagaagcaggcccuucuuagggucccauccuccaggcuccccucucauuuuggacaggccuggaaagcagguacccacuggcucggcccaggguguccuuguguacacccccgcucuguaggcaggggggccagugaugagcuaaucccccagaugagaggucuguccccuggagcucucggggaaccagagagggcugcgcuaggaaaacugcugacccagccaggagcugccggcucuccuucucacccugccccugccaacuccaaccaaacucugaagaaacccaugacugcugcugcuucugcuuaaaaacagaaagaagaaaaugugggaaacaaagaaaagagucacccuccggcccccuccagauagagccauuacuuguaaguugacauuuugguauauucucuucuggugucugugccuaaauacauguacguuuuguuuuugcaccuggcugggaucauacuaagucuagcacucuguuauccuucuggaaaguuaauauuacauguaagcauucccacauagucaucauucuuuggagaccucguuuuaauggccguagaaauagccuggaaguuguuuccacaucugcccuuucucauucugggcauggcagggccccuccccacugcucauuccuggaaccccagggaccaucacagcugccccuccccccaauuccuuggccugggaacacuguguccauaaaccaucccuuuucuccaagagcacagugaggccaccggaucucaggccucaucccucagggaggugggggaggggacggaggccagggccccuggcccaggccaggccacccaccaguucacccaggguaauucagagggaggugguucccuguacuccacaucugaccauccuagaaaucagaccugcuuccagcaccagaagccaugugaccugggucugugucuucccguuuccuccucuauuaaugggcaugcugauaagagcgccaguugccuuucccacggcacugaaacagagggaggugagcgcgugaacagguuucguccacuaaacagaucugaccaugagucaguucugagagggccgggugaugaaauccagagccccuuguaggggcaccugaccggggcgguggagacagcccagcaggaggaaggaagccaaaccccuccccaacaucccagcuuugcugagcuuguaugugggggugggggccgguguccaggaagaagucugucccgaccuugaaaaggugccccagccugccaggcggcuggcauuucaagggcaagggccugccugccugcugucucuggggcaccggcagcugguaacaaauccccugcaauuugcacccaccaauccugccugcucacugggcggccgcgagcuguuuuucacgcagagcugcgcacagcuuugucuuagagagacagcucuggcagggugucccugaauaaggccauuuguccucccaguaacgggaaggcggcugcauguucuggggugggcagaggcagagagggguggagagcagccacaagggaggcgugagggggagaucggagucaagccaccaaaagagaccaggaauguccccaccaccacggggucugagaguccaccauucagccaggugagagcaagagggcuugcuuucaaagacagaaguugaaacagugguuuaugaccuggcuuaagguguccugagcagaagagguagaaaugacuuggcuggccucugacaccugugccucucccaacaaucugaaggcuggagcacucuccagggcccuuggggucagggucuuucucugagcccuggggcugcugcacaaguuguuauagaagcucccugggaucgagagcuccagugaaguacccagccucucccaagcacucucuccauggaccacaggccacagacagggagggugagacagggaccccuuugcauuccugaaucuuuaccucccaggcuggccaggggcccagggcaugucucagccccccucuugugaucugcugacauuucccauggcugucaguuccucuggggacugucaaaacaucagggaaaccaggcugaggagauguuuguggacaaaaaguaagcgauccacucugcaugggacccaggacucgggcugcugcguugagaugggaggguguccuugaacagaggucagaaacacucauguccacagggcugguuuccaacgguggggaaggccaugggugugagacaauagagaaggauggggagggcacagcgccugucccagagguuagccaccaccacccagucagucccagucagcugugaggacgcggguccaagauucccacucaaaggaagccaggcauuugacucuguuguacaaauuuccuaaacagugaaugcuggcaacuuguaugcauaaaaaaaaaacauugagugguccaaucucaggugucugugggccacaucuggccuaugagcagccagucuguguuuucugauugacagccaccagccacucaucccuaaggaaagcuggccucuuccucagugguggcaguucuuccaguucucaccacucuccugaguucugacgaccugucucaggacauccugcggaagcuccaaggccuccuggaccugcugcucucucugcguuuugacuuugccaauagcaugagggugggagcccacagcugugaggccagccucaggaaga

SEQ ID NO: 17474 - RNA, 4785 nt, Homo sapiens
ugaggaaagaugucagccuugggcagacucuguccugggucugcaaggguugggaaagcugcugggcuggguaaggggcagugcgcggacagugaggggacucggccuggggagcuggucuggaccagcugcugguacucccacagacuagacucgggaacuggggggccucuggccucuuccuuguugcccuccaggaggaguggguuaaauucugggucacuaaguaucaucucagaauggccuuuaggucuuuugaagauuacuuaaaaauuugcucagacaaaaaguaagucauuuggaaacaaagguaguuacggugacaaaagauauuuaaguuuugucuuuuuuuuuuuugcuuauuauucuuauuauuagcucuuauuuuauuggauguuuauugaccccuuuaccugaggggcgccaacugggugggcuugggugggcugaggcugcugccagcgccagggccguggcccccgccugcuccaugguagccacucagaaggugcuuugugcucacaggcgggcgacuucaccaaccacaauggcacaggcgggaaguccaucuacggaagccgcuuuccugacgagaacuuuacacugaagcacguggggccaggugagugggggccuccucuagggugaguguccccacagcucugaccuggccuggaagccccagcaggcccugagaggccacaugcagucaccguccaguaucugaugagucuccuuccucccugcgacacuguaggcugucucagcauuucuggcuuguugaguuucccuagaguuuucucaucucucaguuuaaaaagcaggguuuccuuugggaacuuuguggaagaaccuuuaagcagaauggaggcccuggccaccucccuguuuguccucugaguuucggguuggaaauucuaggacacuuagaauuguugcagaaugguccuuagguccuuugaggauuauuuaaaaucuugcuuagauaaaaagcaaaugguuuggaagccagagugguuauuguggcagcaucgugucaccuauaagacccaagguagaauguggagaugucuggaggucagguccugggguccugccccaggucccgccccagcucuaccacugagagcuuccacaaggcccuguccucucaggccaccccacugagaacuagcaggcagcaaaggcaggcauacccuggggggcugguaucgggcccugguucuccucuucugggucccaggaucugcagacucgaaugucccuggugugguuugcaccgucugcccuuucaaaugcccucccaggcaggugccuccaggggcagcguggcucagcccugcugguuuuugcagguguccuguccauggcuaaugcugguccuaacaccaacggcucccaguucuucaucugcaccauaaagacagacuggugaguucccugccccaggcccucugggaaugcgggcagccuugcagcuggaggaggauucgugcacuuuuaggggcaggcaguuuacagccaggccuucugcucugggacaguggcccucucccaggcuguguguuuguaugagaaagagaaaguuaguggaaggaucaagggagaauugggguuguuccugcaacucugucaugguucggguucccauuguugcugucaccuggaauuuucugaguguguucugcucacacgcacacacgaaaggguuucucuaccagauacauuugggaaauguugcaaaacauauuaugaggccucaggagggacugaguagaagcccacuugugugguuuuaaccuggaguuucccaggcuugucuugaccaugggcugagccuuggcaaugcugcagcagacauuuggauaucagcaaauuuccaaaugaagccucuguauuaucauaaaccugcagauagccacaggccuguaagggcccuguuuucaaugcccauggauuuuagggaugucucuuuccugguacauuuuccucuaagggauaaauuucucuggccagagucccaaauguccuagcccuggggcaccuggggaugaacuggcugggagcugacuugguaaagcccauuuccgaggauuuuagggagaccuagguggggcagacacuagaaguguccagccuccaagcccaagagauguggccggcagggcugggcagguccuugcuggcucagccugcucuuugcuccuucaugggaccccaguggauccugcaguucugcucuuggcuggaaccacgccagcuucgcuggagcuggacugagccgccuuuuacauuauuggacucucucggguugagagcugcccaggacuccugcaguuucaccacccuuguuccuuugacucuugacucaucauucaugaccguuaacgugguuccauuuguauggacuucuucuuucuucagagcauuucaguauccuguuaccuccccaugcagaacaaagaauacuccacuuuugauagaugggguuaccaggauucaggcuacauggccugaggcaaggucacaacaugagugacagaauguguccuggaagccaggcauccucugggguguauuuggggcgcucaacaaggcuugaucgagcuuuggggguagaucuagcuauuccauggggauucuuuucagaauugcuguuuucgguaacuaauuccaugaccagguccauggcauuggaugacauugcgcuacacuguugcucacccgggucacccguccucacagguuggauggcaagcauguuguguucggucacgucaaagagggcauggacgucgugaagaaaauagaaucuuucggcucuaagagugggaggacauccaagaagauugucaucacagacuguggccaguugagcuaaucuguggccagggugcuggcaugguggcagcugcaaauguccaugcacccagguggccgcguugggcugucagccaaggugccugaaacgauacgugugcccacuccacugucacagugugccugaggaaggcugcuagggauguuagaccucggccaggacccaccacauugcuuccuaauacccacccuuccucacgaccucauuucugggcaucuuuguggacaugaugucacccaccccuugucaagcauugccugugauugcccagcccagauucaucugugccuuggacauggugauggugauggguugccauccaagugaaagucuuuuccuugaccaagggggacagucaguuuugcaaaaggacucuaauaccuguuuaauauugucuuccuaauugggauaauuuaauuaacaagauugacuagaagugaaacugcaacacuaacuuccccgugcuguggugugaccugaguuggugacacaggccacagaccccagagcuuggcuuuugaaacacaacucagggcuuuugugaagguucccccgcugagaucuuuccuccugguuacugugaagccuguugguuugcugcugucguuuuugaggagggcccauggggguaggagcaguugaaccugggaacaaaccucacuugagcugugccuagacaaugugaauuccuguguugcuaacagaaguggccuguaagcuccugugcuccggagggaagcauuuccugguaggcuuugauuuuucuguguguuaaagaaauucaaucuacucaugauguguuaugcauaaaacauuucuggaacauggauuuguguucaccuuaaaugugaaaauaaauccuauuuucuauggaagacugguaccugguuucuggaagaggggucugugacuuggagcugaucuuuacugagcucgccguggcagaugccaugcucaggacguucauguggaugguuucaugucaucgugcuggcaacuuguccucccugccuuagagaugaggcucagacaaacgaccuuagcacccauagccuaugccaugagcacuggcuccacccugaaucccagcuccuccccuuagugaccccaagucuguuucccucagcugcauaaggaggcgauauaguuugaauauuuguccccagccaaaucucauguugaacuguaauccccagugcuggagguggggccugcuacgagguguuuggaucauggggacggguauuucauggcuuggugcuguuuucuugauggugaauuauugcaagauacggucauuuaaaauuguguggcaccucccccugcccccuucuugcuccugcuuucaccaugugacaugccugaucccccuucaccuuuugccauggucauaagcuuccugaggccucccuggaagcugagcagaugccagcaccaugcuuccuguacauccugcagaaccauaagccaauuaaaccuuuuuaauaauaaauuacucagucucaaguauuuuuuuauagcaauacaagaauccuaacacggguuaacaauaaggcccaccucguaggguggugauccacgugaagugcauaacgcagugucuggcgcaccuuccuaagcacucuggagugacaaggaugaugaccuuuccccugucagggucuuaggaaggaggagggaugccagagcaaaggagccuccaucaucugagguuaggaguggacuuccuaggauaagccaguuccauuuggaauugacuucuagguguuuccaaauucacagggaaggcaggauuggagguaagagcuucccuagguagacagggcugugguguggcccggcaguugaguggucaggcaggcaguucucagaggaaauuugggcccuuuugagggcaucuaaca

SEQ ID NO: 17475 - RNA, 4785 nt, Homo sapiens
uguuagaugcccucaaaagggcccaaauuuccucugagaacugccugccugaccacucaacugccgggccacaccacagcccugucuaccuagggaagcucuuaccuccaauccugccuucccugugaauuuggaaacaccuagaagucaauuccaaauggaacuggcuuauccuaggaaguccacuccuaaccucagaugauggaggcuccuuugcucuggcaucccuccuccuuccuaagacccugacaggggaaaggucaucauccuugucacuccagagugcuuaggaaggugcgccagacacugcguuaugcacuucacguggaucaccacccuacgaggugggccuuauuguuaacccguguuaggauucuuguauugcuauaaaaaaauacuugagacugaguaauuuauuauuaaaaagguuuaauuggcuuaugguucugcaggauguacaggaagcauggugcuggcaucugcucagcuuccagggaggccucaggaagcuuaugaccauggcaaaaggugaagggggaucaggcaugucacauggugaaagcaggagcaagaagggggcagggggaggugccacacaauuuuaaaugaccguaucuugcaauaauucaccaucaagaaaacagcaccaagccaugaaauacccguccccaugauccaaacaccucguagcaggccccaccuccagcacuggggauuacaguucaacaugagauuuggcuggggacaaauauucaaacuauaucgccuccuuaugcagcugagggaaacagacuuggggucacuaaggggaggagcugggauucaggguggagccagugcucauggcauaggcuaugggugcuaaggucguuugucugagccucaucucuaaggcagggaggacaaguugccagcacgaugacaugaaaccauccacaugaacguccugagcauggcaucugccacggcgagcucaguaaagaucagcuccaagucacagaccccucuuccagaaaccagguaccagucuuccauagaaaauaggauuuauuuucacauuuaaggugaacacaaauccauguuccagaaauguuuuaugcauaacacaucaugaguagauugaauuucuuuaacacacagaaaaaucaaagccuaccaggaaaugcuucccuccggagcacaggagcuuacaggccacuucuguuagcaacacaggaauucacauugucuaggcacagcucaagugagguuuguucccagguucaacugcuccuacccccaugggcccuccucaaaaacgacagcagcaaaccaacaggcuucacaguaaccaggaggaaagaucucagcgggggaaccuucacaaaagcccugaguuguguuucaaaagccaagcucuggggucuguggccugugucaccaacucaggucacaccacagcacggggaaguuaguguugcaguuucacuucuagucaaucuuguuaauuaaauuaucccaauuaggaagacaauauuaaacagguauuagaguccuuuugcaaaacugacugucccccuuggucaaggaaaagacuuucacuuggauggcaacccaucaccaucaccauguccaaggcacagaugaaucugggcugggcaaucacaggcaaugcuugacaaggggugggugacaucauguccacaaagaugcccagaaaugaggucgugaggaaggguggguauuaggaagcaaugugguggguccuggccgaggucuaacaucccuagcagccuuccucaggcacacugugacaguggagugggcacacguaucguuucaggcaccuuggcugacagcccaacgcggccaccugggugcauggacauuugcagcugccaccaugccagcacccuggccacagauuagcucaacuggccacagucugugaugacaaucuucuuggauguccucccacucuuagagccgaaagauucuauuuucuucacgacguccaugcccucuuugacgugaccgaacacaacaugcuugccauccaaccugugaggacgggugacccgggugagcaacaguguagcgcaaugucauccaaugccauggaccuggucauggaauuaguuaccgaaaacagcaauucugaaaagaauccccauggaauagcuagaucuacccccaaagcucgaucaagccuuguugagcgccccaaauacaccccagaggaugccuggcuuccaggacacauucugucacucauguugugaccuugccucaggccauguagccugaauccugguaaccccaucuaucaaaaguggaguauucuuuguucugcauggggagguaacaggauacugaaaugcucugaagaaagaagaaguccauacaaauggaaccacguuaacggucaugaaugaugagucaagagucaaaggaacaaggguggugaaacugcaggaguccugggcagcucucaacccgagagaguccaauaauguaaaaggcggcucaguccagcuccagcgaagcuggcgugguuccagccaagagcagaacugcaggauccacuggggucccaugaaggagcaaagagcaggcugagccagcaaggaccugcccagcccugccggccacaucucuugggcuuggaggcuggacacuucuagugucugccccaccuaggucucccuaaaauccucggaaaugggcuuuaccaagucagcucccagccaguucauccccaggugccccagggcuaggacauuugggacucuggccagagaaauuuaucccuuagaggaaaauguaccaggaaagagacaucccuaaaauccaugggcauugaaaacagggcccuuacaggccuguggcuaucugcagguuuaugauaauacagaggcuucauuuggaaauuugcugauauccaaaugucugcugcagcauugccaaggcucagcccauggucaagacaagccugggaaacuccagguuaaaaccacacaagugggcuucuacucagucccuccugaggccucauaauauguuuugcaacauuucccaaauguaucugguagagaaacccuuucgugugugcgugugagcagaacacacucagaaaauuccaggugacagcaacaaugggaacccgaaccaugacagaguugcaggaacaaccccaauucucccuugauccuuccacuaacuuucucuuucucauacaaacacacagccugggagagggccacugucccagagcagaaggccuggcuguaaacugccugccccuaaaagugcacgaauccuccuccagcugcaaggcugcccgcauucccagagggccuggggcagggaacucaccagucugucuuuauggugcagaugaagaacugggagccguugguguuaggaccagcauuagccauggacaggacaccugcaaaaaccagcagggcugagccacgcugccccuggaggcaccugccugggagggcauuugaaagggcagacggugcaaaccacaccagggacauucgagucugcagauccugggacccagaagaggagaaccagggcccgauaccagccccccaggguaugccugccuuugcugccugcuaguucucagugggguggccugagaggacagggccuuguggaagcucucagugguagagcuggggcgggaccuggggcaggaccccaggaccugaccuccagacaucuccacauucuaccuugggucuuauaggugacacgaugcugccacaauaaccacucuggcuuccaaaccauuugcuuuuuaucuaagcaagauuuuaaauaauccucaaaggaccuaaggaccauucugcaacaauucuaaguguccuagaauuuccaacccgaaacucagaggacaaacagggagguggccagggccuccauucugcuuaaagguucuuccacaaaguucccaaaggaaacccugcuuuuuaaacugagagaugagaaaacucuagggaaacucaacaagccagaaaugcugagacagccuacagugucgcagggaggaaggagacucaucagauacuggacggugacugcauguggccucucagggccugcuggggcuuccaggccaggucagagcuguggggacacucacccuagaggaggcccccacucaccuggccccacgugcuucaguguaaaguucucgucaggaaagcggcuuccguagauggacuucccgccugugccauugugguuggugaagucgcccgccugugagcacaaagcaccuucugaguggcuaccauggagcaggcgggggccacggcccuggcgcuggcagcagccucagcccacccaagcccacccaguuggcgccccucagguaaaggggucaauaaacauccaauaaaauaagagcuaauaauaagaauaauaagcaaaaaaaaaaaagacaaaacuuaaauaucuuuugucaccguaacuaccuuuguuuccaaaugacuuacuuuuugucugagcaaauuuuuaaguaaucuucaaaagaccuaaaggccauucugagaugauacuuagugacccagaauuuaacccacuccuccuggagggcaacaaggaagaggccagaggccccccaguucccgagucuagucugugggaguaccagcagcugguccagaccagcuccccaggccgaguccccucacuguccgcgcacugccccuuacccagcccagcagcuuucccaacccuugcagacccaggacagagucugcccaaggcugacaucuuuccuca

SEQ ID NO: 17476 - RNA, 326 nt, Homo sapiens
auuuucugcuccucaguaaggaaagcaugcuugauccugucacgaacacauuuagcacacauggaaccaccacaggcccugcugacauguuccuuuguuuuggacaaucucauaagaacuuuaggucuuacagcaggaaccacuugaagucugccugggcacaugccacaugcagauuuuggugcuuucccaaacuucuugguauaaagauaaacaauucuauuaccagggguucgggacagccuaguuuugguucgggacagccuaguuuuguuagaggcuguauuguaggaaagccuacaauguaugucaaacgcuggaccauu

SEQ ID NO: 17477 - RNA, 63333 nt, Homo sapiens
caggggcccacgcauuccgcaggccacggcugcggcgucgagguccucgcggggcguugcggucgccccuuuuggcgggcucgggcgccccgaaacuccgccccccggcgcgguauuuccgcacucgcgcaggcgggugccgcgcucccauugguggaguggcccgcgguggccccgcccccucccggccccgacgcgcgcacguugaguggcgggggaaggcagaagaacugcccgagggaggagcggcuccgaggaccgggcagcgcauuuggggugcccgcuacagggccccccaagaggcugccaggucgggagcgcagccugaggccacggggggaagggggugggugggcugagagcagcucggcggcgagacuggcccgccgccccuuccccccacacccgucgaccuugugggcagaagcuucccagagcuccuuaggccggcgcgauggcgacugcuguggagacggaggccugucagccgacggaugcgaguugggaaaguggcggcggcggagacgacgagaugaagcaggcgcuuccggagcuugaguccucccaacaaaauggcggcggcggcggccucaacaucgcugagcccagcggcggcgcugggcgugaggagaacgcgggggccgaggccgcccagagccucagccacgagcagccucaggacuccucugaggcgggcgcggccgcccugcccagaggccccgaagagcccgaaaggccuguuaggaggaguuuucagauccccaggaagagcagagaaaagaaagguggugccuccccuucuucucaacccccucucucucuccccuccaucuuuucauuagaaucuuucuaucuccucuucccacacccauccgagauacguaaacacgcaugcagcgccggccgccucuccccucaccgccacggccgcccagcugccgcguuuggugcgagagaaagcgguggaaccacgcuccccugcugccccuccccgcggaaguuggaaguagcucagguuugaagcuuguccguaaggcugcagcucccagagaggaaagauggugcucggcgccccucccucccagccccugaaagcagagaagccguuguguccuccuaaggaugcuucugagaagucucgcuauggaaauagcccguggccauggauucuggggcuuucuccaaggccauugccaauguucugaggaccaugagugcuucuccccguggaaauucuucaguucugugugucuacuugaaaugugcuugaugucagcguccucccuuauuuagaaaucucuauuaguagaugugauccaugcacacugcuguuuuccaucacacuucauuuccauguagauuuuucccccuuguuuuugaagcguuagauuaaauagguuuuucucucuuuaaauucgaacuuaguauuguuuuucuuauauuugaaaagaauggaaagguagguucuuggagcaguaauuucccaauggaaaaaaacuaaugagaaguuaccuuauucucaagagucaccaacuuggucuucuagaugguagaacuucagguuaaaaaaaaguccagucuuaguuuuuggaacccauauggaaacaguuacauuaauuacuuguacuuuuaaaaaaucuuaaugccauauuguuaauauggagucagaauuccuaauggaggucaaaauuaguaucguuuuuuguuauugggguauuauuuuuuaacuauccaguaaauuuuggauauucugaauuuagacaacuuccuuuuugcccuacuguaugguuagguuuucauuauuuacuuuggaaaaaaauaggauuuguuuuuuucccguaucuuuuccauccaucugguacagagucuuggcuguagcauuauacugacuuuccauaagcaucaccaguuccauuugcacuacuggaauuguuugagccuuuuauuggaaaaauacaaauaaaguucauuuguuuggauggcaaagccaagaaaauacuuggugugagaaaccauguugacaaagaugaaguuaaccuuuggaaauuagcaugaggaauguuucuagaaauaucuuuugaguuaauguaauuuuaggguucagaaagauacuuuuaaaggucaaaacucaguucuuuucguguauuuaguuaaaauuugagauguaugauuauagucuguaugagaaaaguucccaguguaaucaauugguagagaauagguaggaaguacauucaaaugggcucugguuaugagguaggagguggaacuauuuuuuuucuucacagcuugauaaaagccguuugaaaucuauuuuuaagguuuaagugccuaagaauauggacaaaccgugauuuuuuuuuuuuuuuuuuuacuguuuguuaggaccagaagauuggccuagaaacucuucaaaauuuaguuugaaaugugggaaggcaguaggaacuggaaaggcacuguguuuguguguuuuuuuaaaauuagauaaaauccagagauuguuguaaaauagacuucagcugaacacacuaaaaguggaaauaauugagggauuaggaaauauaaaucuagcuguugucccccauagucuuguaccucuuggguaaaacuuguauuuuccauuuuuacuuacagacaaaaguugggaggaaaauauaucgcaguggacuuugucaugauuagugaaaaugagcaauuuuuaacuuguguaauuauuuauacccugaacaccagcuguucaaauaguaaaauagcgauuuaaauagaacuuuaaaaaauuaaauaagcagcuauuuuaccaccaugaauuuuaucuuguucaagcugagagaaguuagugguugcugauagaauuuaauacauaaauucaacuuuauuaaaaaaauucaaaaacagugcagguucuguugcauucauauuuuaauaugguagaccuuuucuugugacugugcuuuuccagugaaauuuaagauuaggacuuaaauauuuuaauaccuuaaaggucacugcuaugcaaauacaacuugacucagaaaguucuuuuuuuggucuucccaguagugugacauccaaaauaacugccauuguaauugaguaauaauauuggcaaacacuuguauagugccuaauaaguugugggcauuguucuaagcaauuuacauacauugacuaaaucucaacaauguuuugugguagguacuauucccauuuuacagaugaggagacuaaaguacugagaaguuagguaacuugcuucaggucacacagcuaaguuguggagauggaauuugaagguaguuguagaguacuuuuacuacuauaaaaaagaaaaaucuugcuacccaguuugaauaaucuaaggguuuaaguuagcugcuuuugaccugaccuguuaguaacaaaaacuguucccccccuucauuaaauauagaaauauuuaguauguuuucauccuuggggaauuuugacauucagaaauuauguuuacuaucaacauuugguugguacugacauacuaagugcgucuuugacuggaaagguauacauuuuacuguuuuugauguauguuauuuauuggcugaggcaugauucuuacauuuaaccaaauuauagaauuuaaccaaauuguagaauugcauuuuguugguagauguuucacuauugccuucuuuaaaucuagugagucauaaaaaguaaauuaaaauugguaauugcauuugauguaauuuuucccuccaaaguucuugggaaauggaguagcgaugauucacuuucuggaaaacguuuauugguuaauguuuuuguaggguccaagggagucucaaaaauuaauugcgcucaugcacuaaauuuccauacugguuuaguccagaaguaauggcuaauucuccuaaccuccaucuucccccacaaaauuuucacuugccuuuuugaagucauuggagccaagucucauucuuaaggaaauuuccaugguauuucauuaguuguauauggaugaguggguucugagaacaauagcucucuccauacauaauagcaaaguaaucaagguaaaauuuacuuugagcuauccucaguccaaaaaacuuuguuucguauuuguacucuugauuccugccagcauauucauuucuaauuguacacuauguucaaccuuguugauguagagaugaaguacccacuccuaaaguauugucugugguaauuuuuuuuagaaugaagaaaagugauuuuaaaaaaagaucuuacugugaagaacaaauggauggagagugguuguauuauaaucauuaauaggcgucagcugugaauucagaaaauuucagauccucagccucuucuugcuaauuauuucgucaucuucuauguauuaguuacuuuaaaucagacaauuguuuauuuguacuucguaugacccauuuguaugucuuuuuuuuuuuuuuuuuuggagucagagccucuguugcccaggcugggaugcaguguugcgaucccggcugacugcagccucugcauccuagguucaaaggauucuccuuccuuagccucccccaguaguucggauuacaggcaugugccaccacgcccagcuaauuuuuguauucuccuuagaggugggauuuugccauguuggccaggcuggucuggaacuccugaccugaagugauccgcccuccuuggccucccaaagugcugggauuacaggcaugagccgccacgcccagccccauuuguauguuuugauaggaaugauaugucuuuuaaguuuagcuuuuuuaaauuuauguauauaugauaauauuuuuugugauacauguauacauaauacaaaaagaucugccuuaacaccaaacaaauugguaaaacuaauugaugaagauguucuuuugauuaaggaacaaagcuguuugaugaccuaaauuauauaucaaugcccacugccuuuauaaauacaaccuucaaaucuugagugugggcugggcaugguggaucaugucuguaaucccagcacuuugagaggccgaggugggcgaaucacgaggucaggaguuugagaccagccuggccaacguggugaaacccugacucuauuaaaaauacaaaaaauuagcugggccugguggugggugccugaaaucccagcugcucgggaggcugaggcaggagaauagcuugaacccaggagguggaaguugcagugagccaagaucgcgccacugcacuccagcccgggcaacagugcagaacuccaucucaaaaaaaaaaaaaaaaaaaaaaucauaaguguguuuuguaugauacuaguaauaaaaaauauuugaugauaguauggcuaagagucaggaaauuugaauuccaguugaaauucuaugauacuaucaguuuccucguuugaauuauaaaucucuaagugcccuuguaaaucugcucuucagucucguaaaauacaucuauaauuuguaaguagggaaaccuugugugaucaguaaucaacuuagcuguucuucugacaggcauuuaauggaaaucgaucaaauaagcaaaauuacacauuucuuaaugugugaaagaacuucuauugcuacugcuguuaaccuuuauaaaacaaaggguguuacgacucuuggcccuguugucucuagaggaaaauuaaaaucagaaaaaauuaagaaauuugagagaagauaggaagguagaaagagcaguauuagaacgaaauucuuuguucuuuuauauuaacuuccugugucuaaguguuguauaugauuucuagucuauaaagugaggaaacagucauuuuuccagcucuugacaugauuggacauuguaugucuaauacccauaugcacacacacaucauauauuucaggauacaagaaagggagcuuaaccacuugaauuugaaucccagcagcuugauucauucauuaacccuguaaccuugggccaacucaaaaggcuacuugucucaguuucaauugagaaacgggcauguugaacuucauaguguaguuuugaugauugagaugauauauguaaagcucuuaguacaguauugaaggugguacuuaaccacuaaugguuagacaguaacugucaaucuagagaacaguguauugaauacugaguucccugagugaaauggauaauucauauacauaaugcuuucccuauuuggauagacacaggguuguuuauuauuacuaccucaaauagugacccauaauugagauuuuugacuuaaauauuuucuuuaaaaggagugacaggauacauugaucgagauacauguaguguuaaaugaccucugaggacauaaaauagacuaccagaaaauguacauucagaacaugaacuuaauaaauuuucugaacugcuguuagcagcaaguugacuugaaauccuuaaaaauaguugcaggauaauuuuauuaucuuagaaauuaucaccagaaaaaaugagaaauuauaaccggccuaacgaagccacugaggcauuugcaauacaaaauaauuaggauacagauauuuauuguuaaagcuaaaaugcuuuuuccuuuucauuugcaauaauuuuuuuccugucagcugucauuuuuaguacauuggacaugacuuggacauugcuuuagagucaacuggaaauguuaaguacuuugagaauaauuuggaugugaacuuuuaugcagauucaugauuugacuaauuuuuuacuuacgauuagauuaaugguagaaauuguauuggguagcuuaacuaaugaaaauuucuuuuauguagacuaacauuucauagaaauuggcagccaugugauaccuuuuuuuguguacauuuuauauaucugaagucauuuuguuuagaaacaaaaucguguaaaacccaacuuuuaaaaucauaacccaacuuuuaaaaucaugcuuggcccacuuugguugugaaagccuauaaagaccuccacaugcugcuuuccuugccaaguuuuucacaguuuaauuggggacaauuaucacaaagauaagauguuuuuguccuacguuccauaacacagguuugaaugaagacaauauaugccuucuacccucuuuucugagcuuucauuuguguuucguauauuacugaauuguugaauuugugaaagagucaauuuuaaaucacagucauuuaguaguagaauauauuguuaccauuuuuaaagcucuugacaaaauuucucauuuucuugacuauuuaauauauuuagggcuggcacucacaggucuagcuacugggaugugggaaacacgaguaaugagcaaggcagguuccugcucucauggagcuuacaaucaauagguuaccgagcauauucgucugcuacaaguuugauuauaggacacuuuguguugaguagucuuguucuauuugaguacuuguuugagcuuacuccuguuuauuuuuuaauuguauugcuauaacuguugacuauuuuuuucgugcacaguucgaaaauagugguaaccauuuguuuguacacauugugccauugaaaacuacguuuuuacagacacuuauguaauauauacaugcuuugguaaaugaauggaugaauggcucugucauuugacaugucuuuuaaagucuaauaaucauguauaaaaaagauaacgguucgcugcaucuguuaccuuuaggaguauguacaaguggaacauuauguuuucaguagugaccuguuuugacuguuacauucuugacccuuauuaaauagugucuugaaagaaauuaagguaauagagaauaacauaguuucuaugaguaguucucucuacagugaaaagugguuccuuuuugauuuggggaaauauauauauguauagacuuuuagguguauuaguaaauuaaaguauuuugugcauaagauggaaauuugagguuacuagaccaguaauucucaagaacuaauugcauaguugauuuaaauguuuuaaaaauuaaguggggaccgggcacgguggcucaugcccguaaucccagcacuuugggaggccgaggcagguggauuaccugaggucagggguucgagaccagccuggccaacauggugaaaccccauaucuacuaaaaaucuaaaaauuagcugggcgugguagcaggcaucuguaaucccagcuaguuggaagacugaggcaggagaaucgcuugaaccugggaggcgcggagguugcagugaaccaaaaucgugccacugcacuucagccugggcaacaagagcgaaacuccaucucaaaaaaaaaaaaaauucagugggauguagaaugguuggggauguggaggauaaaaacuuaaauguccuggcugggcacgguggcucaugccugaaucucagcacuuugggaggccgaggcagguggaucacgaggucaggagaucgagaccauccuggcuaacacagugaaaccccgucucuacuaaaaacacacacacacaaaaauuagccgggugugguggugggugccuguagucccagcuacuugggaggcugaggcaggagaaugguguguaccuuggaggcggagcuugcagugagccaagauugugucacugcacuccagccugggugacagagcgagacuccaucucaaaacaaacaauguccuacuaugcgucagaugcuaugcuuagagcuuuuuccacguguugucuaguguggcauguggcauauagugguuauuagaguagcuggaguuugccauuuuacauaugagagagcugagcuauauaaguaauuuauuuaccugcauuuuacuccaagccaguaaugcuaggucugguauuuguguccagcuuugacucuaaagccccacauguuuucauuuuacuaaguugucauaauaaauguucuacuacuuuuuguggauuauacaagaagccacgugagugcagcauuuuauuuuuuauuuuuauuuuugagacagggucucucucucacucccagacuggagugcggugggagaacguggcucacugcagccuugaacuccugggcucaaaggauccuccugccucagccucccaaguagcugguacuacaggcaugcaccaccaugccuggcuaauuuuuuuuuuuuuuuaaugguuuguagagacagggucucacuguguugcccaggcugcucuggaacuccugagcucaagcagucuugcugccuuggccucccaaagagcuggaauuacaagcaugagccaccaagcuuuuuuuuuuuuuuuuuuuuuuuaaacuuaaagaccagugugucaguaacagcauauuuuguuacuucacauaacgucuuaaaugcuuuuauggucucauacaugguauagguaguuugcugaaauacacagucugagacauacuucaguguaacauaaaauaggagcuaaguugaguauaaacacagguucuuuuaagagucuuuaagcaauuuagguugccuaauauagcaugccuaagguuugcaaaauugcaccuuccuugucuauguauguaaugccagauccucauuguugaaggaacugguguauguaggcaacuaguuuuacauuuuuuuucaaugaguuaauaaguaucucuuuugcguaucacaaaguaagauagccuugaugccuuuuuucaugguauuuaaaguuacauuaacccacaaaaauauaaaaagcuauauuuaagauggaguaauguuaaacauuuuaaauguuuguuuuuuuauuuuagcacuuuuccagccauuaacuccaggcucucgagaauuugaagauguuguaaauauucuccauucuucuuaccuugaaccaaccucaguaacaaauuuuaacuacagacgugcuugcuugguacacaaugagcuuuuggaaaaggagguauguuuuaaauuauacuuacuguaagauuguuuucagaaccaguuaacagccugggaaaaaaauguucucuagaaauacuaaaauuuuuaggaaaaccaaauuacaaagggaaaacaaguuuuuuuuuuuuuuuuuuuuuuuuuggagacggaguuucacuguuguugcccaggcuggaguacaguggcgcgaucucggcucacuacagccucugccucccugguucaagcaguucuccugccucagccuccaaaguagcugggauuacagucaugugccacugcaccugccuaauugggaaaacaaguuuuaaaugacaucucuuuuuuccaccagauguugcuguagcauuacauuuaucugcuguguuaaauuguuacuaauaugcaauuauguaaaauaacuuuuuaacugaaaaucuuaaguguagagauagcuuacuagcuaaugguucaauuguaaauucagcugagcaugguggcucaugccuguaaucccagcacuuugggaggccgagguggacgggucgcuugaggccagggguuugagaccagccuggccaacguggcaaaacccgucucuacgaaaauuagcuaggcgugguggcacaugccuguaaucccagcuucuugggagggugaggcaggagaauugcuugaacccgugagguugcagugagcugagaucgcgccacugcacucaagccugggugauagaacaagaacucugucucagauaaauaaguaaauaaauaaauugugaauuaguagggcuuuuugcucuuugaguauuguacauguuaauuaaaugccuaaauuggaagguaauuaaugaagucaaauauauggguguguuuguuuuuaggacaugcuucauuuuuuccacaauuauugccugguggcuauauuaggauuuuaucauuaguacauauucuuagugaaaaaguucaaacaaagaagaauaauugagcauguuagacagugaacuuaaguuucauguacaaauuagaauauuugaguuuugauuuaggaaaagccagaauguauagauguuuugaaauauuugaugcauaaugauuuccgauggaccugaaauacgaauuuuuuauuuuugcaaguugguuaaccaagugguaccaggauuuaauuuugaaagguucccuaaagggcacugaaucccagagaaaauuaaaaucuuaguaguuugaauugaugugguuucaugguaugguagcgauuauuuguuaauuucauaugaaaauuuagucugaagauaaauuaguuauuaaagagcaguaauagccugaauauaaaauguuagcuauuuuauauuuuaaaugcauaucuauuuuauagauaggaaagccagugguuuaggauaacuuauaguuccaacuaguuagaaaaagucacucuuccauccuauaaauauguauggagcacaucuuaugugcuuggcauugagaauacaguuacagagaaaagaagcauuuuucuuguccuaauugaguuuauaaucuagaaguuggucauucagcagauuuauuaaaccaccuguuggaugcaguguaccauguuaaguaaaauggaagauacaaagauaauuaaagcaugaauuuauaaucuaugggagaguuggaaugugguaaaauuauaagauaaauuuaaagauuggugagcauuagauguuuauuugacuauauuaauauuauauauaaagagccaguuaaaauaggggaaaaacugaaggacagagaguauagagagauagagauuauuuuuccauuuugguaggugugagauuucuuggaaaaaaaaauaaaacuuguagcuugaaaaacauaaucacaugcuaaguaguuguuauaguuuuaauuucauuuaguuuacagaaaagcgaagagaacugaaguuugauggucguuuagauaaggaacuuucagaauccuaugcauuucugaugguugaucgauaccaggugaguuaacgcauuuuauaaaaaacaauuuggggauguuuccauuguaaguuacuaauuuugugauuauucaacaguauucuuuacaauuacagacuuuuuugauauauaaguggaauacaugauuuaauggggcaaaauguuuauuguuuguaauuuguuuuucaaauguacucaguuuuuucucugaccaguccuauuuucuuccccuagaaugugcuugauaauaauacuuuucuguuuauuuauuuauuuuuuucugagauggagucuugcucugucacccaggcuggagugcaguggcgugaucuuggcucacugcgaccucugucuccugaguucaagcgauucuccugccucagccucccaaguacaugggguuacagaaacacccccccacaccuggcuaauuuuuguauuuuuaguagagacgggguaucaccaugugggccaggcuggucuugaacuccugaccucaugauccacccaccucggccucccaaagugcugggauuacaggugugagccaccgcgccuggccuuuuuucuuuauuaagaagacugucuucuauauuguugauuauaugugagauuaucuucuauauuguugauucuaugugccuggaaccauuuuuccuuuuuuuuuuuuuuuuuuuuuugagauggagucucacucuguugcucaggcuggaguuaaauggugugaucgcggcucacucacugcaaccuccuucucccagauacaagugauucuugugccucagccucccgaguagcugggauuacaggacacgccaccgcacccggcuaauuuuuuugcguuuuuaguagaguugggguuuccccauguuggccaggcuggucuugaacuccugaccucaagugaucugccugccuuggccucccaaagugcugguauuacaggcgugagccaccaugccuggucuguuuuuuccccuuuuaaucgaagauauuuagguggaauaauauuuugcuguuucuaauucucuuugaaaagaauugguuauauauauugaguggcaggaguuaagaguaucugucacaccuggcaugaagaaaaaugauugaaaaguagccaggcaugguggugagcacuuguaguucuaguuacuugggaggcugaggugagaggaucacuugagcccaggaguucaaggucaugccacugcacuccagccuagagggcagagggagacccuaucucuaaaaaaauuaaaaugaagaaaaauggauucuagauaugguuacuuugagaaguguaagucaguuuuacauuaauauuuauaaaguggcaaauauauaagauuucugugaucuagaaugauacauaguuaagaagcuuuguuuuuauuuaaaccaaguuuauaaaauuauuuuuucauguuuuaaauguuguuaugacugcaagaugaaguauuuuuuuuuaaauuuagguucaaaccauaugugaaaaaggauuacaugugggucaguccaaaauaacaauucuuggcaguccuuccauggguaaucuuuuuucuuuuuaaauauaaauaucuacuacuaaguugcugucuaaaaauacauugucucguaauuucacugcaguuguuauuaaauucaugcuuuauuauguucccagaaaaagacuagucauagguucugaaauguaagaucaguuuuaucuuuuguuucugauuuuugaacaccucaaauugaugaaggauaacuucuuaaaaaugucuuauuuuaguccuagugauuuugaaaaauauaaucaguuuccuuaauuuuuccgucuuuucuaggugucuaucuuucuagguaugcugauuuauuacaagcgaauccuuuggacacgggggcaaugggugauguuguuauuuuuaaaauaaugaagguaauuuaaacuuacacacuucauguaugaaaaacuacacuugauuuggauuuuaauuuuuagaugaugcuguuuuuaggagauuguuuaaaaguucaugcuuguuaguguuugguacuuaaagauacuuuugaaaaugguuuauuugccaucuuuuuuuguguguguguuguuuuuuguuuuuugguuuuuugagauggagucucgcucuguugcccaggcuggauggagugcaguggcgccaucuuggcucacugcaagcuccgccucccgaguucaugccauucuccugcuucaaccucccaaguagcugggacuacaagugcccgccaccaagcccggcuaauuuuuuguauuuuuaguagagacggguuuucaccguguuagccaggauggucucgaucuccugacuucgugauccacccgcgucagccucccaaagugcugggauuacaggcaugagccacugcgccuggccuauuugccaucuuugagcuaagcuaaccguacuuaagaguuuguuuuccuuuccaaagaaaggaauguagagaguaauauguugguaauaugauuuauauuagugaagaguauuaugaauggaguuucuauuuacuuguuauuaaacaaguucaaaugauuuuuuuuuuuucuuuuagugauuagcuuuuucuuacugcuucaaauuugguaaaaguguucuaugagauauuauuuuauuuauuuuuuggagacggagucucacucugucacacaggcuggagugcaguggcacaaucuuggcucacugcaaccuccgccucccagguucaagcaguucugccugccauagcuuccugaguagcugggauuaaaagcgugcgccaccaugcacugcuaauuuuuguauuuuuaguagagacgguuucgccauguuggccaggcuggucucgaacuccugaccucaggugauccgccugccuuggccucccaaagugcugggauuacaggccugagucaccgcgcccagcuguucugugagauauuaaagggaaaaaaugguugggauaguugaucuauauucaaagaaguauuucauaauauuaauguuauauagucaacaauuagguuuagguagacacuuaaaagguuuucucuauuuuaggguaaaauaaagaguauauaugaccccauggguguaaaaaguuuggaaucuauguuaaauaagagugcuuuggaccccacaccaaagcaugaaugucacgugucaaagaaugccaaucgaauuacaucacuuuuggcuuacagagccuaugagcuuacucagguagguuccaggauccguuguaauguugugaucucauaccuguuuguuaccaaauccuuuaaaaugucucccuuucaguucucucuguccccacauuagucuagacucuggugucugcauaucacuuccagacuccagugucuguugcugcuguuuguucaguguuuucugagaugucucagaaacaugcagugggucuucaagguuacaggguaauauuuauagacucccuagucuagcucuuccugccaguagacugugaccugguuuuuauaugaucauugcccucaacacaccucauuucauuuugaaaccuuggcauuuccuggccuagaaagaucucuugccuaauaagauacuacucaucuuucaagguaaaguugaaaccccuugaaauaaucuuaaugcauaacauuuuauacuauugauuugauagguauuuucuaucuuuauuaacauuuuuaaagaugcaaaccuagaacuauuuuuuaagccuuauucaaguauaauugacauauacuacaccuauauaagaguaacauuugaugagcuuuaguguuaaguuuuuauaugagguuugacuauaaagcaaugguuuuuuguuuuuguguuugucuuuuuaaauagagaugggggucucccuguuuugcccaggcuggucuagaacuccugggcucaagugaucuucccacuucggccucccuauucuuguuuuuuaauuauuaguauuuuguuguuuugagacggagucucgcucuguuguccagucuggagugugguggugugaucuuggcucacugcaaccucugccccccagguucaaaugauucuccugccucagccucccaaguagcugggauuauaggcaccugccaccucaccuagcuaauuuuuuguauuuuuuuuaguagagaugggguuucaccauguuggccaggcuggucucaaacuccugaccucaggugauccugucugccucagccucccaaaguguugggauuacaacugugagccaccacacccggcaccuguucuuuuuaacauuaaaaaaaaugucuauaaccaaauagacugcuugugaaaaguaguaauguuaacuucccuggaaauguucuuucuuuaauuuuugcuuuauuuauguaaaauaaaauuuuaagaacuauuguugugggcuuuuagcaaaaauuauauucaccaaagucauuugggacugacucauuugauuacccucuggacaguagcaauauugguaggugugaaguauacauguaagauaguuauuggcuuuucuagaaggacuugcaaacuggccuuacguuuuuuaaaaacuccagccauuuuuagagcaauaacaacauuauugaaaucaauaguuucccaggggaauggacuuugaagaacuguacuacuuuguucauaaacucaggcauucuuaaagugaaaaucacuacucugaaaguuacaaaacuguacuauacugaauguggugaagaggugaaggggaaagacugauggguaaugggaagagggaaggcuaucuuugucaccuauguucagauucuuuuccguaucucccuuugcuacuuuguuugcaauuggagcccagguguguuuuucuuuugaaauagcaaaaccauaguuugguuuaguugagauuguguucuuaguauuuugcuuuuuguauuagauuggcuauucugagcugaccugggagcuuaggcucuguuuauaauauuuuuauuaggaaacucccgguggucaacucuucagaaguaaacuuuuggaauaguuaguaauacucugggaucuuacgcacuuagaugcagaauauuuuauaucacaaaaugaauacaaaguacuaauuauuuuaguuaaauuggcacgcagagcuuaaagacauuuuuugucagaagugcauauaugguuuucuauuucucagaaaucaggcaguuaaauauaagguuucaccuugccuuuuuaaagaaguuaauuuuucauuuucuuauuuuuaguauuauuuuuaugaguauggcuuugaugagcuaaggcgaagaccaagacacguuuguccauaugcaguugugucuuuuacuuacaaagaugauauacaaacuccgaaguuuguaccuucaucaagguaagacuuaggaguuuuagacaucauccgcagugauaauucuacuacagauccuguacuacugaguuaggaggaccauuuuguuuccuucccauuuuuuuuuuuuuaacuucccuugaaguugguuggagacugaaguguuuacaaugacuuuuaaauggucggugugaagaacagacaguuuaccauguggaaauaaauacaagcuaaaauuuaaaccucaucucgcuaaucucuuccuuagaaaugaagguuuguguaguugaguaaguggcagguuuuguuuguuuugagauggagucucucucugucccccaggcuggagugcauuggcaggaucucggcucacugcaagcuccgccucccggguucacgccauucugccucagccucccgaguagcugggacuacaggcacauaccaccaugccuggcuaauuuuuuuguauuuuuaguagagacgggguuucacuguguuacccaggauggucuugaucuccugaccucgggaucuuacugccucgaccucccaaagugcugggauuacaggcgucagccaccgcaccuggccaguaaguggcaguuuuaaaaagugagauuuuggccaggcgcaguggcucaugccuguaauuccagcacuuugggaggacgagguggguggaucaccugaggucaggaguucaagaacagccuggccaacauggugaaacugugucucuacuaaaacuacaaaaaaauuagcuggauguggugguacgugccuguaguccuagcuacuugggaggcugaagcaagagaaucgcuugaaccugggcgguggagguuggcagugagcugugaucgcaccacugcacuacagccugggugacagagcaagacuucgucuguauuuaaacaacaacaacaacaaaaaagugagauuuuguguauuagcacccuuggaaauggggagcuucuacaaaggaugcucaugccucaccacaaaccaaucaaauauuuagugggcagucaaggcauugauaguuuuuaaaagcuuccaggugauucugauuuucagccaguguugaggacccucuguuucuuuuuuuuuccucuuuagagacaaagucuugcucuguugcccaggcuguagugaguaaagcggugcagucauagcuugcugcagccucaaaccccugugugcaagcgauccucccaaguagcugggacuacaggcaugcaccaucaugucugguuuauuuuuaguuuucauggaaaugggucuugcuguguuggccaggcuggucucaaacuccuggccucaagcaguucuccugccuugguauuccagagcacuaggauuauaggcaugagcugccacacuuggccugaugauuucuuuccuuuuuuuugguuuucuguucuuguguuacugaguauuucuuaaaagcucuaguauaaggugaccaaauaggaagcaguuaccauuuuuuuuccccauguguugauucuaaaaaugcuuuagccaaauggaauaaguauauuuauagggauguaggugagauggucaaaugucugcucauuuuuuacuuuggguguguauacauauuugaagucauguaugauaucuauuaauuuagaaauacugcuguucuaaaaccauauaucaugaaacauauauguacauuuuugagguugaccucuuugucaguuuuccagaucaaauuaucuucucuuccauuuacgguccuuuuauguaggugaauaauccuuggaaaccaucuauagccacagguaccaauugacauaguauccagacaguuguggcuuucauuuuuuguggcucuaaauuuaugaucacugugauacauacuuucacuacaguguuuucauaaguacucuuuaaaagacauccagcacuuaaaauuaugaggucaugcccccaggaauaaugacuguuaauuucuuugccuccucuuugauuccaucucuugaccucuauaucauuucaaaggagcauugagugaacauccauccuuguaccuugaauauuccaugaaugcuccugcuucagggccucugcauuugcuguucucucacuuuccccaguaagcugcauaauucauucuacauuucuucacguauuuccuuaugauugagguuucucuguuuuuuuuuuuuaccucuauacucuuaugucucuuuuuauagcacugaaaaccaucaugaucuguuauauaucauuguuuucugucuuccucauuagauuuauguagguuggaacuuuguucuguuuaucucuauaauccuauuaccuagaacugugccugguaaauaagagcuuaguauguauuuacugaaugaugaauuaauauauuuauauauugaggcugugucuucuaaugucagcaaaauaauugacaagagacuuugguggacacuguucucucuugguuaauauuuuuggaaaaaacaacucccuuaaauuuggguaaaugugguaauuugagcgaaguaaguacuucuguuuucucuaaguagacuuggauuuacuagacuuuguaaugaguaauuucuuuguucuuccuaccuggaggaaggacuuaacuguaguaugccauuaaaaauugcacuuauaucaucuuacauguuaauuuuuaugauuauacuaaugaguaauguuuuucuuuucuuuuaaaaaauuuguagaucuaacagcuuuaauacagauagaaacauagguaagagauuuauguuucuuuaguuuuauaaauggaaagaauaaguacauauagcaaaagauuaagugcuuuguauuauuuuuauaaugaaugaaaaucugcaaaguaugaaaaguuauaauguagcaucagcgcauuugguuguccaagcauaagaucuccuuugaaaaucugcuacugugaauagacugaaagguuuuagcacuuuaauagaaaaagauaaaaaauaaaacagguuucauaacucagcuuuuuaaaaguauuaaauucaccagagguguaggacuuagaauuagagaagauugaaaguagcauugacauuaaacuauuuuaaaguuucuuuguuuuuuuuucuuuucugagacagagucuuacucucgcccaggcuggggugcaguggcgugaucucggcucacugcaaccucugccuccuggguuccagcgauucuccagccucagccuucuccugaguagcuaggauuacaggcgcccaccaccacacccggcuaauuuuuuguauuuuuaguagaguugggguuucaccaaguuggccaggcuggucucgaacuccuaaccuuaagugauccacccgccucggccucccaaagugcugggguuacaggugugagccaccaugcccagccuauuuuaaaguuucuuuauaaugaaaacacaaugaguagaagauacaggacacuguaggcauucauauaaucaaccagauuucauacagugucccuuuggaggaaauaagagaugaauaauuaucuugucuuugcuccccaacuuuucugauaaugacauuuagacagauacauuuguuauucuuugcaacuggaaugauuuuguaggggauaaauaccugaaacaaaaauccuaauauuugaacuguuaguaaauagaaguguagaagagucacuguuuuuuuuuuuuugcccuccuacuuaaaccuuguuucuagauauuuuccgucucauuucuaauaaaugugcacucacuucucugggcugccaagugacuaagcugugucauuauauucuuuuuauuuagauaaauauaacuauaccuuguggaaaggacagcuuuuaaauaaaggaaaacuuuuguguuauauuucucugaggucagccacucgugcuuuuuugccuaucaaacuguaaguauaaguaaagagcaguucgugguugcuaauuuuaucacuuucuugagccuuuuuccuuauuucuuuuucauauuuaaauuuuauuuugguucauaagaacuucaauauaaauguugguuuguuuuuuaaaugguugauuugaaauuacgugauuuggcaauaugaguccucuacgucucugucuugauuugaggauaggcuagucaguacauuuacgguauaaaacuuuaucuuuuuuuuuuuuuuuugagacggaguuucgcucuugucacucagucuagagugcaguggugcaaucucggcucgcugcaaccuucgccucccggguucaagcgauucucccaucucagccuccugaguagcugggauuacaggguccugccaccauacccagcuaauuuuuuuuuguauuuuuaguagagacggggcuuuugccaugucagucagucuggucucgaacuccugaccucauaugauccucccgccuuggccucacgaaguguugggauuacaggcgugagcuaccacgcccagccuaaaacuuuuucuuagugauuuaagucugaaauauaauuuuuuaguuuuauucuaaguagauauauuuuuuuauguagcauuuugaauauaguagacuuaaaaguuaccaguucuuuguugggaagagcuuugauuuggugaguuaaaauauauaggcuguuuuuaguccuaugcagcauauguugguauagaaaggucuaaaaucucuugcuuccaucauugugggccuuuauaaacaugugaagauuaacaguuuauacuucaguuguccuuaauaaaaugacagccuuuuaguuucuggcuuaaggauggaagguuggaaauauugccuggcuagcuaucuacccauguauauaucuggacuuccaguaucaaauccccuuuacugcugggcacaguggcucacucauguaaucccaacacuuugggaggcugaggugggaggaucacuugagaccgggaauuugagaccagccugagcaacguaaggagaccuugucucuacaaaaagacccaaaaaaaccaaaauuacccuagcgugguggcacaugccuguagucccagcugcccuggagguugaggugggagaaucacuugauccuaggagguugaagcugcagugagcugugaucgcaccacugcacucuagccuaggugacagagugagacugucacaaacgaaacaaaagaucuuuagaauaaggugagauauucguagauaugcucuucuauuuuccaucaaguguacuuuuuuguguauguguuaagauugcuagaguugaaaauacagauaaggcaaacauguuuuuaaaauuuucuuucagaccugagaaauuagauguugaaacaguuaugaguauugaucaucugaaacagaaaaucccuccagcacuguuuuauaaggaaacauacuuagguccaaaugaagguaagguaauuuaauuuuauugaaaugcauuagaagcagacuugauuuggauauuuacuauguauuuuucuuaugucaguuuugaagaauggaauguauugcagccuuuaugaaguuguggaaaagacaagaauuggaaguaacauggagaguuuacugcaaaaacuagacagagaaaaacuugugagugaaaaguuuuuuaauguuucucauucuuuguuacaaauaugcauauucaugugugaucauauuaguguuucaguuuauuuuugccucugaaaguaccaugaggugucugucuguugcugcuguuuaguuaacaguguuuuacugugguucugguauucuuuuauuugggccaugguauuggagcuugugcaaaccagucuuucccauggaauaucuuuuuuuuuuuuuuuuuuuugagacggagucuugcugucucaccaggauggaguacaguggcgugaucuuggcucacuguaaucuccgccuuccuggguucaagcaauucuccugccucagccuccugaguagcugggauuacaugugcacaccaccacagccagcugauuuuuguauuuuuaguagagacgggguuucaccguguuguccaggauggucucaaucuccugaccucgugaucugcccgccucagccucccaaagugcuggaauuagaggcgugagccaccgugcccagcccccauggaauaucuuuauuauacuuugugauuaagaaugugauuaucaggccgggcguugguggcucacgccuguaaucccagcacuuuaggaggccaaggcaggcagaucauaagaucaggagaucgggaccauccugaccaacauggagaaacccugucucuacuaaaaauauaaaauuagcuuggugugguguaaucucagcuacuggggaggcugaggcaggagaaucgcuugaacccaggaggaagagguuguggugagccaagaucguaccauugcgcuccagccugagugacaaaagcgagacuccaucucaaaaaaaaaagaaaaaagaaaauccaagaacaauaaacucagugagguugaggagauaaaggaacacuagaguaguugggggaaaguaguagggaccugugucauacagcgucauucaggcaguguucaaguguuuggaaauuuggauuugauccuaagagcagcagauuuugaaggauuuucaagggugugcauugaaacuuugaaaguguaugcaacauaagaucuguguuuugaauaauuacguuaguuacucgagaauaaauugaggggagaugagguagaaacuauuacauuagagggugauggcgggugggaugacaagguaaugauacaagaagagacagauuuaugggauauuucugagguaagguccaauuuaauacugaagcauaucuaguuuggguagagggauugggucaaacaucagauugugguggguugagaagugaauggaaaaugaaugugaugccaguauaugugguuuagcugaaggcgaggaggugguuggagagaagggaaguggcuguuccaagguuucuuuuugucuugcuaaaugguggucguaaguuccaagaaagagggauacaacuuuuuugcauaggugcgccauuuaauacaaguuuuacaacaguugacuuuuuacuucucacuuuguugagccucaguuuccagguagucgaauggcagucaaauaucuuugaguuucagaacgugcaacuucauguuuaauggcuacauagaauuuaauuauuuucauauauaugugcuuaaucagucuguuguuuauagaugggauagucagauugacauaaaacuuccaggcagaguuauaaaacccuugcgagucuuugacuuacaggcuagaaaccuuucaauuaaauguccuagaauuaaaacacacacgcgugcacacacacacacacacacacacacacacacacagucucucucucacucucugucucucucucuuuuuuuuuugagacagacucucucgcccaggcuggagcgcaguggcacagucucagcucacugcaaccuccggguucaaccuuccggguucaagcgauucuccugccucagcuucucgaguagcugggauuagaggcaugugccacgacacccagcuaauuuuuguauuuuuaguagagacgggguuuuaucauguugcccaggcuggucucaaacuccugaccucaagugauccacccgccucggccucccaaaguguugggugagccaccgcgccuggcccuuccuucuuacuuucucacugcauaugaacauaauuuuauguuuguauuacauggcuuguuuucuucugaaagccugacuacaaugcaagcauuccucaucaucaaaaucuauucaguucccaaguucagaaagugaaaguugagauaguagguuuggauauggagagauacugaguuacacaaaucuauuugguucuuguguuucagagagugaguauugagaauucggacaaugagggguuuaucagaaaauuacaauaucuuucgguuacugauaugaggaucaggauaggaaagauggcauuucguuccucaccugaccaaguauuacauuauguuaauggaagacuggaucuuuuccagaaucaagaaguaaaguaaaauccuagaucuuaaagguugcuagcauucuacaaggauacacucccagaaucuaauguaccuaggaauuuuguguagcuauccguuuuccagcaggccucacugggauuauuccgucuauagcuacuuuauucauaguuuucuugauaaugagcagugcauugaggaauacugauuuuuaaauuuuguccaagaaaugcacacaagguuuucugaaucagagacagauuuugugaauaccccacaguaaguaaaaauguauuggcccuccuuugccuuaguccuuaacucccuagggcaugcaggccuaagccacuuguccugaguagcugcauacuacauagguaaaagauggggacaaauacuuucuauuugcuuauaaaagggaagaggcagcuauucccugcuauccugaaugugucucuuugaaauguuaugaauauuaacuccaacucuuugguauauaaauaaaaucgcuucaggagccauuuguuuagcccucuuggaccaagagacauuuccaaauuccuggaaacucauucuguauugaaauguaaaugcuuagggagaucuccauagucuucuuggcaccucuggacuuaaccuaggaaccucucuuugcuguaaucucuuaaucuaccccacuugaugcucucagggagauaaaauaaguuuuauuauuguggagcagagcaauuaacuagauaaaugacuacagaucuaaaucuuaagguaugcgaagaguaaaauauuugugggggauaugaaagcaaacauucccuuaucuuuauaucauauacauuuuuguauauuagaaggcuaggacuuuuugcaguggcacguagaaauccagggaaguuuucuuuucacccagggagaugauacacgaaauaagauuauauugacuuuuuuuuuuuuuuuuuucgagacagagccuugcucuguugcugggcuggagugcaguggcgugaucucggcucacugcaaucucugccuccugaguucaagugauucccuugccucagucuccggaguagcugggauuacaggcgccugccaccaugcucggcuaauuuuuguauucuuaguagagaugggguuucaccauguaggccaggcuggucuugaacucuugaccucaugaucugccugccuuggccucugaaagugcugagauuacaggcgugagccaccgugccuggccaucucgcccuuucuuuaguguauucuuuuuuuuuuuuuugacgguguuucgcucuuguugcccagguuggagugcaauggugcaaucucggcucaccgcaaccuccuccuccuggguucaagcaguucuccugcaucagccuccagaguagcugggauuacaggcaugcuccaccaugccugguuaauuguguauuuuuaguagagaugggacuuccuccauguuggucaggcuggucucgaacuccugaccucaucaucugccugccucgaccucccaaagugcugggauuacaggugugagccacugcgcccagccuaguguauucuuuuaauagaguuuuagaauuuucuggauacuagucuugcucauuuuuuguuagauuuauccccagcugucuuacauuuuuugaugcuuuuguaaauaguauuuucuuucuuuuuuugggggggggcgggggacagagucucgcucugucacccaggcuggaaugcaguggugugaucucagcucacugcaaccuccgccucccagguucaaggaauucuccugccucagccuccugaguagcugggacuacaggcgugcaacaccauaccuggcuaauuuuuuuuguauuuuuuguagagaugggguuuugccauguuggccaggcuggucuugaacucuugaccucaagugaucugccugccucaaccucccaaagugcugggauuacaggugugaaccgccaugccuggcccgugaauaguauuuuccauguuaguacauuuucuguuucuuguauauauagaaauguaauugauacuuacauauugauuuaaugcagaucaaugugaaauuugaaugaaguguuuauuuuuguacauuuuuggggguuucuauauagaauucauuaucuggaagguagauugguuuuauuuuuuucuucucaucuuuauaguaguccccuguuauccuugguuuugcuuucuguaguuucaguuaccuguggucagcuguugucugaaaauacuaaauggaaagcuccagaaauaauuaauaaguuuuaaauuaguuuucaguaguagccuaaugcugcaucacaaugucuaugucaucagccucacuuccaucucaucacauaggcauuucaucaucucacgucaucauaagaagggugaguacauuacaauaagauuuugagagagagagagaccacauuacauaacccuuauuauuauauauuguugcaguuacucuauuuuuuuggugggaggacaggauuucauucuguugcccaggcuggaguacaguggugugaugugaucauagcuacugcagccuugaacuacuugucuuuuaagugauucucccaccucagccuccuggguagcugggcugcagguguauaccaccaugcccagcuaguuuuuaaaauuuaucuauuuuuuaaaauuuuuaauagagaauagggucuuacuguguugcccaggcuugucucaaacuccuggccuuaagcaacccucaugccuccaccucccaaagugcugguauuauaggcaugaaccaccaugcccagccuguucuauuuuauuauuaauuauugucguuagucucuuaguaugccuaauuuaaaaguuaaacuuuauuauagguauguauacauaagaaaaaacauaggguuuguuacuaucugugauuucagacauucacugggggucuuguaauauaucuucugcagauaaaagggaacuacuauauacuacuucuuuuuccauguuaaugugcagucuaggaucuguacuaagaaguugaauaaaaauggugauuuugggcauucuugccuucuugauuuaaagaaaaaaaagccuuauaacauuuuaccauuaaguaggaaguccacaguaguuuuuuauguuuuaaacuuugcuucuuuauuuuuuuaaccaugaauggauuuugaauuuuagcagaugguuuuuguuuugggucagggguugcauuuaucaaucuggucacacaguauuuuuggguucugcagagaaacagaaccaauaguuuauggugggggugguauguaaaaagagauuuauuguaaagaauuggcucacacauuuauggaggcugacaugucccaagaucauaucugcaguuaacaagcuggagacccaggagagccaaugguacaguuucagucugaguaugcaggugcaagaaccaggacugccagugguauaguucuaaggcuggcaggcucaagacucaggaagagccaauguuucaguucaagucugaaggcagggaacaguugacaucccaacuuggaagacagacaggaggaauucuuuuguuguggggguuaggguuugccuuucauucucuuuaggccuucagcugauuggauauggccaaccugcauuagggagguuggcuugcuuuacucagucuguugguuguaaacucauccgaaaauagcuugacaggaacacccagaaaaauauuugaucaaauaccugggcacucccuggccaaaucuaguugaccuaaaaaauuaaccaucacacaugguauuuauucuguagaccuacuaaggugaguuauauuuauaguuuuccaauauuaaacuaccccugcauugcuuguauagaaacuaccaccccccaaccccgcccaccccugccacagcuuuuaaaguaaauugugggguuuggcuuuuguuuaggaauuuuguaucugugaugaugaaugagauugaccugaaauuuuccuuucuuauaccaucucugccuuuuuuuuuugagacagaguuucgcucuugucucccaggccagagugcaguggcacaaucucagcucacugcaaccucugccucccggguucaagggauucuccugccucagccucccaaguagcugggauuacaggcaugcuccaugacaccuggcuaauuuuuguauuuuuaguagagacaggguuucaucauguugcccagauuggucucaaacuccugggcucaagugaucugccugccucggccucccguagugcugggauuaccagggugagucaccaagccuggccaacuuuuacuuuuuugagacuuguuuugcuauuucugucuuuaagucagaaaaauagucaauaaauacucaguuguaaguagugcuuuaguugcauuucacguuuuaaugugcaguauuuucauuauucauuucuaagaaauuuuuauuuuuuaguuuccaauuuuuuuuuaacuuugauauaugauguagagguauguguauagggaaacagggauacuuuugucuuuuuuauuucuaauuuaauugcauuguaaucaacaaugguggugauuauuugaaauuuguugagacuaagaucuacuguguggucaauuuuuguacaugcuccuucuguguuugagaaaaauguauaaucuauaaucauugggugcuggguacacaauucuggguugacagcuauuuucuugcacuuugacuaugcugcagugucuuauggcuucuauuuuuguuuagggguuagcucucagucuaauuguuccuuuguagguccccugccgcccccuggcuacuuuuuaaaucuuuuuuuuuuuuggucuuugauguuuagcaguuacaguaucuagguguagauuucuauuuauccagcuugguauaucuuuuccuuucauaucuguggauuugugucuuuuuuucuggaaaauuaguuaucucuuuuauuguacuucucccucauuuucuuuagcuugucuuuucuuuuuuuuuuuuuuuuuuuuuuuuuuugagauggagucucacucuguugcccaggcuggugugcaguggcaugaucuuggcugacugcaaccuccaccucccggguucaagcaguucuccuguuucagccucccgaguagcugggguuguaggugugugccaccacaccuggcuaauuuucguguauuuaguagagacaggguuucgccauguuggccagugguugugaacuccugaccucaggugauccacuggccucggccucccaaagugcugggauuacaggcgugagccacugcgcccggccuggccugucuuuuuaggacucugaagaggcauauuuuccacgucuguuaaccuugucuauguuuuccaucuauuuguuucucugugcugcauucuaaguaacuucaucauaacuaucuucuaguuuaaaaauccuguauuuagcugugucuuauuuguugcuuuauuuauuuauuguguuuuuaauuucacagggaauguuuuuuauuuuuaaaaguuacauuugaauuuuuuuggaucugccugguuauuuuauagcagguucuuguuaagucuuucagaaguauuuagugaguaccuaucauacgccaggcagaguucuaggaggugcacauuauauuccgguauucuuugccuauauuuuuuaagugaaauaaaauucacauaacauaaaauuaaccauuuuagccauuuuuuuuuuuuuuuuaaauaggcagggucuugcuuugucauccaggcuggagugcaguggugugauccuggcucacugcacccucgacuuucugggguccagugauccucuuaccucauccuccuggguagcuggggcuacaggugcguaccaccacaccugccugauuuuuguauguuuuguagagacaggguuuugccauauugccugggcuguucuugaacuuggccucccagagugcugggauuacaggugugcaccaccgugcccagccauuuuagccauuuuaaaguauauaauucuauguuuuuuuuaaaaguagauucacacuguugugcaacaucaacacuaucuaauucccgaacauuuucaucucagaauucacuguacauucccccuuccuaaucccuaacagccauuaaucuacuucugucucuauggauuuaucugcucugaacauuuuauauaaauagagucaagaauauguggcguucggugccuggcuucuuucacuaagcauaauuuucaaggcucauugauguuguagcauauaucagaacuucauucuguuuuauggcccaguaugcuuucauuguguagauaauaccacauuuuguuuguucuuuuaucaguuauuucuauuucuuggcuacuaugaauaauggugcuaugaacauuagcguaaacauuuuugcuugaaaauguuuuuaauucuuccaauuauuuuaugucuuuaaagauuucauaguggauuauuuuccuuuuugcaucugauaauuccaauuuuugaugccuuugaguguuugaaucuuuuuuuuucugcugaaucucacuuuaguguagcuuauuuccuucuaagcuuuuuuuuuuugagacaggacucucuguugccuaggcugaggugcuauagugcguggcacaaucacagcuucacagcuugaacucucaggaucaggcaauucucccaccuuagcuuuccaaguagccaggacuauaggcauaugacgccacacaugacaacuuuuaaaauuuuuuuuguagaguuggggucuugcuguguugccaagguuggucuucaacuccuggcuucaagcaauccuccucccacuucgacuucccaaagugcugagauuacaggcaugagccacugcgccuggcccauuguacauguauuuauacuaacucuuuuuuugugggggugggggagugcuauaauaccuuuaauguuaucuggaaauuuaaaauaguagaauaaacuaauuuaaaaaccccagagauuggauuaauaucuuuuuuuuuuuuuaagaauaaccaaacagcuaaaauagagacaacaggagcacaauuugcaggauuuuucuuuucugcagaguugaauggauuucauugggcugaagccacagauauaacugcugaagccucugucagccuuaguguuguuucugaucauagauugcuuguacuccauggauuucuggaaacauugggcccccuuaaaauacaggaaucuuuagguuacugguaguggaauuuauaaaaccuaguauuuggagugagugagagguuaaaggcaucuaauugguuuucgucagugagcacaaaacaugaaaaucuugugcuucguaacuuuuuauuucaucaacuaggaguuugaacaaaauauuaaaagaaguauauuaucuaaaauacuuuggauaaaaguauuugaaacaaaauuuucagguacauuguccgcuuguaguauacucuaagagacuuagcguggcuauaaaugguagccguaagacccaguuaaauaucuugcagggccaauacuauaugucagcaguaugauguaacuuggccugaggauuuuuaaccuuggcccugggauuuuuaggaaacaaggccaccucagcacagauuaacuauuagaaaccuuacaacaaaguuuacccuuacaagaauauuugaacuuccuuuauaaaagaaagaccugauaacugacccucauggaauccaggcaguaaaaauggggaaagauuccccaaaguuuagaauggucuucagauggaccuagucauuuggucaucugaccccaugacuuuaucugucccauaccaccagccugcuuccacuaaaauaaccuccuugaguaccagguaucuaagacucauuuuuggcacagauugaacugaaggagaaguugacccuggagaaaguggucaacuaagcuaccugaaacccccaaacacaauaccacuuuacuuuugagugugcaaacaauguuuuuauuaaaugugaauuaguagcacaguuacuuuuuguccucugaauuauuaguuuuuauacaggcguuguuuacuggaauuguuuuaguaggaauuuagguaguacgaguuuucuuucagagcucagauauccuuuuguguucaguugccaugcucaguuucucauuuacccaaaacauugugaacuauugcaguagccccugaaauaaauucuuugcauuagauuguuuuucugcguccugcacugugcugucaagucuucuuucuuacuguuguuuuaaggaaacaguagcucaaagggauaugcucucaaggacauuccuggccagccuggcuucuggucuuuuuacagcuaacccaugaucuuucauucccgacuugucuuauacauuuauccuagucuguccucacccuguugccagugauaaauauugugauguuuguaaacuguccauuacaacucaccuuugcucaugguguugccucuacugaaauguccuuccuacaaucucaggcucuugucaguguacccauucuucaaaauccacuuuugauacacuuucaguaaaccuuucuugaccaucuuuuacuaccguaaacaaacuguauuuuuccauuucuguuauuuuguaaaucucuuagggaacuuuucugucuuauguaauuacugguauuuauugugguacucuuucuaccuaauuauaaacuucucgugaucaaggaucuuguguugcuuguauuuggauaucucugggcaaauucccuuacaugugaaaaguguucauguaauaugugugcaguuagauuauggcaacacauuggguuugugauuagucugaacucuugcaacgcaguguuucaaagcauguuuuguaucuagcaucuagcacauuaccuuggccauuaauaaacaugucuuuugaacugaugaagaaaauugaagucuuuagcuugguccuuguauuuuagcuucagggaaaaauuaacgugguuuugcaguuaggggaguucuuucaguaacauuuucucauuaauguuaugaaaaccaaggaauuuuuauuugauuggaauccuguuaaucagcagaguugguagaaagaauuaacuaauucauuagcaauauuuuuucuuaaaagaugauuaagaacuuuuuuucuuuacaauuaguagaaaaugcugugugucugccuuauggugaauaauaauaaagcagauacaacuucuuccuuccccucaaaauacagguucuuguuaaaccuuugggagaccgaggauaccuuuuucuucucuccccuuaucagaugguuccuccauaugguagguggucucucuuuaauaaauuuuuacaauucuuucuuaacuuuuuaguuaaaacacauugcuaaugaguuuggcuucuguuuuuuagaauaucagacugccaagucucgaguccuacaugcuuuguuucuauuucaagaaccuagaagcauaguuacuuguaaguucuuugaauaucuaaaucugguuacuuauagauacuuaacauuucauugaaauuuuccagauaacucacuaaacauuuugucuuucuuaccucauguuucaggaaauacuggggguuaagagguauuagcaauauaagacacaaauuauaugaauuuuuuuuuuuuuuuuuuuuuuuuuuuuuugauacagaguuuugcucuucuugcccaggcuggagugcaggggcgcgaucucagcucacugcgaccuccaccucccagguucaagugauucuccugccucagccuccugaguagcugggauuacaaggcaucuaccaccacucccagcuaauuuuuuuguauuuuuaguagagacgggguuucaccauguuggccaggcuggucucgaacuccugaccucaagugauccuccugccucggucucccaaagugcugggauuacaggcaugagccacugugccuggcugacgauuuuuuuuaacuaugaaaaauuaauuuguguuuaucagugcucucauaaagcuugauuauaauuguuauaguacuguagcuuaguuaugaugguuacuuuuuauuuauuuuagagauagagucucacucuguuggagauagagucucacucuguugcccaggcaguggugcgaucauggcucacuacauacagccuugcccucccuccuaggcucaagugauccuccugccucagccucuugaguagcuugggauuacaggcgugcgccagcacagcuagcuaaguuuaaauuuuuuuuuuuucuuuagaagcaggaucucacuauauugucuagguuguucuugaacuccuggccugaagcgauccaacuaccucagccucccaagcugcugggauuagaggcaugagccacuauucccggucugugaggguuuuguaugauuauuuuuuagcuuaguucaauuuugcauucaaauuuuaguaacucuaaagcaucauuugccaggauaaauauuaggcaauucaaaauuaaugagaauuuuuggcacugauauaagacaagauuuguuaaccaccuuuucuaagaaugaacuuuaauacuguguauuaagcuaaaguucccacuaauggcuuuauuucacuguuggauuaaggaugaguuucucaguuguggcuacucagcaucuacauaucuguucaugugaaguuaguuacuacuuuauaagaggaagagaugacaugcaggacuguuuugcuuggagccucagaucuuguucugucucuguuucuucuuacauauugcuugccacuauuugaauuuccugggggcaguaggaagugagaucuucaaugagugggugauuuuuccuuuaaaaauguguucugcuuuuucauuuguuuuaguuucuuauuggccuguuuuaggauccuggacuuuacaagcaugcuauucauauauuugcuauauuguauauauguacuaggguacauacucgucugguucaacauuaauguauaaauguuuuuauacuucuuuggcaauauuuagaucuguauuugauuaguuucuugauugcuaacaugguuugcuuuuuuguuuguuuguuuuauuuacagcacaaaaagguucaaccaaugcagcaccacaggagaggcaugagagcaugccagauguauuaaaaauagcucaguuuuuacaauuuucuuugauucagugucgaaaggaauucaaaaauauaagcgccauaaauuuucauucuguuguugaaaaguauguaagugaauuuuuuaagcgagguuuugguucagguaaacgagaguuuauuauguuuccauaugauucacgauuagaugauaaaaaauucuuauacucagcucccagaaauaaaucccauauugauacuuguuugcaugccuauauuuuucggccugaaguguaucaguuaccuauuuguaaauuaaaagaacuauuugaagaaaauagaaaacuucagcaguuuaguccacuuucagauuaugaaggucaagaagaagaaaugaaugguacaaaaaugaaauuuggaaaacgaaauaacucaagaggugaagccauuauaucuggaaagcaaagaucaucucauucuuuggauuaugauaaggauagagucaaagaauugauuaauuuaauucaguguaggaaaaagaguguggguggggacucagacacagaagauaugagaagcaaaacugucuugaagaggaagcuugaggaucuaccugaaaauaugagaaagcucgccaaaaccaguaauuuaucugaaaauugccaucuguaugaagguaaaauaucagauugcucuuauaacagccaaaaauaaaguaguucuguucuuucuuguagcagaggggcguauaaauuaaagccugagggucaaauucagccuguccacuauuuuuguaaagaaaguuguauuugaauacagccaugcccauuuauuuauguguauguagcugcucucaugcugucauggcagaguuggcacugagacuguauggcccacaaagccuaaaauauuugcuaccuggcccaguacaggaaacacuuuacaauuccugcccugguacaucagauuucuaaauuguuugguuuagguuaacaugacauaauaauacuaaucagaacucuuguccuuuuauauuccuuuauuuuuuuugagacggagucuugaugucuccccaaggcuggaguguaguggcaugaucucggcucacugcaagcuccaccuccuggguucaugccauucuccugccucagccucccgaguagcugggacugcaggcgccugccaccaugcccggcuaauuuuuuguauuuuuaguagagacgggguuucaccaugugagccaggauggucucgaucuccugaccucgugauccgccugccucggccucccaaagugcugggauuacaggcgugagccaccacgccuggccauauuccuuuauuuuuauaguugaagaaguauaauaucagaauaguaguaucuuuuaggcuguugcauaaugaaaaggaaccuucugaauuugaaaauaaaauaugcauacacauacucuuuucuaccccaagaauccaggaauaucuuuggguuuuucuuuuuuuguuguucuuuuuuccuuuguuuuguuuuaguugacagaaaaagauagacauguaaggcgcuuguuuuaaguguguuuguuucaauauugcaagucagcuaaaacacuuuuaucuagauuuuuaagaucuucacacuacuaguugauaagcacagaaugaguucuuuugcauucauagaaaguugacauaacaauccacguuuuguguuacuguugcuccucugauuauggcagaacugaauauucuuaugcuuuuuauuaagcaacuugucucuucagauucagugugucuuagucuagguuagucagaucagugucuuagucuagguuagucagaucagugucuuuuuacacuuuugcucuuagcaaucuguauuuguauccucacuuuucacuuuccugcucuuuuuauuuauuuauuuauuuuugagacaaaaucucacuccgucacccaggcuguagugcaguggcucagucuuggcucacugcaaccucugccuaccugguucaaaagauucucgugccugagucuccccaguagcuggaauuacaggcacguacuacugugccuggcuaauuuuuguaucuuuaguggagacgggguuuugccauguuggccaggcuggucuugaacuccugaccucaagugaucugucugccucggccucccaaagugcugggauuacagucgucagccaccaugcucagccugcucuccuuuuacuucuuuuauuguuaugguauucaaugugguagccacuagccauauguuuuuauuuaaguuugaauuaaaaugaaauuaaaauacauuucaacaaccacaccauuguauuaguacagagagagaacauuuccauuauugcagaaaguucuauuugacauuacuuuucuuugcaguaacuauaaugauuuuuucuuuaguuaaccugugugucucuuucucuuugcaauguuguuacucuuugucuguguucuuuaucucuuugguggccuuccugacuuacuaccuucuugcacccguuucaguaucauguucuucucaguauugcuuugcuaauuugcuaccaaucucaucuuauauacuugcuuuuuaaggcuuuguuauagacuagccauguccagccauguuucccacuguucucucacaugucuugguuaagggucaucucucucugccuagaguaugucauggucagucuuuuauuucccucuuuuuuuuccugaaguagcuuccauuucuuucaagccuuauaucuuugcaguucauauucuccucagcuuucugucuauucuccuuaauggucuccucuaguuuaugcuggauuugcaaucugugcugaaccuguuagcacuuacugacacauacugucuuaucuugugacaugucuugagagcucuguuuacuaugugcuagguacuuuauguauaugaacucauuuauuaauaguucuugagugauaggcauuauuauccuaauuuugcagaugagaaaaucaucucagauaaguuaaauaacuuuaccaaaaguuaugaaguuaguggcacaauccgaagucaguucugacugacuccaaagcauuguugacaacaaacugcugcauuuccugucacugagcacauuauaugcacucaauaaauaagauacuuauuuuuugguacuguuuuuguugguaacuaauucuguguaugugaaaaaauaguuguggguaaaaaucaggcuucaucaauaauuaaaaugaugagaaagccauacuaauuauaauaaaccaaaugagaaauggagcagaggaagaaggguagaaugcuuaacuaaaacuagugacuaucagacuugcauuuuuagguguuucuuacuuauuucuuuuuaaguaauuuugcauacuuuguuucugaagguagagauuucaagguuguauucuaacuuuuuuuuuuguuuuuuuuuuuuuugagacggagucucgcucugucgcccaggcuggagugcaguggcacaaucucggcucacugcaagcuccgccucccugguucucgccauucucuugccucagccucccgaguagcuggggcgcccgccaccaugccugguuacuuguuuguguuuuuagcagagacgggguuucaccguguuagccaggauggucucgaucuccugaccuugugauccgcccgccucggccucccaaagugcugggauuacaggcgugagccaccaugcccagccauauucuaacuuuuaaaacacccugaucuugauuugguggugagcccagucauuuuaugagguaaccuccuaacccauucccaccaccccuuguaacuuuuaacauaaacuguuuugagguacaguuuauaucaguguaccuauuuaagcacacaguaugauuaguuuugacagcuguguaaucaccgcuccaauauauagaacuuuuuuuuuuuuuuaagauggagucuuacucugucuuccaggcuggagugcagugacccgaucucggcucauugcaaccucugccuccuggguuaagcgauucuccuaucucagccuuccgaguagcugggauuacaggcgugugccaccauacccagcuaauuuuuguauuuuuaguagagacaggguuucaccauguuggcugagcuaguuucgaacuccugacuucaggugauccacccuccucagccuuccaaagugcugagauuacaggcgugagccuauagaauuuuuuuuuuuggugauggagucucgcucuguugcccaggcuggagugcaguggcaugaucucggcucaccgcaaccuccgccuccuggguucaagugauucuccugccucagccucccaaguagcugggacuacagguucaugccacuacgcccagcgaauuuuuuguauuuuuuuaguagagacgggguuucaccuuguuagccaggauggucucgaucuccugaccuugugaucugcccaccucagccugccaaagugcugggauuauaggcaugagccaccgugccuggccagaacauuuuuauauguugcuuuguguucuuuguuagguagcucaccccacuccacuacugaucugcuuuuugucuuuauagauuaguuuugccugcucuauaaaaaguuuacauaauuagagucauacaguaugcacuccuuuguuucugacauuuauuuuuguugugguacauuauacucuuaaauuugaaauccuaacucaggcuucacccaaucccuaccccaccccaauauuaaagcacaugacuuucugaauguuugcgcccuuuacaaguuuuaaaauauauugauuguuacagauuauacagauuuauagugcaugcaugaaaccaugucuuaacguguuuccucuuauaauacuuuuuguucuugaugcaaauuucguggagauuucuucagggugauuuuaucucuauaauacccuagcuucauuaugaauuuaaguaaucuagucauucaagauaagguguagauuuuaagugugucagccaaugccuuaaggacaaaauauaauagguauggaaaagauagaaaucaaauugucauuuuuuuaguagccuaguguaauacacauauaauccuaacaauuggcaaaauaguaauuacaaauguuucaucucuugucaagcaccugguugacuuugagauuuugaugguaguuauuaauacacauauuuaaaaccuaaugcaugagcuuauuuuccuauugauagaaugcuuaaauuacaauggaaauuaaacuuuaauagcaauuuugaacuaugugcaaaauuuuacaauucuuuuuguaaagugaugcgaauauuuguaaagucuaagcaaauugguugaguuccugaccauaaaugcuuuaugauaauuuuuuagguauauuugauuuuaaaaguuuuaugcuugcuuuuaaacuuaacuucaaccaaugacuuccuuuuucucagagucuccacagccuauuggcucacuuggacaugaugcugacuugaggcggcagcagcaggauaccuguaacuccggcauugcugacauccauaggcuguuuaauugguuaucagaaacacuagcaaaugcgcgccauucugaugcaucucugacagacacagucaacaaagccuuaggauugagcacugaugaugccuaugaagagcugaggcaaaaacaugaguaugaguugaacucuaccccagauaagaaagacuaugagcagccuacuugugcaaaaguugaaaaugcacaguuuaaggguacucagagcuuauuacuagaaguugaugcaacaucuaaguauucuguugcuauuucuaccagcgaagugggcacugaccauaagcuacauuugaaagaaguaagcauauagcuguugguuaccuuuguguuugugagugugugugugaaagaggugcugugaguaugcuucagggaaugauuuuuuucuuugaaaaagaaauaaaaugcacuuuugaguaaaggugccugucuaggaugguacuuccuaaguuauuccuuguuacaaagagauaaaugcugaaguaguuuuccuuccuucuuagaagcuuaauauauugucuacaguuuacuugugauaaagcuuaggcggaacaaucuauuaauauuugucagaaauggcuuauugggaguuaauuccuuauuguuucauaaugaaguugaauuauuaaagcauuggcuuucugucggcaguaacagagaacccaaaggugaggcagaugaggaugccagucucaguacagcagugugacaguuagguacuugguauuucuuacgcaaauaggaauggaacauaagcagccuuuaggauuaccccugaagugacucucagccuugcuuauuagaguguccaguauauuuaugauauauguucagagugcugguuuguagcugagaaguagccuuaucugccuuaagcagucacugcaucacuggggaauaguucuaggauugcaccguauuccuaugggcuuauuucuucauuuacugucuccauuuucucuucccugccuuuguuuaaaaguuguaugcauguccccauucuuucucgaugucguuuugggauauuuauuucaaggggaagaugauggcaggaggguuauugggguauguaagguaggcacugaggaacuaaccuguauuaauauuuucugauaucuuuuguauuuuaaaucaaguugauggggggcgggggcauggguugaaccuagcacacuacccauuuuuauaacuaaaguuuuauuggaguacagcuguguccauuuguuuagguauugccugugauagacuagagagucuggccugcagagccuaaaauauuuaauguuuggcacuucagcacaaacguuuaccaaucccuguucuaaauuaacauaaaauuauguuucgagggaaaagauguuuuaauuuugaaacuagaguauaacuuuaccauguugauuuuacgcauuuguaauguuuagauugaagcacgugaauuuucagugaaaaaacaguuuauucuugacauuaaaaugaauuggaaauaaagcuauucaguguguacuuugauuuuuaggauccaaauuuaauuagcgugaauaauuuugaagauugcaguuugugucccaguguucccauugaacauggauuucguagacaacagucuaagucaaauaauguugaagagacugaaauacauuggaaacugauuccaauuacagguaagaaaaguauacuuggacuuguguuugcuucauuuuacuuagagaccaguuuccugaauguuuccaucuucuguggauuucacucuugggucacuaggugcuucaucuuaauuggugcugacaucuucagugucuuauuuugaguaauacaguguucaucacugaguguugcuguucuuggucagcaucagcaagcaccugcaaaaucaccuuaaaaacagggauuuaagacacacugucucuauggaguuuagcaugcagacugcugaaugaagacuguuggcagaaacugaguuuuugauaaggugagguagcugcagagauaaaauggugcucuuuggacaaccaauuaaaugcugucuucucaaacuuuaaacuucaccguaacaagcugucaucuaauaagugauaauguugagguucaucuauuagaaauuugauuucuuaauacuggauuaucuuaaauaaauuggauuaucuuagagaauggccugaaugaucaaauguaaauguuauugaacugugaggcaaaaaguuuagcagauguugaaauauuaucuuuuuuuuuuuuugguagcauucuaauuucucugugcaaacacauacauacacacacauaaauacauacucuuaauauuccaaguuguuacucacuuuucuagcuaaacauuuuuggaaauauuuucaggguauacgucuuuuccaguccuacaccucuaaccuuuuaaaaacaauagcaacagcaaacaacuuuuuguuacaaaguagacuggccugugaacuaaacuagaaccugcugagacuuccgaggacucugagaagaauuuauaaaacuugaugaguucccaugggcuuuagcaccaucuucuacuuaacaucuuucuggaggguaggaggccuguaggugaugauagagggaaccuaguauuguuuuaugagguggaaacaucagcuugaguaggagaaacaaaagaaguaguugauauaagaagguuauccuaaccguuucucauuuagacaccuucauacuugguguugggucauuugaagguacaaugucuuaaguguugauauuccaucaucaccaguaugacccuucagauuauuuuaggcagaagaaggaaugcuugcauuguuaucacuugggguugucugaaaggugcuuaguguagguaucacuaaugucugaagagagucuaauggaugcuuucccucaggagggaaugcaagaagcccagaagaccagcuggggaaacauggugagaaacaaacaccaggugagaaggcuugcuuugcuuuucuucccagugugcccuucuucagaguugcuacuugcauuucugauacuccaucaauagggcauugacuuaaauuuuuuuaauuacagaaaauuuggacaguaccauauuuauuuauauguaaaucauuacuugaguuguauccacuauucuuacuauaaagaguguucagauaagucaccgaauauuuauauaaauuuucuucacccauaguagagucuaucuuacaauaugauuugggaagaccagaauauauuccuaagccauuugugcaguauauuuuaugauaaacucuucuuuuuuuguuuuugguuuuuuugagauggaagcuugcucugucacccaggcuggagugcaguggcgugaccuuggcucacugcaaccucugccucccgagguucaagcaauucaccuuccucagccucccaaguagcugggauuacaggcgcaugccaccaugcccagcuuauuuuuuuauuuuuaguagagacgggauuucaccauguuugccaggcuggucucaaacuccugaccucaggugauccaccugcuucagccucccaaagugcugggauuacaggcuugagcccccaaaccuggguuucuucuuuuuuaaauuuuuaaaaaauagccaagaaggguaagccauuuauauuuuagguauacuauucauagucuuuuaaccuaguucuucugauuguaaaacuaauuucugcagguagauuaaauaagauuaagaaacuuggauuucagaaacaguugcagauauuauugauuagcuaguuggcaguggguaccuaggagauaaucuuugucugaucuugguggauucaacuucucugcagauggucauaggcauuguuuucuuguuuacaguuugguggugaucuuuuuuauauuuuccuucaguuuuguuguaucugacucuuuucagaaauuaaaguguuguuuuuuuauuuguaagaaaugugaaaugacuacaucuuuguaguuauuuauuuccuuugggaguuccccucccccgcuaauuaaaguuacuaguuuccuugaagaaaaucuucaccaucuccuucuaggaaaaugugguuaaaaaaaaaaagaaaccaugaacaacagauauauaacauagaggaaaguucacaaaucuuuuuuuuuuuccccucugauacagaaucucucucugucacccaggcuggagugcaauggcaugaucuugguucacugcaaccucugccuccuggguuaagcgauucuccugccucagccucccaaguagcugggauuacaggcaugugccaccgcacccggcugauuuuuguaguuuuaguagagacaggguuucaccuugucggccaggcuagucucgaacuccugaccucaagugagccacugaaccuggccacagaucuuuauuguacagcuuuuugaaauuuuacauauguacaugaccaucacccaaaucaagauguagaacguuucuagcaucccagaagauuuucuuccacauucuccuaguuaguacucuccuuguucccaaguaagugcuaaucugauuaguuuugccuguuguugaacuuaggauaaauagagccuacucaugucgucucucguguuugguacuuucaugcaauaucgugucagggaguccauguuuugcaucuaucaguaauucuuuucugauuucgggguuuuaccauguuggccaggauggucucaaucucuugaccucgugaucugcccaccuuggccucccaaaguguugggauuacaggugugagccacugugcccggcuaguaguuaucuuucuuaugcuucagaauguuccaucagcaccugcauuccucuuauuuggaaauaccaucuuuauauuuuguaagcuaaaguguagacaucugaaugauggugccuuuagagaacugacuacuccccuuucacuuaaaaguuaaaauacugcaauuauuuaauggcaauaaguuuuuuuuuaaaaaagcacggugucucauguuuguaaucccagcacuuugggaggccaaggugugcggaucaggaggucaagacaucgagaccauccuggccaacaugguaaaacccugucuacuaaaaauaaaaaaauuagcugagcaugguggcuugagccuguagucgcagcuacucgggaggcugaggcaggagaauuguuugaaccugggagguggagguugcagugagccgagaucucaccacugcacuccagccugguggcagagcgagucucugucucaacaacaacaacaacaacaccaccaccaccaccaacaacaaaagcuuuauuauggauugacauguauguguguuuucaaucacuuauagaugaagauauuuucaaaauaauuaaguuuuguuuuuuuuuucuauuuuuuuuugcaacagaaucuugcucuguugcccaggcaggcuggagugcaguggugcaaucuuggcucacugcagccucugcuuccugaguagcugagauuacaggugcucgccaccacgccuggcuaauuuuuguauuuuuuuuuuuaguagagacgagguuucaccauguuggccaggcuggucucgaacuccugaccucaggugaucugccugccuuggccucccaaagugcugggauuacaggcaugagccacugugccugagcaguuaaguucuuaauaaaaucauacagggaaauuugugcaaaauaaaauuagguugugauuauuuauauuuuauaaagggaucuauuugguuuagagguuuuuaauuauggaaaauucuccauguggauuuaauuuauauuucagguuaaaaauauucccuuuauuuauaacccuugaggaguaaacuuacugguuguuguuuagcuauacauuuugggagccacuguugcauuuaaaguaauaaauagcuggguguggugguauguaccuguaaucccaucuacuuggaagacugaggcaggaggaauugaggccagaaauucagggccagucugggaaacauagugaggccccaugucuaauaaauaauucagaauuuuuuaaauuaagguaguucuucgcaacccauauguuuuaugagaugcaauucaauuuuuuuucuuugaauauaucagauauuugacaugauacguaauucaagaaguccaaaaauacuuaagaaaguaauacugccccagcccggaacacuuagauucuuccccauauauuagccaugguuaccaauuucucguguauccuuccagacacuuuauguguacuaaagcacauuuuaauguuggagauuuaagauacucaggauauuuaguacuccuaauuaucuuaugaaacuuggauuuucugguuuaucaauuucauacaguucuaauucuuauccuggcacguuggauauuuuguuccccucucaccuccgccuacagacccgccuugggucuuuucacugugcugacaaauugccuuugcaauaguuaaugaguguacugguucaugauaaccaccaggauugguagagaaugucauaagcucgacuccuagugaggcuauuuaaaccuuuagaaaagugugaugagugugagcaaaaucuucacuguaaguuugaaaacuaccuguaccuggacuuucugauuuagaggcaccauuuccuauacuacagcagcaauuuguuagggaauguuggccaaggcuuaaagaaaaacaguaauuuuuuagcggguaaaauuguguauacgucuucuaagcaaagaucaugaguuuuuguccuuuccuaaaauauaacacuaaaauugaaguuaaauauauuuuuccccuuguugcuuaaaaauggaauuagaguucccuuuuucaaauguaguuucaaaaacauacuguguuugaauuuaggauuuuuuuggggaaaguaugaucuuuuggauugagcuguuugucaagagugaaagguuuuaaucucauuaguaucagcuaaccuuaguaucagcuaacaucuguaucucaaaugagguauagcuaucuuuucuuuuagaauuauuuccaaacaaaaggaaaauauuuaugaaaggacugucaaaaaugugcagcugugaaauauguucuucucuugucuuauuauuguuccuuuuauuuccugauaaaaugaagucccugacauuacaggaaaucuacuuagcaaccucguaagugagaacaagucugaaagcagauaaaauuaauuauccuagauccuagaugcaacuuuuaacuuggcaguuauucccacagcauuucuguuugguauucuuacaauugccuuacacucagaauucuuacuaaggggccauuaccauaguagauauuacuuggcaaauaauaaauacagggauugagcaagcugauguaauugacugucuugauuuaaaauguguauuaaacuuagaucuacagaaugguagggaggcagaaacaagcaaaugacuuaauuuguauugaugccaaauuggugcuugcuugagcgcuucaaaauagcagaguuguuaacacuagcuacaacucuaaggaccaucccauaaguagggcacauagggaauagaauucauaccagaauuuuaggauuuuauuuuaccuucuaauauauaauuaguucuaaauguguguuaacccuuuuuucccccaauuuaaggguuuguguuuucauaucuuaucuuuuuggauugcucuuauaauaaugaacucuuccuguauagguaugaaaucaccagaagaacaacuggugugugugccaccacaggaggccuuuccuaacgacccccggguaauaaauagacagagaaguucugauuaccaguuuccauccucuccauuuacagacacacuaaagggcaccacugaggaugacguguugacaggucagguggaggagcagugugugccagcagcagaggcagagccgccugcagugagcgaaaccacagagaggacaguguuaggagaguacaaucucuuuucuaggaagauagaagagauuuugaagcaaaagaauguuucauaugucaguacaguuuccacaccuaucuuuucaacacaagagaagaugaaacggcuuuccgaguucauauauucuaagacuuccaaagcuggugugcaggaguuuguagaugguuugcaugagaagcuaaauacuauuauuauuaaagcaucagccaagggugggaauuugccaccagucaguccuaacgauucuggugcuaagauagcaucgaauccucuggaaaggcaugucauaccaguuuccucaagugacuucaacaauaaacaucuccuugagccacuguguagugauccuuugaaagauaccaacucugaugagcagcauuccacuucggcuuuaacugaaguagaaaugaaccagccucaacaugccacagaguuaauggugacuucugaucauauuguaccuggugauauggcccgggaaccaguagaagaaacaacaaaaucccccagugauguaaacauuucugcucaaccagcucuuucaaauuuuauaagccaguuagaaccugaaguauuuaauaguuugguuaaaaucaugaaagacguccagaaaaauacugugaaauuuuauauucaugaagaagaagagagugugcucuguaaagaaauaaagguaacuaaaccagaagguaauaguaaugcuguacaaacuucucuuguuggugugaccucuauaaaauggaaguuuuuuguauuuaaauguuuuguguuuaaauguuaggccaggaaugguggcuaauaccuguaaucccaaaacuugggaggcugaggcaggaggauugcuugaggccaggaguucaugacaagccugggcaacauaacaagacauugucucuuaaauuaauaacaaaaauuaggugugguggcacucuacuguagucccagcugcuugggaagcucaagugggaggaucacuugagcccaggcauucaagauuacaguuagcuaugauugugccagccuagguaauagagucagacccugucucuaaaaauaaauguuaauuguguauuuucauaauuuaacucaggguggaauaaaagagugguaaguccaaguaaauucagaacuucugaucuauguuagaauuuagaaucuuguuuuauagugucauuuaugcacauaccuuuuaaacuugauuugaagguuuuaaguauuucuuggauuuuuguuuuuuuuuuugagacagagucuccuucugucgcccaggcuggagugcaguggcgugaucucggcucacugcaaccucugccucccaaguucaagcgauucuccugccucagccuccgagguagcugggauuacaggcgugccacaccaugccuggcuaauuuuuuuuuguauuuuuaguagaggugggguuucaccauguugaucaggcuggucuggaacuccuggccucgugauccguccaccucagccucccaaagugcugagauuacaggcgugggccacugcgccuggccguuucuugcauuuuuaaugaagaggagggaaaaaaacagagaggaaaaguuaaguugccaggguuuaucucaugggauuugaucaaucauauagaaaaacaaacugcccaggguuggccuaaugauaaacuuuugguguuucuugauacccuagccauguaacauucccuuuagccuuuauugaucaagaaacuugauaaucuugaaagacuccucagucaugaaagauuucucauugugagguguauuuuuucuaccgaagcugcagacuaauauuuuagauaguugguuuaaacacacacacagauggcugggcgugguggcucacgccuguaaucccagcacuuugggaggccaagacggguggaucacgaguucaggagauugagaccauccuggcuaacauggugaaaaccccgucuguacuaaaguacaaaaaauuagccgggcaugggggcaggcgccuguagucccagcuacucaggaggcugaggcaggagaauggggugaauccgggaggcggagcuugcagugagccgagaucacgccagugcacuccagccugggcgacagagcaagacuccaucucaaaaaaaaaaaaaaaaacaaaaaaacacagacacacacacacacgccuuucugugugucuguauguuuagacauagauacguaaguuuguuaccaguagguagguaaaugguaacacauuggagcaauuacauuagugguauaauaguaaaauuaaucauaaauuaugggauuuuaauuccucaagggaaugccuaggauuuugaaauaaaugccugcucucauuuauggaguuuacuuaccaugacuggaauuucauuagaggaagcagagggaccaugggcuuuauagcuacuaacauguccuaagccuucuguaaguuuggggaucucugaggucagcauguuuugugugauguuaccuggucaagaccugaagaacauagaaauuacaugagucagaguacuguguugggcuuuccuuacugauugcuaaugguuucuugggaaaaugaaauaagacuucuaggaauuccuugguugcauuuuugcccuacaugacugaauguagaguuucucaacuuuuccccaccagccagcaacaaguucccuagcacaguacucuuugggggcauagcuagcugcauauugguuugggguuagaugagagaauagguugggcacaguucccggugugcuuagcauaacuccaacuuccuccauccccgcaccccccaccccccacccccccgcuccuuuuuuuaaaaggauuuguaacacauaccuauuugacauuuuaaaaaauuuauuuauuuauugagacggaguuuugcucuuguugcccaggguggaguguaauggcacuaucuuggcucacugcaaccuccgccuucuggggucaagcaauucuccugccucauccucccaaauagcugggauugcaggcacccgccaccacucccagcuaauuuuuuguauuuuuaguagagacaggguuucaccauguuggccaggcuggucucgaacuccugaccuuaggugaugugcccgccuuggccucccaaaguacugggauuacaggcgugagccaucgcacccagccguuacauuuagauuaaggggauaggagaugcauuuccuaauuaauugugcuuuuaauuuaucuggcauagaauaagucauuucugucauuuauauagaauaaaagagcauucuuuguuuuacgaaucugauagaaaaccagauugaaacuuuaauucuuuuaaucaguauccauuggaaauauuccagcaaaaauacuacaguaaaagacuuuaugaauaaaaauguaaacuuuauauauuucuggagucaaacugauuuauuaugugaauuaaacugucuuauuuaaaaugagcuuaaagcuucuuaauguaagaagacaucaaagauuaccagcagggaggcugaggcgggcagaucacgaggucaggagauugggaccauccugauugacauggugaaaccccgucucuacuaaaaauacaaaaaauuagccaggcaugguggugggugccuguagucccagcuacuugggaggcugaggcaggagaauggugugaacccaggaggcagagcuugcagugagccgagauagcgccacugcacugcagccugggugacagagcgagacuccaucucaaaaaaaaaaaaaauuaccagcaggcaugucagaugguaauuuaccuuuucauuaacugacuaagcuggucugagaucugcccaaaaguuccagagauuggaucaaaaucaguguagaaggugcugcuuuagcacaacagcauccucuuugggguaacacuucagguugaaagagcagcagacugguugucagguaagcuggguuuuuauuauagcugucugaccagcugugcugacauuaaaaguaaucucugaaaugaggaauaugaccuccaggauccugcaguuugcuucaguguucaggauuccaccagcaagcagagagcaaagggaacucugcaugaaagucugccuguguccugugaaaggcaguaccauguucaccagcauggaggaagaguuacuaguugggaaagucuacuuugaagacagaaacuugacagaaauggcuaauuuguaugugaauaccauuguacauaaugaagcucuauauaaaugcuuuuuuagcuguugugaauuagagcuaugguugugaaaguucuuaacucugaaggcguuuaucccaguuaauacugcugcaaauaaccaagggccuacuuagaauggaaaggaaaaggugagcuagggagugguuaaugauuagacucuagguugccuuaaaguguuucucauaggauauuauagucaaccuagagucuaaucauuaaccucuauaauaacuaaaggagcuggguuaagaaccuggccuaauuaacaguucuuucuguuaacucacacuguuacuuggcuggcuuugcauagugcuguaacauugugacugugugauuggugaagcucuguaacauugugacuaugugauuggugaagcucugaccuuuagauuccucuucuagaaaagaaaaguggauuugggccaugugcaguggcucacgccuguaaucccagcacuuugggcggccaaggcaggaggaucacucgagcccaggaauuuaagaccagcuugggcaacacagcaagacucugucucuuacaaaaaaaaaaaaaaaaaaaaaaauuagccugguaugguggugcgagccuagugccauccauguauucaggaggcugaggugggaggguggcuugagccugggaggucaaggcugcagugagcugugaucaugcugcuauacuccagccugggcaauggugagacccugucucaaagaaaaaaaaaaaggauuugauggucucuuagaguguaaguucauucauuguuaauaaugucaugguaguaguuaagcuuaucaguuuaucuugcauuucugguguuaaauugauguuuacaaagaaguauuuuaauauugauuuaguuguuuuucuuuaacaggaauaucuuaucaaauuaggcaauacagaaugucauccugaacaguuuuuggaaagaagaucaaaauuagauaaacuauugauuauuauucaaaaugaagacauugcagguuucauucacaagguagacuauuaagucaaauucacuacuuugguuuuaaaaacucccuuauuuuaaaaucuuacugucugccagacuaguguuuuuaaaauaagcuuuaaaggagauuaaacuuaaggacccaucugugaaucagcuugugagauucaaguuuguaccuaugcaaaauuuuaaauugcugcacaucacagaucuucccugucacucagguagucaagacuaauaagaguacugaauccuugaaugccauugggucugcugacugacuacauaauguuuucaucuucauuuguauguccuaggaaaaaccuauuugugcuccaucuuugccagaccaguccccuuuucccuuaaauuuugagguaucccaucuagucuuaggagcccuaucuccauccuacaucuuggacgucuuuccugauugacuguucgagcacauaggcuuuugccuucgucugaauucugacuguacucacagguuauagagaggucagcuuuuguccauuuuguguuuucaggucuauuguaagcuccuuuuccuuagucgucugugguaggucccaguacauaaauguugguuuauauauugggaaauaauguugggaauauuauuuguguggcuuuccagagguaauccacuaauauagaugagccauaaugcauucuguuagacuucuuguagguuccuucacacuugagucugucaauucauucccuccaucuguuucucuuuuuguuuugggauuuaaacagauaccuggcuuggugacuuuaaagaagcuccccuguguuaguuuugcugguguugauagccuggaugauguuaaaaaucauacauacaaugaauuauuuguaucuggagguuuuaucguaucugaugaaucaauucuaaacccagagguugucacaguugguaagaugauguucuuuugagcacguaacuccucuucugacucucauacuuuuuaauguacuguccauuuauucugccauucacagauaacuaguacauuucagucuuuucuugagcuuuuauuaccucaaauuucuuucuccuucucuuagaccaauaauauccucuaaaugugguguaaagcaaggcugucugccccugcugcaguugaaucacuucuuguauuacugucaucaacauguucuuuuuuauguguagauguuauauuauuagagcuuuaggcauguauagaucugucucccuuagacaaagagaaaugaaaauaguacauaggaaaguagguguuucuacauaauaugaaaaaacacuucuuucauaauucacuuauggaaugauuauuuauugaauuaaaaacaaacuucauuaucucuaacagagaaccuuaaaaauuuuuugacauuccuugaggaacuuaguacuccagaaggaaaauggcaauggaaaguccacuguaaauuucagaagaaacuaaaggaacuaggcagguaagcuuugaaacauaacuauauaaugguuguugauuuuaacauuguacucauaauauuucucucuucccauguuuguagauuauggauguucauuuuucacagauguccauagccagccauaauugaguauagauacugaauuauucuagccuuuauaagaagcaguauuuuucaguagaaguuugcugaaguuguuaugugcauagguaaaauugguuuaaucuuugccauuuguggauuuagaguaaucauccaaauggaaugaucagcauuuuuuucuuuuuuuuuuugagauagaguuuugcuuuuguagcccaggcuggagugcaaugggacgaucucgccucacugcaaccuccaccuccuggguucaagcaauucuccuaccucagccucucaaguagcugagauuacaggcgcccgccaccaugcccagcuaauuuuuguauuuuuaguagagaugggguuucaccguguuggcccggcuggucucgaacuccugucuucaggugauccaccugccucggccucccaaagugcugggauuacaggugugagccacugugccuggccagcauuuuccuuuuuuaacugaacuguaugugccaacuacaucaggcccucucccaacugacuacuuuauagguagcuaauaaaauuacauauauuuggacaaggauuaaucuugaccuggugaagugauuugugaguaggacaucaauucauguauacauagauaauuucuaaaaugcauggaagucacuucuccaagugugaucuuuggaacacuagucaauugagagauuccauaaaugauuaugguaaucaggcauguuugggacacuauauucuacuaguaaagucuauaaaauguauuuacacauuaaaggauaugaagaacucuaguuaaaagaauuuacauugugucaaucauuauuuccuuaaacuuuauaccacaaaaauuucuuaaaauacgacauuccaugguacacuguucaggaaauuaaggcuuaaauaauuuuugaguauuuaauucauuguagcaauucacuuuuaaaagcuuaucuccacuuguugccuugucccuugcaauauagaaacagcuuagagcuggccgggcacgguggcuuacgccuguaaucccagcacauugggaggcugaggcggguggaucacaaggucaggagauugagaguauccuguccaacauggugaaaccccaucuguacuaaaaauacaaaaauuagcugggugugguggcauacaccuguagucccagcuacucgggaagcugaggcaggagaaucggcgacagagugagacucugucucaaaaaaaaaaaagaaauagcuuagagccauaauaguguauuuaauuuuauuuuuuaagacagaguuucguucuuguugcccagacuggaguguaauagagcagucucagcucacugcaaccucugccuccuggguucaagugauucuucugccucagccucccaaguaguucggauuacaggcaugagccaccucauccggcuaauugugaauuuugaguagagaugggguuucaccauguuggccaggcuggucucgaacuccugaucucaggugauccaacugcuuuggccucccaaaguuuugggauuacaggugugagccaccaggccugguccauauauuguguuuuuugaaggaaggauuuauacuguuuuugucccuuuaaguccuucauuaaaguucaaaauuaauaaagguaaucauaauuuauuauuuaguaaguagaauaaucagcugagauuuuagccuaagcuguauagcuggcccugaggccucgcgaccaagaaaccccuggacuuaucccuucuuucuuucuuuccaaagaagcacacccccuacaucaggcagagagcuaaagcagugcaguugucauuaguugccucaguggagaaauugaauuuuaaucuaaagcagaaauuuccauacuaaauuuuagaaguacagauccagaaacugaacugcuuaauuucacagauugaaugcuaaagcucuaagucuguugacgcuucugaaugucuaucagaagaaacaucugguugaaauuuugucauaccacaauugugauucacaaacucgaaaugcuccagaauuggauugccuuaucagacuucaggcucagaacauacagcaacgacacauagucuuuuuaacagguaaagagagcacuccuaagcuuucuacuaugaauauaggaaugugaaugaaaggauuuuauggggcugugguggguauugcuaagcuuugauucugaaaaugugaaggaaaagauuuugugagggcuaggggcugucuauauuuugaaguguuucauacaugaaacuuuuuuucuuaauuuagagaagaacaucaagaugcuuuccaguuauacagauaauggaauagugguugcaacugcugaagacuucaugcaaaacuuuaaaaaucuugugggcuaucacaauucaaucacagaagaaaaccuuccacagcuuggugcuaaugagaaucuugagucgcagucagguaacuuuucagugguuuucauuuucuuuaacgcagacagaaaaagaggaaugguuuugcuguuaccaaauaaugaaaugaccauuuugaaaccacguaccucaguauaaacagccauagggaaaguguuucaagacauuuaucauucuaauacuuagcaugcacaagaucugcucauuuauuauacuguagccaguguaaguuguaaguuauuauagauuaugcauuucuaccuauauuguagacagugcauacuauggaguaugcauuuugucuuugagguuuuuguaagcauuauugguuacuauugucagcaaagggguuauauuaauaaaaagguaggaaaccagauauggcgauuuagcauugagcuacuagauuuccccacaugcauaaagcaauuuaauugcaagauaguagagcugucauagcuuuaaucuuuugugagauggccucugcuuugguuccagguucuguguaaaaugaaagauguacuuuuguuuuugaugaaaaaaagcagaaaugaucauucauuuagugcuaaccaacuaguuuaguaauccagugaagcuagaugucaaaaaauuuuauuuuauauuugucuugucaaauacugaauuaccguauaacuuuagaugcuguuuugacauuaaccccuuuggagcugggaguugggauuucccaacauuaaacgugaacacauuucgcagaagcuuuuagcaucggauuaucuggacauucacaucuagugugaguguugugacuaagugaacuuguggcagaagaccaagcuuuaagggauuguggacuugcagacccugacgcguuauauugugugaguaguguauaauuuuaaaacuuaaacaaacuguguauuucaauagaggaggacuuuuuguuuuuuaaauguagcucuuuuagaaaacgaugaaaaggaugaagaggauaugucucuggauucaggggaugaaaucucacauauagaaguaugcagcaauuuucauucagaaauaugggagaaagagaccaaaggaucacguggaacagaucaaaaaaagaauacucaaauugaguugcaaucgucuccugaugugcaaaacaguuuauuagaagauaagacuuaccuugauucugaagagagaacuucuauugauauaguaugcucugaaggagagaacagcaauucaacagaacaagauucauauaguaacuuucagguuuaucauagucaauuaaauaugucccaucaguuuagucauuuuaauguucucacucaucagacauuuuuggggacaccauaugcccuuucaucaagucagucucaagaaaaugagaauuacuucuuaucugcuuauacugaaagcuuggauagagauaaaucuccaccucccuuaaguugggggaaaagugauucuuccaggccauauucacaagagaaauaacuguaguaacuuuuuuuuuaagagauuguuguggacuuuguuuauuaacaauuuauauuucauucucuaaacaaaagguucuuguucuuucucaaauguuuuuucuuuuauuuaaaucaugauggccuguaacaguugaagcaucuaaaaauugaaauaaauauauauuuuuaacauauauuguacuugaauuaucucauguuggcacuucuaaguuuuacuuuuuguauguuaccuguacuuaggcuucaaauugaagccuguuuuauguguaaaaucagaugcuugcaggaggacgguaaacagcaaaggcuuuacuucuuuuucucuaaugucaccugauauaaaguacuuuuguugaagugaauuauuuugauguaggcuuuuguauacuguguuuacacagguauaagucaguaauagcaguguuaauauuuacaggauuuuggcucgauaccucaagauuuaucuaacagugcaguuucauuuagauaauaaacuauguacauaggacacauuuuuuaucucuaggcuuagucauguaaaaacugccuauugcuaaaauucugguaacuuuuugagaguauuggauaauuuucaguaccugcgcaauccuugauuuaaugaaauuaaauuuuuuauuucaaaagauaggcuucuguuuaucaaaggcguugaacaauuugauuuuuaaauuaguuuuagcaaaauggaaguauaaugggaauauauuuuugagguggucuuaguaguaauuaccauuuguugaacacauuaaugcuauacuagacagauacaguggagauagcuuucaaacccguaucuauuccuaacuacugccucuaauacuaauuacuaacuuguuacuaaugcuaacuuuuaaaaauguuuuugaaaauugcaauuucuacaaauaaaugucauagugcaaauaaaugucaggauuuagagaaggagccuaaacugaauuuguguuauuucaguaaaaguuauggaguuaugggucuagacguguuaauaaguuagacagaacuuuggcacuuuagaacaaaugcaugagugguauuucaguuccuaaguuacauaaaaagugugaaagaacacugugaggucccagcaacgccagacuauauuaagguaaguagaaaguguuuuuauagggcuucaauacccagguggugacagagcagaagaaccgguuuuuuuuuuuuuuuuuuuacuacuaagcuuuuacaaaagaaguaucuguuuuauuguauagaacaaguacagcauuuuacuacauaguauacaaguuuuuaaugagcauuuaaaaaaauaaguaaaucuaggcuauuugaaaaauacaguugagccagugagcacauuuuauaauuuggaagacacaaaucaaaugugaaggauuugauuuucuacauuuaaaaugaagaaccaaaacucucuucuugauuuucagcuaaaggcaggagacuacuuuccaacuccuuuugcuucuggagaaggcccugaaaucacauugauauauguuuguuaguaaaaugugcacaccugacuugcaauguuguguuaaacuagaauuauauucacuuggaaaacauaucgcuuaggauaaaauuuugucauucaaaaauuuuuucagaaaugcuuguacuagaccaccucauuuggauauauagcuaucacauuuguaagauucuguuuuuagcauaaaaaucaauagggaugaaaauuuucuuagaacucaagacuccauaacuauggggguaaaugaagucaucccuucucccccaguccacccccaagugcucuuagauacugaaggagucucccuuaacauacaguguuuuuuuuuuguuguuguuguuuuguuuuuuuuuggagauggagucucgcucugucgcccaagcuggaguacaguggugcaaucucacugcaagcucugccucccagguucacaccauucuccugccucaaccucccgaauggcugggacuacaggcacccaccaccacgccuggcuaacuaacuaacuaacuuuuuguauuuuuaguagagacaggguuucacuguguuagccaggauggucuugaucuccugaccucaugaucugccugccucagccucccaaagugcugggauuacaggcuugagccacugcuccuggccaacauccaguauuuuaucuugacuguccuaaccuuaccuuagaugcuaacagaaggguccugcugaaauaacacugggugcuauauugauggguaaauguguacauccuauuccuuccucuuuaucucacaauuuuugucuccacuaagcaagaaguaaacuaacacuucgucacucuaaagaaauaacuuauguaaaacucuuaguaacccuguuugucuucaaaugaguaaauagaccaaaguggggggacaauuuucuaguucuguagagggaaaaacaucugagucaacauuuugaaaugcagaggguauugguacaugacgacauggaaaagggcacuuuuaaacacagcuuacucuuccucaaguacagagaguauauagugaaucaaaacuaacuacagccauucuuuuuaaagcccaagggauggagcaaagguguaaggauguuaccuguuuguuuuaaucagagagcaaaaagaagucacaauaguuugggagaaaaaguaguauggugaguaagguuaugcguauaauuucauacugaauuuauuacuauuugggauguacgucaauguucuaacaaacacugccaacacgucaauuuuuuaaaaagcgugggccacauugcuaagaauuuguuaaagcauaacuguauuuuuuguuuuagggccuuauugauguuuugccguuccaauguaugcauuuuuuuacucaauaaacuugucuuaauuuuagaac

SEQ ID NO: 17478 - RNA, 1791 nt, Homo sapiens
aaauugguugaguuccugaccauaaaugcuuuaugauaauuuuuuagguauauuugauuuuaaaaguuuuaugcuugcuuuuaaacuuaacuucaaccaaugacuuccuuuuucucagagucuccacagccuauuggcucacuuggacaugaugcugacuugaggcggcagcagcaggauaccuguaacuccggcauugcugacauccauaggcuguuuaauugguuaucagaaacacuagcaaaugcgcgccauucugaugcaucucugacagacacagucaacaaagccuuaggauugagcacugaugaugccuaugaagagcugaggcaaaaacaugaguaugaguugaacucuaccccagauaagaaagacuaugagcagccuacuugugcaaaaguugaaaaugcacaguuuaaggguacucagagcuuauuacuagaaguugaugcaacaucuaaguauucuguugcuauuucuaccagcgaagugggcacugaccauaagcuacauuugaaagaaguaagcauauagcuguugguuaccuuuguguuugugagugugugugugaaagaggugcugugaguaugcuucagggaaugauuuuuuucuuugaaaaagaaauaaaaugcacuuuugaguaaaggugccugucuaggaugguacuuccuaaguuauuccuuguuacaaagagauaaaugcugaaguaguuuuccuuccuucuuagaagcuuaauauauugucuacaguuuacuugugauaaagcuuaggcggaacaaucuauuaauauuugucagaaauggcuuauugggaguuaauuccuuauuguuucauaaugaaguugaauuauuaaagcauuggcuuucugucggcaguaacagagaacccaaaggugaggcagaugaggaugccagucucaguacagcagugugacaguuagguacuugguauuucuuacgcaaauaggaauggaacauaagcagccuuuaggauuaccccugaagugacucucagccuugcuuauuagaguguccaguauauuuaugauauauguucagagugcugguuuguagcugagaaguagccuuaucugccuuaagcagucacugcaucacuggggaauaguucuaggauugcaccguauuccuaugggcuuauuucuucauuuacugucuccauuuucucuucccugccuuuguuuaaaaguuguaugcauguccccauucuuucucgaugucguuuugggauauuuauuucaaggggaagaugauggcaggaggguuauugggguauguaagguaggcacugaggaacuaaccuguauuaauauuuucugauaucuuuuguauuuuaaaucaaguugauggggggcgggggcauggguugaaccuagcacacuacccauuuuuauaacuaaaguuuuauuggaguacagcuguguccauuuguuuagguauugccugugauagacuagagagucuggccugcagagccuaaaauauuuaauguuuggcacuucagcacaaacguuuaccaaucccuguucuaaauuaacauaaaauuauguuucgagggaaaagauguuuuaauuuugaaacuagaguauaacuuuaccauguugauuuuacgcauuuguaauguuuagauugaagcacgugaauuuucagugaaaaaacaguuuauucuugacauuaaaaugaauuggaaauaaagcuauucaguguguacuuugauuuuuaggauccaaauuuaauuagcgugaauaauuuugaagauugcaguuuguguccc

SEQ ID NO: 17479 - RNA, 1791 nt, Homo sapiens
gggacacaaacugcaaucuucaaaauuauucacgcuaauuaaauuuggauccuaaaaaucaaaguacacacugaauagcuuuauuuccaauucauuuuaaugucaagaauaaacuguuuuuucacugaaaauucacgugcuucaaucuaaacauuacaaaugcguaaaaucaacaugguaaaguuauacucuaguuucaaaauuaaaacaucuuuucccucgaaacauaauuuuauguuaauuuagaacagggauugguaaacguuugugcugaagugccaaacauuaaauauuuuaggcucugcaggccagacucucuagucuaucacaggcaauaccuaaacaaauggacacagcuguacuccaauaaaacuuuaguuauaaaaauggguagugugcuagguucaacccaugcccccgccccccaucaacuugauuuaaaauacaaaagauaucagaaaauauuaauacagguuaguuccucagugccuaccuuacauaccccaauaacccuccugccaucaucuuccccuugaaauaaauaucccaaaacgacaucgagaaagaauggggacaugcauacaacuuuuaaacaaaggcagggaagagaaaauggagacaguaaaugaagaaauaagcccauaggaauacggugcaauccuagaacuauuccccagugaugcagugacugcuuaaggcagauaaggcuacuucucagcuacaaaccagcacucugaacauauaucauaaauauacuggacacucuaauaagcaaggcugagagucacuucagggguaauccuaaaggcugcuuauguuccauuccuauuugcguaagaaauaccaaguaccuaacugucacacugcuguacugagacuggcauccucaucugccucaccuuuggguucucuguuacugccgacagaaagccaaugcuuuaauaauucaacuucauuaugaaacaauaaggaauuaacucccaauaagccauuucugacaaauauuaauagauuguuccgccuaagcuuuaucacaaguaaacuguagacaauauauuaagcuucuaagaaggaaggaaaacuacuucagcauuuaucucuuuguaacaaggaauaacuuaggaaguaccauccuagacaggcaccuuuacucaaaagugcauuuuauuucuuuuucaaagaaaaaaaucauucccugaagcauacucacagcaccucuuucacacacacacucacaaacacaaagguaaccaacagcuauaugcuuacuucuuucaaauguagcuuauggucagugcccacuucgcugguagaaauagcaacagaauacuuagauguugcaucaacuucuaguaauaagcucugaguacccuuaaacugugcauuuucaacuuuugcacaaguaggcugcucauagucuuucuuaucugggguagaguucaacucauacucauguuuuugccucagcucuucauaggcaucaucagugcucaauccuaaggcuuuguugacugugucugucagagaugcaucagaauggcgcgcauuugcuaguguuucugauaaccaauuaaacagccuauggaugucagcaaugccggaguuacagguauccugcugcugccgccucaagucagcaucauguccaagugagccaauaggcuguggagacucugagaaaaaggaagucauugguugaaguuaaguuuaaaagcaagcauaaaacuuuuaaaaucaaauauaccuaaaaaauuaucauaaagcauuuauggucaggaacucaaccaauuu

SEQ ID NO: 17480 - RNA, 21532 nt, Homo sapiens
cuguuugcggggcacaggaucgcguggaaaucugcugcgagcuccacggagccgccuccgccgcccagagccgggguccgugcggcagcugcccagcgagcccuuccgccgccgccguugugcccgggaccgcccgccucccgccggcccgcucucccgccccucggacccgggcgccaaacgaggaggugggcagcuucgccggccauggaccgccggagcugagucgccgccgcggagcuccgagcucucgcccuuccccagccucgcgcccgcggugcacucgcugcucuucgcccuucgcccuggaaaaacggggaaaagagagaucaacccgaagagagaaagaacgggauacgugguggggggggggagcccgcgucuccccuggguuagucgcaccccuccagcucaccgcacagcaauaaguuccggggcgacuuucaccuauuuugcuccccguuuuugccgaacccuaaaaugaaaggacacaauuuggggcugacucuugcagcucagauggcgacuugugcguuuucagcggcaucucccggagaaaaagccaugcgcgccugauuguucuguggccccaaagcugcagcggggguguguguguuggggugugugucuguguguguacagagacguccacacuaacucgcggcugcaggaucagcgucuggaagcagacguuucggcuacagacccagagaggaggagcuggagaucaggaggcgugagccgccaagaguuugcagaaucuguggugugaaugaacugggggcaccugggcgcacagaucgccccccuucccccgccccgggccacaguugaguagugguacauuuuuuucacccucuugugaagaauuucuuuuuauuauuauuugucguaaggucuuuugcacaaucacgcccacauuugggguuggaaagcccuaauuaccgccgucgcugauggacguuggaaacggagcgccucuccguggaacaguugccugcgcgcccucgccggaccggcggcucccuaguugcgccccgaccaggcccugcccuugcugccggcucgcgcgcguccgcgcccccuccauuccugggcgcaucccagcucugccccaacucgggaguccaggcccgggcgccagugcccgcuucagcuccgguucacugcgcccgccggacgcgcgccggaggacuccgcagcccugcuccugaccguccccccaggcuuaacccggucgcuccgcucggauuccucggcugcgcucgcucggguggcgacuuccuccccgcgcccccucccccucgccaugaagguagguguucagugcgcugccacuuuuuuucuuuacuuccccccacccccuguuggaaguuaacugaguucccuucgccucuuccuaucccuccauuuccccaaccgccugaagaagcuggaacuccagcgucgcuggcaggaaccccuaccccuucgcccuccacgccgggcgcacugccucagugucccaggagaucacuucuggucgcaccacccguucugcaaacaauuuugauuuuugagaaaaaguggggaagagcgauaguagacaaacugagugcgguucacugacgacuuuccuuuugcucugagaacaucgaguguaauuuacuauguauauuucaguaacaggauaaugauucaauucaacaaauauuuaccaagcgcccacugcgcgggcaccgggacgguguguggccggggcucgggauggggaaagggacuccuugguugagagaacccgcagaggaacuaggggccaacuacuccagagcggcguacaccuuccccgacacccccccgcaccgacggaggccagauuguaggcuugccuuggccgaguaacucgagcgcuucaggccccuuugccuuuaagagugccuggcggggggccagcgcgcaccccggcgcggggagcggggucgcguuauuagcauuauuagccgccacugggugagcucaggcacuuugcagcaguggugggggcggggaguuguggugguaguggcuguaaucccguacuccgggacagcgcuccccggcccccugagcggaguccgccuuguccuuuagaaaacacuugggccuccgcuuugggagagcaggcgggggccaguuugcgaacucuuguuuguuuuaauugucaguuguauguuaaagccgaaucacacacuccgagggucacugagaguucacuuuuacgaaaaguuaacguuucuuccugcaacauaaguuuuuauuuucuaaacaauuuuucuuaucuguccuccaagcuucgauuccuauuuccauuuuucuggucuuucccauuuuaaguuucuuagaaaauaagguuagaauugaaauuaagauguuuccuggaagcaaauaaccccucuuccccccaaaaaguuaaaaaaaacaacaacaaaaaacuucaagucuggagaccccacggcccuguuugacuuucuaaucccugucugguaucgaggccccuucuccucucucgccucucuuuucucucuucucucuuuaaauggguaauucgcuguuuggaaguaacuugggccuugcggugaggucgcaccuccucagccccugcccuccccccagccaccuucgcacauucacugccgaaccagccagauuuaguuucuagacagacucugccaggggaguuucgagggggcaaugcggagagugcgcagcgaaccgcgggccgacaaauguguguguguccgaguguguggauccuuggcugcgugugugugcguguguguuuguguguguaggggaguuguucucggguccaggacguaguagccuucgucuccuccaccccccgacccucucaacggaagacccuccccaggaggcccggcccaagaguccccugucuucuccuccccucccccgugcgcuccggugcucaagggguuagcacuaugcgcgcagaacucggagccauccccgcggccuuuucuuccccgcggugcggugccggcugcccccuguuggccgccuugagguaggacuccugcgagccucgguuccuuggggcgggcgggcgggcagcugcuccccucucccucccaccccugcucccuucaucccucccgaccaccagaccccacucucccagcaggggcccucggaggcccccagaggaccaguuucgcugcgccgccggccgcugcaauacggaaggggccacggguccagcccagcaaaugggacucggccagcuggacacaggguugguaccucuucuucugggcuugggaaggagagugucgcccuaggaggccucgggucuggccucagcugccucccaacucucuaugaucgagaacaaguguugcuuucccgcuuuucgccucacuuuaaucgucuauuaaaaagugggagagaaacuaccuuuaaagaguggggguuggacuaucauuucauuuucuuccucuguccaaggacucugcuccaccucuggacaaaguugauccucugccgagagggcuagacauccuaugugagaaggugugagugguguguguguguguguguguguguguguguguguguguguguguguguauccuggggccuggaaagcccagucuaagggauggacgagggggcaggaaacagaggagaaccaggccagaccguucuuccccuggggccucucuauacccgaaccuggaaccugcugucaguguugaggccugggcggcucucuuuugucauacugauucuggcucaagguguaaccuccgccuucucuaucuggcaauucccuccuccccuaccccgcuccgcgcgcgccaacacacauauugcuguggacacaacccuugcgcccaggcgugaggcuuagggaguaguggcuccuuugucugcuccccuaaagcggaccuccuacccgccugggccggcccauucuuuagcuccucgcgccgcuccccgcauucuccagggcaggacgucccaaguuuuuggcugcaacugagugcucuccugcuaguuucugcaucucucuccuugcuuuagggagagaucagaguggggaaaacagcuuucuuuuuccaccaagaguggagauucuuuuuggaguuucccauccuccccuucgcugccauaagccugggucaaaugggcuucuuccgccuauuuggcgucccucaucguuucacucccagaaacuuggggccuaaacguagagagucuagcagaaggggaugccuagacugaauguggcagugccccggggccgaggggagaggaucuuugcuuggccuuuuuaucuauucucuuaagggacugccugcggaggaggaguuggguguugcgagacuuuaggugugcauccggcugcuccccgcgcccuccgaacguccucugaacaauuuugcuacugagguuuccucucccucaucccucaucacgccuggcccgcaccgugguugguaaagaaggaucaagaacaccuuuaauccgacgcgaaggcuuugagggauacauagaaagggagccacgucguugagcugcucuggauugaagaggaggacgcgggaacgcccuccuccaccucacuccucuggugcgcugagccccucaaacgcccccaguccuccuccccguggcacgcgaggaagauucucaguguccuuacagagucaucuucccugagccccgaaaguguuggaaaacauuuagccccuucuuugggaaacucaguuucugaucagaauuuuuguuuuaccccugggguugacagucuccccagaggucucauuucauacugucuuuucggaucugaucucuugguaaacaggcggggauguuuuacccuacagagccgauguaugugugaguucgcugugaguucuuugagugucucaaacuuguggggccuuuucucgguugcacugggauugaagagggaagagggccaagguguuuccgggcaagcggcgggguuaaguggagaugcgacucgugaggcucuccuuuccgaucccccuuugggacacccucugccuaccucuacccuggagccagggagacccaagucuuggugaccggaugggcccgcucucaguuggccugggcucugggaacugguggacucucccugggggcuucgggcugggaguggguucgguuuguguggcuucggcucuaacaaagagauccgcuguaauccgccgaaucuguuaucaauuucucugcugcuugagccccgccccacgcgccccgcucgccgcgaagcuuggaaagugcacgcggccagcaccaaucugggccgcugacucggaaacaugucgcagcgugugugucuaugcacgcgugugaguguguaaaugugcacgagugugaauguguaugaugugugugcacgcggcaucggcugcccuuggggagaguugacuuugcagccugggcugcgcgagaagcagacuuugcagcccacucccuccccuggaggaaauuugacacuuagggcggggguggggagauagccggagccuucucucuccuagcuggggaaaccccagauuuccauucuccaggaugcgccccccagcuuugcagcguuuuggggacaacugggccuuggguguggagcccugcuuagcaggcgcuggggaccacauaagcauuuccucuuugagaagccccgaagcguccaggccaaaggggcggcucacggagaaaaaccuuggcacgccccugagccccauagcuuuaccagggcugccuagguccccucugccccuuuuacggcacagguuccaagccaggcucuuccaccgccuuaaagaggcucaccuuucuuuucuuuucuguggaaggggcuccuucaggggcuaugggcgaugcagugcggcaggguuagacuuacguguaaggggauuuuuaaaacccgcuccucccacccgcacccgccaccuacucgcuccgccgccgccuacagguggagaagucaccaguggggaggaacggcagcggaagcuuccaaggccaacuccuaccccugaaauucuucaggaagggaaccuucgccgcugggggccucuuugcccuggaaucgaugcgcccagcugcggcucggaagccagcgccucuggccccgucuggacucaucugcaagggcucuggccucgccccgcacccccaccuuucggcacugaccgaaccaagucugaguugggcuggagaggcuagacuggaggcaggguggcagaguuccaacgacaggcucgcagugccgcgauggcaaaguggcccacaaccccagaucaggaccaagggaaacuggagucucucugggccucccaucuccucccucccuggcagcugccagguguggggugggagggagagugaaaaaucagaauuugggagaaagcuguggggagggcagggaagggaucuucuccccggggaagcgagacccagacucccuucuuuccucuaggguuccaucccuucucucaguccguggaagaggccacaggcgacgcgggcgaggguggcacucuuuuccaguuuccuugguugggagacccgaccucucucuccauuauccccuagggcccccaucuccuucuccccucccuagucuggcugaagaacguccuuaaggaaauccgggcugcucuuccccaucuggaaguggcuuuccccacaucggcucguaaacugauuaugaaacauacgauguuaauucggagcugcauuucccagcugggcacucucgcgcgcugguccccggggccucgccccccacccccugcccuucccucccgcguccugcccccauccuccaccccccgcgcuggccaccccgccuccuuggcagccucuggcggcagcgcgcuccacucgccuccgugcuccucucgcccauggaauuaauucuggcuccacuuguugcucggcccagguuggggagaggacggaggguggccgcagcggguuccugagugaauuacccaggagggacugagcacagcaccaacuagaggggggccagggggugcgggacucgagcgagcaggaaggaggcagcgccuggcaccagggcuuugacucaacagaauugagacacguuuguaaucgcuggcgugccccgcgcacaggaucccagcgaaaucagauuuccuggugagguugcguggguggauuaauuuggaaaaagaaacugccuauaucuugccaucaaaaaacucacggaggagaagcgcagucaaucaacaguaaacuuaagagaccccggaugcuuccguuguuuaaacuuguaugcuugaaaauuaucugagaggcaauaaacaucugcuccuuucuucccucuccagaaguccauuggaauauuaagcccaggaguugcuuuggggauggcuggaagugcaaugucuuccaaguucuuccuaguggcuuuggccauauuuuucuccuucgcccagguuguaauugaagccaauucuuggugguaaguucauucuaugugcguguucuuccucuucuuuuucuuuuuuuaagauuuguuuguaugaugcggcaauauuuaaugcuggauagugaguguggguguauuuauugcaagacauauguauacauuuuacuuauauauaguuuuaaaucagaauuuucuuuuaacuuguuaauauuguaaagcuuaucuucagcuccuagggaaugggaaacuauaaaucuaggccuguuucuaugaagcccuuguucagacgugugcuuguaguacaucaugcaauaaaaaagaacagaaauucacuuugcuaguaauuguaagccuaucuacaaaauuuacuuuuugccaccucuagguaguaaaagugaguuucagccuuuaucuucuguuacucgagauuauuauuaaccuacagaguuugaauuaggcagaguucuaggaggacagcuacacuccaagugcagaaguauuggggcuugaaauguaaucaaaaggagguuaacuugaaguagucaaauguccccaaguggggguuucuuucuggguaggggccuuguagauagacuguaauauauccagaggauuauuuuugacggcauucuggguauuuuuuucccuguaaaugaacagcauuuuucugacugucaaacaugacuucuguucacuggguacccugucuugggucccucacaaucacauaaggagcccuuuuaaaaugucaagaaacauggugaauuuucuccagucuguauacuugucccucuguucuuccaucagucaaaaggaacugcuaucuccuacccguaucuaauugugucuacuuucagcauucauaaguuuucaaggcagauugguccaauuuguggggcaaagugggucacuuucucuaaugucagaggccugucccucaaacugcuguuuccuccuuuucugaguggauuuuggaaauacugguucagguauauggugacaggggcuaggaagggagugaaaauacuaacugaggagccagauggcaggauggggacugcacaauaccuccguuuucugagugcaguuuaaacagaggaguuuuaugaagcccuucucauacuuugucaugaggacaagcaggagagaaaaaagcaucugugugcuuaaaacuauguauugcugacaugcuuucagggggcccaccucgagauuucacguaaaucuugaaugcacaucucccccccuugcaggucgcuagguaugaauaacccuguucagaugucagaaguauauauuauaggagcacagccucucugcagccaacuggcaggacuuucucaaggacagaagaaacugugccacuuguaucaggaccacaugcaguacaucggagaaggcgcgaagacaggcaucaaagaaugccaguaucaauuccgacaucgaagguggaacugcagcacuguggauaacaccucuguuuuuggcagggugaugcagauagguaggaaaacauuuaaaauauuuuuuuaaaacauuaacuuuuuuuccuagaagaaauccuuagcauuuacuucaugcuugauagaaagcaugaaggaggaugccuuccagcucgggugguggcuugggcauuuuugucauuauagcaaaugauguuaauuccugucccuacaccugaugauaaguuuuggauuuuaaucaaaucaggaggcaaguaucacagacaccuucauuuuugcaaacacuuaauuuuucuauaaagcauuuuguuuaaaauagaagcagaacacuuauuuugguuucuuaagaguaggugggggaagcaagucauguauaugcuuuuaaacgucgaaacucucuugccuguuaguuuuuuaagccacaauugaaacggcccgagcaucgaacuaaaaguugccgucuuuuagaauccuggauauauugaaagugaacaaaguuuuaauuuuccuaauagaacuauuuccugaggcuauaaagauauagacguuaaaagcuuuauuuuuagucccagaaagaauuuuaauuaaaagugauccaauuuauguuugugaugucagcaauugauauaauaaaagcacaugcuugggaugucaaccuaggaacuugaaaaaaaaauuaagaguauugcucacaguccgauucuucauuuuaaauacguuguugaaugucuuacuuccccauucaaagagauagcauuucaaaugggcuaaaggcaaagauuuuaaaaaaucuguuuguuugccucugcuuuuguuuaaauaguauaggauacuauuugacagaugugguccaauguauguuuucuagugugaauauuuuagguuucucuacuuuuaugcaaaaaagcccuuauaauuaauaugacugcagugacucccaaaguaagaagcaauuuaucaaggcaauuaacugucuauacugacugaagagaaaaguuggcuuaauguccaucacagauggauaaaaugcauuuuuuauuaaaaaaaaaaccccgaaaauuacauucauugagaacaaaaaagaguugucaggggauguuugagccaagugguuuuauaaacuaaaauaauacaagacuggaagcuguuccucugacugaaugggagaauggccuguagccucagccugcaaaguuucauggggcuuuguccuuucuguuaaugauuaaaaugugcuaauguauauacugggaucugaaucuaagaguuaagcuucaggaacacaggaguuuucccugacugugggcugucuuauguaguuaacugggagugugguagauuuauucucccguguguugauauuguaagggaacuuaaauacuuuugaaaaauucuaugaggaugguaacuuuucccccuucuucuauguuccuccuaaacugccuuccucucaaccuaugggacuacuuuuucacauguauaugaguuagcaaaaaucauacaccucugaugguaaccaggaaggaaaacagcaaucggaacuguuuaucuguguagucacuugaacacagcuuugauuuaagauccuccucucguuuucauacguagccuguuuugggccaaaauguucagaauaagcuaucauuugcuaagugaauuugaguucugcuggagauuuauuuuaaaugcgguccaagauucaaagagccugcuuccucagggaacaagcagaacccuugguacaaaagccuguauuuaauugucccuggaaaguaugcucucuggucuucagcugcacggcacuacugucugggucgaugggaaguggaugggagugguaccucuccacacccucugagacagcccuccuagauacuaucaucaagucagcugauguccugggaagaugagagcacauauggcauccuccccugcaaaaggucccccaagugccuagcgucucagagcugaaagcugcugcuggguggcuuguggugggacacugauggggccuucuguuuuuuacuuaauuaaaaaagagacaggagagaagagaaaacaauagauuuuuaugaaagaggaacauggauccaauuccaauaguuggaaaauuucuuugcuuucacuuuuccacuuaagaguguauuugaagagaaugagcuaagggaaaauuuaaaauaccuuugaugccaaaaggugugugugugugugcccaccccaaagcccucagcacaccaaggacauugagaauaauucuucuuugugagaauuugacccugugauggggccagugucugagaaauucaggccgccaccucugacccccuccucaacucauuuuucuaagaugccaguugccuuggaggcaccaugcacaauuacuucaugaagggcccacucuucauuuuggagaguuucucauuuuucaucaugcuacccuuuccuuccagcuuuuguccccaucugucucuucuuuguuuccaugcugugaaaagauauguaaggaaggcaccauuuguaaggggugugaggaucggaguagauguggguuucacaggaagggaaaccuaacugaaucagcaguauuccaaccaggaugacuguauccucaggcaauuagccaaagaauacuuuucaaacugacguuuacccugcagugaccaauuagcuuagagggaucucccagguuuguauucugcggcauaaaaggaaaugcucaagauagacuuaugaaaaaagaagcauuguuuguguuuuguauaaagccuucuuaugcucuguauacucaaaggacagugucuuauuuuccucuauccccagaggaucauuucaucuccucuucaucuccucuuccucuagcuacuuuguucuacaaaucccccauccagggccacagcauuuucuguacuaucaaauuacucccuagaagcuguauauuguccucauuccuuuccauuccccugaugugcucugccucucuaaucccgcuagauagguguaacgcaucacaggaacuuucuagauccuccugccaaccaccagcacacaccuucaagucauucauuuugaaaauaugggagggggaggauauaugguaaaucagaaccaucaccauucacaaauggcugugacuggcauggagcagaagaccaagaaugagguggccugcuggaugcuuaaacuggcaucgcuguccuccugcagaaugacccuucucguucagacugaguccuguugucagcuuuucuugugcuccucacuucccccucagaaaaaagauuguuagcaagcucucaaaguaaguauaggauaaacugauugcgguacaugaauuucagcaccagaagaggccccuuuccuugcauguauuucaguacccuuauuuugcaauugaggaaagugagccugccccccaaucccaccccuaccccacgcuucagcuggcuggaugauaacccuuucucucucagauuacaguacuuuuauuaacuagcucuuguuacaugcagaaaugucuccauguacaagcgaaguuuaggguacucuaugauagccuccaguuuucuccuuacaaauagggucccuguaacuauuauauggggagauauucuuuacuaguuuugggaagaagaaaacuucucccucccucuuuuccccauagguugugcuuuuuuccuucuugcugucauucuaacacuuuguggcaaaggcagugggggagugggcagggggugucugcagaaguggcauugaagaacaacaggcuguuuuaaaagcagacacucauucuugaaugagaaguaucaggccaaugagccugggauuuaagaauagcaagcuucauuuauaacucucuaugagcugauuuagaauuguccucugggaaaguaaagagacuuguccugagaaauacuuucugcugcaugaaggaagagggaggagagguuacaacugccagaggaggaggggacacaaggccaaaaugaguguggcagaaacuaguguggccgcuggcagugucucccuuagauucaaggccuagcaaauucuguaauccugccuuauauguaacucaaaugaaaauaauacuuaauauuaaaauaaguguaaggaagucuacccauauucugaguguuccuucaaugacuucuuucaugugcauuuuugcaaauagcaaguuuugacuauuuucaaaagaguugcagagaaaaucaauccagcacugcuuagaaucuggccugcagcucugaaauggcugagcagagauacuggggaucugcuacuccuuuguuaauuguugcuucuguguguuuugggggaucuugcuuggcuuccccucaagcugggcccagggccuggugcguguuaaggauggggcagcccgagcuuuuaccuuauugauccccuacccccuacccccccaucuccuacucccuacccucuaccccaaccuccccccagcccuaccugccccccaccuucuaccuccccacuauucuugcuuccccaccuccuacuuccccccaaccuccaaccucccccaccuccuaccuccccccucccuaccucgccccaaccccaccuccuaccuccccuccaucucuaccuugccccccaccuccuaccuccccaccauucccuaccuugcccccacccccacccccggcagcaucccggcccagcgcgugaggcaggcggccagugaucccuuguccucacccacaggcagccgcgagacggccuucacauacgcggugagcgcagcagggguggugaacgccaugagccgggcgugccgcgagggcgagcuguccaccugcggcugcagccgcgccgcgcgccccaaggaccugccgcgggacuggcucuggggcggcugcggcgacaacaucgacuauggcuaccgcuuugccaaggaguucguggacgcccgcgagcgggagcgcauccacgccaagggcuccuacgagagugcucgcauccucaugaaccugcacaacaacgaggccggccgcagggugagugccgcgucucgcccccgccccgcaucucugucuucucaccuugcccuccagccuccucgggucucucccuguagcuccguccucuccucugccacuccuuugcuauaugguccugucucuaucucucugcuucucuuucugucucucccuaucuuucucugucuuuccugucucuuuccuccucauccuguucccgucucacuuucuuucucccucuucccuuccuuuccuccuucccggucucucucuucucccccuuugucuaccucucuuuccuccaucugucuccauaguugccccugcacaucccagaagggccuccugggcggaucauccucccuuucgcccccagccaaggugaaccagcaguugccugaaaaagaccuuuccuugccuucuuaguuagucccugguaccuuuggcuacuggagcacagaaauaaaaaugggaauaacuuucucccuccugccuggacgaugucugugguuggcuuucaguuugggacagggauuuuucugucuucguaggugcccagaugggaaagcccucaccccagcuuugaggcucuuucccuccuuucuuucucccugccucucuuuaugucauuagguagcaggccugauggauggaggguuuuuuuaaaaaagggcuuuucuaggaaaaggacagcauuuuuagcagugugggauuuuauaggucugaccaucaggccaaucacaaaguagcucuggagagaagagagcagcagaaguacccagggaggaccaucuuugcaguccucacgagucuccugguucccgcucuuuccuuccccugguggggauaugaaaagcuacuucucaauaguuaaaaagacccuuuuuuuccugcgguuaaacacauggcacuuuauggcugcuuuaaaaugaaggggugaaaacuuuucuuaacuuuggcagcauugaaaaccagggccauuauuuuuucacagaacccaagguaggugccaggaacuuucuggucagagauuucacucuucuguauuuuggggugagggagaaggaaguuaaucacagaguaaacuguagaggacuggacagagccuuagaagacucuggccccacacucauuugaaagacuaggaaacugaggcccagaaaaccacuucaugaccauggaagaaaauuaaagaauggaaauauaagccuagguacguuuuuauugaauucaugcaucacagcuaagagaugaagagcuagcaguucgggaauuagagaaaucuggguuaaaaugcaguguugucuguucuuugcuuuuucugagccucaguuuucccauuuccacaucuguuaaauggccauggcaauuacaauuaccugagguuauugugaggccucagugagaucaucuaguagguugaaccaugugaaauugugaacacuugacucuuuuuuauuacaaaauaacaauuucauuugguuuaauuaaaggucuuaguuuaguguccgccaguaguaagugcuugauagaugauaacuucuaaaacauuauaggcaaaggacauagagaagucaaagaucguguagauaauuccagcuagcuuaucuucucaaauuuguuguuaaacauuuggguguuccggggaaggacuaaacucuacagaauuuugccuguacugccaugaggggucaaauaauugccacagacagaguguggccucuccuuucucaggccucucacugccauggugucugcagugugggaugccucuucugugguggacccagagccacaugaaaauuugggggggguggggucagccccauucucucuggaagcccauaaaaccuugcuaucacccucuucagggauguaucgcugggaucucuauauaugacaugcccagugccucagaucagaaaugccucaaaaagagagaugugucugacucuuaaaggccccuauccagggguaugcccauauuugauauucucauccaucuuugggacuuucuuagccuucucucauguccagaaaucaucagaggcuuggcaaccaagaagagcgggucaagggauuuccaaguggcaagagaggauuggggaaguuugaaaagcaccuauaauguuacacuucugcauuuuuuuaguagcgaguuuuuuugggguaaauuugaucauuggaguagugagcugaguuuggauuuuggugagugagguuacgaagaagacaguuuuuuuugcucugggaugguggggcuaggggauggaaauuugggcacugugccagaaaaucauauuagaauuuccaugggguguuagcuuuuuaauuuuccucaguggggagcaaagguuaaauacauuugcaaaacccuuccucagacuagcugagugccugaaacucuuuaugccaagagaguacacuuuggcccccuuuaaaagagccccugugaaucccuggaggaagaggguggcuguucucugcggaagaggccuucugaugcacccccagcuuccagguuccugacaggucuucuccagcacacucacaccacguggacucuggagggucacuggcacaaggaacugugggcagcagagucuauaaauaggcaaccaccaccucccagacugcugggcacaguguuauagggccagacccgugggcacugcuacugggaggcccaaggugacugggcaagggcccagaugccguguccucgucacucuggagaaagaccagauuuccugaguguguccguuguuacccuaaagaaagaccagauuuacugugucuuaagugccaagcacuuuccacaucuccccuaauuuuauccuuauaacagcacuuggagguuggugccaccacugcugccuucgcagauagaaaacagaggcccggaaaggugcagccuguugucugaauucaaggguagagucaggaacacaaucuauguugcuuggcuccagggugggugcucuuagccuagcgggguaguagaugggguagggacugugugggaaacaggagugaggauaccugaguuccaggcgcaguccccccacacuuuagcugugugaccugugcaggccacucagcaucacugugccaucauccaauccagcccaugucauaauguugcugggaugguuaaaugagaucaugaguguaaggacacuuauagugccuggugcacagcaauaauaguaguaauggguuaagauuugaacccugaucccacuggggcuggacucuucccaauucugcacuuaccggcuggauauccaugggcaagucacuaagcacgggcuuggaguccagcugccuggguucaaauccuggcaccuuuacuccccgggaguugggugaguggcucaucucucugggucucacuuuccuucucugugaaaugggaugauacuagcacuucucaccuagcugguacgggggauuaauucagguaaugcauugugaacaaccucugggaugaguguccacauguugcugcugcucuuucucugaaaaaaauacagcuggaacaauuuuuuuuuccuguuccuauuaaaaaaccacaguuguuguugauaaugauauaauaaugagugguuaagaacauauuuauuuggaagaauuuuuaaagaaggcaacauaagacuucugguaaugaaggaaauauaauacaguccuuaauucagcuggggaacauagcuccauggagaaggucgaggagaacuuuguuccuauagccugcaucuggcuccuccaugaauguguguauugauugcccccauuucccugcagacgguguacaaccuggcugauguggccugcaagugccaugggguguccggcucauguagccugaagacaugcuggcugcagcuggcagacuuccgcaaggugggugaugcccugaaggagaaguacgacagcgcggcggccaugcggcucaacagccggggcaaguugguacaggucaacagccgcuucaacucgcccaccacacaagaccuggucuacaucgaccccagcccugacuacugcgugcgcaaugagagcaccggcucgcugggcacgcagggccgccugugcaacaagacgucggagggcauggauggcugcgagcucaugugcugcggccguggcuacgaccaguucaagaccgugcagacggagcgcugccacugcaaguuccacuggugcugcuacgucaagugcaagaagugcacggagaucguggaccaguuugugugcaaguagugggugccacccagcacucagccccgcucccaggacccgcuuauuuauagaaaguacagugauucugguuuuugguuuuuagaaauauuuuuuauuuuuccccaagaauugcaaccggaaccauuuuuuuuccuguuaccaucuaagaacucugugguuuauuauuaauauuauaauuauuauuuggcaauaaugggggugggaaccaagaaaaauauuuauuuuguggaucuuugaaaagguaauacaagacuucuuuugauaguauagaaugaaggggaaauaacacauacccuaacuuagcuguguggacaugguacacauccagaagguaaagaaauacauuuucuuuuucucaaauaugccaucauaugggauggguagguuccaguugaaagagggugguagaaaucuauucacaauucagcuucuaugaccaaaaugaguuguaaauucucuggugcaagauaaaaggucuugggaaaacaaaacaaaacaaaacaaaccucccuuccccagcagggcugcuagcuugcuuucugcauuuucaaaaugauaauuuacaauggaaggacaagaaugucauauucucaaggaaaaaagguauaucacaugucucauucuccucaaauauuccauuugcagacagaccgucauauucuaauagcucaugaaauuugggcagcagggaggaaaguccccagaaauuaaaaaauuuaaaacucuuaugucaagauguugauuugaagcuguuauaagaauuaggauuccagauuguaaaaagauccccaaaugauucuggacacuagauuuuuuuguuuggggagguuggcuugaacauaaaugaaaauauccuguuauuuucuuagggauacuugguuaguaaauuauaauaguaaaaauaauacaugaaucccauucacagguucucagcccaagcaacaagguaauugcgugccauucagcacugcaccagagcagacaaccuauuugaggaaaaacagugaaauccaccuuccucuucacacugagcccucucugauuccuccguguugugaugugaugcuggccacguuuccaaacggcagcuccacuggguccccuuugguuguaggacaggaaaugaaacauuaggagcucugcuuggaaaacaguucacuacuuagggauuuuuguuuccuaaaacuuuuauuuugaggagcaguaguuuucuauguuuuaaugacagaacuuggcuaauggaauucacagagguguugcagcguaucacuguuaugauccuguguuuagauuauccacucaugcuucuccuauuguacugcagguguaccuuaaaacuguucccaguguacuugaacaguugcauuuauaaggggggaaaugugguuuaauggugccugauaucucaaagucuuuuguacauaacauauauauauauauacauauauauaaauauaaauauaaauauaucucauugcagccagugauuuagauuuacaguuuacucugggguuauuucucugucuagagcauuguuguccuucacugcaguccaguugggauuauuccaaaaguuuuuugagucuugagcuugggcuguggcccugcugugaucauaccuugagcacgacgaagcaaccuuguuucugaggaagcuugaguucugacucacugaaaugcguguuggguugaagauaucuuuuuucuuuucugccucaccccuuugucuccaaccuccauuucuguucacuuuguggagagggcauuacuuguucguuauagacauggacguuaagagauauucaaaacucagaagcaucagcaauguuucucuuuucuuaguucauucugcagaauggaaacccaugccuauuagaaaugacaguacuuauuaauugagucccuaaggaauauucagcccacuacauagauagcuuuuuuuuuuuuuuuuuuaauaaggacaccucuuuccaaacagugccaucaaauauguucuuaucucagacuuacguuguuuuaaaaguuuggaaagauacacaucuuucauaccccccuuaggcagguuggcuuucauaucaccucagccaacuguggcucuuaauuuauugcauaaugauauucacauccccucaguugcagugaauugugagcaaaagaucuugaaagcaaaaagcacuaauuaguuuaaaaugucacuuuuuugguuuuuauuauacaaaaaccaugaaguacuuuuuuuauuugcuaaaucagauuguuccuuuuuagugacucauguuuaugaagagaguugaguuuaacaauccuagcuuuuaaaagaaacuauuuaauguaaaauauucuacaugucauucagauauuauguauaucuucuagccuuuauucuguacuuuuaauguacauauuucugucuugcgugauuuguauauuucacugguuuaaaaaacaaacaucgaaaggcuuaugccaaauggaagauagaauauaaaauaaaacguuacuuguauauugguaagugguuucaauuguccuucagauaauucauguggagauuuuuggagaaaccaugacggauaguuuaggaugacuacaugucaaaguaauaaaagaguggugaauuuuaccaaaaccaagcuauuuggaagcuucaaaagguuucuauauguaauggaacaaaaggggaauucucuuuuccuauauauguuccuuacaaaaaaaaaaaaaaaagaaaucaagcagauggcuuaaagcugguuauaggauugcucacauucuuuuagcauuaugcauguaacuuaauuguuuuagagcguguugcuguuguaacaucccagagaagaaugaaaaggcacaugcuuuuauccgugaccagauuuuuaguccaaaaaaauguauuuuuuuguguguuuaccacugcaacuauugcaccucucuauuugaauuuacuguggaccauguguggugucucuaugcccuuugaaagcaguuuuuauaaaaagaaagcccgggucugcagagaaugaaaacugguuggaaacuaaagguucauuguguuaagugcaauuaauacaaguuauugugcuuuucaaaaauguacacggaaaucuggacagugcuccacagauugauacauuagccuuugcuuuuucucuuuccggauaaccuuguaacauauugaaaccuuuuaaggaugccaagaaugcauuauuccacaaaaaaacagcagaccaacauauagaguguuuaaaauagcauuucugggcaaauucaaacucuugugguucuaggacucacaucuguuucaguuuuuccucaguuguauauugacc

SEQ ID NO: 17481 - RNA, 21532 nt, Homo sapiens
ggucaauauacaacugaggaaaaacugaaacagaugugaguccuagaaccacaagaguuugaauuugcccagaaaugcuauuuuaaacacucuauauguuggucugcuguuuuuuuguggaauaaugcauucuuggcauccuuaaaagguuucaauauguuacaagguuauccggaaagagaaaaagcaaaggcuaauguaucaaucuguggagcacuguccagauuuccguguacauuuuugaaaagcacaauaacuuguauuaauugcacuuaacacaaugaaccuuuaguuuccaaccaguuuucauucucugcagacccgggcuuucuuuuuauaaaaacugcuuucaaagggcauagagacaccacacaugguccacaguaaauucaaauagagaggugcaauaguugcagugguaaacacacaaaaaaauacauuuuuuuggacuaaaaaucuggucacggauaaaagcaugugccuuuucauucuucucugggauguuacaacagcaacacgcucuaaaacaauuaaguuacaugcauaaugcuaaaagaaugugagcaauccuauaaccagcuuuaagccaucugcuugauuucuuuuuuuuuuuuuuuuguaaggaacauauauaggaaaagagaauuccccuuuuguuccauuacauauagaaaccuuuugaagcuuccaaauagcuugguuuugguaaaauucaccacucuuuuauuacuuugacauguagucauccuaaacuauccgucaugguuucuccaaaaaucuccacaugaauuaucugaaggacaauugaaaccacuuaccaauauacaaguaacguuuuauuuuauauucuaucuuccauuuggcauaagccuuucgauguuuguuuuuuaaaccagugaaauauacaaaucacgcaagacagaaauauguacauuaaaaguacagaauaaaggcuagaagauauacauaauaucugaaugacauguagaauauuuuacauuaaauaguuucuuuuaaaagcuaggauuguuaaacucaacucucuucauaaacaugagucacuaaaaaggaacaaucugauuuagcaaauaaaaaaaguacuucaugguuuuuguauaauaaaaaccaaaaaagugacauuuuaaacuaauuagugcuuuuugcuuucaagaucuuuugcucacaauucacugcaacugaggggaugugaauaucauuaugcaauaaauuaagagccacaguuggcugaggugauaugaaagccaaccugccuaagggggguaugaaagauguguaucuuuccaaacuuuuaaaacaacguaagucugagauaagaacauauuugauggcacuguuuggaaagagguguccuuauuaaaaaaaaaaaaaaaaaagcuaucuauguagugggcugaauauuccuuagggacucaauuaauaaguacugucauuucuaauaggcauggguuuccauucugcagaaugaacuaagaaaagagaaacauugcugaugcuucugaguuuugaauaucucuuaacguccaugucuauaacgaacaaguaaugcccucuccacaaagugaacagaaauggagguuggagacaaaggggugaggcagaaaagaaaaaagauaucuucaacccaacacgcauuucagugagucagaacucaagcuuccucagaaacaagguugcuucgucgugcucaagguaugaucacagcagggccacagcccaagcucaagacucaaaaaacuuuuggaauaaucccaacuggacugcagugaaggacaacaaugcucuagacagagaaauaaccccagaguaaacuguaaaucuaaaucacuggcugcaaugagauauauuuauauuuauauuuauauauauguauauauauauauauguuauguacaaaagacuuugagauaucaggcaccauuaaaccacauuuccccccuuauaaaugcaacuguucaaguacacugggaacaguuuuaagguacaccugcaguacaauaggagaagcaugaguggauaaucuaaacacaggaucauaacagugauacgcugcaacaccucugugaauuccauuagccaaguucugucauuaaaacauagaaaacuacugcuccucaaaauaaaaguuuuaggaaacaaaaaucccuaaguagugaacuguuuuccaagcagagcuccuaauguuucauuuccuguccuacaaccaaaggggacccaguggagcugccguuuggaaacguggccagcaucacaucacaacacggaggaaucagagagggcucagugugaagaggaagguggauuucacuguuuuuccucaaauagguugucugcucuggugcagugcugaauggcacgcaauuaccuuguugcuugggcugagaaccugugaaugggauucauguauuauuuuuacuauuauaauuuacuaaccaaguaucccuaagaaaauaacaggauauuuucauuuauguucaagccaaccuccccaaacaaaaaaaucuaguguccagaaucauuuggggaucuuuuuacaaucuggaauccuaauucuuauaacagcuucaaaucaacaucuugacauaagaguuuuaaauuuuuuaauuucuggggacuuuccucccugcugcccaaauuucaugagcuauuagaauaugacggucugucugcaaauggaauauuugaggagaaugagacaugugauauaccuuuuuuccuugagaauaugacauucuuguccuuccauuguaaauuaucauuuugaaaaugcagaaagcaagcuagcagcccugcuggggaagggagguuuguuuuguuuuguuuuguuuucccaagaccuuuuaucuugcaccagagaauuuacaacucauuuuggucauagaagcugaauugugaauagauuucuaccacccucuuucaacuggaaccuacccaucccauaugauggcauauuugagaaaaagaaaauguauuucuuuaccuucuggauguguaccauguccacacagcuaaguuaggguauguguuauuuccccuucauucuauacuaucaaaagaagucuuguauuaccuuuucaaagauccacaaaauaaauauuuuucuugguucccacccccauuauugccaaauaauaauuauaauauuaauaauaaaccacagaguucuuagaugguaacaggaaaaaaaaugguuccgguugcaauucuuggggaaaaauaaaaaauauuucuaaaaaccaaaaaccagaaucacuguacuuucuauaaauaagcggguccugggagcggggcugagugcuggguggcacccacuacuugcacacaaacugguccacgaucuccgugcacuucuugcacuugacguagcagcaccaguggaacuugcaguggcagcgcuccgucugcacggucuugaacuggucguagccacggccgcagcacaugagcucgcagccauccaugcccuccgacgucuuguugcacaggcggcccugcgugcccagcgagccggugcucucauugcgcacgcaguagucagggcuggggucgauguagaccaggucuuguguggugggcgaguugaagcggcuguugaccuguaccaacuugccccggcuguugagccgcauggccgccgcgcugucguacuucuccuucagggcaucacccaccuugcggaagucugccagcugcagccagcaugucuucaggcuacaugagccggacaccccauggcacuugcaggccacaucagccagguuguacaccgucugcagggaaaugggggcaaucaauacacacauucauggaggagccagaugcaggcuauaggaacaaaguucuccucgaccuucuccauggagcuauguuccccagcugaauuaaggacuguauuauauuuccuucauuaccagaagucuuauguugccuucuuuaaaaauucuuccaaauaaauauguucuuaaccacucauuauuauaucauuaucaacaacaacugugguuuuuuaauaggaacaggaaaaaaaaauuguuccagcuguauuuuuuucagagaaagagcagcagcaacauguggacacucaucccagagguuguucacaaugcauuaccugaauuaaucccccguaccagcuaggugagaagugcuaguaucaucccauuucacagagaaggaaagugagacccagagagaugagccacucacccaacucccggggaguaaaggugccaggauuugaacccaggcagcuggacuccaagcccgugcuuagugacuugcccauggauauccagccgguaagugcagaauugggaagaguccagccccagugggaucaggguucaaaucuuaacccauuacuacuauuauugcugugcaccaggcacuauaaguguccuuacacucaugaucucauuuaaccaucccagcaacauuaugacaugggcuggauuggaugauggcacagugaugcugaguggccugcacaggucacacagcuaaaguguggggggacugcgccuggaacucagguauccucacuccuguuucccacacagucccuaccccaucuacuaccccgcuaggcuaagagcacccacccuggagccaagcaacauagauuguguuccugacucuacccuugaauucagacaacaggcugcaccuuuccgggccucuguuuucuaucugcgaaggcagcagugguggcaccaaccuccaagugcuguuauaaggauaaaauuaggggagauguggaaagugcuuggcacuuaagacacaguaaaucuggucuuucuuuaggguaacaacggacacacucaggaaaucuggucuuucuccagagugacgaggacacggcaucugggcccuugcccagucaccuugggccucccaguagcagugcccacgggucuggcccuauaacacugugcccagcagucugggagguggugguugccuauuuauagacucugcugcccacaguuccuugugccagugacccuccagaguccacguggugugagugugcuggagaagaccugucaggaaccuggaagcugggggugcaucagaaggccucuuccgcagagaacagccacccucuuccuccagggauucacaggggcucuuuuaaagggggccaaaguguacucucuuggcauaaagaguuucaggcacucagcuagucugaggaaggguuuugcaaauguauuuaaccuuugcuccccacugaggaaaauuaaaaagcuaacaccccauggaaauucuaauaugauuuucuggcacagugcccaaauuuccauccccuagccccaccaucccagagcaaaaaaaacugucuucuucguaaccucacucaccaaaauccaaacucagcucacuacuccaaugaucaaauuuaccccaaaaaaacucgcuacuaaaaaaaugcagaaguguaacauuauaggugcuuuucaaacuuccccaauccucucuugccacuuggaaaucccuugacccgcucuucuugguugccaagccucugaugauuucuggacaugagagaaggcuaagaaagucccaaagauggaugagaauaucaaauaugggcauaccccuggauaggggccuuuaagagucagacacaucucucuuuuugaggcauuucugaucugaggcacugggcaugucauauauagagaucccagcgauacaucccugaagagggugauagcaagguuuuaugggcuuccagagagaauggggcugaccccaccccccccaaauuuucauguggcucuggguccaccacagaagaggcaucccacacugcagacaccauggcagugagaggccugagaaaggagaggccacacucugucuguggcaauuauuugaccccucauggcaguacaggcaaaauucuguagaguuuaguccuuccccggaacacccaaauguuuaacaacaaauuugagaagauaagcuagcuggaauuaucuacacgaucuuugacuucucuauguccuuugccuauaauguuuuagaaguuaucaucuaucaagcacuuacuacuggcggacacuaaacuaagaccuuuaauuaaaccaaaugaaauuguuauuuuguaauaaaaaagagucaaguguucacaauuucacaugguucaaccuacuagaugaucucacugaggccucacaauaaccucagguaauuguaauugccauggccauuuaacagauguggaaaugggaaaacugaggcucagaaaaagcaaagaacagacaacacugcauuuuaacccagauuucucuaauucccgaacugcuagcucuucaucucuuagcugugaugcaugaauucaauaaaaacguaccuaggcuuauauuuccauucuuuaauuuucuuccauggucaugaagugguuuucugggccucaguuuccuagucuuucaaaugaguguggggccagagucuucuaaggcucuguccaguccucuacaguuuacucugugauuaacuuccuucucccucaccccaaaauacagaagagugaaaucucugaccagaaaguuccuggcaccuaccuuggguucugugaaaaaauaauggcccugguuuucaaugcugccaaaguuaagaaaaguuuucaccccuucauuuuaaagcagccauaaagugccauguguuuaaccgcaggaaaaaaagggucuuuuuaacuauugagaaguagcuuuucauauccccaccaggggaaggaaagagcgggaaccaggagacucgugaggacugcaaagaugguccucccuggguacuucugcugcucucuucucuccagagcuacuuugugauuggccugauggucagaccuauaaaaucccacacugcuaaaaaugcuguccuuuuccuagaaaagcccuuuuuuaaaaaaacccuccauccaucaggccugcuaccuaaugacauaaagagaggcagggagaaagaaaggagggaaagagccucaaagcuggggugagggcuuucccaucugggcaccuacgaagacagaaaaaucccugucccaaacugaaagccaaccacagacaucguccaggcaggagggagaaaguuauucccauuuuuauuucugugcuccaguagccaaagguaccagggacuaacuaagaaggcaaggaaaggucuuuuucaggcaacugcugguucaccuuggcugggggcgaaagggaggaugauccgcccaggaggcccuucugggaugugcaggggcaacuauggagacagauggaggaaagagagguagacaaagggggagaagagagagaccgggaaggaggaaaggaagggaagagggagaaagaaagugagacgggaacaggaugaggaggaaagagacaggaaagacagagaaagauagggagagacagaaagagaagcagagagauagagacaggaccauauagcaaaggaguggcagaggagaggacggagcuacagggagagacccgaggaggcuggagggcaaggugagaagacagagaugcggggcgggggcgagacgcggcacucacccugcggccggccucguuguugugcagguucaugaggaugcgagcacucucguaggagcccuuggcguggaugcgcucccgcucgcgggcguccacgaacuccuuggcaaagcgguagccauagucgauguugucgccgcagccgccccagagccagucccgcggcagguccuuggggcgcgcggcgcggcugcagccgcagguggacagcucgcccucgcggcacgcccggcucauggcguucaccaccccugcugcgcucaccgcguaugugaaggccgucucgcggcugccugugggugaggacaagggaucacuggccgccugccucacgcgcugggccgggaugcugccgggggugggggugggggcaagguagggaaugguggggagguaggagguggggggcaagguagagauggaggggagguaggaggugggguuggggcgagguagggaggggggagguaggaggugggggagguuggagguuggggggaaguaggagguggggaagcaagaauaguggggagguagaagguggggggcagguagggcuggggggagguugggguagaggguagggaguaggagauggggggguaggggguaggggaucaauaagguaaaagcucgggcugccccauccuuaacacgcaccaggcccugggcccagcuugaggggaagccaagcaagaucccccaaaacacacagaagcaacaauuaacaaaggaguagcagauccccaguaucucugcucagccauuucagagcugcaggccagauucuaagcagugcuggauugauuuucucugcaacucuuuugaaaauagucaaaacuugcuauuugcaaaaaugcacaugaaagaagucauugaaggaacacucagaauauggguagacuuccuuacacuuauuuuaauauuaaguauuauuuucauuugaguuacauauaaggcaggauuacagaauuugcuaggccuugaaucuaagggagacacugccagcggccacacuaguuucugccacacucauuuuggccuuguguccccuccuccucuggcaguuguaaccucuccucccucuuccuucaugcagcagaaaguauuucucaggacaagucucuuuacuuucccagaggacaauucuaaaucagcucauagagaguuauaaaugaagcuugcuauucuuaaaucccaggcucauuggccugauacuucucauucaagaaugagugucugcuuuuaaaacagccuguuguucuucaaugccacuucugcagacacccccugcccacucccccacugccuuugccacaaaguguuagaaugacagcaagaaggaaaaaagcacaaccuauggggaaaagagggagggagaaguuuucuucuucccaaaacuaguaaagaauaucuccccauauaauaguuacagggacccuauuuguaaggagaaaacuggaggcuaucauagaguacccuaaacuucgcuuguacauggagacauuucugcauguaacaagagcuaguuaauaaaaguacuguaaucugagagagaaaggguuaucauccagccagcugaagcgugggguaggggugggauuggggggcaggcucacuuuccucaauugcaaaauaaggguacugaaauacaugcaaggaaaggggccucuucuggugcugaaauucauguaccgcaaucaguuuauccuauacuuacuuugagagcuugcuaacaaucuuuuuucugagggggaagugaggagcacaagaaaagcugacaacaggacucagucugaacgagaagggucauucugcaggaggacagcgaugccaguuuaagcauccagcaggccaccucauucuuggucuucugcuccaugccagucacagccauuugugaauggugaugguucugauuuaccauauauccucccccucccauauuuucaaaaugaaugacuugaaggugugugcuggugguuggcaggaggaucuagaaaguuccugugaugcguuacaccuaucuagcgggauuagagaggcagagcacaucaggggaauggaaaggaaugaggacaauauacagcuucuagggaguaauuugauaguacagaaaaugcuguggcccuggaugggggauuuguagaacaaaguagcuagaggaagaggagaugaagaggagaugaaaugauccucuggggauagaggaaaauaagacacuguccuuugaguauacagagcauaagaaggcuuuauacaaaacacaaacaaugcuucuuuuuucauaagucuaucuugagcauuuccuuuuaugccgcagaauacaaaccugggagaucccucuaagcuaauuggucacugcaggguaaacgucaguuugaaaaguauucuuuggcuaauugccugaggauacagucauccugguuggaauacugcugauucaguuagguuucccuuccugugaaacccacaucuacuccgauccucacaccccuuacaaauggugccuuccuuacauaucuuuucacagcauggaaacaaagaagagacagauggggacaaaagcuggaaggaaaggguagcaugaugaaaaaugagaaacucuccaaaaugaagagugggcccuucaugaaguaauugugcauggugccuccaaggcaacuggcaucuuagaaaaaugaguugaggagggggucagagguggcggccugaauuucucagacacuggccccaucacagggucaaauucucacaaagaagaauuauucucaauguccuuggugugcugagggcuuuggggugggcacacacacacacaccuuuuggcaucaaagguauuuuaaauuuucccuuagcucauucucuucaaauacacucuuaaguggaaaagugaaagcaaagaaauuuuccaacuauuggaauuggauccauguuccucuuucauaaaaaucuauuguuuucucuucucuccugucucuuuuuuaauuaaguaaaaaacagaaggccccaucagugucccaccacaagccacccagcagcagcuuucagcucugagacgcuaggcacuugggggaccuuuugcaggggaggaugccauaugugcucucaucuucccaggacaucagcugacuugaugauaguaucuaggagggcugucucagaggguguggagagguaccacucccauccacuucccaucgacccagacaguagugccgugcagcugaagaccagagagcauacuuuccagggacaauuaaauacaggcuuuuguaccaaggguucugcuuguucccugaggaagcaggcucuuugaaucuuggaccgcauuuaaaauaaaucuccagcagaacucaaauucacuuagcaaaugauagcuuauucugaacauuuuggcccaaaacaggcuacguaugaaaacgagaggaggaucuuaaaucaaagcuguguucaagugacuacacagauaaacaguuccgauugcuguuuuccuuccugguuaccaucagagguguaugauuuuugcuaacucauauacaugugaaaaaguagucccauagguugagaggaaggcaguuuaggaggaacauagaagaagggggaaaaguuaccauccucauagaauuuuucaaaaguauuuaaguucccuuacaauaucaacacacgggagaauaaaucuaccacacucccaguuaacuacauaagacagcccacagucagggaaaacuccuguguuccugaagcuuaacucuuagauucagaucccaguauauacauuagcacauuuuaaucauuaacagaaaggacaaagccccaugaaacuuugcaggcugaggcuacaggccauucucccauucagucagaggaacagcuuccagucuuguauuauuuuaguuuauaaaaccacuuggcucaaacauccccugacaacucuuuuuuguucucaaugaauguaauuuucgggguuuuuuuuuuaauaaaaaaugcauuuuauccaucugugauggacauuaagccaacuuuucucuucagucaguauagacaguuaauugccuugauaaauugcuucuuacuuugggagucacugcagucauauuaauuauaagggcuuuuuugcauaaaaguagagaaaccuaaaauauucacacuagaaaacauacauuggaccacaucugucaaauaguauccuauacuauuuaaacaaaagcagaggcaaacaaacagauuuuuuaaaaucuuugccuuuagcccauuugaaaugcuaucucuuugaauggggaaguaagacauucaacaacguauuuaaaaugaagaaucggacugugagcaauacucuuaauuuuuuuuucaaguuccuagguugacaucccaagcaugugcuuuuauuauaucaauugcugacaucacaaacauaaauuggaucacuuuuaauuaaaauucuuucugggacuaaaaauaaagcuuuuaacgucuauaucuuuauagccucaggaaauaguucuauuaggaaaauuaaaacuuuguucacuuucaauauauccaggauucuaaaagacggcaacuuuuaguucgaugcucgggccguuucaauuguggcuuaaaaaacuaacaggcaagagaguuucgacguuuaaaagcauauacaugacuugcuucccccaccuacucuuaagaaaccaaaauaaguguucugcuucuauuuuaaacaaaaugcuuuauagaaaaauuaaguguuugcaaaaaugaaggugucugugauacuugccuccugauuugauuaaaauccaaaacuuaucaucagguguagggacaggaauuaacaucauuugcuauaaugacaaaaaugcccaagccaccacccgagcuggaaggcauccuccuucaugcuuucuaucaagcaugaaguaaaugcuaaggauuucuucuaggaaaaaaaguuaauguuuuaaaaaaauauuuuaaauguuuuccuaccuaucugcaucacccugccaaaaacagagguguuauccacagugcugcaguuccaccuucgaugucggaauugauacuggcauucuuugaugccugucuucgcgccuucuccgauguacugcaugugguccugauacaaguggcacaguuucuucuguccuugagaaaguccugccaguuggcugcagagaggcugugcuccuauaauauauacuucugacaucugaacaggguuauucauaccuagcgaccugcaagggggggagaugugcauucaagauuuacgugaaaucucgaggugggcccccugaaagcaugucagcaauacauaguuuuaagcacacagaugcuuuuuucucuccugcuuguccucaugacaaaguaugagaagggcuucauaaaacuccucuguuuaaacugcacucagaaaacggagguauugugcaguccccauccugccaucuggcuccucaguuaguauuuucacucccuuccuagccccugucaccauauaccugaaccaguauuuccaaaauccacucagaaaaggaggaaacagcaguuugagggacaggccucugacauuagagaaagugacccacuuugccccacaaauuggaccaaucugccuugaaaacuuaugaaugcugaaaguagacacaauuagauacggguaggagauagcaguuccuuuugacugauggaagaacagagggacaaguauacagacuggagaaaauucaccauguuucuugacauuuuaaaagggcuccuuaugugauugugagggacccaagacaggguacccagugaacagaagucauguuugacagucagaaaaaugcuguucauuuacagggaaaaaaauacccagaaugccgucaaaaauaauccucuggauauauuacagucuaucuacaaggccccuacccagaaagaaacccccacuuggggacauuugacuacuucaaguuaaccuccuuuugauuacauuucaagccccaauacuucugcacuuggaguguagcuguccuccuagaacucugccuaauucaaacucuguagguuaauaauaaucucgaguaacagaagauaaaggcugaaacucacuuuuacuaccuagagguggcaaaaaguaaauuuuguagauaggcuuacaauuacuagcaaagugaauuucuguucuuuuuuauugcaugauguacuacaagcacacgucugaacaagggcuucauagaaacaggccuagauuuauaguuucccauucccuaggagcugaagauaagcuuuacaauauuaacaaguuaaaagaaaauucugauuuaaaacuauauauaaguaaaauguauacauaugucuugcaauaaauacacccacacucacuauccagcauuaaauauugccgcaucauacaaacaaaucuuaaaaaaagaaaaagaagaggaagaacacgcacauagaaugaacuuaccaccaagaauuggcuucaauuacaaccugggcgaaggagaaaaauauggccaaagccacuaggaagaacuuggaagacauugcacuuccagccauccccaaagcaacuccugggcuuaauauuccaauggacuucuggagagggaagaaaggagcagauguuuauugccucucagauaauuuucaagcauacaaguuuaaacaacggaagcauccggggucucuuaaguuuacuguugauugacugcgcuucuccuccgugaguuuuuugauggcaagauauaggcaguuucuuuuuccaaauuaauccacccacgcaaccucaccaggaaaucugauuucgcugggauccugugcgcggggcacgccagcgauuacaaacgugucucaauucuguugagucaaagcccuggugccaggcgcugccuccuuccugcucgcucgagucccgcacccccuggccccccucuaguuggugcugugcucagucccuccuggguaauucacucaggaacccgcugcggccacccuccguccucuccccaaccugggccgagcaacaaguggagccagaauuaauuccaugggcgagaggagcacggaggcgaguggagcgcgcugccgccagaggcugccaaggaggcgggguggccagcgcgggggguggaggaugggggcaggacgcgggagggaagggcaggggguggggggcgaggccccggggaccagcgcgcgagagugcccagcugggaaaugcagcuccgaauuaacaucguauguuucauaaucaguuuacgagccgauguggggaaagccacuuccagauggggaagagcagcccggauuuccuuaaggacguucuucagccagacuagggaggggagaaggagaugggggcccuaggggauaauggagagagaggucgggucucccaaccaaggaaacuggaaaagagugccacccucgcccgcgucgccuguggccucuuccacggacugagagaagggauggaacccuagaggaaagaagggagucugggucucgcuuccccggggagaagaucccuucccugcccuccccacagcuuucucccaaauucugauuuuucacucucccucccaccccacaccuggcagcugccagggagggaggagaugggaggcccagagagacuccaguuucccuugguccugaucugggguugugggccacuuugccaucgcggcacugcgagccugucguuggaacucugccacccugccuccagucuagccucuccagcccaacucagacuugguucggucagugccgaaaggugggggugcggggcgaggccagagcccuugcagaugaguccagacggggccagaggcgcuggcuuccgagccgcagcugggcgcaucgauuccagggcaaagaggcccccagcggcgaagguucccuuccugaagaauuucagggguaggaguuggccuuggaagcuuccgcugccguuccuccccacuggugacuucuccaccuguaggcggcggcggagcgaguagguggcgggugcgggugggaggagcggguuuuaaaaauccccuuacacguaagucuaacccugccgcacugcaucgcccauagccccugaaggagccccuuccacagaaaagaaaagaaaggugagccucuuuaaggcgguggaagagccuggcuuggaaccugugccguaaaaggggcagaggggaccuaggcagcccugguaaagcuauggggcucaggggcgugccaagguuuuucuccgugagccgccccuuuggccuggacgcuucggggcuucucaaagaggaaaugcuuaugugguccccagcgccugcuaagcagggcuccacacccaaggcccaguuguccccaaaacgcugcaaagcuggggggcgcauccuggagaauggaaaucugggguuuccccagcuaggagagagaaggcuccggcuaucuccccacccccgcccuaagugucaaauuuccuccaggggagggagugggcugcaaagucugcuucucgcgcagcccaggcugcaaagucaacucuccccaagggcagccgaugccgcgugcacacacaucauacacauucacacucgugcacauuuacacacucacacgcgugcauagacacacacgcugcgacauguuuccgagucagcggcccagauuggugcuggccgcgugcacuuuccaagcuucgcggcgagcggggcgcguggggcggggcucaagcagcagagaaauugauaacagauucggcggauuacagcggaucucuuuguuagagccgaagccacacaaaccgaacccacucccagcccgaagcccccagggagaguccaccaguucccagagcccaggccaacugagagcgggcccauccggucaccaagacuugggucucccuggcuccaggguagagguaggcagagggugucccaaagggggaucggaaaggagagccucacgagucgcaucuccacuuaaccccgccgcuugcccggaaacaccuuggcccucuucccucuucaaucccagugcaaccgagaaaaggccccacaaguuugagacacucaaagaacucacagcgaacucacacauacaucggcucuguaggguaaaacauccccgccuguuuaccaagagaucagauccgaaaagacaguaugaaaugagaccucuggggagacugucaaccccagggguaaaacaaaaauucugaucagaaacugaguuucccaaagaaggggcuaaauguuuuccaacacuuucggggcucagggaagaugacucuguaaggacacugagaaucuuccucgcgugccacggggaggaggacugggggcguuugaggggcucagcgcaccagaggagugagguggaggagggcguucccgcguccuccucuucaauccagagcagcucaacgacguggcucccuuucuauguaucccucaaagccuucgcgucggauuaaagguguucuugauccuucuuuaccaaccacggugcgggccaggcgugaugagggaugagggagaggaaaccucaguagcaaaauuguucagaggacguucggagggcgcggggagcagccggaugcacaccuaaagucucgcaacacccaacuccuccuccgcaggcagucccuuaagagaauagauaaaaaggccaagcaaagauccucuccccucggccccggggcacugccacauucagucuaggcauccccuucugcuagacucucuacguuuaggccccaaguuucugggagugaaacgaugagggacgccaaauaggcggaagaagcccauuugacccaggcuuauggcagcgaaggggaggaugggaaacuccaaaaagaaucuccacucuugguggaaaaagaaagcuguuuuccccacucugaucucucccuaaagcaaggagagagaugcagaaacuagcaggagagcacucaguugcagccaaaaacuugggacguccugcccuggagaaugcggggagcggcgcgaggagcuaaagaaugggccggcccaggcggguaggagguccgcuuuaggggagcagacaaaggagccacuacucccuaagccucacgccugggcgcaaggguuguguccacagcaauauguguguuggcgcgcgcggagcgggguaggggaggagggaauugccagauagagaaggcggagguuacaccuugagccagaaucaguaugacaaaagagagccgcccaggccucaacacugacagcagguuccagguucggguauagagaggccccaggggaagaacggucuggccugguucuccucuguuuccugcccccucguccaucccuuagacugggcuuuccaggccccaggauacacacacacacacacacacacacacacacacacacacacacacacaccacucacaccuucucacauaggaugucuagcccucucggcagaggaucaacuuuguccagagguggagcagaguccuuggacagaggaagaaaaugaaaugauaguccaacccccacucuuuaaagguaguuucucucccacuuuuuaauagacgauuaaagugaggcgaaaagcgggaaagcaacacuuguucucgaucauagagaguugggaggcagcugaggccagacccgaggccuccuagggcgacacucuccuucccaagcccagaagaagagguaccaacccuguguccagcuggccgagucccauuugcugggcuggacccguggccccuuccguauugcagcggccggcggcgcagcgaaacugguccucugggggccuccgagggccccugcugggagaguggggucugguggucgggagggaugaagggagcaggggugggagggagaggggagcagcugcccgcccgcccgccccaaggaaccgaggcucgcaggaguccuaccucaaggcggccaacagggggcagccggcaccgcaccgcggggaagaaaaggccgcggggauggcuccgaguucugcgcgcauagugcuaaccccuugagcaccggagcgcacgggggaggggaggagaagacaggggacucuugggccgggccuccuggggagggucuuccguugagagggucgggggguggaggagacgaaggcuacuacguccuggacccgagaacaacuccccuacacacacaaacacacacgcacacacacgcagccaaggauccacacacucggacacacacacauuugucggcccgcgguucgcugcgcacucuccgcauugcccccucgaaacuccccuggcagagucugucuagaaacuaaaucuggcugguucggcagugaaugugcgaagguggcuggggggagggcaggggcugaggaggugcgaccucaccgcaaggcccaaguuacuuccaaacagcgaauuacccauuuaaagagagaagagagaaaagagaggcgagagaggagaaggggccucgauaccagacagggauuagaaagucaaacagggccguggggucuccagacuugaaguuuuuuguuguuguuuuuuuuaacuuuuuggggggaagagggguuauuugcuuccaggaaacaucuuaauuucaauucuaaccuuauuuucuaagaaacuuaaaaugggaaagaccagaaaaauggaaauaggaaucgaagcuuggaggacagauaagaaaaauuguuuagaaaauaaaaacuuauguugcaggaagaaacguuaacuuuucguaaaagugaacucucagugacccucggagugugugauucggcuuuaacauacaacugacaauuaaaacaaacaagaguucgcaaacuggcccccgccugcucucccaaagcggaggcccaaguguuuucuaaaggacaaggcggacuccgcucagggggccggggagcgcugucccggaguacgggauuacagccacuaccaccacaacuccccgcccccaccacugcugcaaagugccugagcucacccaguggcggcuaauaaugcuaauaacgcgaccccgcuccccgcgccggggugcgcgcuggccccccgccaggcacucuuaaaggcaaaggggccugaagcgcucgaguuacucggccaaggcaagccuacaaucuggccuccgucggugcgggggggugucggggaagguguacgccgcucuggaguaguuggccccuaguuccucugcggguucucucaaccaaggagucccuuuccccaucccgagccccggccacacaccgucccggugcccgcgcagugggcgcuugguaaauauuuguugaauugaaucauuauccuguuacugaaauauacauaguaaauuacacucgauguucucagagcaaaaggaaagucgucagugaaccgcacucaguuugucuacuaucgcucuuccccacuuuuucucaaaaaucaaaauuguuugcagaacggguggugcgaccagaagugaucuccugggacacugaggcagugcgcccggcguggagggcgaagggguagggguuccugccagcgacgcuggaguuccagcuucuucaggcgguuggggaaauggagggauaggaagaggcgaagggaacucaguuaacuuccaacaggggguggggggaaguaaagaaaaaaaguggcagcgcacugaacaccuaccuucauggcgagggggagggggcgcggggaggaagucgccacccgagcgagcgcagccgaggaauccgagcggagcgaccggguuaagccuggggggacggucaggagcagggcugcggaguccuccggcgcgcguccggcgggcgcagugaaccggagcugaagcgggcacuggcgcccgggccuggacucccgaguuggggcagagcugggaugcgcccaggaauggagggggcgcggacgcgcgcgagccggcagcaagggcagggccuggucggggcgcaacuagggagccgccgguccggcgagggcgcgcaggcaacuguuccacggagaggcgcuccguuuccaacguccaucagcgacggcgguaauuagggcuuuccaaccccaaaugugggcgugauugugcaaaagaccuuacgacaaauaauaauaaaaagaaauucuucacaagagggugaaaaaaauguaccacuacucaacuguggcccggggcgggggaaggggggcgaucugugcgcccaggugcccccaguucauucacaccacagauucugcaaacucuuggcggcucacgccuccugaucuccagcuccuccucucugggucuguagccgaaacgucugcuuccagacgcugauccugcagccgcgaguuaguguggacgucucuguacacacacagacacacaccccaacacacacacccccgcugcagcuuuggggccacagaacaaucaggcgcgcauggcuuuuucuccgggagaugccgcugaaaacgcacaagucgccaucugagcugcaagagucagccccaaauuguguccuuucauuuuaggguucggcaaaaacggggagcaaaauaggugaaagucgccccggaacuuauugcugugcggugagcuggaggggugcgacuaacccaggggagacgcgggcuccccccccccaccacguaucccguucuuucucucuucggguugaucucucuuuuccccguuuuuccagggcgaagggcgaagagcagcgagugcaccgcgggcgcgaggcuggggaagggcgagagcucggagcuccgcggcggcgacucagcuccggcgguccauggccggcgaagcugcccaccuccucguuuggcgcccggguccgaggggcgggagagcgggccggcgggaggcgggcggucccgggcacaacggcggcggcggaagggcucgcugggcagcugccgcacggaccccggcucugggcggcggaggcggcuccguggagcucgcagcagauuuccacgcgauccugugccccgcaaacag

SEQ ID NO: 17482 - RNA, 3516 nt, Homo sapiens
uaauuccaugggcgagaggagcacggaggcgaguggagcgcgcugccgccagaggcugccaaggaggcgggguggccagcgcgggggguggaggaugggggcaggacgcgggagggaagggcaggggguggggggcgaggccccggggaccagcgcgcgagagugcccagcugggaaaugcagcuccgaauuaacaucguauguuucauaaucaguuuacgagccgauguggggaaagccacuuccagauggggaagagcagcccggauuuccuuaaggacguucuucagccagacuagggaggggagaaggagaugggggcccuaggggauaauggagagagaggucgggucucccaaccaaggaaacuggaaaagagugccacccucgcccgcgucgccuguggccucuuccacggacugagagaagggauggaacccuagaggaaagaagggagucugggucucgcuuccccggggagaagaucccuucccugcccuccccacagcuuucucccaaauucugauuuuucacucucccucccaccccacaccuggcagcugccagggagggaggagaugggaggcccagagagacuccaguuucccuugguccugaucugggguugugggccacuuugccaucgcggcacugcgagccugucguuggaacucugccacccugccuccagucuagccucuccagcccaacucagacuugguucggucagugccgaaaggugggggugcggggcgaggccagagcccuugcagaugaguccagacggggccagaggcgcuggcuuccgagccgcagcugggcgcaucgauuccagggcaaagaggcccccagcggcgaagguucccuuccugaagaauuucagggguaggaguuggccuuggaagcuuccgcugccguuccuccccacuggugacuucuccaccuguaggcggcggcggagcgaguagguggcgggugcgggugggaggagcggguuuuaaaaauccccuuacacguaagucuaacccugccgcacugcaucgcccauagccccugaaggagccccuuccacagaaaagaaaagaaaggugagccucuuuaaggcgguggaagagccuggcuuggaaccugugccguaaaaggggcagaggggaccuaggcagcccugguaaagcuauggggcucaggggcgugccaagguuuuucuccgugagccgccccuuuggccuggacgcuucggggcuucucaaagaggaaaugcuuaugugguccccagcgccugcuaagcagggcuccacacccaaggcccaguuguccccaaaacgcugcaaagcuggggggcgcauccuggagaauggaaaucugggguuuccccagcuaggagagagaaggcuccggcuaucuccccacccccgcccuaagugucaaauuuccuccaggggagggagugggcugcaaagucugcuucucgcgcagcccaggcugcaaagucaacucuccccaagggcagccgaugccgcgugcacacacaucauacacauucacacucgugcacauuuacacacucacacgcgugcauagacacacacgcugcgacauguuuccgagucagcggcccagauuggugcuggccgcgugcacuuuccaagcuucgcggcgagcggggcgcguggggcggggcucaagcagcagagaaauugauaacagauucggcggauuacagcggaucucuuuguuagagccgaagccacacaaaccgaacccacucccagcccgaagcccccagggagaguccaccaguucccagagcccaggccaacugagagcgggcccauccggucaccaagacuugggucucccuggcuccaggguagagguaggcagagggugucccaaagggggaucggaaaggagagccucacgagucgcaucuccacuuaaccccgccgcuugcccggaaacaccuuggcccucuucccucuucaaucccagugcaaccgagaaaaggccccacaaguuugagacacucaaagaacucacagcgaacucacacauacaucggcucuguaggguaaaacauccccgccuguuuaccaagagaucagauccgaaaagacaguaugaaaugagaccucuggggagacugucaaccccagggguaaaacaaaaauucugaucagaaacugaguuucccaaagaaggggcuaaauguuuuccaacacuuucggggcucagggaagaugacucuguaaggacacugagaaucuuccucgcgugccacggggaggaggacugggggcguuugaggggcucagcgcaccagaggagugagguggaggagggcguucccgcguccuccucuucaauccagagcagcucaacgacguggcucccuuucuauguaucccucaaagccuucgcgucggauuaaagguguucuugauccuucuuuaccaaccacggugcgggccaggcgugaugagggaugagggagaggaaaccucaguagcaaaauuguucagaggacguucggagggcgcggggagcagccggaugcacaccuaaagucucgcaacacccaacuccuccuccgcaggcagucccuuaagagaauagauaaaaaggccaagcaaagauccucuccccucggccccggggcacugccacauucagucuaggcauccccuucugcuagacucucuacguuuaggccccaaguuucugggagugaaacgaugagggacgccaaauaggcggaagaagcccauuugacccaggcuuauggcagcgaaggggaggaugggaaacuccaaaaagaaucuccacucuugguggaaaaagaaagcuguuuuccccacucugaucucucccuaaagcaaggagagagaugcagaaacuagcaggagagcacucaguugcagccaaaaacuugggacguccugcccuggagaaugcggggagcggcgcgaggagcuaaagaaugggccggcccaggcggguaggagguccgcuuuaggggagcagacaaaggagccacuacucccuaagccucacgccugggcgcaaggguuguguccacagcaauauguguguuggcgcgcgcggagcgggguaggggaggagggaauugccagauagagaaggcggagguuacaccuugagccagaaucaguaugacaaaagagagccgcccaggccucaacacugacagcagguuccagguucggguauagagaggccccaggggaagaacggucuggccugguucuccucuguuuccugcccccucguccaucccuuagacugggcuuuccaggccccaggauacacacacacacacacacacacacacacacacacacacacacacacaccacucacaccuucucacauaggaugucuagcccucucggcagaggaucaacuuuguccagagguggagcagaguccuuggacagaggaagaaaaugaaaugauaguccaacccccacucuuuaaagguaguuucucucccac

SEQ ID NO: 17483 - RNA, 1336 nt, Homo sapiens
ggugaagcguagaaugaguggcuggcauuugaaaaacaaguuagccaagaacaaagcaagcuuugcuucugcagggagaagugauagccccuuggcagucuuguuuggaaccugcaucuaugaaucuuuaagcaccuacugggaccagaauuuugccugcuuuauuucuaaucaucauagcaucccugcaaccuagagcguaucacuuccauuuaauagacaggaaaguuagucucagcgagacagcuaacuugcccacuguuguaggguuaauagcugguagaucaggguucugcucucagcucuuucugaaugcaaaacaaggcuguguuccccuugcugcuccacaauucacagcagaggugauugugugaccugggguguccuaccuagacugacauuugaauaagaaugggggaggcacacccaggcaucuacuuuuaaaaugcccucuuccuuccaagugaucuccgugugcagcugggguugguggagaaugacuucccugggagaugcaaacacacauccacgggccacacuuggcuaaaguuggggagguuuagucugagacaguucuaucuuccccacgcgggcuugggugcaguuccgcggcuuagguagggggagaaaccaagauguuuaugcuuaaaggaaauugguugaguuuuagcccaagaaacuuaggcaagaugugcuuucugucagggaaaugacuguucagggaagcucaauauccccggauccccacugucucucugguaacagcacacugauugugucuggggcagccagccuucucuccucccucacuaugagugcaccaacugcugcagacuuaggcgcauaacucaacccuggccagucagggcacaguagcuccuggcucugugauugguucaggaugcucacaaaacccacgccaagaagucagguccaauuugccaaucuggggaucaucgcuuggauuucaaaagagaugcgcuccacuccuccuucucucccucacuuccccuugcuagacuugggucugugaaagccccaagcugucaugagccaucuugguuacacaaggaaagagccugagaauggagccagcacagagaagucaagcugagagauagagagagaccaaguucugcauuguuuaagccccuggauccauugaagcuugcuuauaaacuucacaguuauggaagacaguaaauccuccuuuuugcuuaagaugguuaagguugcauuuuaugucacuuacaucugaaaagaguucuaacugaugcaagauaucagacaucacacucacgucaaucuaaauaaaggaaauaugcuucucugguag

SEQ ID NO: 17484 - RNA, 6964 nt, Homo sapiens
cgccuccgccuaaccagaagucgcagaugugacgaugcaaaaacgcccgucgggggcgcgucucuuucagcagccaaugggcucugcccaccuucguccucgucagcauuuugucuaaucgcggccugugacgcucgaagggcggggagcagagggagauacagaaaccgacaggggccaggcgcccgguggcuccgaagcggggaagugggacaagaugguuuacaucucgaacgguaaguugagagcgggcuguggcuucgaccggugacuuguaagaucggacuccagguuccuuucaucgucgcucgcugagucuugagcccggugcggcuuccccgggcuuagcgccccgcggccgggcggagcuggaccgaagucgccucggcuugcggcgcgucagccgauggucucugagccggcagucgggggccgaggucccgccggccucacguugaguacugggagcccugcaaccccgccuucgugcagcaagcgcuugauuguggauuugcgaggguggucuuuccucucucgggugucgguauccuuaaaacuaguaaggacaaugaugccgacgcuguacacguagcgcuugugcccuggacaguguuucaguuauuugcuuaucgucacauucaauccuguuuuacggguggaaacucugaggcucagauagauuaaauagcuugccugggcuauuuaagucacagagguaacuuaauggcugagucgggauucgaucacagguaggcugacgucagcguccuuguuaucuguuaugcugccucugucuacaacguguaaaaagaccgagccgaccuaggaugauaauuagaugaaagcuuugcauaggcuuuuuccccaggaaaggguagcuagucaaacauggaauuuuuugcucgaauuucaaggggcaugggaagaaguacuaucuuccccuaggagcaaguuaauuauuaccggaauggagaauccgagagacuuaauucugcgaacccacaaagaagaugaccggaaaggaaggacaugacugugucagaucagugcuagagcugccugcccaccuguuugacucaggugaaauucuuugguacagucuuaacaaggaguuguggaucauuggaacuaggucuugguucuauuugagucaucuguuuuucuccagagacgaguaagguagucagugaggagccuucuggcugacugcacuuuugcauuucuugacuuuuaaaaaucuccccuucucaucucccacuuaaaaaucuuugaaacaaguagauugauggacacuacagaaaagcaucaaaauuucaucuuaguuuugggcgcuuucagacuuuagucuguuuuauagccuguuuuauagccuuugugauauaagcuuaaggcuggaagcuucuguaugaauuauugaauaauuccuuguauuuguugugucuuacuguguucgcauuauuucauuugguccacauaaguagccgauuaggacucuuuaucguacuuuaaaaguugagaaacacaacugcauucaaacaccuuacuucucucuggggauauugguggaagggacauucugccuuaagaaagggaaaguggaaaagcaagauagaaucacagaggaagaaaugacagguuccaauuagauccaccuucuuaggacuguauuaucagcacuugacaaaaucuuucucuugcugucagaugacuuuuuuuuuuccaaaaaucuuaugugauggcuagcccuggaauacuuuuuguuggagaaagaaaaugucacaucagccaacgaagcagagcuaguaagaggcagagaacuaagccugucacccacccucuaaacuuuuguagccccuugcucucaguagcacagugagagcuuagauccaaguggguaucugaaauuaagcuggucaagaaaagaggaaaaguaaacccucauggaguggguagaggugagugggguuaacucuugggauaauggaaaggagagguaguugacaguuacucuuccccgaaaauauucugacaucuugauuugcaaggcugaaauauaguguaccaacuuauguuguagcuucuauuaaagugguuugaaaaauagauccaguuuugcuuaagauaaagcuagagucuauuagaauuaagaguaugcuguuauagaaaacaguaguuauuuuaaugaagaacaagccaaauucucuuuaguacuuagagcauacacacucuuuauaagaauuuuauaaaaauaacugauuccaaagacuuguaagaguaugaauacgcaaucuuuuuauacaggcaagagacuuugcaaaugaaaagaaauacucagcauguuuaggaauauggaaguggugugagcauuccuuuauauucacccgucccauuuguuucuucaaaguacuugaauaaagagguauuuuuacacccauguugauagcagcauuauucacaguagucagaagguggaagcaacucaaguguccaucaacagauaugaguggguaaacaaaauguaguauauacauacaaggauauauuauucaaccuucaggaaggagauuuugacacauacugcaacauggaugaacuuugaagacaugccaagugaaaagcuggucacuaaaggauagaaauuguauuauucuucuuuuaugagguuccuagaguagucaaauuugucgggacagaaaguagaauggugguugccaggggcugggcggagaagguaaugggaaucaggguuuaauggguauagaguuucagcuggagaagaugaaaaacuucuagagguggaugguggugaugguugugcaucaauguagaauguacuuaauaucacagaacuguacucuuuaaaaugguuaaccauugguaaccauuguuacauuuuuaaaccaugauaaauuuuuguuuuauauauauguguuuuuuuguuguuuuuuguuuuuuuuuucuugcucugucgcccaggcuggagugcaguggcgccaucugggcucacugcaaccucugcuuccuggguucaagcaauucuccugccucagccuccugaguagcugggacuacaggugugugccaccaugccuagcuaauuuuuuguaguuuuuaguagagacgggguuucaccguguuagccaggauggucucaaucuccugaccucaugauccgccugccucggccucccaaagugcugggauuacaggcaugagccaccgcgcccagccuuuguuauauauuuauagaaagagagaaaguaguugaauagaaugaagucacccaccaaguuuauaaaccaguaggcuuuugacauacuggaggaaugucccuagauaauggaacauuacuucuccgaaccuuuccuuggaaugaugcucacagauuucuucugguguuggccauuuggaauaaugggcaaguuaaaaccccaaucauuguuaccucaauaauuaaaugugaugccucuuggguuagggauuuguagcacucacuaaaguuucuuuaauucuuaucuguaggacaaguguuggacagccggagucagucuccauggagauuaucuuugauaacagauuucuucuggggaauagcugaguuugugguuuuguuguaaguauagaagagcucuuaauugcccugauauuuaaguugacagguauacaucaugugcauuauguuagggaucuuaaauaagcucaacuuuccugaaacaguuuucuauugcaauuuaaaaaauagcuuuacacagggaaauagauguuagugauaaaguugcuaccaccagauagcuuaugauuaugaguauauguuaguuggauugguaaacuugaccacaucuuaaccuuggugguaacuacuucaaccuauggcuggguccgucaauucugaugcuaaaugacuggaccucacuuucucucuacuauucuuguuuuguuuuuuucuuugugcaugcaacuuucauuccauauuauauaacaaguaaauaaaagguuuuauauccugguuuaaaaaaaauuccaaagaaguaaacuuuuuuauaaugaaggguuagaauugguaaaggagacaaaaauuuaaaugucuucauaauuguaagcaguuacuaguuaaaugcauguuuuggucuuuuacaugcuguuuguuagaauuguucaucaauaauuaagaagucuuaccuauuccuaaauuugaauauauauuugagugucucaugaucagggaacuguagggaugcaaagaugugggagacccuuuuuucauugaguuuacugucaguaaauaucuucauauugcaagggugggcaugacugggaggugaacaucagaggaaguuaucccagauaaaggaaaccacaugaaggauggcauagaaguuugaguaucaggcuguggucuuuaugcuuaauuugaucuuagcugugguuuagaaaguuuaauuuuauggcuauauauagcauaaacuagaugguguagaauguaaaauggaagagaugguuucauagaaaaauacaacagggcacaagagaggcccuaaguuacccaauccaaaacuuaacucuuuuacaaauuucaccuacuccauguuguuuauaaaaguacuuuuuaaacucaguuaaauccuuccauauaauuuuacauaucauuuuuaaaaauuccauuucaauggauucccagaagcccugugccuuugccacaccacccuuggccccuccuucccuaagauguuagguagacuuuugcaggggaaaugagcaugagacacuguaaaaacccgauggcugauuuaaaguggaggucagggaugacucugguuucaugcucugucuaggggaguuauuagcaaauaagaaauacaaggaaggguagauuugguguacaacauagcacauucaguuuagacacaugcuuaaguuagauggugguguccagcuggcugcaagaaauguggguuaggagcuaaguggguuuaguaauccucucacagagaugaugguuaaaaaacauggaaauauauuuuagaauguugucaaaagugauaccuuuguuguuuucugccccuuguuucaguuucaaaacucugcuucagcaagaugugaaaaaaagaagaagcuauggaaacucaucugauuccagauaugaugauggaagaggguacagcuuuuuaaauugauaauaguuguuuuuaugucuuuguauaccuuuauuagauauuuuagguagauagaguuagacuuuuggaaauuaaaaguuuaaauccuauuuuacaaaauuaaugcauuacuguaaauuaaaagucaaauugcuucugauuugauaauaaucaguuaaucugacaaagcuaaaauauacaugaaauaucccauggaaaaagucuaaauuagagggugaaaacugauggccaccauuaaaaucuaaagauuucauuuuaacaucuggauuucuaguugcuaauuaaaaacuuagaagaucgccaggcacgguggcuugagccuguaaucccagcacuuugggaggcugaggcggguggaucacgaggucaagagaucgagaccauccugaccaacaugaugaaaccccgucucuacuaaaauacaaaaauuagcuggguguggugguaugcgccuguagucccagcuacucaggaggcugaggcaggagaauuguuugaacccaggagguagagguugcagugagcugagaucgugccacugcacuccagccuggagacagagugggacuccaucucaaaaaaaaagccguaaagaucaagaucaaguagcacugggcuaggcuuauguuucuaccuggcaaaaaucagcuggagcuggguuucaguggggcauuacuggaggugcuauucaguucaucacaguccuuucuugacucaguuccuugugugcauuaugugucuggucccuuuaaguguuuuaauuuuugccuccugaccuaaaaugguaguuucuauuuuaaauuguguuuuagggucaugugggugcugaaaaagaaaagggucuaguugagugcuuuuaaaaggagacaauucaaguugugucuaucaaacaguagauacuaacuuuuuauuuuauuaggccaccaggaaacccuccccgaagaauggguagaaucaaucaucugcguggcccuagucccccuccaauggcugguggaugaggaagguaacuucagaucugaaauucuuuuguaggauuuuguuuugaaaacacuucuguaguaauguuuucuuuaagaaguugcccagcagcuuauaauuacucagacauuauuuggaaauauauuuguuaucuuaacccuugaaaaauucacuggccuuguuaucaaaaugucuuuugagaaagauuuuauaacauguaauauguugagguuuucacacagauccaaauuaauaaccaguaacuaauuauuguaacauuuucuuucagguaaaugucugcucuaagaagcagacaaccggacaugcgcauucauagcagaaggaaaccaucaagaaguggaaggcugaccaugaugagcaguagaugaauguguaugucuaaacaaggacugcucuguguccucacagaugaaugaggucaugcugggaauucccucugcagggaacuggccugacugacaugcaguuccauaaaugcagauguuugucucauuaccuuuuuguauaguuuauuaaaguauuaauauaguuuuaauaaguaaauauuuuuagguugcagaauggacuccucaucuuuauauucacgaaaaagcaaucugaagaaaacaaauaaaagccuguguauuuagcacuguuagugucaccuuuucaacuucugaaacacuguucauuguuaacuuuuucucauuuauaaaucacuguauuuauuuuaguaguaugcauagcauaucugugcucuugaauuaauuuuuaucuuuaacauauuugucucaucaaucuuuaauaca

SEQ ID NO: 17485 - RNA, 32941 nt, Homo sapiens
cgacuccgcggcggccaucuugacugugggcagccggccgugcgccugcgcgguggcccuuccaucccggcagucguggcugcagcgcugaggcgagagguuggugggugucuccggccauaaugacccaggcugagaagggugauacggagaacggaaaggagaagggcggcgagaaggagaaggagcagcgcggcgugaagcggcccaucgugcccgcgcuggugccggagucgcugcaagaggugcggcucuggcuggguuggaacucuuugcccuugcuuggguccuccgcugccaggcaaggggcgggaggcggcgggaggcuucgagucccccuugcaggccccagccccugguggggggagugcggaagcggucguucuuuuccgggugguggcgcgccgggacgccgagggcugggaggugcggagcgccaggagccaggcggagcccccgcagggacaccgcuccgaucucccgcacgccccaccgucugguugugugcgcuccugcccgggcucuggccucagcuuccccgaccauaaaacgaccacggugauaaccagccgccucgcaaguugccgugaggguuaaaugguggcagauagaguuuaggaccaggcuggcucacugggagcgucagccugugcuuguuaagggauaguuugggguccaggcuuuuuccuuuguuaaggaaaucucagauaauggaagucauuucaagcuuaaaagcaaggaaaugguggacauuugucuaaauauauauuaagagcuuguguaucaaaaacaacacuauuagaccaaacuaaacuaaccagaaaaaauuauuugcaguagcgugccuggcagaggaccuuagauguauacacauacacaaaaccuuacugaucaguaacuaaaacagcauucacguaggaaaacgggcacaggcaguguacaauucacagaagaaaugaggcauaaacugcucagaaauucauguaggacaucucugauccagcuuccuuaccgguagauggguuaaggauaauaccuaacuaguagggcagcuacuaguuaguuaucacuaguaugacagugccuggcacaccguaagcccagaguggccauuacuguugcacaggccugguuucuccaucugucuaguugagaaggcugacuggauggucuguaagggccuugccagauccuucccucuaggauucucccacucuguggggggugauuaggaggagagaggucacacuuggagauaggacaacagguaucagagcauggcauggaaugggcuugugcagagggcaguauugggcacucaagcaaguaccuccuccauccccgacagucagggaggguuucuucaaaggaggugaggugacaucuguuuagaguccugaaggugauuaggagcuaaccagagggaggagggaaucucagggaagaagaacaguguggaagacacuugugccaacagaggaugugaaguguuggaggcccagccaguagauuaggaugucuggaguuaaggaaggggacugaagaucuuagcaggggccauaucaugagggucguguaagccacagagucugaccucuugugaaggcaguggaucacguugaaaggcuuuacuauaguaagagccaacauuccucgaaugcuuccuguggcccagcucugaguuacauguauaacucauuuaauucucacaguaacugugaguuaggagcuucauucagagcaaggaaguggcagucugaauuugcagacagauccgugaauucagagccugggcccggauucuauagcaacauuucuucagucacauaaaugcucaauaacuguauguuaauuuguaguggacaauuuuuguuucauuuauuuaaacaaauauuuguugagcuauguacuauaacucaggucaagggaacauaauaaacaaugaguuuguguuuagguagagagcgguaauuggauacuucucaaagaacuuuauugaauuauuuugauaccuuugagucagcuucuuaguuuagcuuguuauguguauguuguuuaacuuuguuaccugcauauuauuuacaaagucacacaucuauguuuuauaucugcagcaaauccagagcaacuucaucauugucauacauccagguucaacaacuuuaaggauuggucgagccacagacacucuuccugccagcauuccucacgucauugcccgaagacacaaacaacaagggcagccccuauacaaggacaguuggcuccuaagggagggacuaaauguaagucaaaaacgaccuggagagaaagccuaagguuguuucccugggagggcuuagacacaaguacaccagaaucuuaaagaaacaucuucauagcuuugcuguguuuuaaaacauuaauaaugucacuaauuuuucaucagagcuagugacuuuagauguaaagaauuaguuacaacaaaaguaagucuuucagggugaauugaguguggaugaaggugaucuauaauggaagacacaaaaucaucacucacaguaauacauucagguccuuguuaacaggcuuaaacuuauggauuaagccauauuuaaacuguaaauaucucuuucagauacuuacaguuuaagucaauaagucaaacucuuauuuucaauccauuagcaaauuagauuguuacaauaagcacuuauuauggucuuagauuaaccauaauuucaaggcaaaaaaaaaauuuucuugcaguaagcaucuacuuuauccuauguugcagaugguaauuaucaggaaaauucuuugugaucaaugauaaaucuauauauuacaucauaauccacauuuuacuuugaaguuuuaagucaaggauaguuuugggaauguaaaguuucuuuaauucugauaguaggccuuaggguuccauuuuuuaguguaacaagcagacucuacguaagucuaguuguaaguuuaaauauaacuugcugauauaagaguccgcacuucauuauuuaucuuuggaucuuauaauucuacuuuagggaguacguuuaagaaauaaaaaucaaaagaaaacauuucuguaaagauauuuaugggcauuuucuuuauacuauaauaacgagaaccaguaaguuuauggcuuaaccaaaaaguuuaagccuugcugaucaacauaugaaggaaugugucauugucaaaacuguaaacauaagaauuauauaauuguauggaagagucucugaaauauuuuuuaaacaugaaguagguaugcuuugauuagugcugugagaaauuuuaugaaaaaucacuugaaaauuuugcauauaguuguuuuauagugagggcugcuuuugacuuauuuauaauaaaagauuccugggaauucuuuuuuucuuuucuugagacagggucuugcucucuucuucaggcuggaguacaguggugcgaucucggcucauugcaccuuccaccuccugggcucaagcaaucuuuccaccuuagucucccaaguagcugggaccacaggccugugccaccacacccagcuaauuucuuguauuuuuuguagagaugguguuuugccauguugcccaggcuagagggaauucuuaagagcaguacaugugauaaagauuaaggaaacgcuacuuguugaugaaggagcauuuccaaagauuggauuaaauuaguaguuuuugaauugcuuugucuucucauuaaauccuuuguacugcucaucuuucauuuuuuccccagaaaccagaaaguaaugaacaaagacaaaauggccuuaaaaugguggaucaagcaauauggucuaaaaagauguccaaugguacaagacgcauuccuguguccccugaacagguucgauuaacucuucagauuuauucuuuuaucaccacuauugguaucauaauaccauucacauguucuuccuauaccacuaugcaaauacaagaugggaguuccuuaaaaaggaagaaaaccccucauaaccacuuaaagaauacccgagucaguguuacaaaugcuuaggcaagccacauaauuuauaagguggugguaggcaaguugauggaaguuuauacuuuaccugagaaggugugauuccaggaucuuggugggaaacuguucuuacuacauucuucaauuucauaugauaaaccaauaugauaggaauggacaggagucuguauuacauauaaauuugaauucagcuuuaagcagcguuuaguguuaauuuuggacuggcugugaaucacagccuagguguuaaaauugggggaaaaagaaccccaagauuguaaaaaggacaagagaauccuuuugcagccagucaauauuuugccaaauauuugugauuaaaauuugccaaugugucuaguaugugagagagaagaaaaggagacccuuauguugcccccgccuugaauaaauugagauaauuuucugaugguuuuucuuuucaggcacgcuccuacaauaagcagaugcgaccugcaauuuuagaucacuguucgggaaauaaguggacaaacacaucucaucacccugaguauuuaguaggagaagagguaagaaacuucuuuacaauagaaugaaagaaggggaagcugauccuccuccuaaaauucauuuacguugccacccaguccuaguuguuuccuagcguucuauaacccugcuuugaguaccagauagucacaccgacuccuacuucacucucaacauuucucacauucagcaaacguuaguuagauuuuuggauaugaauccagaaaaccuugagagaaaaguuuuaacaaaguacucaucucccuccuccuuuucuaggccuuguauguuaauccacuggacuguuacaauauucacuggccuaucagaagaggucaguuaaauauucacccaggcccugggggcucucuuacagcuguucuggcagauauugaaguaauauggucucaugcgauacaaaaauacuuggaaaucccacugaaagauuuaaaggugagcuaaaauccucaguuauuuggauuguuuuuaagauucuuggucaaugaaaguacacguuaccgaguuguuuguaauauaguguccuucuugaaacauucuugaccuucagggugaggauucuugguggcaugaggaugucuuuucuucuucacuuaauucccuucuggugcuuuuuuucuuucucuguuucuuuggugucucuauuacucgaaucagcaagcuugcucauuuuugucuucucuuuggaccuuacugacacaucaguugucuuauuuuugauuuuacaaguuuuuaaaaauuucaaggaaaaaaaaacacuugagcauuuuuuuuuuccuuauaaaacccaaaggauaguacagagguuugagcuuuaaucuggguguguaaccguagcugcuacuccuuuggagggaagucucucuaaaaaggagugugaauuugaccugacuagacuugagugcuaacccuuuuaucuuuguucuucuuuuuaguauuauagauguaucuuguuaauuccugauaucuauaauaagcagcaugugaaagaacuagugaauaugauacuaaugaagauggguuuuucagguaugucugauaucccagugaaaccuauuuuaaauggaauuuucuuucuuuaaugacagaguuaaucuuauuuacugacuuauuuauuuauuuauuuauuugagacagagucucucucugucgcccaggcuggagugcaguggcgcuaucucagcucacugcaagcuccaccucccggguucacgccacucuccugccucagccuccugauuggcugggacuacaggcacccgccaccaugcccagcuaauuuuuuguauuuuuuaguagauacaggguuucacuguguuagccaggaucgucuccaucuccugaccucgugauccucccaccuuggccucccaaagugcugggauuacagacgugagccaccgcgccgggccuacugacuuauuuaaaugcuuauucugaaaggaucaguguuccucagaugcccugcccagaggucccuaggcuccccgcuucagcugauuaucuguuuugggaucuuuaccgugcuacagcuaaugacuacucugccuuuucuuuuccccccccagggauugugguccaucaggagucugugugugccaccuauggaaguggcuuaagcagcacguguauuguagacguuggggaccagaagacaaguguaugcuguguggaggauggggugucucaucggaauacucgguaaggaacuuggaagguggcauucccuguuuccucuucccucauaaucuguucaaccguaaauaauaagaaaucacagguuaaaaauuauaagauaaccauaaauucaaaagucugcaugguaaaccagcaagauuauggaagugcauauucuagcaaggcuaaaacuaaaacgaaucauuuuacccuucccauuggaacuucuuaauaggaauuuacaucagcagccccugaaaguccugggauguuuuaugcgcuuucccauaggggaaacguaaacaguagcuucgugucuuuagcugugguuuggcauagagcuacuaaucacauccuuauagcagagcuuuauuuaggcaagucauguaggagaaaaucgaccuuuucaaucugaauucucuggccaguguuuugaauaucugcauuuuuugucauagugguguucugcgggugaguaacuuuaugaugauagacagguaaagaaaauaacuaucaggaccagauuugcagcuuguccuucuucaggcaagccuaacauauguaagcacacucagguaaugcagguaugggcucucugaagcauuuugugcuccagagauggcuucuugcugccccucaggaugcuuucauucuucccguccuccacauuagguaguuugagucuuuaaaagagggcuuaaaucguccaugagaaagggucaucugcugccucccgccccaaguucuaguacauucuaaaauccauuuugaguuauuuggcucauccauuguuagaauauccaaugccacuuguucucaaaguguggagaaaaugcuggacccagguuuccuaccaauaaaauaauauagcagcugucuucccaaauuguagaaaccuucaguuaguagacagcuuucucuaagcuauucucccauaaguuugucuuauauugucauugcugccuuacaugcuagugaguguagaccaccaaacaacugucauaugauaaacacauauugacugggaaguaagcuggauuuaaugggugaguauuggguuucucagauacauuuugcaaacaucaugacuacuguagguguuccccacugguuuuugcugaaguuccuuuucucccuucuuccauccauucauucuggccuuucaacauacauuucuugaaacuugcuauauaucacuguguuuaauggacauuuuuguuuguuuuuuguguuucuuuuuuuuuuuuagauagaaucuuacucugucacccaggcugcagugcaguggcgugaccucuuggcucacugcaaccucuuccuccuggguucaagcaauucucgugccucagccucccgaguagcugggauuacaggugugcaccaccaugccuggcuaauuuuuguauuuuuaguagagacaggguuucgccauauuggccagcuggucuugaacuccuggccucaagugaucugcucaucucagccucccaaagugcugggauuacaggcaggaaccaccaugcccagccauuaauggauuucuucaaacaccuuuugcaccuucuuaaccaacagauuaaccaucuacccuuuucucuuaacuuuaggcuuugucuggcauacggaggaucugaugugucaagauguuuuuacuggcuaaugcagcgagcuggguucccuuacagagaaugccaguuaacaaauaaaauggauugucuucuucugcaacaccuuaaagaaacuuuuugucauuuagaucaggugggagcagaaucaauauugcugauuauuuuuguuucuaggaaaaauuuaagagauuuaaaagauacuuaaaaauguaacagcauuggcugggcacgguggcucaugccuguaaucccagcacuuugggaggccgagguggguggaucaugaggucaggagaucaagaccauccuggcuaacacggugaaacuccgucucuaauaaaaauacaaaaaauuagccgggcgugguggcgggcaccuguagucccagcuacucgggaggcugaggcgggagaauggcgugaaccuggaagguggagcuugcagugagccgagauugcaccacugcacuccagccucggcgacaaagcgagacuccaucucaaaauaaauaaauaaauaaauaaaaugaaguaacagcauuauaaugccuuuuucaacccacgauaaagccugcaggugaaagcccuuaaggagugagaguuuuuugcuaaaguccgagcagugagggugugucuuaggcucaggaaaaguuugauuuuuuuagggaacaaguuuagcaaauuucucugucucauccugauaaaagaugaagauaaaccuuuagguguaaggaagauaguagguaaauauguaagaacagacauuuuguuaaauguuauaauuugaagcacuuucuuaauauugcaaacaaucaauguuuaaucauugcuauauauggauugguauccuuuuuuuguuugagacuuguuuuuacuuuuuucagguaaucuaaauauuaaaaaauuggggaaacaaaaauacuguaaauuucccaguuacugagggaauuugcuuauugauuugggucauuguuguacuaauguauguugauaauggagaaaacaaauaaugcaaacaguggaaauuccagaaauguuaaauaggggaacaaaguacaacuuaauuccuauuuuacuaaauuauagugugagugguacaaagcuguagguuggccuuuuuauaggugauauuuagaugauggugaggcugaagcauaauuugaagaguuuacaugcauucuuacugauucacugacagcaucuuuuccuggaaucaggacaucucugggcuucaggaccaugaguuucagauucgacauccugauucuccugcccugcuuuaccaguuucgauuaggagaugaaaaacugcagguaacuuauagguaucuguuuccauggguagaaagaaaguuauccagguucaaucaaacugagagaauaugcccuugcuggaaacauugugagaucagaaugucaacugauuguagauuauccacuaaaccaacauuuaagccacugguauagacuagaauggaucugaagaauaucuuucuauuuagccccuauaugaugagguguuaauuagaaagaaagguaucauucuuacuaggaaauuaugaaguagauuuugagguacuugauauuugcuuugagauuucucucauauggugucauaucacccaucugguuggaugaugagugaguuuucuggccuauggugcaccagagaaauaaugccacucccgaaagagaacauugcccagucuaacuuagggaaucugaucugccaguuuuguuuuuagaagaacagaauuuaguggaucaguuuuuuucaggaugcaguaucuuuuguugaucacucuuuuucuucauguacaggcuccaauggcuuuguuuuaccccgcaacuuuuggaaucguuggacagaaaaugacgacuuugcagcacagaucucagggcgauccugaggauccucacgaugaacauuaccugcuggccacacagagcaaacaagaacagguccguagcaauucugguaggagaagagagaguuuugucccugaaggagaaauuuguccagaguuaauaggccauuguaaucaguucuaucuuccagcauaauaacacugauauagcuuuuagaauuguagaugaacugaagucugaguuuaaaaucuggaagacauauuucucuauucagcaaacauuaauuuucugaaugcuaguccauacauuuaaaaguuaaugacacuuuccuuuugguguauaucauuuacuuacauuaucuacuucugaauauuuuuucaguaguauuuucauuaaaaucucaccuguuacuuaauuuugugaaagauguguggcauagccaaagagcugaauuccuuuguugaaaguggauccccauaauaugaugucugguacaggggcacaaauugaaggucuugucugcuaaugaaacaguaccagcucaugauggagacuagauuuucuagucuuuguuccuccccagaggcaggcaugagguggacucauaggaucugaaaguaagaauuccuuaacagucauggcccaugaaucccacuggaauacuccauuuaaaaacucagggcacggggaagaaagucugucugcacugguauuucacuuuuaaaaucuaaccagugaugauaagguucugagagcuacccugccuaccagcagcuaccuugcuuuggaauggucaaagcaucuucaucugugcaccgucucucauuccuaaguuaccugggaaugggugcugggcaguuguuguauugcuguguggcuuuuguuuuauaguaguaggguagggagggaucuagcuagacaacaucaauaguguucuguuguuguaauaccacauacuugauuguccuuuugauuuaaagucugcaaaagcuacugcugaccgaaagucugcauccaaaccuauuggauuugaaggggaucuucguggccaguccucugaucuuccagaaagacuccauucccaggagguagauuuggggucugcacagggagauggccugauggccggcaacgauuccgaggaggcccucacugcacugauguccaggaagacugccaucucgcuguuugaaggaaaagcccugggccuggauaaagccauccuccauagcauagacugcuguuguaagcacaucuggggagaccgggagauagcagugaaacaagauagcaguuaaauaaauugguucagucuaggauauacuugugcaguauaacauauucauugaaaagugauuaagcgccuacuuggcuugcauugccagguguugggaauacauuaacgaaguaggauggguuuauagccuaguggaagaggccaaaauaagucagauuauuacacaaaugugaaauuaccacuggcaggccacuacuaagcagucaguacccuuuagauaaacuuuguagcaccugccagugguacuuucacauuuguguaauaauuugaggaauuucacauagaaucuuuacucacuaggggaugguauggaaggugggaggcagggaaagcuuccuugaggaaggcagaccuugagagagauguaaaggaugaaaggggucaguuagcagucacagaugggguagaggaagaagccugugaagaccuguguggcugggaagcagggugugaggaugaggcuagagaagcaggggacgaccacccguaguggaucuugugggucccuuuaaagauuuuauuuauuuauuuuucagagucucacuccauugcccaggcuagagugcaauggcgugauugcggcucaccacaaccucugccuccuggguucaagugauucuccugccucagccucccgaguagcugggacuacaggcgcacgcuaccaugcccggcuacuuuuuguauuuuuaguagagacaggguuucacuauguuggccaggcugguuucgaacuccugaccucgugaucugccugccuuggccucccaaagugcugggauuacaggcgugagccaccaugcucggccuccuuuaaagauuuugauccuaauccugcaaguaggauugcgguggcguggcaacaugccuacauuuguguuucguaggguuccccuggcugcaguguggagggugggcuggagggaaaucuuugagaaggcuauugcacuugcucaagcaagagguguugguggcuuggccuagaauuauggauguggagaaaaaagcauggaggaugucaacugucuuuucagcaucugacgacaccaaaaagaagauguacagcuccauccuaguggugggaggugguuugauguuucauaaagcucaagaauuucugcagcacagaauucucaacaaaaugccaccauccuucaggcgaauuauugaaaauguggaugugaucacaaggccuaagguagguuguuucauugugcaaguuggacuguaugcaaaugaaaccagccuuguauguggacagaucaaauccugggaggcaugggcuugugucugaggaguucuugagggcuuagggcaaguggaaaaguuaauuucagcaagccauagaugugguggaaggugcucuggccuaagguacuggauuucugcugcuuuccccugccgugcuccccaaacuagcaugacugaauuccaccuuuguuaaaggaucagguggggcaaggggaggaccaacugcucucaagcccugccagccagaacagcuccauuuuaaucucuuuuuuauauuaaggaucuccuucugcucccuggaccagaugaucuuuaaggaucuuuuugguuugaacuaucuugaaaagaaagauaaacccaggaauuuagaaauagauuuuguguguuuuauuaaaucucacugacaauuccuggaaauguuccuauuucuuuuuaauccugagggagggauuguggggaucuauuuauuccacucaaacugcgaaauaaguaagucauuuauuuauauauguuccuguguacaggguaaauaggguauuugugcaauaguaguaaauaguagcaucuucaguuauaaaaauuuaaaaguuuucuuggcuauugaaacagaaagaugccuguaguucauaaguccuacugucuuuuuuugagacggagucucacucugucacccaggcuggagugcaguggcgcgaucuuggcucacugcaaccucugccucccggguucacgccauucuccugccucagccuccugaguagcugggacuacaggugccugccaccacgccuggcuaauuuuuuguauuuuuaguagaggcggcauuccaccguguuagccaggauggucuugaucuccugaucucgugaucugcccgccucggccucccaaagugcugggguuacaggcgugagccuguauuuaauccugcugucuuuaauacagggugaaagccuggcuuacuagguauugacucagcagggauuuuucucggccccauauucaaguaaaugauugaguauaugucuuaugugauuaggcugaaaugccuucaucccuucuguaggacauggacccccggcugauugcauggaaaggaggggcaguguuggcuuguuuggauacaacacaggaacuguggauuuaucagcgagaguggcagcgcuuugguguccgcauguuacgagagcgggcugcguuuguguggugaauggggaggaaaugucacugccgaagaccaaaaacaagcuucuugguauaaaagacucuuacagaauauguguauuguaauuuauugaucuggaugcuuaagugucauggacaguaaaugaauuugaacuuuauguugaggacaugacauugguuugaaaauauaaacugcuuuugagcaguuuagucagggcauuugagaauaaauaggaacuuucucuucaguuguaaacucucuugcccucucucagggucucauaaacuccccagugauguaaacguugcuauugaagguucucauguggugaagcccuucauuuaaguuggcuugaaucucaucagcaggcagccucaugcaaccaugagggauaguaugugacgagggagaacuguccacucaugccauuuucucucuugucuaguauuucauuaggaucuaaaguugucugaguuaaaugcacuuaugugacucauguguccucuuagaaucccaaauagggggaaaaaguuuuggugguuuuuguuuuuuuuuucauuuucuguuggauuacagaaaaagaaugggacccauucaggucucgauuuccaaagguaaagauggaaggcugggcagacuggcuuuuguuaccugacaugccguagggugagcuuagaggaagaaagaaaacaauuuuuauuuggccaaaacagaacaaaugcugaaaaggaaaucuuguuuuuuuccuaaagccaaauagaaaugauuuggguauaauuuaagaguccuuguguuguacagauauggugacugauguaguuauuaauacuaccaacuuagucaucaagccucaauuuuccuuuaccugaaggauuaagugaaagcuuuuggaguucaugauguucaguaugaucaguuaaccuuaaccucugagcauccugaagcaaaaucuaaauaaugcagcuauuaccacuggugguccaggcucuggugaagcccucugagcccaggaggaagagaaagcauuguccagagguaggaacacagucugggagcccagagcucugggaggagugggaaaaugcugcuuccugcugcuugcuucuaggcaccugcuuccgccaucucacuuaccauggcuagagaugggggugagacuggggaaggacaaaagcagggaacagauaagugauggaaaucagaagggaauauagaaagaacucuggauguggagaaaugccgguaccugagcauuuuguaucaaugggaguacccucuguaacugcucaguagguuacaaaugaagaguccaccaguauuagaaacaauuuaaacuugccaguaccaacugggaugugugccuucaauuugaaaauuguauguuuuauuuuuuaaauuuguuaacagcauuaauuuauagaguauugaugucauuuauguuucugagguguuucaacacaauuuuggaucagcugccuguuugcaaaaacauaauauauuucuguuaaacaguucuucaccuaacagcauauugcucuuauaacugguagagcuguuucaaaggaaguugguuucugguccaaguuuugaccuaaaccauguccaucuucuauuaccagcacuuacaagcacugugaaaacugaucaugacaaauaaguaaaauuugcuacauuaaacauauugccucagccauuacuaagcguccacuuguaaagcuggacacaguuuuuacuuuaugcuucauuuugauuuuuuauccguaagacauaaauuagaaggcaugagguggcccuuuaaggauaaucugcaaauauacacauuuuaauagucauccaucugaaaucgauccacauuccagagaagauucaguauugugcugugugaaauaagcauucccagaaaaaaaacauuuaugcuaauaauacaacauaaccucugcauuaaagaaaaagaugcuuuuaggccaggcgccguggcucacaccuguaaucccugcacuuugagaggcugagguggguggaucaugaggucaggagaucaagaccauccuggcuaacagggugaaaccccgucucuacuaaaaauauaaaaaguuagcugggugugguggugggugccuguagucccagcuacucaggaggcugaggcaggagaauggcgugaacccggaaggcagagguuguagugagccgaggucacgccacugcacuccagccugggugacagagugaaacucugucucaaaaaaaaaaaauuuaaaaaauuuaaaaaagaugcuuuuagaagaguaaaaaguuggaagacaaaaugugcaucuuuuauguucugucauucuguggggguuuuuucguuuguuuguuuuagacagggucugcucucacccaggauggagugcaguggcacaaucaccguuuacugcacccuugaccuccagggcucaagugauccucccaucucagccucccuaguagcugggaccacaggcuuacaccaucacacucagcuaauuuuuuaaaucuuuuguagagauggaggucucgcuuugugacguagccuggucuugagcgauccuuuugccuuggccuugccaaagugcugggauuggaggcaugagccacugcacccaccccuguuuuuuauuuaaguaaaccauuauaauaacucauuuauaaaaagguuacuucaagagggcuuucaacuuaagaauuauuuucauuuugaacaugaaaaguuaaauaguaacuaagaaacugagaacucugacagugaccucuaauagguaacuuuaggcaaaaguagacaaguuuguggguauuuuguuguucauguuaaaaggcaccuguacaagaaucaagauaugaaucuaguuuguagagggaaggucuuaugcaaauaccaaaucauacaagugguuacacauauaauagaucauuugguccaguaaaaguggguucagcuuguuuauucccuacuuuuguuaucuuaaaaacaaugauuuuuugcauguaauagaagguuuuucacuuaagaugcuauugagugaaucagugagggguucuuagaguuaguauucauuaauuaaacauagaauauuagcuaaacaguucuggguacacugcaaugcauggucuauggaagacuagauguuuggcugaagaugcuuuauuguugcauuaucaaaaugguuauaguuuucaauuaaaacuguaauugauuucuauguauaaaacagcuuugaaguuguaaauguaguuuccaaucguuaguuaaugcuacauuaguuagcaauauuugaaaauuuuauugguauaaaauguuuuaauuacuaaggcuguuuguaggcugcauaguaagcuucaggaucaucacacguuuuuucccuguaauuggugggauaggaagccuuuaaggucucuugcuucucaugggugggcuacaaggagcagcagccaucguggcaggcuugugaucuuuuuccugcugacaccugcugcuugacauggagaaguucugcacagaaagcaguggcauccuucaugaggugguacuuggggcagacacugagagcauuguaaucgucuuuuguaucaaucucucuaaaguagaccaccacguauuugugcagaugaaucuggcuucuuagaucacugcagaaaagguuaaaggcaagggggaagaggucuugagaguucucacugggacugcccucgcucuugccacagguaccaucgcacacacuguugacgucauuggaaagaaggaagacgacuuugucugcugccuucuuuugaguggcaagccacugcacuggacccaucucugcuauuuucuuuuucugccacuuuucaaggaugaccucacuucugcaaugguuuugaagaaauucagugaaguaacaaauugugugauggaaacauauuucagauggguaaaccacaagaaccuuaauggggggcaguaguguggugguagaaaaggaagucuucuugauccuuucugugagaggagaaaagcauuuguuaucugugaacagcaaacagcaggcuuucacucuguaaaccaucccugacaaaugaucccuugcuagagaaugucagcugagcaccaagggccuuguuagugacagcaaggaaaaacauccugauguuccuuuugaacacaucaccugaaacacacugaugcuuaaaccuuaacuuuuuuuuuuuuggagacauagucucacucugucgcccaggcuggagugcaguggcgugaccucggcugacuacaaccuccgccuccuggguucacgccauucuccugccucagccucccgaguagcugggacuacaggcgcccgccaccacgccuggcuaauuuuuguacuuuuaguagagacgggguuucacccuguuagccaggauggucucgaucuccugaccucguguuccgcccgccugggccucccagagugcugggauuacaggcgugagccaccgcacccugccuuaaaccuuaacuuuuuaaaccuuauuuuaaaagcaguauuuucuaagucccucucacuaaaacaauccucucaaccaagccuucucuuuucagauaaauucauagaaacuuuagguuuaagauacuuuguuggccaggugugguggcuuacaccaggaaucccagcacuuugggaggccaaggcugguagaucacuugaguccaggaguuccagaccagccagggcaacauggcgaaaccccaucucaacaaaaaguacaaauauuagcugggcuugauggcaugcaucuguggucccagcuacucaggcggcuaaggugggagguucacuugagcucaggaggcagagguugcagugagccaagaucacaccauuccacuccagccugggcaacagagugagacccugucucaaaaaaaaaaaaaaaaaaauacuuugaggugugugauuguaaccucaguacuuuuagugcuguauaugaacagggacacuugaccucugcacuucacauuuugagucgggucaauuagguaguugcuuguacugucuucuaccugcaggugguagaguuucuuuauaguucccaaaguuaaguggcaccccuuuucagccccuggaacuuaaccuggaauucugcccuauacggugcuguaaaacaaaccauguuugaaacuacuguaacgaauacaggucagacagcaucccuaaauguaagaauuccugagguccaggugccccuguggcuuucuuagcuuagaacauggaguuaaucucauuuuauuuacaacaucacaaaugacucaaaggaugcauuuguauuuccuuuccuacauauggagaagaggaguuuuuuuaauagcucugccuugagcugaguauguaaaugcucugguuucuguauucaaauacuccauguuuugaaguuagcaaagcccuuagagaguacagcugacccuugaacaacacaguggggaggggcaccggcccugcaugcaguugaaaaucuccuauaaccuuugauuuucccacaacuuaacuucuaauagccuacuguugacuggaagucuuaccaauaacauaaacagccaauuaacacauauuuugcauguuauguguauuaugugcuguauuauaauaaaguaagcuagagaaaaaaauguaauuaaaaucaugagaaaauauauuuacuaauucauuaaauggaaguggaccaucagaaaggucuuuauucuugucaucaucuuguugaguaggcugacgaggaagaggaggaagggguuagucuugcugacuuagggguggcagaggcagaagcgguggaagaggaggcaggagaggugggcgccucaguguaacuuuacagaaagacaucauaauuucuggcuuuuuugcuuuuucauuuuucuaaaaauauuuguauaugguaccaauccuuccuccaccacuugcuuuagguuuaaugcuuguaucauagaagggucuguguuacaaaagaagugaaaagcagucuugacuaaucagaaaccugccagauuguuuaaugucgauuuguuuucugaugcugcugcuucugugucgucuucaucaucaccucacacugauggggaagcacucgucuccagcagguugucuucucuuuguuccucuagugugguuaucuguuagcucuugaauuucuccaagauccguaucuugaaacccuucaccccccaccuuuuuugccacaucuacaaucucuuuccuugauuggcucuguuguaaauccugugaagucaugcacaucaucuggacaguuuucuccugcaggaauuuauuguuucaggcuugauggcuuucauggcuugcucugucacaaugauggcaucuucagugauguaauucuuccagacuuccauguuguucucucuguugguguucucguccauaguguugacaauccuuuccauaaaguacuguguguaaugagccuugaagguccuuauggccucccaaucuagaggccaaauuaugauguguuugggggcaaggagaccacucugaggacuuuaguguugaacucauggggcucuggguggcugggggcauuguccaauaucaaaagaacuuuaaaaggcagucgcuuccugggaagguacuucugacuucagggacaaagcaucaguggaaccaauccagaaaaguuuucucaguguccaggccuucuuauuguacaaccaaaagauuggcagcugguguuuaucuuuucccuucaaggccaggggguuagcagcuuuauagauaaggccaguccugaucauaaacccaauugcauuuguacaaagcaguccaguuagccugucccuuccugccuuaaauccugaugcaugcuucucuuccuuacuaaucaauguccuuuguagcauuuuuuucccagaagaggacacuuucaucugcacugaaaaccuguucaggcagguauccuuucuccucagugauuuucuuaauggcauccgggaacucaccugcugccucuuggucagcagaagcugcuucuccuguuaucuugacaguuuuuaagccaaaccacuuuuaaaaauuaucaaaccauccuuuacuggcauuaaauucuccagcuuuagaugcuucaccuuccuuuugcuuuaaguugucauauaaugacuuugcuuuuucucaaaucauauuagagucuacagauaugccuuucuuacagcaauccugcacccacauaaaagcuacauuuucaauacaagauuaaaagguauucugcaaaaugugcaagguuuucaugucugcugguguagcuguagugauggcuucaugaauuuuuuucuuuuuugacuaugguccuuacgcuggauucauuuaucuugaaauggugaacaaucacagcugcagacccucaauuuaugguacauaucaagcaauuuggcuuuuuuucuuguaaugaaaaaaaaaaguuuuuuuugcuuuuuuucaugacacugcuucuugggagcacugccagcauuacuaguggcacuucguauggguccuaagguguuauugaagguuuacgauauugcacuaaacacgaaaaauaccagagaaccacuggagauacuuuuuacugugauauguaauuuacuggagacaggaacugcucguuuggagaugguuagcaucacaggguguuuuaagucgauacuugcaacccuugagcucaccacaguagcaacaggagguggcuaggaaauuauucacagcaggacaguacgcacugcaauuaauuguaugcaguuaugauuuaauaccacaucuuuaugcucacguuucucucaacugugaauggugccauguacaguugguauguguguguuuaaguuuugauaaauuuuuaacuuuuaauaguuaaaauaguuaacuauugguaugguaggaaaugauaaaguagacuaguaucuguauacauuuucugcauuuaugacauaccuuuuucuucauuuuuuucaauauuuuaauugaaaaguucauccgaguuucaucuaaguuuuuucaaagugauacaaaucuccaaaaaauuuuccaauauauguauugaaaaaauccagguguaaguggcucugcgcaguccaaaccuguguuguucaagggucaacuguguaugaauccaagcgaaagcuuuucuuaacaccucauaagaacuauuuuuuaaaaaacaggaacuagcauagaguaaccaucacagguaaaguguaauuuguuaucagccaucuuuugcccauuucaguacugguagaaggcucaaugguaaaaauaaaaacgggacagucagaagaucuggaaguccugacccugcuuucaccuggcauguguaauccagucaugcucguaucagucucuguaggagcacuugaagguauuacauaaaugcuaucuaacucugggaaacgccaacaugugauugccuccagaggaaucuucuuuaaaaaaaaauucaaaauguuauuuccuuacuaggaugucuuuaaagaauuauaacccuuaccgugccuccacauuagauagaucccugccaccagcacccauguggccaccagcagagacagcaggaggagaggcagccagccucccggcuugcuuuugucuggaaaaaacaaagcuuauucaccuuuggaaaacaaauccacacuuaucucuuaauuuaaaaacuaagacuugguauacuuuauagagguuuauuuauuuuuuauuauuuuuuaguuuugagacagagucucgcuuuguugccuaggcuggagugcaguggcgcaaucucgguucacugcagccuccgucucccggguucaagcaaugcugccucagccuccugaguagcugggauuacaggcaugugucaccgcgcccagccacuuuguagagauuuagaucccuuuaaaaccaucagucagaagcucuuuagagagucugccaaucauaucuuuuucccuagagugugcaggucuugcauuagauucucaaaagggauaugggacccaggaaguuaagaacaguccuaaaaucucuuuggcuucuuuguccugauaugcaccggcauuuucacaguaggaacuaggguuucuguccaguuuuuuugguucuuuaaggaauuaauguuauucuggguacaacugcuuacauacauagcacauauagaugacauuuuuacaggccgucuuguuagacugacauacauggaggauagugccacccgccucacaagaacaucagguaagcucaggcacagagugcccaggaaucuguaaggcuucgcccacgcacaagucagggcugccagucaccuggguugucuucacuuuauuuggcugcgucuaaugacaccuuccaacuuuugaccccaccccuggacuguuguguaaacauuguauuucuccaucuguaaugaaaaagcuaacacaucucuaacuccagagacauuuuccagaacaugcuguucucaggcacuagugaggcgguaccauuauuccucauuuguuauccaaauguuggccaugugaccacaccaaaagcucauccugggccacugagacugguaauugaaucagaauauagugaaauauucauucucauauauacccagccaucuuacaucuuuggcuuuuuucagcagauccuuguggcacucagaacauccauuuugcacuguguauuuuuuucccuucuguguauccugcuuuguaaagagucacgagugguuuuacaaauaaagccuguucuuacucagauucuagguucucugggacagcacuguuggcuuucucugcaccccaguucaguguacacaggcagcgaccccuugcacugcccacauacacacaacccuuccacauacugaguggggggcagugacugugugugagccacuuugaucaucugguugaaguuacugggcacuuacuguuauccagagggaaagggacgccuguuugugggcagagcacaacuguuccuuuaugucggaugcagucgcugccacaaguaggaaaauauggagucagcugaggaaaaacaagaggcucagaaaguucacaccaugcaucagagcaaaaucucaccaagacuccuacuucagccaaaacuucccuucuuucuggcuucgcccauaccucuaguguugucaugcacauuuuccccuuggucacacaucuguaacaaagcccuaaagucaaaaccagugacccgagacccacgugcccaagacucccggggucugaaccuaaacuuuguacacguuacuaacauaccaguucgcuuaccuaaaagggcuaggucauaucuuaccacguagacaaacauuuccucuagaaaaaaggagcagcagugauccucuuggcuuccuucagccagugcuuuaggacaugcaagucccuguaguaagggaagucuaugguucuccagaaaaggguaguagccaucauacccuggcuggugccugcccccucugguguguuugagcacuuuuuaugccagggaaugaagcauggaagcuccuuacucuuuggggaguggcugugucccacuggaccuccuguguccccaccucaaaaacuagaguugaaagagacauacugagaggugaaggagcaccuacugcuccaacuuccuguguuccagcuggguccgcugcggcccagagaggacuggcagccccucuccagaguucauacgcugccuggaacucaaaccuucccauuucaaacccuuugcagcuucaucuugcaguuaaaggcuugcggaaguaaaaugguacugcuaucccugagugucugugacagaaaaugaaaauaaaaagugcuuuggaaggucagcagccauuaauacaagcaaaagggaccacaacugccacgucggccuccugaccucagcacgguggaggcugcagcgaaagagcccccaugaacgccacuuaacuggugucugcuggcagaagugcauuugacaagagagaacucauccuuaaaagcaaugaaugauggaacagucuucuaugucccuucccuccccagagcagcucacugaacuuuaccugcaccguagcaccuucacuauccccagucacuggaaucaccacugaagcucgcguuuguuucuucugguguggcuuaagagagagagagucaagaauuaugaggugccaggugcacuggcucaccccuguaaucccaacacuuugggaggccaaggcaggcagauggcuugagcccaguauuuugagaccagccugggcaacauggcgaaaccgucucuacuaaagaugaaaaaauuagcucggcaugguggcacaugccuguaaucccagcuaucuggggaggcugaggugggaggaucacuugagcccgggagguggaggcugcacuaagcugugauugugccacugcauuccagccuggaugacagagugagacccugugucaaccuccgccccccaaaaauuaugaggcacaggagugagcagauuucgaggcuuccagcaaagcagcuuugcuucccaaaaggacuccuuucacuagaccauguguaaagaagggcucauuuccugcuucggagacuuccuucuuucuaugguuugagguucacagugacaccucucaggaugcccacagggacuuguuuuuaucuguugaauucaucaaaguagcccagcacguuuggacaacacuguccccauuuuccuucaacacacuaaggaaagcuggaggacgaggugaaggggacgaagagaaaaaguaccucaaacaccugagaaaacccgaugauagugcuguguuggauaagagccauguaucuguuucccaggggagugguugugaaguucacuucuacugucuccucauucuucuuacaagcagugauguucggaucccacaggcuuccugugaguugagagagaaccauguagaugaacuugcuaacucuucccucauuuaaguuccccacagggcuuuauggaaacaaacccaaguucucaggaacaauguccaagagauagggacgcugcuacauagugaacuuuuuaucauuguuuccaaagucucaaaguacuugcugcccaagacaguuuggggauccguacaucgcugcuuugcuaaaaacagcuucccugggcugaguauggugggaggcacggauugguucugcuacucacugcuguuuucaaccucucuuuugaguuaagggauagggucaguauuuucuacuucccaggauggggagaaagagcuacagguuggaaaacaugucuaagauuauagagcaagugaacucacaaucaggacuacaaccacuagaauauuuuguguuccaggagcuucauccaucagaccauucugccagcuucacuagaugcaaagaaagaaggaaauggcucguagcuuagaggauauacccugauaggucugcucuggcagaaaaagucagucguuucauucaugugacuugcaaauaaggacuggacugauuuccaggaacaacaauguauaacagcagaaauuaucuucuccaccgaggagaccauuugaggcccuggcucagaacugucuuuaggaguucagguucaggacugacuucaaggcccucugaccuccucacaccugcaguguucucuguacccuuggugggaagcucagcguccaaaucugccuucuagcaaggacagcauggacggcugucugaaaggguaccagggaugccuugugcagugaagggugccuaagaguucugggcugauccaaauaccacuagccucauuagcauuccaacacuauauuacucagaaauuuacacaaacccuuggaaacugggcacuagggacuaauaauccuaaaggggauuacuacaaaauucaagggguaaaauucacuagccugugaaaagugauccucuuugaggacacaaauugagagcguaauugugggccaguccuuuagcgaacucacacucccaccucgaauguuugcuaauccaaacagaagguucuuaggauccccauggccacagguggguggugcuagcaucugagcagguggaagggcucguaggacucccaucaaucaggaagagccuuugauuggcacugcugagccauuugggcuaaaauguuguuaaccaaguggaugggggugguucuuugugacuguugcuccacuauauaaauguacugagggucuaccccuuucuggacaggcugcugcacucagugggcaaaguacuggcuggagaucaggagccauaggugcuucugccaccaccaucgggggugcuuggauauucaacucuccccuagggcucaguucuucugugcaaagaugaagagagcuaugcugccucaaguuacaaguuucuucaaauaauaaaagcaaaugccguauuuacuuaccggccuugacacacuuuuuuuuauauuucauuauguggucuaggcagccuggaaauuugaaugaaaguuuuuacauuuuagaaaaagguaucucugccccacccccuuugccaagugcacacacacauacgcauaccacaccuguaacaaauugccaaaacauuccagauguaagauggcaaauucaaauggggcucuaauuuuuuuuuuuuuuuuuuuuuuuuugagccggagucuugcucugucgccuaggcuggagugcaguggcgcaaucucagcucacugcuagcucugccacccagguucacgccauucuccugccucaggcuccugaguagcugggacuacaggcgcccgccaccacgcccggcuaauuuuuuguggggcucuaacauuuuacugcuaaacagagaacaucugcccauuacgugauaaccagagucuaauuuaaauacagccuuuaucaaaacaguaucuuugaucccuaagagaggacucgaaaaccauccaucauuugaaaaggacauuugguaauaucuguagaugcugccccuucaaggacaugaagccuaacacuccccuauccucaccccagggugggguagaauuagugacuuguuuccaaaaacgagaguugggaaaaacaguagauuuacauggagaagucuggcaguccccacauuaaucuaguguugauggugacccccagccuggugucaugugggugccauggaccccugaugggauaagaagggcccggcaccucugugguaugaauucccugucuaaucaugagacaaacaucagacaaacccacacugggggacauucuacaggaugccuggucagaacucaagacugucaacguucugaaaaacaaagacuaagaaacuguuacagaccagaggagagacacacagggacuaaaugcaacuggaacagaaagaggacauucaugaaaaagcaggugaaguccaaauaaagucuggaguuuaguuaacagacacguacuaauguugguuucuuaguuuugacaaauguaucaugguaauacaagacguuaauaggagaagcugggugagagguauauggaaacuguacuaucuuugcaacuuuucuguaaaucuaaaauuauuccaaaauaaggcuggguacgguggcucacuccuguaaucccagcacuuugggaggccaagguaggcagaucacccgagguuaggaguuugagacuagccuagccaucauagugaaaccccgucucuacuaaaaauacaaaaauuagcugggugugguggcucaugacuguaauccuagcuucuugggaggcugaggcaggagaaucacuuaaauccaagaggcggagguugcagugagcugagauggugccacugcacuccagccagggcaacaagagcaaaaccccgucuaaaaaauaaauaaauaaauaaauaauaaaauaaaagaauuccaaaauaaaaaagcuuauuugaaaacaaaaugagguuugcucucaucaagaaaguuggaaaccacguguaguaaauggugcagcaccaaaaacacccuggaccacaaucuccaagaccagcagugaauuggaaauuaccguuuggcuuugaugccuugccugugacagaugacaggauggugguaugggaugggugacucggcucagauagacccuucacacacaccauccugucucauccucaucacagcccugugugugacauugcagcugugguaccagagaacugguccugugucacaaagcuggggcaagggcccagcauccaacucaggaccacccugccucucauggacagcuuggggacaagccaacuggagucuguagauucucagaggcccagccauaugcagcccacucuagaaagcugagauaggaacgaacaaacauuuugcaucagugauauaaagaguggcucaggugcauugcucuagaaggaccaaagugugaaugucagcuucacuuuuauguguguauaacccagggaaagugacuuaaccucucaguuucuucaucuguaaaaugcagcuaucccaaccuugggguugcugagaugcuuaagugagaugaugcauaucaaguauucagcacagugccuggcauacaggaacagacuuuuuccuacauuuuaccugacuuuauucucucugcucuguggguaaaguaugguuacuacuguguccaugcuuuagauaagggaacugagauuuagcaaggccaaaagccuuauccaggguucccugggcucucucugugcauaucgcaaagcaggcaucccagcaagacaaagaauaauaaacaaaugaggaaguuuaccuggugaggugaaauucacagacauggaagggccaucuucauucauauuugcauuaggaauauuaugggccccaaugaaauagacuguguucagcucuacagggaagccgauguaggaaaauguccacugaaaggcaaagcaaggaacucucaauucccaaaacacugcaguacagaaacaguauaccuuaguguguugcccuuuuaguuuguauuucauuacucacucugugaaaacuuaggucuccaaccaaugucuacuuagggaaugggcacuaaacaauuuacagaaucagagaaguauaaaguuuuaaagccaggauauaauuuaaguccaauucucuuccauuggcugguagggaaaaacugaggcccagagaugcugacuuacaaaaggcacaaaacagagaaguagccgaaaaugggauuugaaccaagggaucuugcucuaagcucugagucauagcuauuuaccagcccgugugagcagcacaucauccaugcuccccaaacaaagggcauagcuuucagcaacaauuagccaaauacauaaaagugucuaugcccggauacaguggcucauaccuguaaucccagcacuuugggaagcugaggcaggcagaucgcuugagcacuggaauucaagaccagcaacacggugaaaccccccucuacaaaaacuacaaaaauuagccaggucugguggcucaugccuguagucccagcugcuugggaggcugaaguagaacgaucgcuugagcccagaagauugaggucgcagugagccaugaucgcaccacugcacuccagccugggugacagaacaagaugcuaucucaaaaaacaaaacaaaaaacaaaaaagugcuuacuuuaccaccagagggucuggucugagucuggaaggccucuguguaauugcaccucacacagcuguaggacuggaaguugcuuuugcccgucacacaaaucuugguggccuucaacaagcggaugcuggcugccgagauaggcaagaggacauugguuuauuuagcacuugcuguguggcugacuugaugcuagaugcuuuacuagcaugcuuuauuuuaugucucgguucauauucacaauaguacugaaagguaggcaccacugucuccaguuuacagaugggguucgugaggcuuaggaaguuucagggagcucugcuuaaacuuagaaaacucaucagcaaguagcagauacgaauucagauuccaaagcccaagcucccuccuccucauaggucagcuugaauuucauaggaugccugcaaagguggcuauagcucugcacuauucugggucucuuuuaagaggaagaggcuggccucagggagacccacaaagacccuccaagacugucaucaccaaaccacaccuguuccgauugcaccuuuauccaugcugauucuucucccugaagguccuuuccucccauuaucuaccucuucaaguuucacucuuuuaaagcccaacucacucaugcaccacagcccauaaccacagcugacaaagagcucacucugugccagguaagggcccaaacccuuauggccacaucucaccuaaagcaaccucaccagagacccuuuccagcuccucucgcccuaucccacucagaugaagcacagcucccuucugggacuccccugacauugugccugugucugccuccccuaccccucugaauccuccuggguggagacuguaggugacuccucucucugugccuggcacucauggauucuugaccagguagacuuuuuuccgaucugaauuuagcagauggaaaccaaaaggaugggcauuaggaucccaggaguagcucacugaaagaacucauauggugccuugcagcacaaucuuggggaaaugccaaaagcuucgugacgucaucugggaaguggaaaaguaaucuaucuaagccagugcuuucccuaaacugaagugggguggggaaaaucaucucucgccuuaccuuaucuucuuccaugaaguacauacacagaaaaguacacacauaaguguaccacuugaugcaucgggacacucaugcaaccaguaugcagguuaagaaacucccucaggugugcuccucauacuuccuuacaguuauuccuaccccagcaggaaccacuacccugacuuuuauuuuauuuuauuuuauuuuauuuugagacagucucucugucacccaggcaggagugcaauggcacagucucaacucacugcaaccuccaccuccuggguucaaguuauucuccugccucagccucccaaguagcugggauuacaggcaugugccaccaugccuggcuaauuuuuuguauuuuuaggagagauggaguuucaccauguuggccaggcuggucuugaacuccugaccucaaguaaucuacccgccuuggccucccaaagugcugggauuacaggcaugcgccaccacgccuggucuuuugcuuuuuuuuuuuuuuuugagacggaguuucacucuguugcccaggcugcuggagugcaguggugcgaucacagcucacugcaagcuccgccuccuggguucaagcgauucucgugccucagccucccgaguagcugggauuacaggugugcaacaccacaucuggcuaauuuuuguauucuuaguagagaugggguuuugccauguuggccaggcuggucucgaacuccuggccucaagugauccacccaccucggccucccaaagugcugggauuacaggcguuagccaccgcuccuggcuacuauccugacuucuaaacacuagauugguuuuguuugcuuggcacuuucuguaaaugggaucauauggcauguaugccugcaggcaugcacacagauauaaauguacaaacucuuuugaaucugccuuauguuugugacauucauccauauuguuguacguaguuacagaucauucauucuuguugcugugacggaauuuaucuggugauuccuuucuacuguugggcauuugagugcuuucuaauguugccuguuguaaguagugcuacugcgaucacccuaguauguggcuuuuggugcguguaugcauguauuucuguugguuaugcguagaaggggaauuaaugguucauauagucugcacauuucugauuuaguagacacuuugggccuuaucucugauggaugcaaacuuaccaucugcccggaguacccagcuuacauucaucaaaauugaauaguccccuguugcaacacuaguuguaacagguucuacucggaggucccucaagucuccggggauuagaucauguuguagcauccacucuggagauggcccugggaaaaagcaagacuuccaugacacugucuuucccagcccagucugaugccaugccaucuccucucagugacucacaccaaaccuucccccauucacaauuccucacuucuuuuuuuuuuaauuaaaaaaauguuuuuuguagagauggggucucacucuguugccuaagaugaucucaaacuccuggccucaaaugauccucccaccucagccucccaaagugcuuggauuauagguauaagccaccacgccugacccaauuccucaguucuuccugcuaaggccaaauguuucuuagcgcuggcugauuuauagcccagauaauuuugaucuaacagaaguacucucaaccuccuggcuuucaccua

SEQ ID NO: 17486 - RNA, 64252 nt, Homo sapiens
gaccagaauggcugacguaccgcccugccgcgaggcccgcguagaggcggaaguugaggggacugacgcagaugggggaauuuugccucgauggcacuuuccuguccgcgacuccgcccccaccagaggggcuaggcucugggauucaagauggaggcgcugagucgagcugggcaggagaugagccuagcggcccugaagcaacacgaccccuauaucaccagcaucgcagaccucacgggccaggucgcucuguacaccuucugccccaaggccaaccagugggugagugccgccuggcccugaggacggccacccggccgcugccgucucuuaaaggggccgcgcggguuacuguggggugggggggcacacuaagaggccagggcgguggagacgaggccagggucuggccaagagccuagccagagccugaggggugucggguccgcuugggauugggggauaggagugagagaaguggcucgagacaucccaaggaaaagccaguggaggggaggauuggagcaggaucagucccuuggcgucgggucuggggacgugggcgaccugccuucuuugcagauacauugggaguuauaagaccgguggggucaaaagggugccugaaagcuuguguuugaggcuuugcggauuauuagauaaauuauauguacauuaucuauaaaauaaacacuccuccucucccccuggcaaacguaaaugagagccccugucgcagaggucauuuggguuuaaaguuuaaaauccaauuaguuucgauucuuggaaggaggggguggguggguccggcuuuaaucgaacuacacagaguuucggaaaagauuccaaggcacuuaggaaaagggcuuccguguucacuggauccccgaagaccuuuguacaaacaagagagacccuguaaauguguuuuguuccaucuaugaugcuggugaugucaucucugaaugcuccccucggacucaguacuuucuggcuuucgugcacuggggaggguccgaaaagucacauucaguguguucacugauucuuguuagccccugcuugaagcuuuguuaguuguuuaaaaagcauaauuucccacuuucuuguaauugacccuuccuaauuaacucauucagcuacaggcuuuacacuuagaaaguaauacguaaaugcuuguuggauugaauucaccaaugacuggaguucacauuucaauaagauacgaaauccuuaaacugacagaacucuggaagaugaccguaguaugucguuuacccuauaauacaguugcauagauuauauuuaucaguaauuuaucgaaaaucauuuggcauuuaugaacaguuaauucagaugaagaguuuuuauaaucacguuguuuaucuuugccuccuggaagagaaggagauaugggaagccacaaggaauaaaauuguagauuguuuuuuaaauguagcuauuuuagacauugccuuaguuugaaauuuuaugaaucuuuuuucuuuucuuggccuauauauaaauuuugaaauauggauugccgacaaauggugaagacuuggggcuagaguuuuccuaguuuuucacaaaggcuuucaauauuuuaaaauuuuacauuguggaguucuguuuuaaauaugaaauacaagcuauaauaaccugaauugaaaaauaagcugcuacuguuuauuuggauccuggcacauagagcaugacaaaaaucuuuucccucuuuauuauuuuacagugaguuguaacuuugcaugauguuuuuuggugggcaaauuuucuuuuacuguaagacaguugauuaccaguuucuuauaguaauaaccuaacauuuuaaagguaagaaaaagccucugaauccuuaggaaggaaaauaaugauauuuaagcuaggguaguacuucuggaagaaaucgagaugaucaauuuucuaaauuuuuuaaucccaacacauucaauauaugacuaacauuuaaaauguuaauaaugcguugauuacaguaaaauauuuagguccauuguaggcuguaaauugcagacuaauaagcuuauuuauuuuuuaaaaaacacugaacuguguuuaaaaccuaaauacacucuugucacagaaaaugaacuaugguaaaggccuccaauaauuacacugaggcaggguauacuuucaguauucaagauucuucaaguucuaaaaauaacaagcugauuuuguuugguaguaauucuuaaccacaaaauuugcuaguugucaaaauguacgaaaacucccuagugaugaaacaaaguauccuauaagaaaguuucauuccuuuccuuuuuuaaaauuaacuuggauaaacuuaaaagagaagaaauugcaguauacaggaccuuagcuuuaaaguuaagaaaucuggcuaaaauauuuuagcuauaaaaagugaagguuuauucuaugauuuucuccuuuacuaauuaaaaaagaaaaauacugcagauacagauauguugcuggauuaaauauugcauaugcuuaugcacugaaaggauacauuagaaaugguaaccacaauuuguggaaugagagggagacuuuaccuguucaaaagugguuaauuuuauaauagaugaaaugaaacaaguugaucuuaaacgugaagcauuacuucuccauggggacuauuuggggucugauuauggggaaaaaaaacuaauugagucauugucuuucauaggagaagacugauauagaagggaccuuauucguauaucgaagguaaguuuuuaaaauauguauauuuguuuuuaacagucuaguggugaacaaugugaaacgguucaauucucuuguacauuugucuuuggaaccguccugcuaguacccuucaaguuuucaucuuucccuagcugugaaaucuuaaccagguucuuucuuuucucugagccuuucugugauucagaauaaacugaacuagaauuuauauuaccagccuagcaaagcaauuucaaaauaauaaugauugagucuaaaauggaugccugcgucucucuuccuacccccauauuagaaagaaaaagaaagauauauauuuggggaaaagacaauacauagacuggcucuguaaaauaauguuauugagaggucgaucccucuguucuuucauuacuacaugagugguugucuuuuaugacugguucuguccucuuucccaacccacagaaguucuggauuauguacagugucuuauuugagaguucuuuagaaagcuuggauuauucaugauggcguauuuuuuauuuuugacuuauucaaaaauucauuaucuuuaagauugguuugcaaauugcaacuuuuuuguuaggcagcuuuuggggccuaaagacaacugacaguauaugauagucaugggguacuuguuuuccuggauuccucuaaggucuuaacucuuacaagggcagguuccuucccuuguuuucuaaagcuuagggagucagcaggaguuauuacugauaucuggucuuuucccuuuuuuuuuuguauugaguugcuucauaaggauugccuuucuccauugaugccaauuuaaaagaauuugucaaauacucuucuaaauuuugauacaaagcuuugagaucucgucuaaaugcacucauuuuuuucuucuuuuaaguguaauucuuugauauuuguacaccaagcucuuuuuucuuagacacuuucuuuguucccugcuauucaucuuucugcuuuuaaaaaggaagggaucggccgggugcaguggcucacgccuguaaucccagcacuuugggaggccgaggugggcggaucacgaggucaggagaucaagaccauccuggcuaacacggugaaacccugucucuacuaaaaauacaaaaaauuagcugggcaugguggcaggcaccuguagucccagcuacuugagaggcugaggcaggagaauaucgugaacccaggaggcggagcuugcagugagccgaggucgugccacugcacuccagccugggugacagagcgagacucccucucauaaaaaauaaauaaauuaauaggaaaggaucuuuacccucacucccuucauuacucuucauuagcaauauaaaucucuagaaacucuguuauuagaaccuuaguuucuaugauauuugguaaaaguacuuuacuggcuuuauuguuaucauacagaggcacugauuguagaaaguaggagauuuaguguaguggguggcuggauuuaauacaauucacggaggcuuauaugguacugauucuaauuaaaggagacgcaagaaacuguguuuggaaaaugugagacuauuuugcguaccuuggauaaagguauaccaggaugucagacugucacuuugcagcuauuacuucauauaguagaagcuuggauuuggagucaaaaaaccugaaacugaauccuaguuauauuauuuguaacucauuauuugugugaccucaggcacaggccuuaucauucaaagcuugucuccuaaucuauagaauaguguucuguuaacaccccggguauaucguagagaaacaaaugaaaaacggugaaguguuagguacaugugaagaguaaaggaucauguaccgaaucccucugauaugggaaccaaggauguuuccuauuguaggauucaaggcauuuuccgucuaacucaggagcgcuauguaaauaucuauuuguugcaagaaaaacauuauuguaaugaugggcagccauuauagccaauccaauugaaugauauuucauucagcaacugugugucuaucuugggauauauguaugaaaaaaguaagacaaaagcuccauuugcauggggcuuacauccuaguggggggaggacaauaaauacuaaaaauaagugguauggauaaaagaggaagguuagagauauugagcuugggagcauuaaaaaggauaguucaaguaggccucaugaaaaaggugacaucugaacaaaggcuuggaggagaugagauagcugugcagcuucuggggcaguaauccaggaagagguuuuuagguagaagcacacacgcagagagaguggcaaggagcccgguguggcuggagaguaggagcuggagaagagccauaggaaaugaagucagaguggggaguauaucagguggggccuugguggccucaguaaggacuuuggccuuuacucugagagacugucuuuggagacuucucgucagaggaggaguaugaucugacuuaaauuuuuuguuuacagauguaagugcugauaauauuguauaauguucuaaugcauucuuuuuugaaaugaaaauaaaguacauaguagauaacauuucuacagauuaaaugguaacuacauauuuuuuuuucuucuauuaaaucuaaggucagcuuccccuuaccaugguuuuaccauugugaaucgacuaaauaugcacaaucuaguugaaccagugaauaaagauuuggaauuucagcuccaugaaccauuucuucuguauagaaaugcaagcugugaguauaucuguuuuauuauaguuauuacauuuaaaauugagugacuuuaguuucuaucaauccauuauuuaggaaguuucaaauuacaaaacaaaauauggucucuacuuaaugauuauaaaugagucuguuggaaagaucaaaccuuuuaaacugggcucugaggccagaggugguggcucaugccuguaaucccagcacuuugggaggccgaggagggcagaucacuugaggucaggaguucgagaccagccaggccaacauggugaaaccccguaucuacuaaaaauacagaaaaaaauuagccgggcuugguggcaggcgccuguaaucacuugaaccugggagguggagguugcagugagcugagaucgcgccacuguacuccagccugggcaacagaaugagacugugucucaaaaaaauaaauaaauaaacugggcucugaaacuggaaacauucuuuuguauauaauuuaguuuacuauuucauuuaauagcacuacauuucuguugucgguuuauuaaaauaagguuuaugccuuuguuuuuuugcagcuguggacuaucagcugcccaugucccuaagcaacagaacuuaguuugggacacacaggaugggaacagauacagauaauucuuuccacaaagaaaguauuauuauuacuauuauuauuuucuuuuuuuugagacggagucuugcucuguugcccaggcuggagugcaguggugugaucuaggcucaugcaagcucugccucccggauucaugcccuucuccuggcucggccucccaaguagcugggacuacaggcacccgccaccacgccuggcuaauuuuuuuguauuuuugguagagaagggguuucaccguguuagccaggauggucuugaucuccugaccuugugaucugccugccucggccucccaaaaugcugggauuauaggcaugagccaccacgcccggccagaaaauauuauuuuugcccagaauaguggugauggguuuuuuuuuuuaagauauuuauuacuuuuucuacuuuauuuugucugaauauguuucuaaguaagguuuuucuaucuguuuauuuaauugagugucuacugguuaccagcacugagccaagagcuguggugcuuuaauguuaacgauacaguuaccuaugugguguaagcaggcaguuaagucaacugagacucagagaugcauaacuauuacccuguuggagaguuaggauuaugacuauucuucugcuuuuuaguccaggguucuuucaggcauuuuuacaaucucuaauaacgauuggauguagucagcaaagcuagaguggcccuuccaagaaacuacaguacuaaaaaauauacuugauuccaguguauuaguauggauauugaagguauggguguuugaggacaguuuguuggacauugacuauagggauaugaaaacugguuaugguaacaaugauugugcucuaauuggcaucuaaggauauaguuggagaaauguugcuucuaacuuaaaaaguaaaaguuaauguguuugaauuucacuuggcggggggguaauuggucuugggggaugucuucaguauaaaauagaaaaaguuacuaaaaauuauacaccucuuaauucccugaaugagaaguaacaaggccuauuuuaaagcuagaaacccccaaguucuuuuccguagcacacuuugaaguauaagugaaauagguucuaucuuuugacuucucaguaaacuauuuguccagguaauuaccucucagauuuuaaauucuguggacauauuagacaugcuuuguaauagcuguaaguucagauggauuuauuuaaacuaauguuaacaauguaauuauuucagauugcucuuuucuuuguacugaauauuccauuaaagggaaaauucggcugggcaaaguggcucaacaccugcaaucccacgauuuugggagaccgaggcaagcagauugcuugagcccaggaguuugagaccagccugggcaacaugucaaaacccccacuccacaaaaaaauagaaaaauuagccagguguggugucacacacuuguagucccagcuacccaggaggcugaggugggaaagucgcuugaacccaggaggcuguccaggcugcagugagccaugauugcgccacugcacuccagccugggcaacaagcgagacccugacucaaaaaaugaaaagagggugggagaaauucugcaaaugaauauggauccaauuuuuuuuuaagugaaauaggcuuaauucuguucuuuacugccuggaaacuuaaucuagccaucacuccuaagugguuugauuauuaaaguagucaguagggaaaguuauccggacccaguuaccauuuagcauaaaccugagaugaauuguauuauauuuuuuucacaaggcaaaaguccugugaaauugaaagugugacauaacacaaauguaauugaaccaugaguaaccagaagcuaacuaauuagagcuucaguugucuggaaauauuuuuauaguucguguguggaagaaaugaaggcaaauuauaagaaaacaagcuaauacuagguuuuauuuucugaaaaucaagcagauauccagagaauaaccuggggucggcauuaaaaugucaauauuuuauaacuuuaacuccacuguaguaucauagguuaaauuguuauagugagaccuaaaaucaucaggaguauuuauuauguuaacuagaacauucuuggggagaaagugcauuaaugcauuuuacuuuagaaaauuuucaacugauugaaacaaaaguuuucuuaguugaacagaaaacucacuuaaccaggucauuucauuagggaaaguauuuaaaggaauagcuguauuggggagaagugauaagacaacagaaaaugauuuugugaguguuaagcccucucgaguguguguuuugucuacauagucuuaaaaguggaaaauagucuugucaggucagcgagcuauuaaguuguuuagggauuuguucuuuaaauaaaaaguuaguaucugauuaugcauacagguaauuauaccugauucuauagcugcacuucugccauucucuugugggaaauaccaucaagacaccugacccauuuaacucaagugacaccuucauauccaacuucuuucauucaaauuaauuuuuggaguuaauguacuagaacagugaaccauaacuuuuuuucaguucuaaguuauuuguuuuauuuauuuuuaagaguuuuucuuuuuuuuuuuuuuugagacggagccuugcucugucacccaggcuggagugcaguggcaugaucuuggcucacugcaagcucugccucccagguucacgccauucuccugccucagccucccgaguagcugggacuacaggcgcccaccaccacgcccggcuaauuuuuucuauuuuuaguagagacgggguuucaccguguuagcuaggauggucucgaucuccugaccucgugauccaccugccuuggccuuccaaagugcugggauuacaggagugagccaccgcgcccagccaagaguuuuucuuuauaaaacaugcccaucuacacccaccccaccccucaagaaaaagauaaaaucuuaaagagaaaauucuuacacugacuaagggcuuaggcuuggugauucucuuaaaucuuugugggguaguggugguggugguggugguuguuuucaaaagacaaggucucacuguguugcccaggcuggucuugaacuccugggcucaagcaauucucccgccucagccucccgaagugcuagcaugggccaccauguccagccucuugaaucuuuugggaacaguguauuuuuauucugugcaagggccuuuuggcagucacaagaccccagugggauugcaaugaauuauggggagguuauaaauucuggaguuauugaguagcagugguauuucuagcaccuuauuucugauccucaacuuacagguugagaaaacaagaggcucagagcuguuuaggaaucugcucgagauucgcaaagguaauaagugacagauggagaauuugggaguaggucuuucgggcuucaaggccaauguucuuuccacucuacuguaacaauaaaauuacuucaucaauccauauucuagaguagugcuauccacuaaaacuuugcaauuagggaaaaugauaguuccgugucagcacugucccauauaguagccugcaauguggcuagggcaaaugaagaacacuucuuuuuaguuuauuuaauuuaauauauuagaauuuacauggcuguaugugcuggcagcugccauacuggacaguggaagucucagcaugagcucaugugcuaacaugcucuuuguugugccauaccugaaucaaacaacuacuugggaagcuuuggcuuagauuuuuaugcguccuauuuagucauuccuuuuugaaacuuacaaaugauuucuagauacaaaagcugcagaauauaucccugaggguggcuuugccaugguaacauucuuuuggcauggaauuuaguuugcagauaagaauucuauucugggcuuugccuuacugacuauaaccuuggcuaaaucauuuaaaccacugauuugaccuauuuaucuuaaaaggccaucaugaaaguaagguauuuuguuaggcauuuacaaauacaaaauaucauagacugugucuccauucuagacucaacaaaugaucucauuagugaaagaauccuagggacaucaguguuauccacaccuggccuauccagauucucuuauaacacaggccugugauaugcuucuuccuaucccuucugauaguaccaugcaugagcugcaggcucuuugugucucuuuacaaguauuauuuucaaauguuguaggggccauuacuagaaagccugagguauacauuggaaaaauauauauauuaaaaaugagaagucuuggccagguaugguggcucacgccuguaucccagcacuuugggaggccaaggcggguggaucaccugcggucaggaguucaagaccagccuggccaacacggcgaaaccccaucucuacuaaaaauacaaaaaaauuagccggacaugguggugcacgccuguagucccagcuacuugggaggcuaggcaggagaaucgcuugaacccaggcagugaagguugcagugagccuagauggccccuuggcacuccagccugggagacagagcaagacuccaucucaauaaauaaauaaauaaauaaauaaauaaauaaauaaauaaaucugggcuuuggguuagaaggaagaugucuuccuaaaaaauaaccaugggacuucccucauacaaauuuaagguucaaguuguaccauucauuuaguaucauuucuuacccaggucaagaaauuaacauaaaauuaaucaucagcuggugauuacucuacggcaucuggcagaagcaaauguagaucccuucuggcaagauacauucuuagcccagccagguugcccaggaauaucaggcaugucucauggucuaaaauuacuaaauauacaaggaaauacuuugcagugaaugaaagguagcauauaacaaacagcaggauuauacaacccuucccaaagacuuuaguucauggaaacuagagacucuaauggauguaaauaccagauacagauuauaaaauaaaguaaaaagaacagcaaaugugaaaaaagaauaaaggcccugugcgguggcucacgccugaaaucccaacacuuugggaggccgaggcagguggaucaccugaggucaagaguucgagaccagccugcccaacauggugaaaccccaucucuacuaaaaauagaaaaaauuagccuggcgugguggcagacaccuguaaucccagcuacucgggagagacugagucagaagaaucguuugaacccgggaggcagagguugcagugagccaagaucaugccacugcacuccagccugggcaacaagagcuaaacuccaucucaaaaagaaaagaauaaaaugcugccaggcacaguggcucacacuuguaaucucagcacuuugggaggccaaggcgaacagaucacuugagcccaggaguucaagaccaacaugagcaacauggcgaaacccugucucuauaaaaaauacaaaaaauuagccggguggaccugggaggcugaggugagagaaucaccugagcccgcgagguugaggcugcagugagccaugaucacgccacugcgcuccagccugggugauagugagacccugucucaaaaaauaaaagaauaaaaaagaauuaaaugcuauuaaaaaaaaggaagauuugaaaaauugcugaguagaacuaauagaaauuaaaauuuuaauugaaagauacucucuacuuggauucaacaguuaauugguaauagcugaaaagagaauuggugagcuagaagauauaucugaggaaauccagaauguauccaaaaaaaggacaaaauggaaauaugacagagugauuagaauuauaaacucuaacauuugauggauaagaauuucagaaugauaaagcagauuuguagagaggcaauauuugaagcguugaugacugggaauuuuccagaauccauaaaagacauaaaucucagauuuaaacaauagaaugagcuccaagcauaaaacauagaaauauuagccggacacuauggcucacgccuguaaucccagcacuuugggaggccuaggcaggcuggaucacuugaggucaggaguucgagaccagucuggccaacauggugaaaccccaccgcuacuaaaaauacaaaaauuagcugggccugguggcgggcaccuguaauuccagcuacucaggaggcugaggcaggaaaaucgcuugaacccgggagguggagguugcagugagccgggaugaugccacugcacuccagccuaggugacagagugagacucugucucaaaaaauaaauaaauaaaaauaaaaaaaauauauauauauacacaugcgcgugcacacacacacacacacacccagacacauucugaugagaugucaaaggcagagacagaagcaaccaaagguugcucaagauuggguguuuacaaaggaacaccaguuagacugacagcauauuccauaguugcagcuacugaguuuagaagacaaaagaauaauauauugagaggacugaagaaaaaaaaaaaccaauaauucaguaaucgaagagaacaaaauaaagauacuuuucaacaaaaacaacagcaguugucuccccagauucuugcuguaggagcucccacagcagugcugucagugcaguagccacaugugucuauugagcauuugcagcgcgugacggguaaaagcagacaacugguuuuucucuuucuuacagccaaacgcuccacaguauaacaugauuaauugaaaauauuaagaugcaggcuugugguaccaucaagcucuaugaaauugguucuggcuuuuaaugauuuuauuuuguaaaaaacaguaacaaacuagaagcuguucaaaccuaagcauuccaagauugugaugacggcagauaaauugauuaauaagguuuuguguauucaaaagauuccaccgcagaacauaaauaggauauuuuaacuuucaaaccaauaaaaaccaggaagugggaaaaaaguaaauagaaaccaugggaaaaagaaagcccaaaauaaaauggcagaaaucaaucaauuuagaacaaauguuaagugaacuaaacuugccaguuaaaagacucagauuggauaaacauauagaauuugccuacauacuguuuuaauauuuuuaauuauuuuuaucuauuuauuuauuuuuuagagacaggucucgcugugacacccaggcuggagugcaguaacacaccaucauggcucucugcagccucaaccucugaggcuugagugauccuuccauuucagccucccaaguagcugggaccacaagugcacgccaccacucccagcuaauacguuuuuauuuuuuguagagacaaggucucucuauauuguccaggcuggucucaaacuccugggcucaagcaauccuccugucuuggccucccaaagugcuggauuauaggugugagccacugcacuggcccuguaugcugguuucaagaaacuuuaaaaacucuaagaucguggaaagguugaaaguaagcaauagaaugagauuuaucaggcagcuaucaagcaaaaaaggcuggugucucugugugagucauacacgguaaacuguaaagcaaaaagcaucauuagggauaaaaguuaccacauaaugaugaaaggaauaagugaccuagaagauaaaauaauuuugaaugauauauacuuaguauaugucagaauugcaaacugaauguuaaaaaucccuaauuauagugacagauuuuaauaagccacuuuaguaauugacagauaaagcagacaaauuuuuuuuuuuuaagaguuaggguuuugcuuuauugcccaggcugucucgaccuccuggccacaagugauccucccaccuuggccucccaaagugcuaggauuacaggugugacccaccacaucuggccacagacaauaaaaguuauuggauaguugaacaauacaguuaacaaaccugauaugauggacauauaaaaaacccugcuggccaggcgcaguggcucacgccuauaaucccaguacuuugggaggccgaggaggguggaucacgaggucaggaguucaagaccagccugcccaagauggugaaaacuugucucuacuaaaaauacaaaaaaaaaauuagccaggcaugguggcaggcgccuguaaucccagcuacucaggaggcugaggcagagaauugccuaaauucgggaggcagagguugcagugagccaagaucacacuacugcacuccagccugggcaacagagcgagacuccaucucaaaaaaaaaaaaaaaaccaaaacccugcugcugucagugaugaaaauuuugucuaguucugcuacugacauuaaguuaugauaaagucugucugaggagaaaaaagaaaaaaaaauccuacuuuuagcaauuagagaauuuacauuuuuuucaaguauauauuagagguuuauaaaaauugccacauauaggccauucagccaaagaauuuagggaggaaaauagggaaaucugaguaaaguugaaggaaaauaaagaguagaaauuaauugcaaaaaguagaaauuucuuuuuuuuuuuuugaaacggagucuugcuuugucacccaggcuggagugcaguggggcgaucuaggcaagcuccacgacccggguucacgccauucuccugccuuagccucccgaguggcugggacuacaggcacccgccaccacacccggcuaauuuuuugguauuuuuaguaaagaugggguuucacuguguuagccaggauggucucgaucuccugaccucaugauccacccgccuuggccucccaaagugcugggauuacaggcaugagccaccgcgcccggccuagaaauuucaauagaauagagcagaucaacaaaacaaaaaacuccacuauaacaacaaccauaaaaagaacaaggggagguacaauaugcaguauuaggaauaaaaauauaaauguguuccaacuaaaggaagagaacaugcauuuuuaaaaacaagaagccacugugaagaacuuuugccuguaaauuuaaaacuuggaugauaaagacaguuuccuaggaaaacauaguuuaacaaaaauuacuuaggaauaaauagauuugaauggacucauaaauaaaauaauugggccaauagacuaaaaaucucucccaucacuucuaaagaaaaugcugagaggaauguucuauucaguaaauggcacuaggacuguuaguucuccauguggagaccagccucuguaaagguagcuaugggguucauacacuucuggucuaaucuucaagggaaacuugucuccaaaggccacucuucugugaugaggaaaucaugcuucugugauucacuauucccucagcaagguggugagcagcauaccucccuauuauacauaccugcuacaagcaacauaccucacuauuagguuggugcaaaaguaauugugguuuuugcaauuaaugucaagaaacacaaauauuuugcaccaacccaguacauaccugcuacaagcagcacaccucaccgaguaauacuucucuuagaagauguuuuuccucaagaccagugucagaggucuuuugauuuucacuguggacaccucuuaggaauaaaaguaguaauggggaaucuuuuuuuaauaucuaugugcuuaccuaucacuuaauuacaaaaugccccaagaauauucugugaaguguguucugaggaauuuuuuaagaaucuaaacccggcaugugaaucaauaauaaaguacagucaugagucacuuaaugucacuuaacaacagggauauguccuaaaggcgccauuaggcaguuuuguuguaugcacaucauagaguguacuuacacaaaccuaaaugacauagccuacacaccuagaauauaugguauugcuuugaggcuacaaaccuguacagcauguuacuguacugaaugugagaggcaguuauagcacauugguaagaauuuguacaucuaaauacaucuuaagagaaaacguacagugaaaaugugguauuauaaucuuaagagaccacuguuagguaugcagucugucacugaccaaagcagcauuuguggcacgugacuugcaaaagcaaacagaacugauuuuucucuuucuuacagcuagacagucuacaguauaaccugguuaauugaaaguauuaauaauauagguuugugguaccaucaggcucuauaaaauugauucuggcauuuaaugauuuucuuuggcaaaaacuauuucaauauugcauuuugggccaggcgcagugacucaugccuauaaucccagcacuuugggaggccaagccaggcggaucacgaggucaggaguuugagaccagccugaccaacaugguaaaaccccauugcuacuaaaaauacaaaaauuagccgggcauggcggcacgcaccugcagucccagcuacuuaggaggcugaggcaggagaaucacuugaaccugggaggcagagguugcaguuagccaagaucgcaccauugcacuccagccugggcaacagagcgagacuccaucucaaaaaaaaaaaaaaaaaaauuacauauacuccaucucaaaaaaaaaaaaaauauauauauauguguauauauuguguuuuaccuuguuuuuaaccaacgugauuaacucggauacauaccuuaauucagugacauuuauugaauaugucauuugccaagcacuuuaccagcugcuauaccauauagauuaaaacuacugugcgcuuauaaagaauuuuguuuauauuuuuaguccuuagguucuauuauauuuucuuagaaaauuauaagcugaaguuacuaaacugcguuagaacuuucuaugucaaaacucugccuucuugguaagggugaagauucuuuuuuuuuuuuuucugagacaaggucucacucuguugcccaggcuauaguguccaaaugauccuccauccucagccacugcccugaguagcuaggacuauaggugugagcuacuacaccagcuaaauuuuuuucuuuuaaauagagauagggucucugcaaauuuuuuguagugauagggucuugcuguguugaccaaccuggucuccaacuccuggccucaagcgaucuucccaccucagccucccaaagugcuaggauuacacuauagccacugcaccccgcugggucaggauucuuaaugaaaugugcuacuacaguaagcccaaagcuaugcauguuuauucuuaaaacaacucccuguagauuaaugauaaaaauuaaugauuuaaggucugugauuugagaguuauugcuuguaaauuugaaugacugggcuaguaacagugacagucugaucuaccagagagacaguaaggguauguacauauuuuuucuuggucauuuucagcagcaguacucacccauuguugggaaagaguauauggucuugauuuucucuucucagaccuaaccuuauucucaccauagaccaguguguaaugguaguuuuaaccaaaaacaaugauuguuuuacuuuaugugcauguuagauacggcaucuuuuuacuggaaguuuaucauuuauaaggacaacuuuuucauguuuccuucauguaacacccuaaggcauguaucucccacuuaaugccacuuuuuguauuuuuuaauguuuucuguaaaaccaaaagcaguuuugggaaaauggacaaagcccuuuugaguuuuucaaaagaacacagacauuucccgaauuuuauuuuaccuugacagguuuaaacaauuacaaguuugugguuuguaugaaacacuuucaaagugauccuaugugaguaaaaucugaucugaaauuuucuuaaaaaggaguuaaugucauauaucuacuagucuaauauguugcucuuuagcuugcuuaaccgaaaaagacaauuaccucuuaaguauaauuuaaaauguuaaauauuauugcuauuuaauauuuuuaagaacuuaccuccaaaagccagagagaaguaccccuucguuucugcuucacuuaucacuuuuccuuuauaucgggcaucgaucucuugauacauagugcuuuuaaugaaaauuagaucacuagaaaaaguagggagguucauuuccauaguguugaaaaugccacugccaaauggaaaguuuuaguagaagaaaugcuguagugugugcuuuuuuugucucucugcuuguccuuucucaguucaagggcaagucucagaacaguagagaugguagguggcuguuggcauuuggagcaaaucuucagacuuuuaaagcacagcgcaagaaauuuccuuacaagauaaguuuacaauuuguccaauccaaaaaugugaguucucccuccacacugaaagaggaauucauaaacaacaagaaaauuuccgugauucauucuuugauaucuuugaauucagugcaguacuucuuucuuagccugaagaaaggcagucuuccaccaucaguugcggcaccgcugugcuugguaugauucuguaaucagugaaggagaaagggucuguggcaacugcauuagucuggccuucuggaccaagauaaggaaagagccuugcuguugccacauuuguagauugaagagguaaaaucaccacgaaaacauagagggacuuaaggcucaguggcugagucugacucagugacacuguuaguucaaauguuuuaaaaauacauauauugcuuucuggcucauuguaggcgcugcuuaguauucugguagagccuuuaccaagugccuucuugguaacuuuguaaauccaugaacauuucagaauuuccaaagcagauucuuuucauuaugauucacuaauuacuggcuuuuuccuccucagguaguguugucagauaaaagcacuuuuuaucuuuuuuuuuuuauugugguguuaucuaaauuguaaagauuuguaaaguuaaccaugccuguaucauuuaucuuuuagauaauuauguuaaauauucaauacuucaaauguuuuuucuuuugagaacucacaaaggaaaucauuguuuguacuuaagugacagaaauauguuaacauguaauauguagguuuucaccuucuguuuacacaaugaaguuaucuguguagguaaaaauugaaacagaguaaccgcuagucuaagcgaagcuccucuggagugugcagaauaaaccuccagacugggcccuucagguucagugugcuggaggauccaggcaggucugagucacuuacaaagucacugcuuccaggcaugcucagcuucugcuuuuucuuuucuuuuuuuuuuuuccugagacggaguuuugcucuugucacccaggcuggaguacaguggcgcaaucucggcucacugcaaccuccaccacccagguucaagugauucuucugccucagccuccugagcugggauuacaggcacacgccaccaugcccggcuaauuuuuguauuguuaguagaaaugggauuucaccauguuggccaggcuggucuugaacuccugacuucaggugauccaccugccucggccucccaaagugcugggauuacagacgugagccaccacgcccggccuuuguuuuuguuguuguuguuuuuuuguuguuguuuuguuuuguuuuuuugagguggaaucuugcucuguugcccagacuggagugcacuggcacaaucucagcucaccgcaaccucugccucccaggcucaagcaauucuucugccucggccucaccaguagcugggauuacaggcacaugccaccaugccuggcuaauuuuuuguauuuuuaguagagaugggguuuuacuauguuggccaggcuggucuugaacuccuggccucaagugauccacccaccuuggccucccaaagugcugggauuacaagcgugagccaccgcacccggccagcuuuuucuuuuuaauaaaaggaaagcacaggcuaagcauuugcuaccaacauuuaaaaauuaccauauuuuauacauccuuaaccuggauuucugauuuuucuugugauaaaaugacgugugugaccacacagcacuuggauuccugcaaguacugcagucagccagaauuguagguaagacauuuucaucacugaucucaccacacccugaggucucuuauaguccgugagguauuugugcuuacaacccugcuguggaugaucgauuaguaaauugguagaaaaauguguaggagaguagaaguuagggaaaguagagaaaagaaguucccccccuuuuuuacaccccaucugaccuauuucccagaucccuaacuauagauuuuuggaagccuaggaaaugggaauucaaauccauggaggucaggggccaugcuucccccugccuuugucucucccuuaugauacauaaagaugauauuugugugggauacuagagcgacuagaauaccaguugggggggggggguuggacauguccaacauuuggcagaaccguaaucauuuacaccagcauuccccaaccuuuuuggcaccagggaccggcuuuguggaagaccauuuuucaauggacggggauugggggauuguuucaggaugauucaaacacauuacauuuauuguguacuuuauuucuauagguguuguaauaaauaaugaaauaauuaugcaacucaccaucauguagaaucagugggagccuggagcuuguuuuccugcaucuaaacagcaguuccaucuggaggugauggaagacaaugacagaucaucaggcauuagauucucauaaggagccacaaucuagaucccucguaugugcaguucacaguagggcuggagcuccuaugagaaucuauugccacagcugaucugacaagaagcagagcucaggcaguaaugcucuguugucugccacucaccuucugcugugcagccugguuccuaacaggccacagaccaguaccaauccgugacccugagguuggggaccccugauuuacaccacacuuuggaagcuguauuuuaaggagcuauggguacuguguggcaguagcagauauacauccuaacagcaaaggcaaaacccuagugcaauucacuguuuuacuuaggguugcccauuguuuaagaauaaaacuuuugcaagugggaguaaucaguugugauauuguuggguuuauuuuccuaauuccuaaagaaguucaauggucauuucaugugucuaaauucuguacugagauuauaauguuaaugggauuguggaaggaguauuucggguuaauauauucagauuugauuuaauuuagacagaggcaccaaauuuuuaaaugauaaacugaagaccuugaagaguagcauuuuaaaauuaccuguccuaagucuuuuaaucauuguucaauauucaauaaguagauauuacaauuuaaauuuuagaaguuggacucuuucucuaccauauuaguguucagugguggucugaaaugaguggguuuuuuggccaaaaggguuaagcugcaaagauaauugaaugacauuuuccagaguuucuugcggauauacaacaucucaucuaccuaaguguuuguaacaugccaaaaucuguuaugaucccacgucagucagucuuaggcuccauauccuuuuuccuguguguguguuuucugccccucuauccuagagccuuucuugucuucucacucuuuccuaacccuuugauguucuuagagagccuccaugcuuauucuugucuuaaaggaaaugaucugcugaggcagagguauuugccuuuucacuugccaggccugacuuauguuuauauaccuauuccauuuuucuauauaaaaaauguauuugucuauacccaaagcccguuuucuuguuuuuguuuccugguguaagagaucuuugucaguaucaucuuuagaaauugcauaacuuuuuuucucuuuauuuauuuucucaagcacagaguuucaggaaaaagaaauuuuauaacucuuaacaucaccaccaaaaagcuuuuuauuaaaccaccuuuuugcuuggcaccauacugagaaaaucuccagccuccucagauccuucuagaaaguagguuagaucuaaauaauaaaugaaucacaaagacaacauauguaugagagugauucccagcucuguuucugugacauuucacagcaucucuagaagucucaagggauuuuacgaagauaccaaauuaauuuggcuuuucuugaucuugugugagccauguaccucucucaagaugagaaacagugaaauauuuuauaugaaaucauaauagguugcuauaucuuuaaacgggucuaaggaaauagaaaacucuuacucaaaacuccacuucuuaaaauuucucaauacaaaauaguucaaauaccuuuaauuuuuguaauuuguauuuuuuuuuacauuuucaaaagaaaggggccuucauuugaaaagcaaaggaaacauuuaauguuugauauucuuagauggaucuggauauuuuuuguggaaggcaaugaaauguccuaucacaccuccuaacuuuuuucuuuuuuuuuuuuaguuaacaaauuuuuaaaaaauaaacaaggucccacuguguugcccaggcuggucuugaacuccugggcucaagugaaccuccugccucagccucccaaaguguugggauuagaggcaugagccaccacacccagccaacuuuucaaugacuugucuauccuaugcaacaugacugacuuaggauagcuguuagcagucacaaugugugguagguauccauuaaguaaguaguuucuuucaucuugagaaaggccauuuguaaaacagugugccaucauuugccauagcaaggcaauacuguauugccaaaagccugaauucucuguaggauaguuaaucagagaaauuuauuucagcaagugaauuguuggcagaauguguugggccuuagaguguaaguucucuagagggaagaaugcuuagcuuugguuuaaaggggagguccucugcaguuuuagcuaucuggugaacuugucugucuuuccucaugagugacagugacaggcuccguggcagcucccugggcuuucuugccaguugcacgcacugaccguuugauauguuggcagacagagcugauucuuggaugcgugucugaaccucuacaggucugcuuuuggcagaaucgagugugacucuuaucccuuacccauuaagcuaucauuauggcuuucuuaucuuuauuucuucugcaaacaugccuuugaaaguguuuggcucuuuuuaggcaguuugauaauauacaaaagcagaaggcaugugucuuauuucuaaauuauauuguauuuuuucaaaggaaaagaggacaucuuaaaugaagguuuuucaaaauaaguugacagcuuugauggacuuacuuugauuauugauaaguaguucuuuccuaagaguucgguuuagaagucccugugaaaauacacuuaauugcuucuguuuagcacagaaaaaauuguguguuccucucuaagccugauguguugcauaucauaaacuuuuuuuuuuuuuuuuuuuuugagacagagucuuguucugucacccagacuggagugcaguggugcgaucucggcucacugcaaccucugccucccggguuuaagcaauuccccuuccuuagccucccgaguagcugggauuauaaacaugcaucaccacgcccagcuaauuuuuguauuuuuaguagagacgggauuucaccauguuggccaggcuggucuccucaccucaggugauccacccaccucagccucccaaaauucugggauuacaggcaugagccacugcacccggccgcauaucauaaacuuuucuuaucacuguguauuguuuugguauguccagauuaauauagcuuauugaaggaaaacgaauuuuuguauuuggacuucaguguuugggguguucauuagccaagcuuggaagaagcauauuucaagaaagguaguccuauguaauugccauauauggagucuuuuuaaagcccugaucugauuuacuguaguuagagcaagccuuagccgcuaagagcguaacuaagaaccugcaguagauaaugcuuaauaauuaucucuguaacaaggcugcuucugugcuccuuccauugagauguuaaagcugagugaauuuguugacuuaccaugauguaaaacauuccaaaauuacuuguuauucauuggaguuugauucuguuuggagcacucaacucugugaagaaaagaggcacugugaaaauggauuccaaacaugggaaacucggccgggcgcgguggcucacgccuguaaucccagcacuuugggaggccgaggugggcggaucacgaggucaggagaucgagaccauacuggcuaacaugguuaaaccccaucucuacuaaaaauacaaaaaguuagccggguguggugacgggcgccuguaauccccgggcgccuguaaucccagcuacucgggcggcugaggagaauggcgugaacacgggaggcagagcuugcaaugagccaagaucgugccacugcacuccagccugggugacagugagacuccaucucucaaaaaaaaaaaaaaaagcaaacaaacaaacaaacaugggaaacucuucccagcugguugaaggcucagagacuagugagccuggacuuccuucagguagugcaccacuugugggacacauggccauacacgggcuccauagauuuagagcaguuuuaguguaauuagagguuuuucccugccugagaagcccuuuguaaacaggguaggaaaaaaaauucuuguucaugaucuucauucauuaaaaugaagccguucacuugcuguguguaucaauaauauuuucauuaacucuacaauaacaauagaaagacucaaaauuauauuucuguugagaagggaacauacauauauauauauauaauuuuuuuuuuuuucugagacagaguuucacucuuguugcccaggcuggagugcaguggcgugaucucggcucacugcaaccuccaccucccaguucaagagagucuccugccucagccucccgaguagcuggaauuacaggcauccaccaccacgccuggcuacuuuuuguauuuuuaguagagacggguuucaucguguuggccaggguggucucgaacuccugaccucaggugauccacccgccuuggccuuccagggugccaggauuacaggcaugagccaccgugcccagccgagaaggaaacuuuuaaaguuaagauuugccaugaagucuuuuguggaauaaugggcuuaauucagggugaaacaaauaauugagcauuaaaauaacuuuuaaagcggugguuuucuaaauugguauauauugauaauuauagaauucaaauaauaguuauaaaaaugauuuuuugauuuauuuaaaaucucuugugcuagcacuucuauuuccuauauuguauggcacccucuuaaugugccuuuuaacuuaauuauguauaggcuuucuucuuuuaugugucacuuuaaucaucgagcauaacugaagcucacuaacuuuuuguuucuauaaaaaauuguaauguuauuucaauguaaugagauguaagcaaugaaaauguagugacaagauaacuggucuaggagugagaagacccaaguuuguuuuuuggguuuuuuuguuuguuuugagacggaguuucgcucuuguugcccaggcugcagugcaguggugcaaucucgacucacugcaaccuccaccuccuggauucaagcaauucuccugucuccgcuuccugaguagcugggauuacgggcaugcgcuaccaugcccggcuaauuuuguauuuuuaguagagacgggguuucaccauguuggccaggcuggucucaaacuccugaccucaggugcuccgcccaucuuggccucccaaaguguugggauuacaggcgugagccaccaugcccagccugacccaaguuuuacuuauagcucugagacugauuuuuuucucuaauuuguuaauaaguuacuuagucucuccguuaaccccuauucccauccauaaaaaugcaaaaugaaaguuccaauuaaaccgaguagcauagacuugucucucccugccacuugcaacuauaaaaccuggaaaugacacaacagacaaucuggagaacucugaaagauagaaagaggaugaucuggucaggaacccagaacuggcagaacagcagcagcaaagugucuuacaaacccccacccaacauaagaagggggccugggccugauguuucuugaccuucaaccuagcaacagaagguggcccggguaggcucauuccucuccuagacugaaugagaguccugccagcaauacugggccagcccagcaaaacuggcaaggauuggaagccccacuaauaauaauuggccgccaggggacuucugcgucucccuuccaugaagucaguggagcaggaauagcaaagaggaucucauuacaaccagcuuggaauggacagcagucuucuaugacuucugugguuucauuuauguaauauaauacucuugaaauuacaacauuguagaaauagagaacagguuccuauuugccaagagucagggacgggaggggccagagcaagguggauuugggcuauaaaagggcaccagguauccugguggccauggaaauuucuguaucucgacugaugucaguauccuggcugugauaguauaccauaauuuuguaaaauguuaccauuggaggaaacaauuuauagggcaccaagaucugucuguucuuuacaguugcauuugaagguacaauuauuucaaaauaaaaaguuuuaauguuuucuuaaaaaaagcauaaugauaccugccauuucugugcuagggaaucauuguaaguauuuaaggagguacaagguaugcugaggugugucaucauaugggcccacaugguagcaaugggucuuauccauccgugugucuguuucagcuuguauguucaguauucuacucuaccuuauccaaaaagcaguuauaguagcuuuaauauauuauaaucuuuaauaaaguucauuuaucuugcagcaaguuuguuuagggcuuucuuugaacugagcaccauauugggaauaaaaagaaugggauaagaaaugccauagacugagcucaguccauuucacauguaaacagucagucauaggauggauauagagcugggguuuguuuugaaagcuuuguauuguaacaauuuuaauaucuuuuuuuuuuuuuuagauggagucucacucuguugccuaggcuggagugcaguggcgugaucucggcucacugcaaccacugccucccgggcccaagcgauucuccugccucagccucccaaguagcugggauuacaggcacgccaccacagcuggcuaauuuuuguauuuuuaguagagacggguuucaccuauguuggccaggcuggucuuaaacuccugaccucaagugauccgcccaccucagccucccaaagugcugggauuacaggugugagccaccaugcccggcaacaauuuuaauaucaauuuagaaugcaucuuagaaucaauaugauucuuaguuuaauugggagccuuuugcuuaaaagcuugauaguacauaaauaaugguugcaucuuacacuuaguaacaucuuagguucacugagaucuggugauaaugucuaaaacuauuuuguguaaucuuuaucugaauguuuuaccuguccugauuuuauuaaacagaauuuggggaggagauacuuguuuucuuuagauagaguauuaacaauuugagggucugaugguacauuuagugaauuccaugaugauaauauauuauuuacauacacccaaauguugaaaccucauuucuucuuaucuuuuuuucccuuuguuuuucaagugucgauauauaguaucugguuuuaugacaagaaugacugucaccgcauagcaaaacucauggcugaguaaguauauuacuccauaaauuuaacugaugauaugugagaaaugaaaaauaauccccucccacuucucuuuguuacuaaagucugccaacucauguauuuccccaauuucuuuuuacugccaaaaacuuggaaaaggcugaaaagcuuuaaaauauauauaauuauuaucuuaacuccucccagugugcauuucaguuuccuuccagucuuccuucuuuguguauauauuaaguagaugugugugauuguuuuuuuacaaaaauaggauccuacuguauguauacugcuuuucauaucaacagcauuuuuccagggcauuaaaucuuucucuguaguauuuaugacagcugcauuguauccagcucuauagacagaucaugauuuaaccagaacuuuacuguuggaccuguagguuaaggcugccaaacugcccggcuccagaggauaucugcaucagguguacagccugaccauauacagcaacucugauuuagguucugugcagauuuccacuguaacaagugauaccauaugugauagccugauagagaacucauacacacaucuguauuuaguucuuuuaagugaacuuguuuuugacacagacucuaggcuuaacaggccccaauccacucauggguuguguuccagaagauuuuuugugacucagaaccuugaaauuuagaaaauuauuuuccuugaauuaauguucuaaagggcaguucauuguccucucucaagcuagccuguagaagccagcccuugugugaccuauccguauugcuggacugccauucuggauucuggaagcccauuacacggggcuucagggggccugagggacuacagagcucugggcaaaaugcuauaauagguagacgguauauucuggugcaccucugcuuuuuuucaguuuuugccugaaucuucucagaaauguggaccucucuccccccuccaccauccccaucugucaaaucaaaauuccuuuugcucucuuacaguuuucaaucacauguuuaaaagaaaauaaucuuaaauuuuuuaacagucuaaucuuauuuuauuuuuauuuuauuuuacuuuauuugguuuuuuuuagacagagucucgcucugucacgcagucuggagugcaguggcgcagucacagcucagugcagccucaaacuucugggcuuaagugauccucccaucucagccucucaaguagcugggacuacaggcaugcaccaccacuaucagcuaauuuuuugggggguggguagagauagggucucacuauguuucccaaacuggucuugaaguccuaggcucaagcguuccucccaccuuggccucccaaagugcugggauuauaggcgugagccaccaugccaggccaacagccuaauuuuaaacucaugaaaguauauauaaguaauuaacccagaaucucaguucauggcuaaggccagguugugaucuaagacuacuaacauguccugaucggaaguuaucggcccccugcuuuguugccuguucuggcugugagcuugcagggcagggccauguuuauuacuuguguacaccccaagggcaucguucuguaugaacuuguagucacuuauacuugaaaaaauguuggcuugaaaaaagagccacgcuuuguuuuuagaacacuuuuucucuuaaaaaagauaaaacuauuuuucauuuuuuaauuuaauuuuuuucuuuugagauaggauguugccguauugcccaggcuagucucaaacuccugggcuuaagggauccuccugccuuagccucccaaguaauugggacuauaggcacaagccaccauacccagcuaaaaccauuuuucaacauagccauuuauuagaugaucacuuguuuuagcuuugaaagugacagcaaaggcagcuuacuugugguuaccuagaagacacaggguuggcugggcgcgguggcucacgccuguaauccuagcacuuuggugggccaaggcgggcagaucaccugagauuggaagugcgagaccagccugaccaacauggagaaacccugucuguacuaaaaacacaaaauuagccagguaugguggugcaugccuguaaucccagcuacucgggaggcugaggcgagagaaucacuugaacccggaagcuggagguugcggugagccaagaucgcgccauugcauuccagccugggcaacaagagugaaacuuugucucaaaaaaacaaaaacaacaacaacaacaacaaaaaggcacaggguuguugauucaugguuauccagaaauccagauuuuuucuaaacuuuggaauguauuaauauauaaacacuuucuccugcagaaugaggacgugggcuuugagugaaaugaucuggcucuuuuagcucuaacaacuauugaaagaaaaccguuuaucuaucagggcaaguguuaccccuaaugcaagauuucaaaugauaaaugaagcugaagacugaaggccuaucuaaaaauauuuuauugaacccagaaauaggauuaggaguagaaauggaaagcuggaagggaaaagaagagcauuggggcuucuuucaccagaaaugcccgaaaagggacaauugcuuaaauuuucagcuuguuugacuagaaacagauguguuauuaaaagugauuugagccugggcacaguggcucaugccuguagucccagcacuuugggaggucaaggcggggaggauugcuuaaggccaggaguucaagaccauccuggccugauauagcaagacucaucucuguuuaauuaaaaaaaaaaaaaaaaaaaaagggaagaagaaaagaaagugauuagagaagccaggcacagugguguguaccugucauuucagcuauaauacuugugaggcccaggugggcagaucacuugggccccaggaguucaagaucaaucugggcaacauagugagaucccaucucaaaaaaaaaaagugauuagagaauacccuggugaaacuguugauaaugaguuuuaagugucuggccuauuuauagcugaagagaauauuguauguuaccauuaacuuugugauaaaugccucucuggucaccaaaacuaaagaagacuaucugucuuuguucuaaaucugccugcauaaaccuguuuguuacuuuuuguuguuguuguuugcuacauauuugagaauaucaccucuacuauccaaaaauacuagcacaguucuuguuaguauauuauacauauaaauaaauguguccaucagugcccauucuuuuaaauacaguucuucccaucacuauuugacagccacaauauaauaaagauccuccaaguaaaaaaacugauuuacuccaggcugggcgcgguggcucacgccuguaaucccagcgcuuugggaggccaagacaggcguaucacgaggucaggagaucgagaccauccuggccaauauggugaaaccucgucucuaguaaaaauacaaaaaaauuagcggggcaugguggcgggcaccuguagucccagcuacucaggaggcugaggcagaagaauggcgugaacccgggaagcggagcuuucagugagccaagaucgugccacugcacuccagccugggcgacagagcgagacuccgucucaaaaaaaaaaaaacaaaaaaaaaaaacaacaaacugauuuacuccaaacaauguuuauaaaaacgagaaacuauguaggaaaaugagugagcuucuagacccuaugucaucuaaauuuguauauucucuggucagugguggcagaguugaaaacccacuaaacuuagaagcuguugacucuccuaaagaggaaauccagucugccagaaacucuuuuuuuuuuuuuuuuuuuuuuugagacagagucuugcucugucacccaggaaugugguggcgugaucuggguucacugcaaccuccgcccuccuggguucaagcaguucuccugccucagccucccgaguagcugggauuacaagugccugccacugcacccagcuaauuuuuguauuuuuaguagagacaggguuucaccaucuugaccuggcugaccuugaacuccugaccucaugauccacccaccuuggccucccaaagugcugggauuacaggcgugagccaccacacccggccucagaaacucuuuuuaacaauaaaaaguuguuugacgguuuggccacauagacuauguaaacuuuggagaacucauggaaguaagcuuuauuccugaucuuacagacaucuuagggguagguuuugguguuugaaaggaaaggagaauggcaugagugcuauccauaaaguuuggauuagaagaggccuuagaguccaagccucguuuaugugagagucccuuccauuaccacccccgacagcuucugcuuucagcaguggugagcuuuauaaaauuaccuguucuggcugggcgcaguggcucacgccuguaaucccagcacuuugggaggcugagguggucagaucacuugaggucaggaguucaagaccagccuagucaacauggugaaacccugucuuuauuaaaaauacaaaaauuagccgggcaugauagugcauaccuguaaucccagcuacuagggaggcugaggcacgagaaucgcuugaacccgggagucgaagguugcaguaagccgagaucgcaccacugcacucuagcccgggugacagaguaaggcucugucucaaaaaaaaaaaaaaaaaaaaagaaaaagaaaagaaauauucuucucuuaaaccaaaauaaucacagaaucacagauccuagucugggucagggaagaguuaaauaccagcauggccaagucaggcaacaugucaggagguagguggaaaacaggccgugugacagauccuuuaugaagauggauucaggcugauguggccuauauuugagcauuaaauaaacaauucauguuuggucuuauucucauaucccauaccagucuuucagucuaccaugaagcucaugaugcuacauuuguuuuagaaguaauagucuuauuaagagcuauaauuaugaaucuagauagaaaaacuacauguuaccuuaaagccacauuuuccaaacaggaauucuaccucagaguaaaauucuauagucaaauaaaauuugagaaaaucuauaggccugcccuucuuggagaaucacaauaaauuuuagcaugcuuaaaaaucaacuggccaguugugguggcucaugucuauaaucccggcacuuugggaggcugaggugggaggauugcuugaggccaggaguuugagaccagccugggcaacauggugagaccuugucuguacaauaaaaaaauaaauaaaacaaacaaacaaaaauucaauggguggguugugguaauucaugccuuuaaucccaguauuuugggaggcugaggcaggaggaucacuugagacuaggaguuuugggaccagccagggcaacauaucaaacuccaucucuacaaaaauaauaauaaaacucaaggauucuguuuuuucuuuuuuuuuaagucgguuuaauauuguuuaacccaguauuuuuaaauaaaaaagccaucucuguucaccucuuccccacacucuaaugagagcuccugugcaggcuggguuuuuuguuuuuuaaaacaggguuucacuauguugccugggcuggucucaaacuccugggcucaagugaucguccugccucagccucacaaagugcuaggauuauaggcaugagcacugugccuggccugaaugaaucuuaaaaaaaacaaaaaaaguugcuuuauuaaaauuuauuauucaagcuugaaagcuugaagaaaaauauaggaaauaauaaaauauguaugugcuuaccacccagcuuucaguuccuaauauuuugcuguaauuguuucagaucuuucuuuacaagggagaaggggguguucuuaaaaacugaaagcccacuuagugauuuuuuuuuuuuuuuggagucaaggucucacucuguuacccaggcuggagugcaguagugugaucucaguucacugcagccucuaccucccagacucaagcaguccucccaccucagccuuccaaauagcugggacuacaggcguguaccacuacgcccagcuaauuuuuguauuuuuuguagagacgggguuuugccaaguugcccaggcuaaguuggugguuuuuaaaagggagaauaagggaaaccuuuuauuugcuuauaguguuacuaacuuuuaaggauucaccaagaccucuauuuucaagaacugacuuuguccuugcuagcccagugucaauccaaacuuuccacagaggauuuguucaacuaugcagccuuccugugucuugguggaacugucaguuuucauauuuacuuuagcaauuaguuugacugauuuugaaauacuucaagggaaaaagggagaaaccuuaguggaguuuguaaugcaucucugccaacucuaggaaggaauucuguauuuuuauccuucugaaggguaaauauuggcacuguuaaugagacggugaaaugguaagucauuuauuucugaaaugagguaacugaaguucuguguuauauauugcaagaauaauguaaucggcugggcgcgguggcucaggccuguaaucccagcacuuggggaggccuagggcagaucacgaggucaggagauugagaccauccuggcuaacacggugaaaccccaucucuacuaaaaauacaaaacauuagccgggugugguggugggcgcuguagucccagcuacuccggaggcugaggcaggaggauggugugaacccaggagguggaguuugcagugagccgagaucacaccacugcacuccagccugggcgacagugcgagacuccaucucaaaaaaaaaaaaaaaaaagaagaaugucaucaugugacacucuuaguguauccuuggaagaugaacaccaaaagaaaucuugggucagauuuuguuucaagaggccuuucuaaaaccuuguucuucuccucuagugugguagaagaggagacacggcgaucccagcaagcugcucgggacaaacagagucccagccaggccaauggcugcagcgaccacaggcccaucgacauccuggagaugcugagcagagccaaggaugaguaugagagggugaggcucucuggguacuugggugcugaccagggaagaccaaaacgggaggaggaggucugcaggagacuauuuuacuagggaagcuggccuccagggacggcagaaauauaaguucaaaaagagagcguguuagcacacuccuguaaucagucccagcuacuuggcaggcugaggaaggaagaucacuugacuccaggaguuggaggcugcagugggcuaugauugugccacuccacucuagucugggcaacagugagacccugugucucucuuuuuuuuuuuuuaaaacagaugugucuuacaauuuuaaaccuaaaacauaaggaaagaacuugcuuaccccagauuacuuguuuuuggcaggaaaauuuacaaugcuuuuuucuauuccuauaagauuacuaugggagaagauggucuuggagugcagaaguuagcucgcagcagcuaguucugguaaagcuucgugccucuucuucaccacugcaguuucuguuaggauccucagugguccuaggaauuuguuuaggcuuugaaaaguauucugauaguuuguaccacauaauacuaaaaaauacacucauggucuguaauuggugguagaugcacaaccuucauuaagcuucauuuggaauuuuacccaaaugagaggcuuuucugaaauucacuguuuucuuucucuucuguugugcauuuuaguuuauaaauuagcugauaaaauuuucucccaaaaguugaauaaaauggcaauugugguacuuucguuaauuuauucaauaccugcuuaugaaccaucuacuaugugcaagcagugggcauuucaugguuaugacucuccuggaauuuuacuuggcaccucaaagcccccacacuucacuggagugagacaagcucucuacugcugaacuuuguuuuagcagaauuauacugucaccuuacucuucauuaaauauugaauuaagugcuuuccuuucaugccuauuucaccucaccagaacuucaaggaacaaaaugugaaaaagcacuguccaaaagacccuguuucccauacaguucugcuauaauaccagcuacuaaguuauuaaucagugauccugaaaaaagcuucaaauuggcaaaacgaguuaagguacuguuguuagcaugacucuuccuccucccauccucuugggacuuuacagagcucaaaacugagagguccugcaauaaguaaaacaauaacaccaauucccagauugacuugacugcaggaccauuuuuugcauacugcccuuuaacaacucaagaauuuggaguucaggaaaaaguuugaaaaaaguguucugaaagauaguuucuucugacuaaaaauaggcauguucaccauaaacuacauagaccuucuacauucugauaacaaaggaagucccaccuccaggguggagaaauguacaugagagcccaugagaaguuucaaguuuguaccaaauucuucaaugucucacagagaauuaggaggaaugaauggaucuauggaaguuaaauuuggaggagcagucaccucucuaauaaauuaaucgauucuuaggaaaccaaaugagaacuaacuucaagaauggcuuucugauuuagaaguuaccuuacauuccccucuucuacccuugaugacaagcggauuuucuacguacauacuuuguucuguuuguagagcccuuucaguguucucauagguaccuaguaaguccagggcucugucacucauccugaguaauaacuguaucaagguaccacacgggacagaaacuguaggugcugcgcacuaaagcagauacuccaguaaguggccuggcuuacucaggcugagagguuaaguagccacaacgagaaaguaggaaauaagacauuagcuuugaacacaaaacuuuaaaggaacucuagggucaggugggcaaucuaaacaucugacauuauuuugaauuauaucaauauuacaaaaggaauauagauagcaugauaguuucuguuuuaaauaaacuucuuucacacuauggaauaaaauaucgucuauggguagauuaaaaugaaacccuuugggauuugguuaaaucuuugauauuuacuuuaucauguguucuuucugauuuugaaaacugucugcaauagguggagcuucuuugaauuagaguuuuguucucuuaucugcauuugucuaucaucucaucagauggagcugguauaagcagugacccaugaauucaugggucuugguguuuggaugggcucccuucagcugccacauuuuuucagacggccccuuuguuuaucuuuaggugaagacucagaagauuggcaaucaagggcaggggugcaagcuaggccucaguguugggauuuaauccugauucugagucuccgcuaucugcugaguaugauauaaugaacgaaauuucagacuuuugaaugagcacuuguaauaaugagacucuuuucuuuuuucagacagggucucucuguugcccaggcuggagugcaggggcacaaucuuggcccacugcagccucuaccucccaggcucaagacauucucccaucuuagccucccaauuagccacgacuauaggccaugcaucaccaugcuuggauaauuuuguuuauuuuuuguagagauagagucucacuauguugcccuggcugaucuugacaagcuccugggcucaagcuguccucccgccuuggccucccaaagugcuggaauuauaggugugagacacuguggccagccuagagacuguuugaaaauuaaaaaucuguauaauaagcauuuucuucaaaagaaagauauugcacuucuauaauaucuuuuaauuaacuuuccuuuuuuuuuuuuuuugagauggagucucgcucuguugccaggcuacagugcaguggcgcgaucucgacucacugcaaccuccaccucccagauucaagugauccuccugccucagccuccugaguagcugggacuacaggcaugcaccacuaugaccggcuaauuuuuuguauuuuuaguagagacaggguuucaccauguuggccaggauagucucaaucucuugaccucgugauuggcccgccucagccucccaaaguccugggauuacaggcgugagccaccguaccuagccucaacuuucuuauuuuuuauguaaagaaagauaguugaaaccacacuuggcccauuaugaguugcuucuagccauaggauguaauccuggauuuuggucaggggggugcggaugguuguuuguuugguuuuaguuuaauugcaaaacaguuuuuuaaaguccaggguauuuuuguucuuaaaaaauagaggccagacacagugacucaugcccauaauuccagcaccuugggaggccgaggugggaggauugcuugaauccacgaguuucagaccacccugggcaacauagcaagaccuugucucuaccaaaaaaaaauuuuuuuuuaauuaguuaggcaugguggcacacaccuguagucccagcuacuccggaggcugaggcgggaggagcacuugagcccagcaguucgaggcugcagugagccaugauugaacugcugcauuccagcucaggugacagcaagacucuguuucuuaaaaagaaaaaagaaaagaaaaaaauaggauaggccaggcgcuguggcuaugucuauaaucccagcgcuuuggaaggcuggagcaggagaauugauugaggacaggccuggucaacauauaaugagaucccaucucuauaaaaaauuuaaaaaucagccaggugugguggugugcaccugugguccuggcuguuuggaggcugaggugggaagaucacgagcccaacagcuccaaguuacagugagcuauuauucugccacugcacuccagccugggcaacagagcaugacccugucucaaaaaacaauaaaaauaaauaaauaccuaaauaaacaugaacaccauuauuuuucuuauuauguaagcaguauaaacuauagaaaaguuuuuucuuuuuuuaaaacagcuuacagagaacguuuuauauucaaaaauuacaguaaacaaaaagaagaaaauaucauaguucuaccaccuagaaauaaucacugcuaauacuuuguuacguauccuugcaaaaauauguccaaguguaagugguauguuuguguacauuagauuuauuaauguucuuugguaaccuguuuuguuccaaauaacuaucuuuuuuauugacaguaacuauucaucucacagagaaucccuaugagauuuccuuugguagaaugaaguuuuugaaaaaacugauauuuauagcuguguauuuuuccuuaugugcauuauauaaaugauacccuaggcuucucuaauucuauuaagaacuuggcgauauauccuuauagcuaaauccuuguaaaauccucauguacagcauuaacuuuuuauuaggauaaauuacuuuaaauggaauugguagaucaaagcauuuuuauguuuuuaagauuuuuaccaaauauuauaaaaucacccuccagcagguuugucugauugcccauuuucccucauuuuuacaaacacuggaugcuguuauuaacaaacacaaaaucuccaagaaaggcccugcacaaguaucagaaauacauuaaauucuugagaacuuucauuaaaguacaaccuaacaauauaagccaguuuuauugcuuauacuuaagaauugcaaaucaaaugccccaagagccagggaagccaugguagugaguaaagcaggccggguggaacugaagcagguugagagcuaguucguauguaaagggucauuuacagcccagcucucaguuauugccgauaagguuuugcaaccuuauccagccugucucuaaaaauuacaaaucuggggcuuggggcaguggcauauggcuuccagcacuuuggaaggcugaagcagauagauugcuugaguccaggaguuuaagaccagccuggggccgggugugguggcucacgccuguaaucccaacacuuuggaaggcugaagcggguggauugcuugaggucaggaguucaagaccagccuggccaacauggugaaaucccaucucuacuaaaaauagaaaaauuagcuggguguggugguaugugccuauagucccagcuacuugggagguugagggaggcugagguucaugagaaucacuugaacccaagaggcgaagguuacagugagccaagauugcgccacugcacuccagccugggugacagagcaggacucaguccacaaaaaaaaaaaaaaaaaaaaaagaacagccugggcaacaugguuggugaagucccaucucuacaaaaaaauagcaaaagaaaaucauagcuugcugcagccuuaaacucuugggcucaagugauccaccugucucagccuccaccauguuggucaggcuggcuuuuuuuuuuuuuuuuuuuuugagacggagucuugcacuguugcccaggcuggagugcaguggcccaaucucggcucacugcaagcucugccucuuggguucacaccauucuccugccucagccucccgaguagcugggacuacaggcgcccaccaccacgccuggcuaauuuuuuguacuuuuaguauagacaggguuucacaguguuagccaggauggucucuauuuuuauuuuuuguagagauggggucucacuauguugcccaggcuggucuugaacucuuggucucaagugaucuuccugccucagcuuccugaagugcugggagccacugcuuccagccccaacuuuuuaauguuucugaacauuuauaccuucuguuuuaagaacuuguuaugaacaauauuuuaacuuuauauuuucuguaauauaauucaguuccaagcauuccacauaaugggguugauaugguugauagugauguugcaaacagaggcauguuaaaagauugagauauuucauaggcuuucaccaaauguuccgccgcuauucaaauugauaacacugaguaaaugauguucugaaauaauauaaggauuaagucauuugggugggaaaaaacacaugccauccauuuaauauuugaguaccuacuccugugauaagcauuaauugucuguagcaugguaucaagaaaaucugucugugaacugaguuuagggcugcuuuuuaaaaaaaucucauaucuugcauuuucugaacuguuuuuggugucgguuuuggcauggaugauguucaucagaugccggaucagauagcacaaauauucaagaauucguaacccauaauuccauguccaucuauuggucugaucauuuuuugaggauucuuuuuaagaacaagauuauuuucauuuuuaaugucaugagcacauuaaugguaacuuaauaauauuaguacaauuagauguccauaugcgacaaaaaaaaccuaaccuaauaacaucuuagagaauaaucaacucaaaaugugucaucgauguaaaauauaaaacuauaaaacuuuuagaagaaaaauguauuuaucauaugacccaagaaguaccacuccuagguauuuacccuagagaaacaaauuuugccaggcacgauguggcucacgcuuguaaccccagcacuuugggaggccgaggagggugaaucaccugaagucaggaguucgagaccagccuggccaacauggugaaaccccgucucuacuaaaaauaugaaaauuagcugggugugguggcgcgcgccuguaaucccagcuacucaggaggcugaggcaagagaauugcuugaaucugggaggcagagagcacaguaagcugagaucaagccacuaaaauccaggcugggcaacagagugagacuccgucucaaaaaaaaaaaagaaaaaaaaauuuuuguccacuuaaaaaccuauaucaauguuuauagauguuguauucauaauuaccaaaaaacggaaacaacacagaugugcuucugugagugaaugguuaaacacucacguauuuauauaauguaauacuacucagcaauaaaaaggagugaacuauuaauaccauacaacagcuuggauguaccuuaaaggcauuaugcuaagugcaagaagcuggcauucuacuuauauuucauuuauaugacaucuuugaaaagacgaaacuagagugagagagaauagaccuaguugccgggaguggagggagggcaugacugcaacaggacagcacaagggaauuuuuuuuuggaugauggaacuguuuuguauccugauuaugcugauagggacauaaauagaacuguacacccccuuaaaaauucauuucaccauauguuagcuuuuauuugaaaauaaaaucaggcugggcacaguggcucacacccauaaucccagcacuuugggaggccgagguggauggaucacaaggucaggaguuugagaccagccuggccaacaugcugaaacccugucucuacuaaaaauacaaaaaaaaaaagaaaaaccagcuggacaugguggcuugcaccuguaaucccagcuacucgggaggcugaggcaggagaaucgcuugaacccaggaggcagagguuguagugagccaagauugcgccacugcaguccagccugggcaacagagcaagacuccaucuuggaaaaacaaauaaauaagauuaaaagaauaugugauaaaguaauaccauuaucuuuuucuuaaaaaggugauaaaaauaacaguuguggccaacacuguugucuaaaauuaggugcucaauguucuagaaauuuuauugcauguuauuuacauuggaguacagagcaaacauuuugagguugguuuuucuucuucuuuuuaaaaaauaacauuuuugauaaccucagaugcuguuuugugagccaaauaauagcaaauuuuuuucacaagauauauuuuuuucuuuuaacuuuuuaaagaaucagaugggugacucaaauaucuccagcccuggguuacagccaagcacucagcucuccaaucugggaagcaccgagacucuagaagaaaugcccuccgggucacaggauaagguuuguacagcuaaagcucuagcuuuguccuaaguaacaaagaguaacauucaguaaggauucuaaugagugcaaguuugauuugucaguugugucaagguucaaaugugcagcaacauaaugacauccuccuaggucaugauccgaguaacuguuuaaucuggauuuugcaguagccugcuaccugguuucccaucuuuugcucccugguugcuucuuaccuauucuuaacccaacagccagaguaauccuugcaaaacauaagucagaucauggcacuccucugcuuaaaacccuccagcaguguccgagcucacucaaaucauagccaggaucaugacaguggcccacgaggcccuaccuuaucuggccccucuaccccaggccucaucugucacucugcauugcucaccuggcuccagucccauuggcucucuugucuuuccccaaaugugccagauauguuccugccucgagacaggccuuugcacuuguucccuuggccuguaauacuuuccucccagauagggcuugcucccuuuacucccucaagccucauauguccuccauaagucaggccuucucugacuacccuauuuaaaauaacccuuggcuaggcacaguggcucacaccuauaacgccagcacuuuggaagguugaggcaggcagaucgcuugagcccaggaguuugaaaccagccuggccaauugacgaaacccugucucuacuaaaaauacaaaaauuagcugggugugguggcacgugccuguaaugccagcuacucaggaggcugcagcaccagaauggcuugaacccuggaggcagagguugcagugagccgagauugcaccagugcacuccagucugagcaacagaguaagacucugucucaaggaagaaaaaaauaauaacaguaacaccccuuggacaggcacaguggcucucgucuguaaucucagcucuuugggaggccaaggcaggaggaucacuugagcccaggaguuagagaccagccugggcagcauagugagaccccuucucuagaaacaaauuuuaaaauuagccagacgugaugucaugcaccuguggucccagcuaauugggaggcugagguaggagccucgcuugagcucaggagguuugagauugcagugagccaugaucacaccacugcacuccagccuggguagcagagcaaggcccugucucaaaaauuuaauuuaauuuaauuuaauuuaaaaauaaaauaaaacucccaggugcaguggcucaugccuguaaucccagcacuucaggaggccaaggcaggcagaucaccugaggucaggaguucgagaccagccuggccaacauggcgaaaccccguuucuacuaaaaauacaaaauuagccgggugugguaauagacaccaguaaucccagcuauucgggaagcugagguaggagaaauugcuugaacccgggagguggagguugcagugagccgugauugcgccacugcacuccagccuaggcgacagagcaaggcucuggcucaaaauaaauaaguaaauaaauaaaauaaaacaacccuuccucaccuccauccucuuacuguacuuuauuuucucacuaagguuucuaaccagcuaagaugguuucuguuuuuguuuuuugucugucuccugcccaccaaaauauaagcaccauguaaaacaguuuuguuuuuuuguuuuuaagcugucucuuacgggaaagaagggcaguuuuaugagccuuguucauugcuguauccuuagcauguagcacuguaaauauuuguugaauuaguucucuuuauaacugauagucugauaaaagaacagauaucaaauaaaauccguagguuuuuaaguagacuuuuuguuuugagauaauuacagauuuauaugcaguuguaagaaauaaugcagaaagauccuauguacccauuacccauuugcccauugauaacauuuugcaaaauauaguacgauaugacaaccaggauauuaacacaauccacacauguuguucagauuuccuuuguuguguguauauucaguucuguguaauuuuaucucauguauagcuuuuuguauauccacuaccacagucaagaugcuaaauauuuucaucacccccaagauguuuugcccuuucauaaacacacugacuucccugucauacccuauucugccucugcgucuaccucugccuccccgaucccgccaucguuuagcccuggcaacuauuaauccauuuuccaguucuauaaugucauuucaagaauauuauauaaauggaaucauauauauaaccucuugagauugucuuucuucacucagcauaauuccugaacauuucacugaaguuguuacauguaucaaguuuguuuccuuuuauuacugagaguauuacaugauacgcaaguacuaaaauuuguuuaacuguuuuuggcaacucacuuacugaagaacaucuagauuguuuucaguuuuggguuauuacaaauaaagcuccuaugaacauuuauguacagguuuuuaugugaacauaaaucuucauuucucugagauaaaugcccaggagugcaaaugucaggucauuugguauugcauguuuuaguuuaauaagaaacugccuugggaggccaaggcggguggaucacuugaggucaggaguucgagacuagccugaccaacauggugaaaccccgucucuacuaaaaauacaaaaauuggacgggcauggugguggugguaccugaaucccagcuauucgggaggcugaggcacgagaaucgcuugaaccugggaggcaaagguugcagugagcugaggucaugccauugcacuccagccugggcaacaagagcaaaacccugucucaaaaaaaaaagaaagaaaccaccaaacuguuuucuaggaagucuguacagucuuacauucacaucaacaauguauccaaaaauguuuuuagauauuuagauaauuaauuuaaaccaaauuuuguauucuaccuucccauaccccauuuuuacuguaucuggauuuaggaucaucauccaggagugugcagugggcuuacuacuuccccuuucuaaaucaugaaucacuucaucuuccuuuugugaaucaugaaguuaaggauuauuguaccgccuaaugcagauuuguugugagacccuaaggaagaaauggaccagaaaaaaaugacuuaagaauuauaaggucaggcauggugacucacaccuguaaucucgggacuuugggaaguggaggcaggcggaucccuugaguccaggaguuugagaacagccuggccaacauggugaaacccugucucuaauaaaaauacaaaaauuagccgggugugguggugcacgccuguaaucacagcuacucaggaggcuaaagugggaggaucacuugaaaccaggagguggagguuauagugagccaagaucgcaccacugcacuccagccugggcgaccaagggagacccuguuucaaaaauccaacaacaaaaaaaagaaucagccaggcacaguggcucacgccuguaauccuagcacuuugggaggccaaggcaaguggaucaccugaggucaggaguucaagaccagccugaccaacauggugaaaccccaucucuacuaaauagaaaagaaauuagccaggggugguggcacaugccuguaaucccagcuacuugagaggcugaggcaggagaaucgcuugaacccgggaggcggagguugcaguaagcugagauugugccauugcacuccagccuggccaacaagagugaaacuccaucucaaaaaaaaaaaaaaagucauaaagcacuguccauugaaagaugaaaaaugagugugacaagccauagaugcuaagccuuucaacaauagcacugcgucuguagacauacagaacucaagugguacagacagugcugauguguuauuccgucauuuuucauauacuuuuaaaacuucacguuuggucgggcauggaggcucacaccuguaaucccagcacuuugcacuuugggaggccgagacaggcagaucaugaggucaggaguuugagaccagccuggccaacauggugaaacccugucucuacuaaaaauacaaaaaguagccgggcgugauggcauacgccuguaaucccagcuacucaggaggcagaggcaggagaauugcuugaacccaggagggggagguugcagugagccaagaucgugccaccacacuccagccugggcgacagagcaagacuccaucucggggugggaggaagacuccauuauuuagguuauagugacaaaauuuuaugaaauacugagaucuggauauugucagaagucaugugauugacuaaaguuaguuuaaauuuaucaucagccgccacaggcagauacuacauuuguuuaguaacacugccaucuagugcugaggagcaaguacugcugucaagccuuaauaguauuacauuccauuucaguugcauaauucacuuguuuaaacuuuucuugggauuguuucuguaguguauuuuguuauuguuuguuuccuauguucaagaauagugccuaucuuauagugugcccacugcagugaccaguagcuccaaacagacauguaaaauucucuaaacaucaauucuccgugggaugaggagugaaccauauuaaaccugaugcugaagauuauaauuuuguccugugcuguacaugcuguugcucgcugaaugccauuuccugagcuaaacggucagacuaacacuugaucuacaugaaguauuaaaaaacucagaauccuaacuugaagcauguucaagcaugaggaaagaauaacauuuuaccuuuucuguggaugauggaagguuaauucaugaauaaauaagcccagcuacuagaggagggcaaccaguuuuucuuaucagaaacagaaaagaaugcagagacugugaaacuuuugggaauuugugugaagagaaauauucugcucacccaggcuccuaugacaaauucaaccaguuagguauaaucaugugucauuuaacaaugggaauacuuucugagaaaugugucauuaggcgauuucauucuccgaacaucauagaguguauuuauacuuucacaaaccaagaaaccaagauggcauugccuacuaacaccuaggcucgaugggauagccuauggcuucuaggcuacagaccugugcagcacauuacugcacugcguauuauaggcacuuguaacacacugguauuuguauauuuaaccauagaaaagguuuaguaaaaacacaauauuauauucuuaugggaccacuguuguauaugcaguccaucauugaccaaaacaugguuugugccaaaugauaguauuuccaaacguugaugcauuuugaucuguagccaccucaguuauucaaaccuuagcuguaccuguuuuccggagguaaguaucaccauccaggugauuagguaaccuauacuuugcugaauugacaucuccauaugguggcacacugcuuaagaauguagacuguauuguuagaacugaguuggagucugguucuuuuguuguauuugggcaucaucuauaaaguagcaauaauaauuuaccuacucuagcagaugaauagaguaauacauguaaagugcuuagcauaucgccucccacauaguaagcauucuguguaugaugauucauuauuaccaucacaaauucguuuauucucucuuauaugagaaaaccuccaaaacuguaaugcuuuaccauacuccccauucuagagaaaguuagagaaucugucuggccucgcaguaguuauagggaggcagcauagagaaucuagaaacuuucugcugcuuuuaaagucaggggucaggguucuaccauauggugguuucauauuuuaauuuaaaguagguguguguguuuguagagacaacgucucacucuguugcccaggcuagauugcaguggccugaucauagcucacuguaaccucaaacucuugggcuuaaacaauccuccugccucagccucccaagcagccaggaccacaggugcacaccaccuugugcagcuaauuuuuaaauuuuuuguagaggcagggucucaauauguugaccaggcugaucuuaaacuccuggcuucaagcaaugcuuccgccuaggccugccaaagugcugagauuauaagcaugaggcacucugccugacuuaaaguagauuuuuggcuguucaaaguuaauuuauguuucacuggacaaggaaaaauugcugucuggauuaugccucagguguauuuugugaugagguuucuccauguccugccauuugauuauuccuuuucuuaaauuucugcaacauagacccaaucugaucucuguuuuucaaaguaguuuauaccuaaauauugguuuguguguuuguauacauaugucuguaauagaauggggugguuaugagcuguuuaauuugcauuaauaagaauuagucuuguuggccaggcacgguggcuguaaucccagcacuuugggagccgaggcagacagaucaccugaggucagaaguucaagaacagccuggccaacauggugaaaugccaucucuacuaaaaauacaaaaauuaacugagcgugguggugcaugucugcauucccagcuacuugggacguugaggcaggacuaucacuugaacccaggagguggagguugcagugagccgugaucacaccacugcacuccagccugggugacagcaagacuccaucucaaaaauuaaaaaaaaaaaaaaaagaauuaguguuguuuuccaauacuuuuuuuugcuaagaaaccugacccauuuguuuucuaaacauauaauguguauaaaaaggaauuaacccaauucaaaacuggguaaaagauuuuaauaggaaucuccauauaagguauacaaauggccaauaagcacaugaaaagaugcuccacaucauuagucauuagggacaugcaaauucaaaccacacugaaguaucacuucauacucauuaggauggcuaauaucauuaaaauggaacaucacaaguguuggagaguauauggaaaaugcuccauauacucuguuaccucauauacugcuguauacuggcaaccauguuggauugcuggugauaauguaaaaugguucaggcacuauggaaaaaaacaguucggugauuccucaaaaaguuaaacuuggaauuacuauaugacccagcaauucugcuccuggguauauacccaaaagaauugaaaacagacauucaaacagauacuuccacaccagucuuuauagcagcaguauuugcacuagcuagaagguggaaacaucucaagaacuccaguguccauuaauggaugaauggauaaauaaaugucauauauacaugcauuggaacauuauucggccauaaaaauaagugaaguucugauacauguuggaacacggaugaaccuuaaaaacaacaacaugaauauacuaaaggccacugaauuuuacacuuaaauaugguuaaaaugguaaguuuuauguauauuuuacuacaguuuuuuaaaauagggagauaaaugucuauugugcugucaguagacauuuaugaugccaugaauucacaagugacuaagucacaguguucaguguaguaaauggaaccugugaacaugucugcagcuauguggccuggacagagaagucugucccaagggagaauuuguugucuauuuugaccuagauggaauggguuugaaauauuaccagacagcuguguccuugaugauucuuugcauugggagugaccaggagguuuauaauagccuagccuugguuaucuuaccagguguuuuguuguugucuugcauugugggauaugauauuccaggagcauuuaaugaauuuuuguuugguacuccaugcuugcuauuaagaccacauggugggccgggcgcgguggcucaugccuguaaucccagcacuuugggaggccgcggcacgcagaucaccugaggucagaagaaguuugagaccagcccgggcaacauggugaauccugucucuacaaaaaauacaaaaauuagcuggauguggugacgcacgccuauaaucccagcugcucaggaggcugaggcauaagaaucgcuugaaccugggaggaggagguuacagugagccgaggucacgccaccgcacuugagccugggcgauagggcuagacugugucucaaaaaaaaaaaaaagaccacaugguguuuaugugauuauaguuuaagccaacuucaauuuaaugcuuuuugggcaccagacauuauauugagaauuuaauuuucacaacaguguucugagaucauugucacaauguccucgcuuuucagauaaggaacuaaauuagaaggauuaugcugggcucaauggcucacuacaaaaaauuuaaaaauaaacugaucaugguggcaugcaccuguggucccagcuacaugaaaggauuguuugagucuggaaggucaaggcugcaugagcugugaucacaccacugcacuccagucugacugaaugagacccugucucaaaaaaaagagaaagaaaaagaaagaugauguaauuuucccaguuaacagcugagguaucuuuuauuucagacccuaaacucuacaguuuuuuucagaaguaaaaauaugaagaaauugaaccauauaagaucuuuaguauuuuuuuguauccauggucuaaaauuagauacugaugcugccuuauauuugaagugagagucuaacauuaguagaaucucuuuauugaauauuuuuaaaggugaaaugguuugguaugaagcuacaacuuuuuuacaacugugggagguucuugccucuuccuccacaacaguuacuuuuuacugacuacauuuuuucagaccugcccugucccucucaccuagcagaugaugcuguccucauaccagggagagaagacagaauggcacucccuuaacuuucuguccuucacaugcaaacuugccugcaugcucaucgcugcuggcccucuuucucuguugucugacaggagccccuccugacacaggaucucuugccuuaagcucccucuccucauacugacuucccccuacuccccgaaagaacuuuggaagagagcacuguugagugucugccauguacugaugggaucugugguccugggugguggugccauuacuuggguaggcaaguccaagagcaagaaaggcaaggauuggggaauacaugagaaagagagccccugccuuggcaaauucgcuuuccauguuguuaggagugcugacauuaaacacacacuuccugugugcuggguuccauacauuucagccucccaccagaccucccuacuuuauagaggccugagacucagagaaguggacagcacuccucaggccacacagcuggaaaggagcagagccaggcagcggcagucaucuucaggcccugccugugggugguugauaggacaucacagcugugucgcugcagccuccugaggggaugccuuugcucccuugacuuguauuaccaucuuuguguuuuaauaacccaaaaugaaauuaccguuuuguguucuaagucaguaccuccagguucuagaugucccacagagaccuccagacauguucacaacuaacuucagcuucccccucucccuaacccuaggugcucuuccugggcugggcuggccugcccaggcagugauaccaccacccaauacccagauaccaggguguccucuaggcucccugcuccuaccugaccagccaccaacuccuuccauuccaacuccaguucucauccucuucucugccaguaucuuaguccagacucuccucaaucucaccccuacaauuuguccuuuauguggccgaccaagugcacguucuaaaauauaaagccugauggcucauccccuggacauguugccauugcccuguggauaaaguccagauccucuaacgugucucagauacucugcagucugcccgcuucuucucucuuucccugucacccuccuacccagccucugauccagcugugcugaagcacguguggcucucaguggcugugcuccccagccagcucgccucaucccuccccaguuucacuccucuuccuagugccuuccuucccacugagcucugcaacucugccuugugugugugugugcggggguccggugggggggcccuuaccaguuguccuggccucuuuuuucacaucacagucacagcacaaugccuggcaccugauaaauucaagaauuuuuaucaaauggaugaaacauuugccuggacaaaacuggguuuguuuuccuguagaaaugugaucauaccauagucuuauaauauugauauuauacuaauuugcaguguacuuuggggccuuacagacuuucugaagccuugagaaucauguguuucagugaacuaauuuuuucaguauaaacagaucuaaacaacuaauucacucauuuuaggaauaaaaaguugaggcugucuguguuuucaaagugcuuaggugugucucccacuaaaauguaagcucugugagaacuguuguuacucccuugcugcaucgcgugggcccagguuagagcaagaccuggcacccugugaguacucaggaaauaaagguuauugacuauggaaauacugcuuaaaaguacaggaaaacacgaauguuuuuccuuugaacgauuaugguaucaauaagccaacuuacuaaaauauauauaaauuuuaaauugucaggcuuacaugcuuuuucugaagaauucugugacuagggacuaaggcagugggaguuggggauggcccacuauuaaauggcuagauuuauuuucugauauuugagacccagucucugagguccagugccuagcguuucauugagaacagugaaaguaaagguagaaucaccugauuagcauuuggucccugugucuccucuagugucauuucccuguguguuguugacaugaggcaauugggcacagucagcuuugccaagaaaaagaauggugaauucugauccugcuacccagagacccuaaaaauuugaauuauauuaccaaugcaaauuuccauccaccaaccuggggacacuagaugaaccugggccuuaauccuuaguauaucuucaguuuuuuccguuccuuauuuugauacuccauccauccuugauucugcaaaaucuuuggcuucuggaaaagaaguuugguuaugcugauuuauaacagaccucuuugacugggugguuucauuuguuuuucagucugcuccaucuggacacaagcaucugacgguagaagaguuauuuggaaccucuuugccaaaggaacaaccagcaguugugggucuggauucagaagaaauggagagguugccaggagaugccucccagaaagagcccaauucauuccuaccauuucccuuugagcaguuaggaggagccccucaaucagaaacccugggugucccuucugcugcccaccauucaguccagccugaaaucaccaccccggugcuaaucacuccagccuccaucacacaguccaaugaaaagcaugcuccaaccuacacaaucccguugagcccuguucucagucccacucugccagcugaagcuccuacugcacagguuccccccagcuuaccucgaaacagcaccaugaugcaggcagugaagaccacgccuagacagaggucuccacuccugaaccagccagucccugagcuaagccaugccagucugauugccaaccagagccccuucagggccccauugaacgugacgaacacagcuggcacaucccucccaagcguugaucuucuccagaaacucagguugaccccacagcaugaccaaauacagacacaaccacuugggaaaggugcaaugguagccagcuuuucuccggcagcuggucagcuagccacaccugagagcuucauagagccucccucuaagacagcagcagcaagaguggcggccucagccucccugagcaacauggugcuugcuccccuucagguaauggcaggagggugggggugggcagaguggguaacuguaacuggaugggaugaaacuacagagaccuugguuuuaacugucaugacaugacaauuuuuagaguugucccuuuaaaguaugucagaggcucggagacaggugagguaagaagcccuaucaugaacaaccaaguaauuuauauuuuccuaucgggauauucacuuuaguggggguuguauguuuguuuugcuuuugcccagcaguuccaggaguccucauuugacugaggaccaaauuauuccaaagcuuaacucccuaucucccacggcagucuccuagagugccuaccuugugccaaguacccuagaggugccauaagagcauccuagacucgaagguaugaggucaaauaaagcugauuuuuucaacugcccauauuuacaucaccuuauaaagaggugccaugcugccuagaucucuuaucucuacagacucagcagcaaaaauaugcccaggcugaaggacagauaucacauguucuuacuuuauuugaacucauggagauagagaauagaaggaugguuaccagaggcugggaaggguagugggaagguggggggagguggggauggugaaugcauacaaaaaaaaaaaaauagaaugaauaagaccuguauuuaauaacacaacagggugauuauaguccauaauaauuuaaguauauauuuuaaaauaaugaaaaggguauaauuagauuguaacacaaaggaaaaauucgugaggggauggaugccccguuuuccaugaugugauuauuaugcaucgcaugccuguaucaaaacauuucauauaccucauaaauacauacaccuauauacccacaaaaauuaaaaauuauauauauuccugggcugucucuggcuuuuauaagagacacagguuucagguuuuucuuuaaagauaccugaaaggcucugcacacaccccuucccucaggagcuaaagaggagaggcugucgcagagcucuagugcaguugaauuguuggcugcaugguuacagguuccugucagacucuucccuugggaaucuaggaacuaguuaauaucugaaccauuuucuguuacuaaccuagauuuuccacugggaaagucuuuuucaauuaagacuaggaagucuucuuaauugaaacuucuuauaucugucugucuuuucuucauaaacauuucagucuaugcagcagaaccaggauccugaaguauuugugcagccuaagguguuauccagugccagugccaucccgguaaggacucgcuuuuuuuuuuuuuuuuuuuuuuuuuuuuuuuuuuuaagacuagucgggugccauagugagaaaguagaaagaguagaacaaggaauuuggucuguaacuggcugugaacagucaggugagauaauucacucccuuuggaccagccaggacucccucuuucugaagaacacauuauuuuuaaguucugcuggaugugaaguaaaagguugucagcuuagugaaaagaguuagcuauggagcccagcacaucuuagaugccuuuccuaggccagguccucucccaccccguccuggcagaguccauugcuguggcuucuguggaucucgaggcgucugcauggauaucuucccugacuguguguguagagggcacggugggcccuuacucgguauuugugaaugggugacugcuaagagugugguagccuggcuucuauaaguaggaaauacugcccuggaagagcugugaugucccagguggcagagccacuauccugcuauaguccucucauuucccauugcucugagaacaaagccucccaggccugugucuucugucccauuuguccucccuugcuucauuuuuuguugucccuacucuccaucacccacuaaccuugcaaugcacacagguuuuuuuuuagcucccuaaagucauuucuguuuuccuuugagccuuuguacccuccuugagucuuggaguuuaaaugggaaccagcuucugacuggucuuacaucuuggaguuuaaaugggagccagcaccugacuggucuuggaaacgagccucuuuucuaugugucuuguccuucugcauggugaucuaucucagccugcuuuugcaccaaaaauaaauaaauaaaagguaaauagcucagaugccaaaaaccauaccguugaaacuguggcccgcucugugcucuuuguaaaugaggaggugacauauaagagaaagaaaugcagaucucuguugauuguaucaaaucugacaaauacugaaaauacugauuauuacugguuuaauguauucagauaauuagcuggaauuagccuagaagcacaucuaaauggaggagagagguagauguuagcuuuauuuuaagaaauuuucucauugcuaucuauaauaguauaaaaaaauagauugaacauaacuggauuuuuuuuuuuuuuuggaagcagagucuugcuuuguugcccaggcuggagugcaguggcacuaucucagcucacugcaacccccaccuucuggguucaaaugauucuccugcuucagcgucccaaguagcugggauuacaggcucccaucaccacacuccacuacguuuuuguauuuuuaguagagaugggguuucaccauguugaucaggcuggucuugaacuccugaccucaagugauccucccaccuaggccucccaaagugcuaggauuacaggcaugagccaccacucccggccauaauuggauuuuuaaauucuucuuuauugcaaugugauuuacauaaacugaaaugcagauuuuuagaggccaggugugguggcucaugccuguaaccccagcacuuugggaggccuaggugggaggaucacuuaagcccaggaguucaagaccauccugggcaacauuagugagaccucgucuuuacaaaaaaaucaaaaauggggggaggauugcuugagcccaggaaguugaagcugcagugaguggugacugcaccacugcacucccaccugggugacagaaugagacccugccuuaaaaaaaaaaagacgagauggagucuuucucugucacccaggcuggagugcaauggugcagucucggcucacugcaaccuccaccuccuggguucaagcgauucucaugccuuagccuccugagucugggauuacaggcacacgccaccaugcccagcuaauuuuuguauuuuuaguacagacgggguuucaccauguuggccaggcuggucucgaaccccaccucggccucccagagugcugggauuauaggcaugaaccacugcgcccagccaaaacaugcagauuuuuaaaugaguuuuugacacauguauguaauaucccuugggcaacccaaucaauauguaacauuuugucacuccagaaaguucccucauguccucuucagucauuuccccaacucuccucccaaaaagccuuuacauuuuaaauuuaucauaggauuuuucuuacugugcauucuauacuguuacuucucuuaccuacuguggugguuggacuuggcuucccguaaugauucuaggacauucuuacauaaaugggcuggucauccuuuagcuaauggaaguuuauaaccagaugucagauguucacauguuccuacugaauguuuaccugaacucaaaauagucugucucugugcuccacucuucugcugcuuaugccuguuuccacauggucccuauucugggccuggcuacuggcuucugcacuucgguacaaaaugaccauugucacucuccagguugcaggcgccccacugguuacugcaacgaccacugcagugucuucaguccugcuggccccaaguguuuuccagcagacaguuacaagaucuucggaccuugagaggaaagccagcuccccuucuccucuaacuauuggaacgccagaaagucagagaaagccuuccauuauucucagcaagucucagcuccaggauacauuaauacaucuaauaaagguauguaggauaccaauuuuaucuuugauuuuucauuauuuaaugaaagaaauuuuauaaauuccucuuacagaaucaguucauaaaguaaauucaaaagacuagcuggaggccaggcaaaguggcucacaccuguaaucccagcacuaugggaggccaaggcaggcaaaaaaaaaacaaaaacagacuagcugggaguacuguuucucuuuuuuuaagcauacaguccugguggagaaauaucugcaugaacucaaaauauuaaucaugauugucucuggguggugggauuaucaguuauacaaaucauuuauacaauuuuuuuccuaagcuguuaccaaggaaguaaaaucugaugagguaaauguggcauucguauccuuaaccuuuaccaucucuucuagaaugauuccagcuuccucaguacacuucaugaagucuacuugcagguucugaccaagaacaaagacaaccacaaccuaugacuggagcagaauaagucuaaaggcagagccccagccucagagacaaauaggcuucaucauggaaacuucugagcagaacauugaguuugagaauccugaaauugagccuaugagaaagagacucauuucuuaagaauguuuuccaagugacauucucagugauaauggagguuucacugugaagcaucaccagcagauccuuguuuugacaaaaaaaaaaaaaaaaaaaaaaaaaaagagagcgaucauuguguuaaguuauguggguguuuucaucagcuaggagcaaggcuguggaauaaggagucagauucucagcuugcuuucacuuucaaggacuuacagaggaguagucaccagccucacagcagaaguucagcccggcccccaccgcuucccccagccuaccccauagaaacgggcuuugggcugacaagucaaguuuugaacagaguagaaggcagcucugcaaaguagcuucuaguuuuuaggaccagaauuuaagccggcaaauuaggaauuauuuccucaagugaaguauauuuuauaugaaugccccauuugggccuuaaaaguugugaaauuucuuaauagcauuuuguuuuuaagugccccaguccugcccugcagcaggcccccagugcagcauuaccauuugaauagggcacugucaggcucuggugguguggacacaggcaugucauaccuuugaaggaaaggcuggggcugggaaugcccacauccuaucaaaucuucauuuuagguuaaacucuccauugguucugaaaaugcuaaguuugugugugaagcacagccuuauuuuccuuuucugucauuguugauuguuuuccuuaacacuuugacaaaaggaccaguggaccaaucugacaaagccauucugguuccuuuccuugaguguacugagaauaguuuuaaagcuaugcagaaaagggagcuguuauucacacugcccuuauuuuguuguagaauuauggaguuaaaagaaaaugugauuccgaacucuaccaauguauuccuaggcugugaguacuuucccggcccaaagugugaaaauauguaaagaagcuuuguuaugcugcuauugaucugccaugauuucuauuuauucuuuuauggcauguaaugguguuuaguaauauuuuaauguagauuuugauuuauuucagcaauaguaauuuuaagauauucuuugaaugaaagugucuucguuucuaugauacaggucauuuuguaguauuuaaccaauuaagaugcacugcuuacuuuucugagcacuauuuaaugaugggguaaaaacccaauuggcucaaccagcuagcauaaggauuagcugugaauaaugcugacagauaugaugguuccuuaggaacaaucauuuaagcuuuaaugguaacucaaucauaaguccauagauuauuuuuuucuagcuaaaauuuuagaaaauuacuugugaauuacauacuuguuuuaguuuggucuuaguuuuuagcauaaagaaugauuggcuuuuguugaucuaaacaugcuuccuggacaggguuucugcuucucauuuuagugucuucuauugcugucuaccuaauuaugugugaauugugcagaauucagggaagcuuauaaguuuucaugcucaauugugaauaguuuguuuucacagauaguauguaaauuaagcaaccaaaaaugaauuccuuaugcaucaucugggaacgagaaagcuauagugggauacagaguguugcugacaccgggagaugguguccagggagccacgugacuuccauaaaguggacgcaccaguaggugugauugcaccucaaguguagucucagugggcuucggugaacagacgaaucaagggauucuugaaucgaaauuaugcuuuugaguauguaauauuaugagagaguuaagagagaauauccuaaagagagucugugaucauacuaauuuucaccuuuaaugcuaggaauggauaugauagacaguaaagagcaucuaugauaaggcuuccuuagugugaaaguaaacuuaagugcccaagucauggagacuugaaaaggguaaaccuguuucaccucccaaauuuauauauucaaaguauuuacuuaaaauucagaagccagaaguucaugucaugauuaccaggaaguucaggccagaaugaaucccuagagaagccaggccaagccuggauaauugcagcuggaugacccuggcccgaaagucacaguucaguugccuuauuccuaguucaggcuuacuaucuagaaccucaugcuagcuuagguugcauguuuacauugcugcagugucuuuacuggaagcuuaguuggaucgaaauggacaccgagauggagaugcuucuggcuagauuucgcagaaccccaggagaccugcauuuagaccacucuguccauuugugugcccacccccacccccagggucuaaguguagacuccaagaggagcagcccagagcuuggaggagaggugugucuggggcaccacugguggguggugcugcucuucuuuuuguuguaguuaaugcggugucuuuuaauggacucucaggccucccagacagccuuguuccuuuaaggcagaagcucuucuucauuguguaccuccugggauucaugaggugugagauuuggccugcuugacuuugaauucaaguuuuucaagugacucucagugucagaagaagcauuucaugcuguccacaugugguauguccacagcucaccuucaaaggcuuagauguagccaucacagagagugguauuuuauuaagaacccaagucccagccugaccaacauggugaaaccccaucucuacuaaaaauacaaaaauuagccgggcgugguggcacgcgccuauacucccagcuacuuaggaggcugaggcaggagaaucacuugaacccgggaggcagagguugcagugagccaagaucacaccacugcacucuagccugggcgacagugagacuccaccucaaaaaaaaaaaaaaaaaaaaaaaaaaaagucacgcugggccccucucuacagggggacacacaggcuuaguuuaguauaugucuaaccagauuuugcaugucaagcauuuguccuuuuccuggcuuauguuuucuuguagaaauuauauaaacccuaucaaauccacuacuagguaaauuuuuaaaccaugcagcuuuauuacucuccucccccaaagaauguaguuugaaauuuucucauuuccauaguagaggcccuaacugccauuguauuacuaauaaugcaacaugaaauugaaggugccuaacugcucaaaaaacaaaaucagccaucauacuguaacucugagaggaaugagagguggcacaggcacgagugggcucagcccgugugagugaggagaacugaggaauccuagggugcgcauccugcauccuggcugcacguuugcugcagaguauguuuuucuuucuugccucccuucaguuuucuucaguugcguucaguguaucuucuggaaccaauagugcccuguguucucaagucucuaaaaugcuaagaucugagcaaagucaagcagcuuacacuaggcuuuuuuacagcugugcuugagaacauuuccgaguggaccagggccuugaggagccuguuuuucagcaaauucaacagaugugugcagugauucccuccguuuuguauuugacaccuucauuuaaaaugcuaagaugcaauaucauucacuucaaaguggggaaaaugcagaauuguguuuccuuuuuaucugugugauuccuuaagaaacauguuuuuaaaauauguguucuaaaugguuuuuuauucuguauuacugcuuuggccauguggcucucaugacuuucauuguaccagauucucagcucccugaaacauggggacgagaagcucuggaauuacagcaagauuuuuguuccaugagcgcaauacuguaucauuaacauuuuuaaugguauggauuuuauagcaucuguguauguuugcaaauauuaaguuauuacauguuuuaaaaugagcguuuuucaucuuaaauuuuauauguuugcaaauauauuuuuuuaauaaaauuucaaaaccaaguuuuagcaccuacuaaaa

SEQ ID NO: 17487 - RNA, 30817 nt, Homo sapiens
cccauccccgccccgccccgcccggcgacuuaacgcgcccccgccccgcgcccggccucggcagccgccugucgccgcgggagcagccgcuaucucuguguguccgcgugugcgcccgguccccgccugccgcaccauggagagcuaccacaagccugaccagcagaagcugcaggccuugaaggacacggccaaccgccuacguaucagcuccauccaggccaccacugcggcgggcucugggugagugcgcggcgccggccggggacgcggcucgggcggggcggggggcgucugcggcggccagagucgccgcgggcucugggucgcgcugcgagaugccuagacgaggaagguggcccgggcgccgucggagggcggagacgcgcgccucgcagggccccgggcugcaggcggcuuccgcugcgccgcacacucgcccuacgcccgggcucggccgcgugggccucugguccuccgugcgccucaggccggcucuuccccacgcggaucgccggccgcgcagcugcaugguggcgcgggggaugggcucgcgacucgccaaguacccucuagggugaugccgggaaggccaccauuacugcuguucuacagaacgcggcccucuuaacccucuccaccaccuggcugugugggcgccgccgggaguguucccccuuccagauggggaaacggaggcuccgaguuagucagcuacccaaaguuacacacagggagaucugauuugagccccagcaguccgacucuagagacccuguuuuuaauuccucuugcaggagacucgggggcccggccuucuccccaccucagacuacgcuccccuaccccugucuccugccaccccuggguuggguccgaguuuggagcagggggcugcugagacgccaggcagcggcggggcugauugggggaagaggggaggagggcgguggcacgugggugcagaacccugggauccauugugaaaaggaggucuaagauuugaccuggggcgggaggaggcggagggcaaggagacugagaaggcugagcgccggaaggacggaguuccagggcccuagcgccgggagugacguccuggggcagggccagccaccaggugcuguaucucccaggcaggagcuggcgugccuaggccccaagauccuucccuggccagcccuuuuggcccagaagguggacacccaaggagccuccucuguagcggagacagggauaauuaaugagggccaccgugcaugcagcuggagguguccaguggggugggugagggggucagucagugaauuacuucagagccugcuucccgcucuguaaagcggggacaguaauggcacuuaaccacgcugggugguuucaaggacuccagugcucuacuuggaggcugcuuugaggccacagugccagcagugcuccgggcucaugacaggguugugagggcugcgugauggaugauuucucgggaccuucccaaacaagcucuguuucagacagacaagauucuggcuucuggccaauuucauucaggauauauuauuaagaaguaaaucuguucaccuuucuggguggauacgcauucacccuuugugccucuaagacacccuguucucagaagggauuagaugucuuucaaagcccuucccccacccacugccuugcacacuuuggaccuguuagcucuccuggguuugugucagucuuaccacuuaugugggguauccccugccugggcagggaccuggcuuacucucagcuccccuuucaccagccuggcacacgguagcucugcaggccuuguauugcuuauuugguacuguuggaccugcuaccuuuggccguuucagggggucugaggucuagcuggagagaggcagcaauuacccaacuaaguaguauugcacaucugagcaucuuucagggcuagauaaaacaugcagauguuuacaggguuccugagcugccaaguagguaucugguaugacacagcaucaucguuuguugcauccugagaauaacccugugagauagauuguguuguauucacauuuuauagacgggaacacugaggcuaguguguuaaguuacuugcccaggcugggaauugguggccauuccguacugucugguuggggcucaugcugucaggaaugcuucuuggcagggcauggugguucaugccuguaaucacagcacuuugggaggccaaggugggaggauugcuugagcccaggaguuccagaccaaccugggcaacacagugagaccccauagcuuaaaaaaaaaauuuuuuuuuugagauggagucuugcucuaucgcccaggcuagagugcagcagcacaaucuuggcucacugcaaccucugccucccagguucaacugauucuccugcccuagccuccugaguagcugggacuacaggcauccgccaccgcaccggcuaauuuuuguauuuuuaguagagaugggguuucaccaucuuggccaggcuggucucuugaccucaggugauccacccaccucggccucccgaagugcugggauuacgagugugaaccacugcccccggccaaacauuuuuuuuaauuggcuagguguggugauguguaccuguagucccagcuacaugggaggcugaggcagaggaucacuugagcccaggaaguugaggcuguagugagccuugaacaugccacacacugcagcaugggugacagagugagacugugucucaaaagaaagaaagagagagagagagaaagaaagaaaggccaagaaaagaaaaauaguugggcaugguguuacauguaugccagcacuuugggaggccaaggcagaagguucgcuugaggccaggaguucaagaccagccuggguaacauuagcaagacccugucuccaaaaauaaauaauguuucggccaggcgcagugacucaucccuuuaaucccagcacuuugggagguguaggcgaguggaucaccugaaggucaggagaucgagaccagcuuggccaacauggugaaacccugucccuacuaaaaauacaaaaaauuagcuggacgugguggcgggcgccuguaaucccagcuacucaggaggcugaggcaggagaaucacuugaacccgggaggcagaaguugcggugagcugagauugcaccauugcacucuggccugggcaacaaaauugaaacuucuucucaaaaaaaaaaaagaaugccucuugggcaagcagucugugccaggcuggagaauggugaaaaaggugaaagggaaggccagguacagccgcgguggauauuagucagucugaaaggcacuuggagagaaauaagauuuacaaauguagggugcuccaaaagaguggaaugucaagugugucuccuaguucuuuguuaggcaaagucugauuuccucaccgccguuaccccuccggaaacauacugugguguccgagaguuacaccauguuuacauuguaaugucuuggagagggaagcucacugaacucaaaaaauauccauuugcaaaagaaaaaaaggauauguaaaauacagugacuguguguguguauguauauguuuaaaauaugcaaaaaaggagggaaaacuuauuuuucagaaggaaauaacguugcuaugcaacccauauuuugaaaguugugagccaagaguauguguguguuugcacccaaaagcuaaucaaggaagacuugagacacagguagucuucuguuucuuguccccagauguuuaucuugaggcccacuguucccucucugcaaugaggcauagagugaaggcucaguccggaagcccuggcccaaucugggcuguagucacagcuaaagugacaguuugucagaauguccccuuuucugggggagcucacaggacuuugauccaguucuuuuucuuuugagauggaguuucacucuuguugcccaggcuggagugcaauggugcgaucuuggcucaccacaaacuccgccucccagguucaagcaauucuccugccucagccucccaaguagcugggauuacaggcaugcaccaccacgcccggcuaauuuuguauuuuuaccccguagagacgggguuucuccauguugagguuggucuugaacuccugaccucaggugauccgcccgccucggccucccaaagugcugggauuauaggcgugagccaccgcuccuggccccuuuuccuuuuuucuuuuuuuuuaagacagggucuugcugugucacccaccaggucuggaguacagaggcacagucauggcucccugcagucuugaacuccuaggcuauagcaauccugccucacccuccuggguagcugggaccacagacaugugcuaccaugucuagcuuugguccaaucuuuugcuggccacuuacugagacaggauuuguacauucugugaggacccaggcucguuucucgauagcuuucccauuccuaugccauugcugacccgugugcagugaaccucaccaggcccaggaagcagggacacuggccucugucaggaguugggccuggaggugaagggacagaccucacagaaggcucuuuguugaggcagcgcccacaguggcuagagcuucucuggggucaucuccuuccaugggcugaaggaauuauggcaaggguccagcucauccuggcuuuaaaaaaacaaaaccccaguggccuugucagaaguggccuggaugcugaggcugguggcaaagauuucucaguucucaccagggccagacugugguguuauccaaacagugcaagugucaucugaggacuccaucacagucaggccugauucaaaagggaagguggucugugcuuucaacaaguccccccaggguuucugacccacagcuuuggggagguuaaugccuggccaguccuggcugguggacacaggagaugaguccaacccuggcucuguuccuaguggcugugccuuugucagaaaggcccuuccggccaggugcgguggcucaugccuguauucacagcacuuugggaggccagggugggaggauugcuugagccugggaguucaggaccaaacugggcaacauagugagaccucaucucuacaaaaaaaagaaagagcugugcaugugccuguagucccagcuacuugggaggcugaggugugaggaucacuugagcccaggaguucaaggcugcagugaguuaugaucauggcucugcacuccagccugggcaacagugaaacccuggcucuuaaaaaaacaaaacaaaacaaaaaaaccuuccuaucucagguucucaguugcccaggcuagaaugcuguggcgugaucucugcucacugcagccuccgccuccugggcucaaaugaugcccucaucucagccucacaaguagcugggaccacaggcaugagccacuaugccuuggcuaauuuuuguauuuuuuguagaguugagguuuugucauuuugcccaggcuggucucaaacuccugggcuuaagcgauccaccugccucagcuucccuagaguacugggauuacaggccauuuucuccaucuugaaaggagagguucauggauaggugguuucaaacugggugccucaggaguagggcuggggauggagugagugggcuccggggucccaccgcccgcuguugcugauuuuacauccuggugcucuuugugcccuuaaaguggcugggguuguaucccaguuuacccagcucugacauccaggugcuuuggcugaaggcuugagggccuccuggggucucuggccccauguggcuccgccucucugggccuguuucuguuuuugggcugccucaggacccauccuggcccugacugaggcaagagcaugaccguugagauugccccagcagcagcauuuccucacucagugugaagacacuggccacccugggguggcuugguucucugcccgagugaccucuccucugcagggcugguggucgguguuuuaagaaacuggaagugaaguacagcaccuaguuaggaucuggcugagacuuugucguggcuuccuauggacucuaacugauguccggccccuguuguggcucugaccccucaacauucauugucucuuguggcaggcuuguugucacugucgccuaguuccacaaaaucaggaacucccuucuugccacagaccaguuugcccugggugcuggggacacuucuagaggucagggaccugcacagagcuagguccucaggcaggcucugcuccugcccugaauggagaggcaagguaggggagagaggaugugcugggagcuggggugagcccaccugcagauggggguugcucagaagucaguugcauuugugcacuggguggaaucuccgaggacuacacagcuggaagggaaguguggacgcccaagaacuuccucuacugagcucuccuagcaccuuuuucuucauuuauuuguuuguuugacagagucucgcucugucacccaggcuggagugcaguggggcggcgaucuuggcucacuguaaccuccacauccuagguucaagcgauuuucugccucagucucccaaguagcugggauuacaggugcaugccaccacugcccagcuaauuuuugcauuuucaguagggaugggguuucaccauguuggccaggcuggucuugaauuccugaccucaggugauccucccgccagccuuggccucccaaaguguugggauuacaggcgugagccacugcuccaggcccuuuuucuuuuaaaaacaaauuuuuaggccaggugugauagcucacaccuguaaucccagcacuuugggaggccaagguggguggaucauuugaggucaggaguucgagacagcccagccaacauggugaaacccugucucuacuaaaaaauacaaaaaaaaugagucgggcaugguagcaggcaccuguaaccccagcuacucgggaggcugaggcaugagaaucgcuugaacccgggaggcggagguugcagugagccaagauuguaccacugcacuccagccugggugacagagugagaacuugucucaaauaaauaaauaaauaaaaauaaaaacaaauuucuagcagcuugauuaagguauaauuggcguaucauaacauuguaagugauuuuaaugaauuugcagagauuuacuacaaaaauuuaccacaucuccuaaaagaucucuucuggacauuugcugucacuccccauuuccacccccaguccugggcaaccacuaaucuaauuuucugucucuaaauuuaacucuucuagacauuucauauaaaugcaauuauacagaaugaguucuuuugggucuggccucuuagcauaauuuuuagagggucauccauguuguaacaugaaucaguacuuuguuccuuuuuuuugggggguggggggcagggucuccacugugucccgaagcuggagugcaauggcacagucauggcacacugcagccucaaccucccgggaucaagcagucuucccagcucagccuccuaaguagcugggaggcacucaccaccauacacagcuaauuuuaaaaauuauuuguagagacaggguauguugcugagccuggucucaaauucugggcucaaguccucuuccugccuuggccucucaaagugcuggaauuaacaggcaugagccaccacgcccagcccuucauuucuuuuuacggcugaauauuccguuguguggacauagugcauuuuguuuauccauucaccaguuuuucuuagcauuuugcucuuauccuagcucugcugcuggcaggccgugugacuuuaggcaagucacuuucugugaaccuuaguggccccauccuccgaaugaagcauagucuaauauuuacugagcaauugcuaauuucuaugcauggugccacguucuguacauacacacuacaucauuuagucagauucuucuuuuaccuccguuuuauagugaggaaacugaggcucaaagagguuacagccccaagguuacuaggauacaucauguauucauuugugcacucaguuugugccugguacuauucaagccuguggauacaacagugaaaggcccaaagcucuguccucaaggagcuuguauugcaguaggguagacaggcaauaaccaccuaaugucagguggcaagcaugagugaggggaagaagagcuauuuuagacaguguggucagggagggcuucuuggaagaggugacauggggcagagaucugaagaaacaaccugaggucuggagccagagguucuuuccgggcagaagccagcucggguaguucagggcacaggaagagcaagaacugcuucugauguucauuuccacccugacauccugggauucucuccugaguauuuuuuuuuuuuuuuuuuuuuuuugagguggagucuguugccuaggcuggagugcaguggugcgaucucggcucacugcagccucugccucccagguucaagcaauucuccugccuuagccucccauguaaaguagcugggacuaguggcccgcaccaccaugcccagcuaauuuuuguguuuuuaguagaggcgggguuuugccauguuggccaggccggucuugaacuccugaccucaggugccucaggugagccaccgccccuggccucuucuaaauuuuuuuuuuuuuuuuuuuuugaggcugaguuucacucuugucucccaggcuggagugcaauggugagaucucagcucacugcaaccucugccucccagguucaagcgauucuccugccucagucucccaaguagcugggauuacaggcacccaccaccaugcccaacuaauuauuguauuuuuaguagagacgggguuucaccuuguuggccaagcuggucucagacuccugaccucaggugauccaccugucucugucucccaaagugcugggauuauaggcgugagccaccugaauauuuaaaaaaaaaaaaguauaugcauaaagaagaagauaaaugauguacucuugucauaaauaaugaaccuguguguagcugcucccaggauuaagaacuaguacauuacagugauuuuuggaacuacagugggucccuccauccucaucuucccuuccccugagaaagaacuauacccugaauuuuuuguuuguuaucauucuauuguuuuccuuuuuuuuuuuuuugagacggaguuuugcucuuguuguccaggcuggagugcaauggcgccaucucggcucacuucaaccuccgccucccggguucaaacgauucuccugucucagccucccgaguagcugggauuacaggcaugugccacaugcccggcuaauuuuguauuuuuaguagagaugggguuuauccguguuggucaagcuggucucaaacucaugaccucaggugaucugcccuccucggccucccaaagugcugggauuacaggcuugagccaccgcaccuggccuguuuuccuuguaguauauacaaaaagacuuguacauaaaucaauauggucuucuuuguuaaacagauccuucugcacugugcuuuuuucacacuauauuugggagagaauauugauaccggauuugugaaguguagcucgcucauucuuacugcuguauaguaucccauuauauuaauauauuccaguuaaccucgucuauugauaaacauauaagugaguuccaggucuugcaauugcaaacaaugcggggcagcccuguuuguguuuccuuuuuuuuguuguuguuguuguuuuuuuccugagauggagucucacucugucaccgagucuagaguacaauggcacgaucuugauucacugcaaccucagccuccuggguucaagugguucuccugccucagcuucccaaguagcugggauuacgggugccugccaccaugcccagcuaauuuuuguauuuguaguagauacaggguuucaccauguuggccagguuggucucgaacuccugaccucaguugauccacccaccucagccucccagagugcugggauuacaggugugagccacugugcccggccuguuuguguuuccuguagaauguguggaacaugugaguacauuucacuguauguuccuacuggugaaguugcugggaguuaagggaugugcaucuucggcuacugaucugguuuauuuuuaaugcuugaaagauuacuuagguucucuauuucuucuugagucaguuuugguaaauuauuuucauuauuguuauuauuuuuuagacagagucucacucuguugcccaggcuggagugcaguagcaugaucucggcucauugcaacccacgccuccgggguucaagcuauucuccugccucagccucccaaguagcugggauuauaggcaugugccaccacgcccggcuaauuuuuguauuuuuaguagagacgggguuucaccauguuggccaggcuggucuuugagccgcugaccucaggugaucugccugccuuggccucccaaagugcuggaauuacgggugugagcuaccgcgcccaaccugacauccauuaucucuugaaggagcccaucuggagggugagggagccucucuggccuuuucuugcauagaaaccugugagcagguggagugagcacuaaagcgaugacagagauucuccuggccaggggacaucuggaagaauauauauuguccuggaggggaguggagagggggcuuuuuuuuuuuuuuuuuugagauggaguguuacucuuguugccaaggcuggagugcaauggugcaaucuuggcucacugcaaccucuggcucccagguucaagugauucuccugccucagcuucccgaguagcugggauuacaggcguccaccaccacaccuggcuaauuuuuugguauuuuuaguagagaugggguuuuaccauauuggccaggcuggucuuaaacuccugaccucaggugauccgccugccuugaccucccaaagugcugggauuacaggugugagccacugcccccagccuggagggggcuuuaagagacuuucuuugggccuagcucuaagcuugccacaccaccgucacagguugaacuaauugggguuguaaguggacuguuuuggucaaggcaggguguguuaguuuuuuuuuuuuuuuuuugaacagucaagugugcuuguuagcccuguuuaucacagagucaggguauacaguaaguacccuguagccccuccaccgugcuccucaccccaucucucgccaguguucacccagaguugucacacacagcaccacgggauggggcguccaccugcaguugugcaggcagucuggaauggcaggaaaaacucuggcccugaggaggccacaggcuuaaauguaugccuuuggccccaaaggcccgcuaggaaguugagcuugaaaguaacugucuccugugugcucagugcuuuacagugugcagagcccggucucaauccuugguguauuucuccccucuugccugccuguggccagcaggaguggguggugucaccaucccugccuguagauaagagcugcaggugcugagaggguuggcagugguggcggcugcuagagaccuggguacugugcaugcugcguuaucucacugugucucccagacacucucccaagugaagaagcugagccccggguugacgaagcacuuguugaagucacgaagcccaaguggcacagcucaccuccccaacccaggaugcucugccgagggagagccccaaaagcucuggggaagagugcggggacaccuggcuccuaagcguucuucuuuugugcguguuuacuugguagaagugaagagaguggccgcagcaggcuggaugcagccuuuggaaggaaugaaaggcugcaggccuagcaaggaaggcuuaaaaucagcugcacguucuacuucucacccuuggucaccucgcagcugaccuuccucucuccacguuuacucuaucugggccugggugugcuucugccacacacagaaagagccugugccacaccauuucucccuggaaccccuucugguggccaaugggacugucaccccggggugucgagguggauggggcagguggagcccugcacuuaccguccuuguucuuccccggaacaguuuggcccaguguccacccacauccuucucccaccaaggaucccuccuaaugggaccauggcuuuagaaacaggaccccucagggccggggcugcccuuggaggugggaaggacgagaggucagccugaggugaccuccaguugaagcuggcccugggagcgugggauuaggguggccuccaguugaagcuggcacugggagcgugggauuagggucccugccaggcagaaaaggguuucucguuuaccauguccuccccucccucuuucagguguagugucuuuucccaugaccgggaguucauagaaauaguuaaguauaagaugaucgugugcgagaauguugguacuaaaccagcauggacaguuuucuggauuucucuacuacuaacuugucugcacugagcgugacucaccccuaaccuggugggagcgcugauuggaggggcgggaggcuggcggcgugagcuccagauggugcaugugcccuugggcuuggcaugcggcgugucuucgugugaaggaccucugggagcagcgagagggcugagcugagcugagcugagcugcauguggaggggcccucccgggaggccugugcccugaggcugaacuuuuaacaaaacccugggaccagagggcuucagggcugaucaggaccugcagcgcuuccugcugggaagcaggaagcaauagaaaguuuacgcuuucuauugcucaggagccgcucagugauuaaaacaagucuaaaaagccaaggggacuccguggccccaccacucccaggcuggaaggcagguucuugcuuugucagcccuuccucagcccuuguccauaggcagaagggguuuuuauuaauacaugauuguagccuuguaggagaugagauuaugugucuugcuuugaaaauucuacacaaaagccuguuuccuaguugcuacagcagcccucaaacugcccauuucuaaagcuuucaaguagcccagugaugcaauuggaaagcccaaggcccaguuuuucaggcuaccacaccccaugcguggaggcugcugggaggucugugguaacuccaugagccucagucccuuccucccugccccaugggcucagaggcccagcaccccugggugcugagagggcagggugcccuucacaagugggcaguguccgggcaguccugucaggauguggggucagucguaggaaugccggcaccccuuggcugcugaguccuuagacuccugggggccacuaggugggaacuggguucuaccugacagcagcugcccccagccgcagugcuagccuugggcugagucuucugugcuagaucucuccugggccccuccuuccuucuuacucaaguccaaccccagauauuuucaguugccgugauucugaggaucugaugccccuggaaagguacaacaguccccagcacccacuagcuggcccaggccccaaacugccaggaguggccuucuugagaccaugugucacccucccagggaacaagagcucguggcugucugauaagccaggccugugugacuccucaggacaugcacccccaggucccuguacagcugagcacaauagcucaggagugcagggccaugaugccugugucugucuucucuccugggccacagccaccccacgucaugcugcagcgccgcagagaucauggcuguccucuuuuuccacaccaugcgcuacaagucccaggacccccggaauccgcacaaugaccgcuuugugcucuccaagguaagagcccagcugcccacugccagccacaccuugccugggacuagggucacacgggcccuggaauggugaguggucuuugaggagaccuggcugggcccaccucucccaggugccuucucccugcucguccuggccucucccucaguguccugcucugugcugacccagcuggcuaaggaauacaggacugaauugauggguugcucugccauggagcccagguacauaaacaacgcuuuaacucaaagaaauggaguaggggacuacggaaacaucuguuguguguucugcccagucuggguguugacaggcaggacuggcaucucggucuggguuguggcucccuaccugcucuaucuguguugugccagcgcucccgaggccacggcuugcccccucggggugguggugugcuguagcaggguuuuggauggggacccccugaccccccccuucuggguggaaucacagccacagaucccugaaauccaccugugcucaggccugccuccguggcguuuggucucucgggcaggcuuuagagcuuagaagucuguccaaguuguucccaugccacaaaccagggauuagggcagccggcugccugcugggguuuuggcuucguccagccucacagcugugcccccugcaccugucuuagugccugccuggccuuggcagugggaacuuugggcugaaaaccaagaggcugaagagggcugaaaggggagaaguggccuucacuugcuuccuccccugaaauggaugcugcaguuggccggcucggccgggccccaggggucagugugaaguaggcacagcccgaaguagaaccgcuccccaccugaccucaccccaccauccaucucccggcagggccaugcagcucccauccucuacgcggucugggcugaagcugguuuccuggccgaggcggagcugcugaaccugaggaagaucagcuccgacuuggacgggcacccggucccgguaagugcuccugccagagccucccaugccucugccuccacuuccuauuucccagacaugugggacggggguagggggugcccacugagaagccaaagguguugaaaggcggaggagggcauugaguugaggaaggaaagaagcagguguuuuggggacacguauucaacccaagcuggugccaaaggggaaggccuucugaggccucagccagggugcucugggaugacuucagggagggccucuccccaagcuacccuucugcacugggccuccuuggcuagguagcuacagcuugggaagagaggggacucgauaagggaguggcugcaggaugcuggcgaaacccuggggaagggacccaguuuguuccuuggggugccaucuggcaucccugcaaacguuaagacuucauggauuaccacaaaaacugucacauggucuggguccccacgaggggcaaauguucugucaauuuuuucaugauucucucucccagcacuuugugaagugggugaugugggaacugaggcucacagagguucagucccuugccugaggccugaggccacauagcuggcuagugggcagggcugggauuugaaccuauaauuauaauuaguucauuaggagaagaagucacaugcuagguagaggccauccuggggccugaccuucugcagaggaagggcuugcugggcugggugggaguguggcucccuaggcgggugagaccaggaucccuucuccucucagauuaacgguggccuucuguuaugacagaaacaagcuuucaccgacguggccacuggcucccugggccagggccucggggccgcuugugggauggccuacaccggcaaauacuucgacaaggccagguaacacaccuacuccccacccccaaccuggguaguuuuggggagugguccuugggugacccacccuucaccaucgcccccagacucuuccucuuuccuggcuagggcagaguaauacauaugcguggccucuuuugcucuuuaaacauccgcuauggcuggugccaugaccggcccccuuuacaaaugaggaaacacucaggaguuaagggaccugcccugggucccucagcagugacuggcagggccagguuugcacagagugcgugcucucaaucaugugcucuucagccagagugcuuaggcugaggacuuccuguuuugcccccagcccugugcccagaccccagaagucucagaaagacccacccccaggccccugucugacuaggcaccaggagcccaggccugagccacuugccuuuaucuugguaaaggggaggguuguauguucugagggguucugggauaccuguaagccaccuccuaucagcagggaagaaacaaacauuugagagauugagccuucagagggugggugaugagccugaccagaaaggugugcugcucuagcgcccaccaggugauuuguaggaacggccccccaggaagguucuagccauaaguuugucugcgguggucagauauggccuggggggaugagguuguaaacuguuaagaauaauggcuggcugagggaaggauugcuugaggccaggaguuccagaccagccuaggcaacagagcaagacucucucuacaaaaaauacaaaacuuagccaggcauggugguacacaccuguagucccagcuacauaggaggcugaggugggaggaucacuugagccuagggcuucaagauuauagcuauacaugauugagccacugcacccuagccugggcuacagagcgagacucugccucuuuaaaaaaaaaauuauucuuuuuuuuaaagaauaaucacuguauuagucuguuuccacacugcugauaaaggcauacccaagucuggggaagaaaaagaggucuaauggacuuacaguuccacauggcuagggaggccucacagucaugcuggaagguaaggaggaacaagucacaucuuauguggaaggcgcaggcaaagagagaguuugugcagggaaacucccguuuuuaaaaccaucagaucuugugagacuuauucaccaucacgagaacagcauggggaagaccuguccccaugauucaguuaucuccugcugggccccucccacaaccaguaggaauuacgggagcuacaagguaagauuuggguggggacccagagccuaaccaugucagucacucaucagaaggguuccuuugcccuuugggggcuaggcccugugcucagugcucaugugcuguauuggguuccaccuuuaaaagcccccugugaguuggguaguggugugagaaccgugacccgucuuacaggugaggaagcugaggcaagaugcuggccuaggccauccaguuggugguggagguacccaggcugcucuuggagaggcugagggcaccacaggagcucggggaguccugugggcgggaagccuccuagaggaggaaggccaguggggccagcccgcagggugugagaagggcccaguucugcagcugauggcaucuccacugcccuguccuccacuccugcagcagaagugccauagugggguucgggaagacuguggguccuugaaggacaggaggcugcagggagcaccuucugugugcaggcccuuccccaggacuggcucuccaaggaggccucacagucccuuccagaccccuucaggccagugucaccugaccacaguuugcuuucauuccuuggugagccuuggggcaggcuuggcuacacccagaagugauucaccaugaaguaaagagagagagacacacaaagaaugagaugcauguuuaagagcauuuuauuuggcagagaaccagagaugugaguuaauuauucccuacaguugcuggaaauaauucccugugaaggggcauuuccugacccuaacauaauggaacaagucaguguagggagaaggaguuuagcuggguucccagaagccaggguggcuuggggccaggguugccuggagccuaggccccugacuguaccugggggaaggggccagggcauccagggauuaucaugucaggccaggcacccggagguagcgucuugauagagcaaacuggucuccacucacuguuucucccugcccuccuguuuaaaaaguacagaaugauauuaagaaaugaacguuuuccuuauuuuuuuauuuuuauuuuuucugagauggagucucgcucugucacccaggcuggagugcagugguacgaucucggcccacugcaaccuccgccucccggguucaagugauucuccuccugccucagccucccgaguagcugggacuacagguacgugccaccacgccuggcuaauuuuuuguauuuuuaguagagacgggcuuucaccauguuagccaggauggucucaaucuccugaccuugugaucugcccaccucggccucccaaagugcugggauuacaggcaugagccacugcacccaaccaauguuuuccuuauucuuagcacacugccucccacccccaauuuaaaucuaaugauguauuuuguccauguuaucaugagaaaagcuuacaaaucuguaaucccaguguguguguguguguguguguguguguguguguguguguauaauauaaaaucuaguauuacacuuuaaaccaagccuucuaucaugagcuuuuucuccugauauuaacaguggagagcugguuuuuuuuguuuuguuuuguuuuuuugagauggagucuugcucugucacccaggcuggagugcaguggugccaucuuagcucacugcaaccuccgccuccuggguucaaguaauucuccugccucagcuucccgaguagcugggauuacagacgcgcaccaccacacucagcuaauuuuuauauauuuaguagagacgggguuucaugacguuggccaggauggucagucucaaacuccugaccucaggucaucucccuacuucagccucccagagugcugggauuacaggcgugagccacugcacacauccugagagcugguuuuaaugaucacauaauauucuguuuuauggagaugcuauaauccaucuagccaguccuuuguuguuggacacguaagguaguuuccaaaucguucuacaacaaaugucgaccuucuguuuaggguucccucucuucaaauuaguucaugaauggauguuugcagccccccaccccuaacucuaacagcucaggcaauaccaagccucaggguuagcccaggcuccuguaggccccuucccuguucacaaccccuuccuuggcaucuccucgggaccucagcacgcccucugaccugagccugauggcccuguagggcuuagccuugucccuagucucgaagccaaagcugugcugggccuccagugcuagccucgguucgacuucccuggaagugggugugggcuugggguggcagccaguugccuucccuggaaucccuuucugggaagucgaguuggcuucucuggcucagccccaucauguggccccuuucuggagcugcugugccagaccagagucccugcagggucucugggcccccucaaaaccuacaggggaaagaggaggcaaggcugggacaggauagggccucugaagugugggccugaggcuuuguccuucuggccaugguaccccacaggggcaccaccuccugugguggaggccacagaagagcaguaugaggcaggagaggcugcagggagugcuccuggccugcuggcauguggaagugcugagucaugcugacagcuccguggcuagcugucccagccucuuccugcugccccugccuuggcccugcggcagggaggccuggaggcuuggacugcugagcaugcagccggguugagggccuuuuccugcaggagcaggagggcagccauguccccucugagcccaaccaggcaccagccucauuuccuagggcuacacagcuagacacugggcaggguaaggggagguccccaaguccuaccacuccucacccuacuugcaugccugcacggcaaggagcggacagucuaggcuacagucagaccugcguuugaauccuggcucagcaacuuccugacagcgcgaccuucagacaaguccugucuguugcugccgucccucugcuacccccauccccucacaucucccaggccgggaacguucuguuugcuggguaauuuaucccaaguucaguguucuuuuuaacgucucacugucuugaaaagaucacaguugccuguguugaggggaggagagggccccugugguagagaaagagccaggugcagcuucagucuuggggucaagagcuagucuuggaagcuuggggagagccugucccaggaagcgccugguccucaagugcccucugcucuauccuccccagagcccucuugcuccaggguguugccuagagugccucaggccuccuuggcccaccucccuccuccgggcagaagcagagcuugguucccaagguuccccuuucccacuggcccacccagccagucccaaggccuccuccaaccucugguucacagcggggucuguccccugcagcagguggcucaagccuauucacccacccuuccucacuuuccucucauuccaacaacccccauuuuucuagaucuuauuagccagaucccuguuguccuagaccucuguuucuuaacaaccaguacuucuuccugagcuccugacgucuuccuucaugccauuuucucuugggguguggcuugugguaggcugcaggaaccuggugacacuguugccccucgaguguaaaugccaucuguucugcauauccaugcguggcugcuccuuuacccagaaugcaggcuccuuggaugggugggggggugggagccagcuggguccaggugagagggacuggccugauucacucucuguccacagcuaccgagucuauugcuugcugggagacggggagcugucagagggcucuguaugggaggccauggccuucgccagcaucuauaagcuggacaaccuuguggccauucuagacaucaaucgccugggccagagugacccggccccacugcagcaccagauggacaucuaccagaagcggugcgaggccuucggguauguacgaggcuguggccugaguguggucacagcacgggagaguggucugugaucacagcuuugcaggugcaggugcaggagcugaagcugggaccuuaagcaccaucuaaaggucccuuucuuuagcauuugacucacaauuucaaacucuaggcauuuggacuuaauggcucaggauaugugggccaggcccaguuuuaagugaguuuccuuguuuucgugguuguggcaugguggcucucggagcuuccacacaccaucucacgucagcucgcuuuguucuugaggaaggaggguucuugagggaugggggcuugcucgguaaagcuaaaggauguauagcugcggagagguuugaaccucaguuugguggccacguccugugcccagccccgcccagccuggggaggaggaacaggcuccuggugaaaugggagauaggguuuccagaugccccccuucggccuugauugguuacaaauucagggucaaagggcacaaagcagggaggucaaucugcaugggugucagccagaggggcuccaccucaaagccuccaccgguguugccaaacacaagcugcucugcacaggggcccagcauuggcugaggaggcuguggaggggagggagcagggcaggugccgugcaaggcuuugagacucaggucaggccuccaggacugcguuuugcggaugaacccaugccugugacuacacuaaguaacaggaugcuugggguuaccuugcaguagcacagcauacgcaggccuguguucccugaugacugaccucagaaagggagaggaggaagggaggaaauaaucucuguuggacaggcgaggaaacugagccacaggguccucaccccacaggccuccccaaggccacaucuaucuggggacucagaguacaaccccagcagcacccccaggaccuguguccauaaccucgugacucaagccagauuccugaaguccuggcuccaccgcuaacuugcuuuguggcgugggucacguuacuuacuccaccuucggugucucaguugauuugucuguacaauggggccagcucagcacccaagcauggcguggugaggcuucagugggcuaauauggguagugguuggcauggcacucaguuugagaagugcuauuuuuauucuuaugucaaaaagaguccccaaaaggauagcuuuucaagagaaagggugcucugccccagcuccuuccuguauauuugacuccaugguucauuucaaaaacauuuccagcaccacauccagcaucuguggagugaucaaauguguuccccaaauaagaauugggccaaaaaauucaucaagaaucuaauagcagacagauuccaaacccagugcgcugaccccagaacagcuuucaguaggaaaugagcagaucaggaaugaaagagacaauaaaggaacugagcucuggauuacuuaagaggaggaggaaaaccuguucagaggcaaacaaaaggaaguaaaauaaugugaaaaagaaaaggauuuaaaaaacccaaacuggaaacaggaauguugcaagcuuucuacuacuccagcugaggccgcaguugugggguggagccugggcagaccccagcugccaaggcagaccuuucccuggaaggcuccucgguguuguggccccugggaauugccccuuacucucugcccccuguccccaguuggcaugccaucaucguggauggacacagcguggaggagcugugcaaggccuuuggccaggccaagcaccagccaacagccaucauugccaagaccuucaagggccgagggaucacgggucaguaugcacaagccgcccuccccaccuucaccccucgcccagacacuguggcuacguagcucugacccgcacauccagggaaacagcccuugcugcucacugagcucaccaggcuccagggaaggggagcgggagaugcugugacucagugaccccuguggcugagccaggauuuaaacucagauccgucuggccucugccggugggggcauguacaggcaggaggagaggagggacuuggagggucugugggugagaggaaggucguggagugaggcagcccccgugccccacccuggcuggugccuuucagagcugcagcugugugugcucugccagcuccggccaccugcuccagcugaagggccgacacagagccaggcagggcccggagagaacuguucccuccaggaggugagugggguacuccucaagcaauggcagaugcugagcaaggccugugugggccaagagccuugggggguuuggaaccuggguucugccccaggccggagaaugaggcaggcguaagucacucccuggcacccaggugugggcuucagauuccuaggccugggauggccucacccauuuuaaagaugggaaaaugagacuacaaguggucagggacuugcccggggacagaggaagucuauggcacgaggggggcugaucccagggccugggucggcuucccugccaaaugccccuggcugcccaccugccugcucucagggguuguggcuuguucugcccauguagacucagguauaugaggauguucugaguggggguuuggcagugcugggaggugucugggaggggguggaugucgaggaaagggcucugggauauugucauggcuuuggugcugcugccuggcacugcccucugguguuaaaaaugggcaggaucuggaccacuugcagcuucuugggggcuccugcuagucuuucgggcugcugggugcuaccugggaguucagucuguucuuggcucuggccagacucuagugacuacugaggugaccuccagggagagggauauucagccuuccuggccgcacacaacaaggugccauggggugggcaugccuaggugcuuauagacuccucugcugcucacagaugcauugggugacccuggaagcccuguucugggccuuggguuccccuucugauggccagggucccuuccaacccagucgacaaacugaguauuucugcagcagacaccucuaccugugugugacccugcaggcgggguuguggggaggaagagaauggacacauuggugaagggauggggcagugggcccagaaacacacaccugcccacgucuggccccuccuuucccacucagcugugagcucccaaaggaccaggcaguagacagugaguggugggcacguaggaguccauccuauucacugcgacccuccuuuccuggcccccgugccuggcugggcucugccugucugggaugaugccauuccucccuugcccucggcagguagagggccagucuccuggagcagccuccuggcccucugggagcuucugucuuacccauuccucuguccucccguguugggucugcagggguagaagauaaggagucuuggcaugggaagccccuccccaaaaacauggcugagcagaucauccaggagaucuacagccagauccagagcaaaaagaagauccuggcaaccccuccacaggaggacgcacccucaguggacauugccaacauccgcaugcccagccugcccagcuacaaaguuggggacaagguacaaaguggggccuguuucucugaacccauaguucucagguuucccaagucuguggcccagauacacccucuggagggcugggaaagggaggagagcgauucauuuagggcgaggagugaucccugagguguuguuccugucacuucccucagaaugacagacaucucuggaguugaccugcagaggcucagaccgggcaagggaauugcccacuuagcaagcuuagcaagcuacugacagaacugagaucaaagccaaggacucacucccaaguucuugcaucgcugguccacgagggacccuuggccugagcucaggacccccaccugaccugggaaaggcuaggcagagcugucccacuccagguuucugucccaagggaacccauccaugcagccugugccuggccuugacucccaagccuucuguguucccaugcaaaguggaauagguucauggaccuggugcagcaggcgggaaguuggggcuggugggugucuucuguagcuuauaccuuucacagccagaaggggccggggcuccaggggcucccaagacauugaccguagucguuggcaaccuuucagcaguuaaaagccucugcaggaccuugugcuccagggcuuccauuuuuggccccguuuuaauccuucucugaaagcagggcuccaggcugcaggugugcacucacccucagagggguccagagccuucccacucucuuccucacagauagccacccgcaaggccuacgggcaggcacuggccaagcugggccaugccagugaccgcaucaucgcccuggauggggacaccaaaaauuccaccuucucggagaucuucaaaaaggagcacccggaccgcuucaucgagugcuacauugcugagcagaacaugguaggugcuggggccggcagggacagguccacccaaggcugagggcuguggucugaggggugcggggcagccauguuggcagagccaggugccugcuguaggccagcccagggagacuauaagaaaagccaggacccagcguuaaccccugaccuugaacagccacaguuugggagguucugcccaggugcaaauguccuggacaggugugcacaugggggagccgaaugggacugcaggugcucucaggaggagcugcguacaggccaggccugguggugaauggggucucuuccagguggaggacaggccuggccaguagguggggccgugauggguuuagcagcccgagucuguagagcaccuguaaugcacacggcucugggcccugccacccugagggaugcagagaugagggaacucugggccccugacauguacccauuuggggaagcagacccuugucaggaacugagguugugaaguaaggaacaauguuuuguccauguuuucaaaauauccccuccuggugguccaggagcccagccuggcuugcaggccccuagggacagggagcuuccucucucuggagggcacucagaucuccagaguucuuccaacuggaccugaaauucucucugugguuuccagagacugcucugcagggcguggggcuggggaggucccagguacuagggaaagaggccuuguguuggcuggcagauuuuggagccuugaagggcagcugguuuggaacugaugacuguacucagugcugcuucuggaugagugauuuggggccuggagccucagcaggcaugaggcugcugcccucggaccccagggagggguugggaggaccggucucugcagaagaagguggugggggacauauucagaagcccagaaaggauggacaaucuauauacaaauuguggcuuucuccacaaaagggguccuaggcuccccgaccacccucugccugccccuuugggcugacccugucccaccugcccccaggugagcaucgcggugggcugugccacccgcaacaggacggugcccuucugcagcacuuuugcagccuucuucacgcgggccuuugaccagauucgcauggccgccaucuccgagagcaacaucaaccucugcggcucccacugcggcguuuccaucggugaguuuagccaggguguuuacaccuggagcucccuugacuuuugcaccaggagguaugggagggggaugggccaggauuccagcccauggauggggggguaggggucuuauuucugcauauccuuucccccacaccccaggggaagacgggcccucccagauggcccuagaagaucuggcuauguuucggucaguccccacaucaacugucuuuuacccaagugauggcguugcuacagagaaggcaguggaacuagccgccaauacaaagguagguugcauggcuguucuuucuccugcuggcagccaucacuucccaagggaaacagaagaggaggccagagcuggucacuugcugccccaggggguguuuccugaccuugccccugguguucguguagcuuguggaaguuagacaagaaaaaacgaaauacacaccccacuuacugccacguggcagacauugucaacugauugccagucugucucugcugagaauccuggcagcccuggccgguccagcgguugacaccucuccacccuccugaguuggguucuccaagacaggcaaggaugagcugagcccugugguccaggcccggagcugcaugccacagacccagugcgcgugguuccugccccucugccuggugcagucugugggaguagcccaccugcagccagucuaccugguggaaaguugccuucggucugaggcugcaagguggugggcaguucucagaguguucaaguggggugcgggcggcagagggcaagcaaggcccuuuucccugcuggaguagccaggaugcaguaacuaacgcucccaugggaagggauggccucucuagaaagaccucgucucugagguugggugugccacauccuguauccucaguuuaucuguuucggucucaggguaucugcuucauccggaccagccgcccagaaaaugccaucaucuauaacaacaaugaggacuuccaggucggacaagccaaggucagugccucgcaugccccaggagcccacagagcugccuggacccucccugcugugacucccagcagucagggcacacccugccccagggcccugagccuuacucacccucugugucacccccaggugguccugaagagcaaggaugaccaggugaccguuaucggggcuggggugacccugcacgaggccuuggccgcugccgaacugcugaagaaaggugaggagaaggggccuccaaagucaucaacugagcggccacugcaugcuaggucuugggguucuuucuuucguucuuucuguucuuucuugaagagcucacagcuagagagaaagcauuucauuucauuaaauaaugauagcaauuauagccauccuuugagcacuuguucugucuggcauguugcuaaguccuggggcugcagugcccacagucccuacccuaugacucuaaagucgagacccccccagcaugguggccagaucaguggccuggagccugccagcugggcuggaaucacucagccaggcacuaguuaaggaaguaaguuauucacugucaccaugccuguuuuccuaucuguaaaauggagauacuagccccuugcccucagagcucuccugaggguuacaugcaugugacuugguauucuauuauuauuacugcgagcucacaguguuggcuagugguuuguaggggagacaggcauuggccucuccugcaauagaaucacacagcagaugucauguuuuagcacgaaagagggggcagguguggcaucuuccagaaaguggcuucagaguggguaggaauugauuagcagagaggagagugaagggaggccggaggagggucaggcaggagcaagauggggcuggaggagccagaggaguccauccccaggcagggggagacccaggggggugagcuuuaagcagggccuggcaagcguggguuuguccuucugagaaggugccucugcugcuggggccgcacgugggccucugaucacucugcgggcugcagcuccccaacgucaccacaucaagccucaccuuccaucaggccagacaccugggguguuuucucucgcauucccuuugucuucaagguugugggaggaugagggaaggcgcucagggccugcacgcuccgcucuggguucuuggauacugcgggcaacacagcuggaccagaugccccagugcaagggguuggcaagcaugagcucagccaugggaacgagguggcaagugguucucccugggacagggacaggcccgcaggcugagcucuuagcuacacgcagcccucaggaugucccaccaggcccccaccagggcagauaguggugcccagcccuccccucagccacgccgugugcucucccucacagaaaagaucaacauccgcgugcuggaccccuucaccaucaagccccuggacagaaaacucauucucgacagcgcucgugccaccaagggcaggauccucaccguggaggaccauuauuaugaagguaaggaggccuggggcaggcaggcugggcaagggacagggccagagagccgagcguuggacgugccucuucuaucugagccccaggagggcagcuguggcccagaacacccagagcugucccucagagcagcugggacguggucucuuaaaaggccucaggcuuggccuggggaccuagcuaacucacagcugcugaugagcucuguggagcuccugcugcccaggaagcuggugaggauuccaaccucgcugcuaaaugguggaugguggcgucccugagguaguguaggguggaagcuauggugcagcuugggaagcaaugcagaauuucugguauuugugaguccuucacacagcaggcucccuaaguacacaccagccucucuaaguaggaggccccagugggagagaugggcuuugacucuggggucaaauguagauaauuggacuauggacaguggcuggcuggucaccaacaaugguguuugaaacaaacauuuagaggccauauuugggcuuauaaaaauaguucugggccgugcaugguggcucacaccugcaaucccagcacuuugggaggcugaggacagcggauuucuugagcucaggaguugggagaccagccugggcaacauggugauaccugucugucucuuuaaaauaaaaaaaaucaaugaguuaugugaugggcucauggcuacagguggagaaaggcagugcauaugcagccuccuccauccuugacuaaggcugacagagggcugggcccaccacugcucacccugaggccucgucuucugacuccccuccuuucauuucuagguggcauuggugaggcuguguccagugcaguagugggcgagccuggcaucacugucacccaccuggcaguuaaccggguaccaagaagugggaagccggcugagcugcugaagauguuugguaucgacagggaugccauugcacaagcugugaggggccucaucaccaaggccuagggcggguaugaaguguggggcgggggucuauacauuccugagauucugggaaaggugcucaaagauguacugagaggagggguaaauauauguuuugagaaaaaugaauuggcccugaaauguuuucuuuuuugauguguuugcagccagugcagguucuggggaagaagcguggagggugcgcuagggaggcugguguccuugguccugggccaggaccugggugucccaaguccccuuggaaucaccugcaacugcccucaaccuccagaacuaucgcugccucccauucaucaccaggugacauuugacugcaaccugccuucuagcugagaggcugagaccuacaucccucauugugaccucaguccaccuggcccugagcgggcuggggaacugccucagucuggaagcugaccaggcacucucagggccgccccaccucccccaaguccccacagccuugcagucaggucuccugggauagggagguu

SEQ ID NO: 17488 - RNA, 4934 nt, Homo sapiens
aaucacauuccuguagacccgugcaaccucacacacaccgauucaugcaugcugcagccuggggagcagccagcagcagcccccaacuggcccucucucccuggcccaccaagaggucaagggcagcuggccuggcacacaggccaccugcuggugucaggcugaaggcuucgggacuugggcucaggcaugagcuugcacacccacucucacauccacugaguaggagccagggccgggcaaggaaugugguggggucugccccugcccugccuggguccugcucucugcuuuggcagcugcuggccucagagggcugccuggacucacugggcugggcugcagggugaggucagcauuugcugugagcucaucugagcugggagcucccagcagagcuggccacugcucuggccaccuugugcaggagcuggaggaagucaucuggggcugggcagcuguugugugugcaugcacacgugugugucugagugugccccugugugcuggcuuauguucaggauggagugaauacaugugcaugugcacaaaaucgaaugagcgcucccucaaccaaggcuauggagcagccuuguggggccugggcaggagccagugugcacauaggugcuugcacaccuguguguccuucacaaguggcaaccugaggagccccuuggagucacuuacuguagugaacauuaacuuagagaauggugagaaacccaggagugugggaggcugcuguguaugaaucugcaaggcacauucagcguuacauucaacauuaaaauacaguuuggguuuuuuuuaauuuuuauuuuucugaggcagagucucgcucuguugcccaggcuggagugcaauggcgcagucucagcucacugcaaccucugccucccagguuccagccauucuucugcccucagccucccaaguagcugggauuauaggcaugcgccaccacgccuggcuaguuuuuguauuuuuaguagagaugggguuucaccauguuggccaggcuggucucgaacuccugaccucaggugacucgccugccuuggccucccaaagugcugagauuacaggcaugagccaccgcgccuaggcaguuuggguucuuuuuuuaagagauagggucucacucugccacccaugcuggagugcacugcguggcacucugcugccuugaacucuuggccucaagcgauccucuuaccuuggccuccugaaguaccaagauuaugggagugagccaccaugcccaccuguuuuauauuuggggaaauaauuaguuugaaggugcaggcaaccuuccaggcaagcgagaggcacucgaccccaaggggucaauuuagaagggucaggcacacugaugugggcagagccucucacugcccugaucccugaacagagugggugccaaguuaguggaaugucagcuuuugguucugauucucugccuuaggguuucaguuuccccaucugaaaagugggggguguuuaucuuggcacugcuugucugccuggguaguuaugaagaaaaaaccccaaacuuagaaaaucaugaagggcugcauggggcaggaugggagaaagaggcaguacuguccuguccccuuaccaggugacaauggcacauaccaggugccuggcauggagcagguacccagcaauaggguacuuagggagucacugagugacuccccaaaugaauaucuaggggugacagaugcaaaugccaccagggcccagguaggaggagugaagagagugccccuggccugggguagauugauggagggcagccaucccagugcuagcuggcuguugcccagugggcccaacaucacauuuuccaguuuuaccagagacgccgcaaauccagacuuacauaaaccucucaauauuuuucuuuuucuuuuucuuuuuuuuuuuuuuuugagacggaguuuggcucuugucacccaggcuggaguguacuggugcgaucuuggcucacugcaaccuccgccucccggguucaagugauucuccugccucagccucccgaguagcuggaauuacaggcaugcaccaccacacccagcuaauuuuuaguagagauggcuuuucaccauguuggucaggcuggucucaaacuccugaccucaggccaucugccuaccuuggccucccaaagugcugggauuacaggcgucagccacugcgccuggcaaaccucucaguuuuuaacacuggcaacugagacuagugugugugugcaucaugugggccaaacccaaucauagcagagcccugggggagcgggucccugagugcugcccgugacuguucccgcuggucccgcccggccgccuggccucaccccucugugugcacagccccacugcaggccccaccauggcgccguuccugcgcaucgccuucaacuccuaugagcugggcucccugcaggccgaggacgaggcgaaccagcccuucugugccgugaagaugaaggaggcgcucagcacagguaggccuggaggcuggacccuggagaggggcugggaaucugggcccagcuggaaggacuggagggggccuggccuuguucccugcaaccucugaaggauucugcucuuccucauccuugacucccugccccacucagcuaugaaggcagaggccacugagucgcuauagggcugcaaacacuggccaaauugagcccuccuuggaaggcuuggaguuucugguuccuccucccugguuguuuuacccagcaauuuuuacauguccauuugugccagggccugugcggggcacugaggauacugucaugcuccaggacuaaccuggcccugcccucaugggguucauagucagguggggaaaccaggcacgucaaaaagcagugaguccugcaauagggaagcccagagaaggcacccucugaaccugaggucagggaggacuuccuggaggaagcacauaccucacaucauucccucuugcuuuugcccuggccuggugaaccccuauuugucccucaggucucggcugaacuguuccuuccucuaggaaaucuucccugacccuuaggcuugacccuguagcacuaccagccuugcccucuucagucucaucacaacugugacuuaacaguuacuugaggaaggaguuggugcauucgccacccgggccuggggauccaggaggacaggcccuggauguagcuuuucuuucagcuguguucugcgccucgaauauuauggcuggcaugcaggagcugucagcccauguucccugcaugaaugcauaagggcaggcgacauuuaaauggagcuggagcaagaggaucagaggaagagggaacagcaggaacaaaggccuggagggaggaccuagcagggugcccaagguaguucugugcucuagaggacacuggggaaccacagcaggcccucaaggcaggagagucgggcagauucugccaggggaaggccguggaggucuacgagggagggacagaggggccauggcccaaccuucucugccuggccuuguugcagagcgugggaaaacacuggugcagaagaagccgaccauguauccugaguggaagucgacguucgaugcccacaucuaugaggggcgcgucauccagauugugcuaaugcgggcagcagaggagccagugucugaggugaccgugggugugucggugcuggccgagcgcugcaagaagaacaauggcaaggcugaguucuggguaaggggcgcacgagccgugccgugugugugugugugugugucugugugugugugcaugcgugcaugugugugcgugcacacacgcgggcuuggucagugagcacagcugaagagcaccgggcccugugcuggccaccaguccagcccuguggccaacauguccugggugugaauccuggcucugcaauucaccagauucccagccucucugagcuucugcuuccgcaucuguuaagggaaggcgcuacuaaaugugccuaccucagggucaguuguucaaaugaaaggagcagcuggauguacagggcuuauugcagaaccugacacauagcaggugcuaaagacggccaacuuccuuauugugacuacuuuuuccuuuuuaauuuuggaaaggcaggauaugcacauaguaaaacauuuuuaacugcaugaaagggugugucccugccccaacaccaggccaccaggccuccuucccagaggcacccauuaucccaguucuuuuuggaaucuucgcauauauucuaggccuuggcagccauugagggggcaacauagugaucuuuaacagcaaggaggugggagaaggggaggcugacggucucaucuacuuaccugcugaaauggagacucugcacaagcauguggccacuuggccaugugcagcuguguguucuggguggccacaggaugccagugcuggcagaaguccccugggguuacaugugggauguaaccaagaugucuccaccaggaaaggcccugugaccauuggaggcucugaucagccuccugcgaggggugagggggcugggaugggagagagguuaacacagggcuguacugacccuuggccagucaggcagggacacagaggggccucuggcugugcugucuccgcucccccaagggaggauaucagucaccaggucuaggucuugggggaggugaggggauagaggcucaggucccacccucgagacuguccaaucugcaugaggagcccucggcacagagggaggagcagcgugugugcacgaggaugagugugucugugugucugucucucuccgcaugugcacacggguaggggccuccauucuaagauccuugcuaagggagcugcagcggguagggguggggaauuucccuucccgcucuauuccccagcuaug

SEQ ID NO: 17489 - RNA, 2453 nt, Homo sapiens
ccuccauucccucagggacaccccacacccaccccacacacugggaugaacccuugcagaggaacaauucagauggucacacauuccaggacccaaauccguaaacacaaagcauguccgucagugccagcaccuccccccggcgaaucaagcagcugucccagagggcaaagggucucugcagccaucugcuuucaucagggcugcagcccccaggcagcaguacugggagccccucucaucuccgagaauaaacucugaagccagcgacccugcggaccugaaucaucagggagccugucagaggaggggcagugacucugcgggacaagcaagcaggcuauauaaguuucagaaggcugggcuccacucagaucuuuuccagcagcugcugccugccagagaggcgccuucagagacccagcgcuuacacaauacccaccaugucccagguaggaggacccagcaagggcuguguugaugccagagggaguggagguggaguccuggacacuuucggcucuggcagcugugucuugaucugagccccaagcaugaacuggaggcucugcagcccuugggagaugggggcucagggaggacccccugaagaaccccucuucuauguggcuuuggugguauuccacgguuuguuaggaggaguggagagaaauguuggggguggggggggccuagauagaucuuugcaugugccugugugugugugugugugugugcgcaucugugugugugcugccgauauagcucaguguguagagcuuugugcauuuguagcuaugggcccggcagccaugcacucuguguguggccacacacauaggucugucugucucuguguaugguauaugcaugaagcuguaugugugugcacaugaggcuggagggacacagcuggaugcaucgcuguacagggguauaguguguugcucugaggagccuggcccaggcugagcgaggaaauaccugcaccugcacccaagcacaggcaggucucagacucacaggcgccugggguugagggguaggguaaacaccgagccugggugucccccacccuggagggacagaccagccugccaagagagaggacuguccuugcugccugcucuguggguggguggccauuuuggacuguaauucugugggcaucuggcccuucuaccccauuuccagccccaaagacacaaaguaaauaguggcgcuuuucuggaagggggcaauccuugaggaaccgcuugccacccagugaacagguuuuggaacuaaccaaauucccuaguauugcccaaccucagagcuaguccccuucgcuguuccccacugugcccaguccugagcuugaccagguagccagacacgccagugugaggcugcagcagccacugcucccaagagcucccaggcuauaggggaaaggcacaugggcaagucagaccaagacagcugggagaccugcagcagguggaguauaguugggaaggcuuucucuggaagaggaguagagccuugaauaggcuuggguuuaaugagcagagaagaggggucuuggccaaggcacagagguaggugugccuuucuaccgaggcuucagguaguaagaugaggcucuuggaucuccaaggcuggugcucaggaagccccuaucaagaagaagcgccccccugugaaggacgaggaccugaagggggcccgaggaaaccugaccaagaaccaggaaaucaaguccaagaccuaccaggucaugcgagaguguggugaguguccucaugccaucuggggcuggggaugggggugcaggugugugucagugguggggggagguggucaaggauccuuuucugagaauccaguauuccuggguucaagaaaggugcucccaucguaagggaucuucccucccaggaagcuaggcuggccccugacuuuaccuccucccacagagcaagcuggcucggccgccccgucgguguucagccgcacccgcacagguaccgagacugucuuugagaagcccaaagccggacccaccaagagugucuucggcugagaagugugcgccacuccccuugcugcccgaaugcucggaaacaggagccuuucccaggaacucuuuuuuaugccagaacgcuuccucuccccugcugucucuggggcugccacccucccccacaguccaggcccuucagccaagggcucugcaccagcaccuuggaagcaccaauaaagaggaugcccacguggccccagcaaucagaagguguugguuggucccuggcuauggccacuauugagagggaggacagggugggaacauggaacauguccguuuaagaggaucccaggggauagcacaggugcuauuaugggcacugccacaugcugccuuggacauggagacucagugcugaccugugacuucagacuuuucugag

SEQ ID NO: 17490 - RNA, 2873 nt, Homo sapiens
uguacuaucauuuaugaggcauuuauuuuucauuauuuacaccugaaagaaacuucauacuuguguguucuguuccccaucucagagcaagauuaugaagagaaggucuaaacuacuuauauaaaucaaaacccaacugggcuagaaaugaaguauaaagagaacuaaaucuauacacagcugugccauaagagcauuaggugguuuuagcucuuaucugggguaugaaagcaauuuagcucaucucacagaaacaaaagcaggugcugaaucaugaaaaccucaauuauuuuuagcaugccucuuaauuuuucuuuccccugguuucuugucgucugugcuugauucuugaacagguaaccacuugagaggaugccggcgauagaugggccauggaggaagugucagcugggccagaaaagaggaaaugcauaaauuauagcuauuaaaaguuuaaaaaaucauuacguauaaugccagguucccaaaugacuccuaugcugagggaacaaaaaaacaaaaaaaaaaauccauauuccuauaaaggcucugugccaccauccaugcaaaauacuguaugaugaugggaacaggcucacugccuauacaaauggcuuuaagaccuaaaagaaaggugggggccaggcgugguggcucucgccuguaauccaagcacucugggaggccaaggugggcggauugcuugagaccagccuggccaacacagugaagcccugucuuuacuaaaaauacaaaaauuagcugggugugguggugggcuccuguagucacagcuacucgggaggcugaggcaggaaaaucuauuaaacccgggaggcagaaggugcagugagccgaaaucgccccagugcacugcagccugggcaacaagagugaaacuccgucucaaaaaauuuaaauaaauaaauaaauaaaaggugaagggacaacgugagcaccaugaaaacuccugcuggcuuugaccuuaagauuauuagccagaguagccgccaaaggaaauaagcuguguccuuuuauauaguucgcaccaucugacacuauuuuggcauucuacuuuuccaaugauagcaaagggaaacgcuguuuggaaggaugagggaaacguuggcuuugggucucacuacugaguaggucuaaccaaaccaacccgacucacaaaacccaagcugccacuaauacccacaaauuucuuaccaaacaugaaaaagcaaauccggccauaacuauauagacaguccacccgaacuguucagccacguacccguagauaaauccaacuaucuagagacaaaugaaguauauuaaacacacucaaacugaggguugggagggaggcgggggcggagauuaaauguaaaaccaauacuuacugcagaaaaaagaauaauucccugaaacaucuguucagcuagcuucuggcccuuguaauccuggggugaagcagaggaaaaaaagaauugguuccaccgccgagaacauacaauuccugcccugaccucacaacucuggcacaggguaaccccaacaucagggucucccgcucuccuaagggccugggcaagauauuaaauucugggcuucccgggaggaacugaaacacccucacggagaauggacaggagauucucgcggaguagaagagaaggggacccaggaggcaauucgggaaagaggguggacgguaaccauccgggcccggaacagcgcagcaccgggucggugcuccaacaugggcuucgaagcugccaggcacaagaacggcgugcagagguccccggguugcgcccucaccaucugcgugggcagcgagcucagaugcuccagcauggcuggcugaggaggcgggcagcugagcgcggguggcaggcugcgaggcgagggcgaccgagacuuaaggaccgugagggguaaggucuggcacugcgcgucaguagccgggccuucuaagcccgggagagcgauggcggcggccccggaagcggaagucuccgacgggccgguacagcccguguccccgccccgcgccaucgcuaggcgacgugcgcuuuugccgcgccgugcugcccgcgagggcagcugagguggugguggcggccgccuugucgaggcaucgcgcgcccgugaaguguucgccgucagugcuguugggugccuggagccgcgucccccgucccgaaaacuguccuugacaguacuugcgcggcccaacggccgccggcgcccccgcgucuccauggcgacggccuuuuucccugcgaggaccccggcggcagggcugccccgcggcgccugcuuggcgcgacgcucuagcgguuaccgcugcgggcuggcugggcguaguggggcugcgcggcugccacggagcuagagggcaagugugcucggcccagcgugcagggaacgcgggcggccagacaacgggcugggcuccggggccugcggcgcgggcgcugagcuggcagggcgggucggggcgcgggcugcauccgcaucuccuccaucgccugcaguaagggcggccgcggcgagccuuugaggggaacgacuugucggagcccuaaccagggguaucucugagccuggugggauccccggagcgucacaucacuuuccgaucacuucaaaguguaaggggggcccuacugacccuuggaauuuaggggggcuacccuaggcggcauccacaacagagagaauucccuuggagaggggacccuggugcucggcugucccucucauccgcguagaaagucccucaucugggggcucccgaacucagcccucucacauuguggccggcuuuacugacccucacagacccaggcugggcccucccgauagaggccagccaa

SEQ ID NO: 17491 - RNA, 11605 nt, Homo sapiens
cagcccguguccccgccccgcgccaucgcuaggcgacgugcgcuuuugccgcgccgugcugcccgcgagggcagcugagguggugguggcggccgccuugucgaggcaucgcgcgcccgugaaguguucgccgucagugcuguugggugccuggagccgcgucccccgucccgaaaacuguccuugacaguacuugcgcggcccaacggccgccggcgcccccgcgucuccauggcgacggccuuuuucccugcgaggaccccggcggcagggcugccccgcggcgccugcuuggcgcgacgcucuagcgguuaccgcugcgggcuggcugggcguaguggggcugcgcggcugccacggagcuagagggcaagugugcucggcccagcgugcagggaacgcgggcggccagacaacgggcugggcuccggggccugcggcgcgggcgcugagcuggcagggcgggucggggcgcgggcugcauccgcaucuccuccaucgccugcaguaagggcggccgcggcgagccuuugaggggaacgacuugucggagcccuaaccagggguaucucugagccuggugggauccccggagcgucacaucacuuuccgaucacuucaaaguguaaggggggcccuacugacccuuggaauuuaggggggcuacccuaggcggcauccacaacagagagaauucccuuggagaggggacccuggugcucggcugucccucucauccgcguagaaagucccucaucugggggcucccgaacucagcccucucacauuguggccggcuuuacugacccucacagacccaggcugggcccucccgauagaggccagccaaagguucacucagccucucuuucaaggcugguguaucucuaaaucuuagacccuccuccguuaccgucagccaggugggaugcccacguuuuggagagaaaccguucugaggaacccgggccucugggucccagcuggcucuccggcccccagguuauguauucuggguuggccacaaacaguggaauucuaggcacucccgggacagggugggacugcuguccucauucaugcaaccagcaaauauucacggcaccuuguuugugccagacagcagaccgaggacacgguuguuaccaagaccaggcuguugccuuggaagagcccagagcgugucaagggagacagccacaucacgccagaaauacaugacagcuggauuagcccugggagagggaggcccagaugugggagcucaggggaggugcagcucaacguggaguuuggaggaggcuaccuugaccuuugaaugccaagugggagccagccagaugaaaggguaggagaaaguguuuguauauccucagugcccuuucauccuugcacguggcagagaccaaacaguaaaaugcagacacguuugacacuuuucugaccucagaaggacucaggacguguagaaggcagaaagagggaugggcaagaguuuauuccuguuuccuucucaugcucuguauuucuugguguguuugaagagacuuucuguuguguguauaaauagauauaucucuguguggucuuuuuuuuuuuuuuuuuuuuuuuuugaggcgaagacucgcucuguugcccaggcuggagugcaguggugcgaucgcggcucacugcaaccuccgccuccuggguucaagggauuguccugccucagccuucugaguagcugggauuacaggcaugcgccaccacgcccggcuaauuuuugugauuuuaguggagacgggguuucacuguguuggccagacuagucucaaacgccugaccucaagugauccacccaccucggccuuccaaagugcugggauuacaggcaugagccaccgcgcccggccagugcggucuuuuuuuuuuguauccacaguuuuguauccuuggauucaaccaaccacggacugaaauuacagauacagagggcugacuguaauaugccauuuuacauaagggacuugagcauccgugaauuuuuguauacauggggaguccuggagccaauccccgacugauacugaggaccaacuguguugcuaaucaaauuguacacaauuauauacucuuacgaaaauguaguuaacuauuacagauccagcgucugugugcaauuucguuuugagaauuccuucuaaccagaucaggaaagcucucuuaccaggaauagccccaggaaagacaauauggauuagacguacuccaugauaacuggcguuuugcauguagguaacuguggaaguuuuaggagcaacugguuucugccuugccagucuacuuaaguaugucagauacuugauagaauuguguuuuucuuguuuccagccaagugugccucuugaucccguaacugcuaacuggaagucaagaaacuaaaaacauuaucucuuguaccauuaauuaagugggauuuauuugagugcaagaucguuuucucaguggugguggaaguugccucaucgcaggcagauguuggggcuuuguccgaacagcuccccucugccagcuucuguagauaaggucagcccauaaugugauagaggcauaugacuuaggguauauacugauguauauacuucucuuuuuuuuuuuuuuuuuuugagacagagucuuacucuguugcccaggcuggagugcaguggcacggucucagcucacugcaaccuccgccucccggguucaagggauucucuugccucagccucucaaauagcugggauuacaggcaccugccaccaugccuggcuaauuuuuuguauuuuuaguagagaugggguuucaccaucuuggacaggcuggucucgaacuccugaccucuugauccaccugccuuggccucccaaagugcugggauuacagacgugagccacggcgcccugauguauaugagaagaaguucacugacacguuguacuucauauauacugcuuuggaaaggugugugugggcugggccugguggcucaggccuguaaucccagcacuuuggaaggccgaggcagguggaucaccugaggucaggaguucgagaccagccuggccaacauggugaaacccucucucuauuaaaauuagcugggcgugguggcgcacaccuguagucccugcuacucgggagguugaggcacaagaauugcuugaaucugagaggcagagguugcagugagccaagacggcaccacugcacugcagccuggcugacagagccagacucugucucgaaaaaaaaaaaaaaggaaagaaagaaagauguguauuuucccccuaauuuguaaucuggccugugaucccauuuuuaaaaaaaauuuuuuuuagauaugggguugggggauggucauacuauguugcucaggcuggucuggaacuccugggcucaggcagccucccaccccagccaccugaauaguugggauuauggguaucagccacagugccuggcugauccacaguuuuuauugcuuuuuauuuuuuauuuuuuugagacagggugucgcuuugucacccaggcuggagugcaguggcaugaauauggcuuacugcagccuugaccucccuggcucaggggauccuccugccuuagccucccaaaugcuugggacuacagaugcacgucaccaugccuggcuaauuuuuguauauuuuguagagaugagcuuucacaauguuacccaggcuggucuugaacuccucagcucaggugaucugcccgcguuagccuuguuguuuucauuuugggauuauaggcaugagccacagugcccagcccccaauuuuuuaaacaguuuuucaacauauuucucuucuuuacaaaggccuugagaaauuaagugccugguaggcacacaauuuucccaggaugaaguuaauucaaacuuacuuugucuguagucccugcuacuugggaggcugaggcaggaggcuugcuugagccuaggaguuagaggccagccugggcaacauggugagacccugucuaaaaaaacaaaugaacuaacuugcauugcaauacgcuauguuugaaagugcuuuguaaaauuaauagccuuauguaaggguuggguacuacuaugggugaagaugaaguaagaaaggguuaaaagguagguucacgauaucuugguugguaaaaugucuuuaaggaaacauuuuauccagagcuuguugaaggaauuuauuuuuuaaauaaauuuaguuccaccuacuaucuuguuuccacugaauuguuuugaaaaagugaaggucagaugagcugaggaggaccaaccaggacauugugacaauuagacaccaccuucuuaagagaugaauagcuagcuaacagagaugguuuuugagaauagcaccuuaaauguuuuuuuggccgggcgugguggcucacgccuguaaucucagcacuuugggaggcugaggugggcagaucacgaagucaggaguucgagaccagucuggccaacauggugaaaccccaucucuacuaaaaauacaaaaauuagcugggcgugguggcgcacaccuguaaucccaacuauugggaaggcugaggcgggagaaucgcuugaaugcgggaggcagagguugcagugagcugagaucaugccgcugcacuccagccuggacgacagaacaagacuccguuucaaaaaauaauaaacuaaaauaaaccuuuuuuuuuuuuugcuaguuacaauggcuagaaauguacuccacacuuuugauaucgauuggauuuugugaauuuuuguagcuuuuucugugcuguggguuugucaagugaauuuggauaauauucuuuucucugaggacacucauguuaaaggugaaugggauacaacucugaacaggcauguuuuuacugaugaggcuaagaccucagguuacuuggucauagacaacgugaauccaugucuacuuuaggaauuuuaaguagaaacuuaauuauguuauguaauuuuuuauuuuaaagacagagucucacucugucgcccaggcuggagugcaauggcaugaucucggcucacugcaaccucuguugcccagguucaagcgauucuccugccucagccuccugagcagcugggauuacaggccccugccacugcaccuggcuaauuuuuuugcaguuuuuaguagagacgagguuucaccaucuuggccaggcuggucuugaacuccugaccucaugauccaccccacucggccucccaaagugcugggauuauaggccagacccugccuggcugaaacuuaauucuuaaauguuucuuuugcuuuucaucuugugauguauaauguacaaggcuaaggcuguuucuccaacuuauuuuuaaguuuuuuauuaaugaguaccacaaaaauuucagaucccaaauuggguucuugggaacugugaauucaaaaugaguuucuggcggaauacuguauaugccucuuguuucuuccugaauuaaaaaaaaaaaaaaaguguuagggcauuuugaugucccuucucaugugcuuacugacuuugggggcuuguuuuuguuuuguaggguuaaaaacuaauauuuauaugacagaagaaaaagaugucauuccguaaagguaugcucuuucuacaaguuaaguuguuuuuauaccuggucaaagauaaagagguauaacauagguuuucccuaucuauuucaguaaacaucaucaucuugguccuggcuguugcucucuucuuacugguuuugcaccauaacuuccucagcuugagcaguuuguuaaggaaugagguuacagguaugcgagcacuuauuaauaaugccuuagaaucuguugcggaccugguauucucugugucacacauccuaaguuguucuucuuccgguaguacuagcaguuguuuguuaaggguuugaucugacagaauauuccuuuucaccaaaucagaggccuuaggagagccucugagggcugccaucuguucacaugucagcaggacagggcuucagaaagugagggcauaccaguguccuugguguuugaugccugcucuagucacuagagugucagucuaguuacuuuccuucagcugugcagcugcaucagugggacuguagcaauaaaaguuugucaagugauuuuuaaaaaucacuguguuguauaauauaucgcacaguauauugaauuagucguucauacuguucucccuugguacugagaaauguuugaggcuugaguguuugucaaaaaucauuuuuggauugccacccaccauagcugaccagagugagagacuguaauagcuuuccccugacuuucacggagugcucugauagcauguuuuaucacguguauauauguaugauacauauaaaguaaugcauguuccugguaggaaaguuuauaaaaaagagaacagcggccgggagcaguggcucaugccuguaaucccaaaacuuugguaggccaaggugggcgucucacaaggucagagaucgagaccaucucagcacuuugggaggcugaggugggcagaucacgaggucaggaguacaagaccagccuggccaacauggugaaaccccgucucuacuaaaaauacaaaaauuagcugggcguggugguaugcgccuguagucccagcuacucgggaggcugaggcaggagaaucgcuugaacccaggaggcggagguugcagugagccaagaucacgccacugcacuccagccuggugacagagugagucuucgucucaagaaaaaaaaaaagagacaacaguauuuaagcuccaugaaggcaauuuguguacuguuuuaucuucugugccuauggaugauggcugauacuagcuguucaauaaauauuaguugguugaaugauuucauuuacaauuuuggcuuaguaccuuccaguuuuuuccuacacaucuuuuuuucuguacaguugagauuguacuauauauaaacuguacaugacauguuuuucuguauaucaugucacugugaugguagaaacucuucauacauaaucuuaaugucuauuaauuuguuuccacaggauaacaucuuuugcuacaacagcuuucagacuuuuugauggcagcccuacaauaggaaauacauuacauguagcacauguacauacauguguauuugcuuauuggcugucuauccucagaaaguuagggauguuuuauucauggcuguaaccccagugccuagauauugccuggcacauaguaaauaccaggguucaaugaggaauaaaaaaaaaaaaaugaaaggcaagaaugcauacaggacaguaauugcaguuuccuugugugauacacuauguuuucuuugguauucuaauucaguuuucuuuuuuuuuuuuugagauggaguuuuccuauugcugcccaggcuggagugcagugguacagucuuggcucacugcaaccuccaccucccgaguucaagcgauucuccugccucagucucccaaguagcugggauuacagguguucaccacuacaccuggcucauuuuguauuuuuaguagagaugagguuucaccauguuggucaggcuggucucaaauuccugaccucaagugauccacccgccucagccucccaaagugcugggauuacaggcgugaccuaccaugcccggccucuauuucaguuuucuauugcaauccagaaacuuuuucuguauaaauugauugugacucacucaauugguuucaugccuacuugugauucgugacuugaaaaacauugauuuaguuugcugcuaaguuuucacaauuuaaauaaaauucuuucuuuugauuauauuucagauuuuguccuuaggaaacucuugauacaaauugccauaauacauucuaacagguucuguuauuuuccuaccaguaguguaccaaagugcugucaguguauuuuaaaaaaugcuuccuccacuuuuccaaaagcuuauuuacauacagggaaaguuucagggcuauaugcuucaguuuaaugggggagaaugagguagaucaguaccauaauccuuaccuucccuuuuuccaugucuuggacucuauaucaaaagcccaugagauuguaaucacagugccuuccuuguguuuucagauucaggaauuguagggccucaaccuauagacuuugucccaaaugcucuccgacaugcaguagaugggagacaagaggagauuccuguggucaucgcugcaucugaagacaggcuugggggggccauugcagcuauaaacagcauucagcacaacacucgcuccaaugugauuuucuacauuguuacucucaacaauacagcagaccaucuccggugagcucugcuuaugugauucugcuucuagaggaugauuuagagcaggccagcugccaauccaggaucuguuuuucugugguuuguauguuguuuuauacaauugaaauuguaccagugauaaacuguacaaaugacauauuuuuuuuaggacuguauuaugagcauauccccauaauaggagaagugauacaaggagcucaugccaggaaguaagucagcugucacucugaacuguuaaccccaccugaugguguuuugauaauaauacuuucucagugaagggagcaguaaauguugauuuacaagucacaaguuccuuauuucauggacaugcucggagcaguucuggucuagagugggaagggacuuagcaacaauggcaagguaguguugugaugcugaucacagauccugauccaaauccuggcccagagugaucuggggaaacuuggauagucuaauccauuuugaaaaugaauaagacuuauaaaacuuacuccaaauuuguuggucuaacaaauuaaccaguugucaaauuucugaaacauuuugguccuuguggcccucugcaugguucauauuuaguuuuuaaagcuguaaauucugaacgcauuuaaaauacagaaacagaagcuguauaaaaauagacuacagaaauaacacuaaguagccacaaaacacugauuugaaacugaccuagaaaaaaugugcaguacuccuuuagcaaacaguuuuuucuuacagguagugccucagacuugagugguggaauuagggucaccacaguuaagaguuggauaguccagguggugaugaaauguucuuaauucuauaguuuuucuagaguaguuuuaguguuagaagauaauuaccauacaaucuuaauucagggagggacuuuggugggaauuacccucacuucagacgaggaaaccaaagcucagagauaaaaggagcuugaaaacaccuauuugguccauaggguuucuuuugcauuauucccucauugguuuggagacauuauuugaaacuaaaauguaguguuuuaucuucaucagguccuggcucaacagugauucccugaaaagcaucagauacaaaauugucaauuuugacccuaaacuuuuggaaggaaaaguaaaggaggauccugaccagggggaauccaugaaaccugugaguuccaugcauccuucuuugcacuuggcaguauuaggaaauaauggaauaccuggguaucuguggguauagugcaaguaguuuccuggggaccaagccugggugguucuaagaguccuuucuucuccugaauggguacugaaagcauccuaggaguuucuguguaaauaaaagcacagcuagugcgguauccuaugccaauuauucuuuccuuuuccaguuaaccuuugcaagguucuacuugccaauucugguucccagcgcaaagaaggccauauacauggaugaugauguaauugugcaagguaucaaaaaugucaccaugagugcuguucuccacccagauuggguacaauugcuaaauaaaacaaugggcuacagugggcuguagugguuuauuuauggucuucuauaaaaggucaccauagggagaagugggaguaacagggaacucucaaggcaacggaaauguaaaucuuaacaucuugucuauuucaggugauauucuugcccuuuacaauacagcacugaagccaggacaugcagcugcauuuucagaagauugugauucagccucuacuaaaguugucauccguggagcaggaaaccagguaaauugcuuaccaaacaccccucuuccuacaauauuguuuaaugggaagagguugcaaauucagggaacucuuuugcugcaauuuacacuccccaaucauuucaucccaaaacucaagccugcuuuucuguagacuucuucauggacuugacagccuaauuguucuugaacaucugguuuauuaugucaacaucuagguuccuauucuaacuuggaauuucaaauauuuauuuucuaaucugaagaagucaguuuaacagcucuucucucuacuggcuauaaaauuguaucuauuuuguuugaagcaguaaguacauauauccuauuuguguuuuuaguacaauuacauuggcuaucuugacuauaaaaaggaaagaauucguaagcuuuccaugaaagccagcacuugcucauuuaauccuggaguuuuuguugcaaaccugacggaauggaaacgacagaauauaacuaaccaacuggaaaaauggaugaaacucaauguagaguaaguauguaacuggccuagcugugaaaaacuguuguauuucaauuccuagagucuugacuaacaggaguuagucaguacuuuucacuaacaaacauuuguuuucugucccaccaagagagggacuguauagcagaacccuggcugguagcaucacaacaccuccucugcuuaucguauuuuaucaacagcacucuaccaucgauccuauguggaauguccgccaccuugguaaguagaauuaaccaguggcauaagcuaguaaagaauugguaucuaaagaacuauccucagggaugggguauauucuuuguuucccuuaaguaaguuuucugcacaauuucacauggcgcaacgauguggcuauuuuugucucaaauguaagguuccagugcuggaaaacgauauucaccucaguuuguaaaggcugccaaguuacuccauuggaauggacauuugaagccauggggaaggacugcuucauauacugauguuugggaaaaaugguauauuccagacccaacaggcaaauucaaccuaauccgaagauauaccgagaucucaaacauaaagugaaacagaauuugaacuguaagcaagcauuucucaggaaguccuggaagauagcaugcgugggaaguaacaguugcuaggcuucaaugccuaucgguagcaagccauggaaaaagaugugucagcuagguaaagaugacaaacugcccugucuggcagucagcuucccagacagacuauagacuauaaauaugucuccaucugccuuaccaaguguuuucuuacuacaaugcugaaugacuggaaagaagaacugauauggcuaguucagcuagcugguacagauaauucaaaacugcuguugguuuuaauuuuguaaccuguggccugaucuguaaauaaaacuuacauuuuucaauagguaucuucuuuuuuuauucc

SEQ ID NO: 17492 - RNA, 11605 nt, Homo sapiens
ggaauaaaaaaagaagauaccuauugaaaaauguaaguuuuauuuacagaucaggccacagguuacaaaauuaaaaccaacagcaguuuugaauuaucuguaccagcuagcugaacuagccauaucaguucuucuuuccagucauucagcauuguaguaagaaaacacuugguaaggcagauggagacauauuuauagucuauagucugucugggaagcugacugccagacagggcaguuugucaucuuuaccuagcugacacaucuuuuuccauggcuugcuaccgauaggcauugaagccuagcaacuguuacuucccacgcaugcuaucuuccaggacuuccugagaaaugcuugcuuacaguucaaauucuguuucacuuuauguuugagaucucgguauaucuucggauuagguugaauuugccuguugggucuggaauauaccauuuuucccaaacaucaguauaugaagcaguccuuccccauggcuucaaauguccauuccaauggaguaacuuggcagccuuuacaaacugaggugaauaucguuuuccagcacuggaaccuuacauuugagacaaaaauagccacaucguugcgccaugugaaauugugcagaaaacuuacuuaagggaaacaaagaauauaccccaucccugaggauaguucuuuagauaccaauucuuuacuagcuuaugccacugguuaauucuacuuaccaagguggcggacauuccacauaggaucgaugguagagugcuguugauaaaauacgauaagcagaggagguguugugaugcuaccagccaggguucugcuauacagucccucucuuggugggacagaaaacaaauguuuguuagugaaaaguacugacuaacuccuguuagucaagacucuaggaauugaaauacaacaguuuuucacagcuaggccaguuacauacuuacucuacauugaguuucauccauuuuuccaguugguuaguuauauucugucguuuccauuccgucagguuugcaacaaaaacuccaggauuaaaugagcaagugcuggcuuucauggaaagcuuacgaauucuuuccuuuuuauagucaagauagccaauguaauuguacuaaaaacacaaauaggauauauguacuuacugcuucaaacaaaauagauacaauuuuauagccaguagagagaagagcuguuaaacugacuucuucagauuagaaaauaaauauuugaaauuccaaguuagaauaggaaccuagauguugacauaauaaaccagauguucaagaacaauuaggcugucaaguccaugaagaagucuacagaaaagcaggcuugaguuuugggaugaaaugauuggggaguguaaauugcagcaaaagaguucccugaauuugcaaccucuucccauuaaacaauauuguaggaagagggguguuugguaagcaauuuaccugguuuccugcuccacggaugacaacuuuaguagaggcugaaucacaaucuucugaaaaugcagcugcauguccuggcuucagugcuguauuguaaagggcaagaauaucaccugaaauagacaagauguuaagauuuacauuuccguugccuugagaguucccuguuacucccacuucucccuauggugaccuuuuauagaagaccauaaauaaaccacuacagcccacuguagcccauuguuuuauuuagcaauuguacccaaucuggguggagaacagcacucauggugacauuuuugauaccuugcacaauuacaucaucauccauguauauggccuucuuugcgcugggaaccagaauuggcaaguagaaccuugcaaagguuaacuggaaaaggaaagaauaauuggcauaggauaccgcacuagcugugcuuuuauuuacacagaaacuccuaggaugcuuucaguacccauucaggagaagaaaggacucuuagaaccacccaggcuugguccccaggaaacuacuugcacuauacccacagauacccagguauuccauuauuuccuaauacugccaagugcaaagaaggaugcauggaacucacagguuucauggauucccccuggucaggauccuccuuuacuuuuccuuccaaaaguuuagggucaaaauugacaauuuuguaucugaugcuuuucagggaaucacuguugagccaggaccugaugaagauaaaacacuacauuuuaguuucaaauaaugucuccaaaccaaugagggaauaaugcaaaagaaacccuauggaccaaauagguguuuucaagcuccuuuuaucucugagcuuugguuuccucgucugaagugaggguaauucccaccaaagucccucccugaauuaagauuguaugguaauuaucuucuaacacuaaaacuacucuagaaaaacuauagaauuaagaacauuucaucaccaccuggacuauccaacucuuaacuguggugacccuaauuccaccacucaagucugaggcacuaccuguaagaaaaaacuguuugcuaaaggaguacugcacauuuuuucuaggucaguuucaaaucaguguuuuguggcuacuuaguguuauuucuguagucuauuuuuauacagcuucuguuucuguauuuuaaaugcguucagaauuuacagcuuuaaaaacuaaauaugaaccaugcagagggccacaaggaccaaaauguuucagaaauuugacaacugguuaauuuguuagaccaacaaauuuggaguaaguuuuauaagucuuauucauuuucaaaauggauuagacuauccaaguuuccccagaucacucugggccaggauuuggaucaggaucugugaucagcaucacaacacuaccuugccauuguugcuaagucccuucccacucuagaccagaacugcuccgagcauguccaugaaauaaggaacuugugacuuguaaaucaacauuuacugcucccuucacugagaaaguauuauuaucaaaacaccaucaggugggguuaacaguucagagugacagcugacuuacuuccuggcaugagcuccuuguaucacuucuccuauuauggggauaugcucauaauacaguccuaaaaaaaauaugucauuuguacaguuuaucacugguacaauuucaauuguauaaaacaacauacaaaccacagaaaaacagauccuggauuggcagcuggccugcucuaaaucauccucuagaagcagaaucacauaagcagagcucaccggagauggucugcuguauuguugagaguaacaauguagaaaaucacauuggagcgaguguugugcugaaugcuguuuauagcugcaauggcccccccaagccugucuucagaugcagcgaugaccacaggaaucuccucuugucucccaucuacugcaugucggagagcauuugggacaaagucuauagguugaggcccuacaauuccugaaucugaaaacacaaggaaggcacugugauuacaaucucaugggcuuuugauauagaguccaagacauggaaaaagggaagguaaggauuaugguacugaucuaccucauucucccccauuaaacugaagcauauagcccugaaacuuucccuguauguaaauaagcuuuuggaaaaguggaggaagcauuuuuuaaaauacacugacagcacuuugguacacuacugguaggaaaauaacagaaccuguuagaauguauuauggcaauuuguaucaagaguuuccuaaggacaaaaucugaaauauaaucaaaagaaagaauuuuauuuaaauugugaaaacuuagcagcaaacuaaaucaauguuuuucaagucacgaaucacaaguaggcaugaaaccaauugagugagucacaaucaauuuauacagaaaaaguuucuggauugcaauagaaaacugaaauagaggccgggcaugguaggucacgccuguaaucccagcacuuugggaggcugaggcggguggaucacuugaggucaggaauuugagaccagccugaccaacauggugaaaccucaucucuacuaaaaauacaaaaugagccagguguaguggugaacaccuguaaucccagcuacuugggagacugaggcaggagaaucgcuugaacucgggagguggagguugcagugagccaagacuguaccacugcacuccagccugggcagcaauaggaaaacuccaucucaaaaaaaaaaaaagaaaacugaauuagaauaccaaagaaaacauaguguaucacacaaggaaacugcaauuacuguccuguaugcauucuugccuuucauuuuuuuuuuuuuauuccucauugaacccugguauuuacuaugugccaggcaauaucuaggcacugggguuacagccaugaauaaaacaucccuaacuuucugaggauagacagccaauaagcaaauacacauguauguacaugugcuacauguaauguauuuccuauuguagggcugccaucaaaaagucugaaagcuguuguagcaaaagauguuauccuguggaaacaaauuaauagacauuaagauuauguaugaagaguuucuaccaucacagugacaugauauacagaaaaacaugucauguacaguuuauauauaguacaaucucaacuguacagaaaaaaagauguguaggaaaaaacuggaagguacuaagccaaaauuguaaaugaaaucauucaaccaacuaauauuuauugaacagcuaguaucagccaucauccauaggcacagaagauaaaacaguacacaaauugccuucauggagcuuaaauacuguugucucuuuuuuuuuuucuugagacgaagacucacucugucaccaggcuggagugcaguggcgugaucuuggcucacugcaaccuccgccuccuggguucaagcgauucuccugccucagccucccgaguagcugggacuacaggcgcauaccaccacgcccagcuaauuuuuguauuuuuaguagagacgggguuucaccauguuggccaggcuggucuuguacuccugaccucgugaucugcccaccucagccucccaaagugcugagauggucucgaucucugaccuugugagacgcccaccuuggccuaccaaaguuuugggauuacaggcaugagccacugcucccggccgcuguucucuuuuuuauaaacuuuccuaccaggaacaugcauuacuuuauauguaucauacauauauacacgugauaaaacaugcuaucagagcacuccgugaaagucaggggaaagcuauuacagucucucacucuggucagcuaugguggguggcaauccaaaaaugauuuuugacaaacacucaagccucaaacauuucucaguaccaagggagaacaguaugaacgacuaauucaauauacugugcgauauauuauacaacacagugauuuuuaaaaaucacuugacaaacuuuuauugcuacagucccacugaugcagcugcacagcugaaggaaaguaacuagacugacacucuagugacuagagcaggcaucaaacaccaaggacacugguaugcccucacuuucugaagcccuguccugcugacaugugaacagauggcagcccucagaggcucuccuaaggccucugauuuggugaaaaggaauauucugucagaucaaacccuuaacaaacaacugcuaguacuaccggaagaagaacaacuuaggaugugugacacagagaauaccagguccgcaacagauucuaaggcauuauuaauaagugcucgcauaccuguaaccucauuccuuaacaaacugcucaagcugaggaaguuauggugcaaaaccaguaagaagagagcaacagccaggaccaagaugaugauguuuacugaaauagauagggaaaaccuauguuauaccucuuuaucuuugaccagguauaaaaacaacuuaacuuguagaaagagcauaccuuuacggaaugacaucuuuuucuucugucauauaaauauuaguuuuuaacccuacaaaacaaaaacaagcccccaaagucaguaagcacaugagaagggacaucaaaaugcccuaacacuuuuuuuuuuuuuuuaauucaggaagaaacaagaggcauauacaguauuccgccagaaacucauuuugaauucacaguucccaagaacccaauuugggaucugaaauuuuugugguacucauuaauaaaaaacuuaaaaauaaguuggagaaacagccuuagccuuguacauuauacaucacaagaugaaaagcaaaagaaacauuuaagaauuaaguuucagccaggcagggucuggccuauaaucccagcacuuugggaggccgagugggguggaucaugaggucaggaguucaagaccagccuggccaagauggugaaaccucgucucuacuaaaaacugcaaaaaaauuagccaggugcaguggcaggggccuguaaucccagcugcucaggaggcugaggcaggagaaucgcuugaaccugggcaacagagguugcagugagccgagaucaugccauugcacuccagccugggcgacagagugagacucugucuuuaaaauaaaaaauuacauaacauaauuaaguuucuacuuaaaauuccuaaaguagacauggauucacguugucuaugaccaaguaaccugaggucuuagccucaucaguaaaaacaugccuguucagaguuguaucccauucaccuuuaacaugaguguccucagagaaaagaauauuauccaaauucacuugacaaacccacagcacagaaaaagcuacaaaaauucacaaaauccaaucgauaucaaaaguguggaguacauuucuagccauuguaacuagcaaaaaaaaaaaaagguuuauuuuaguuuauuauuuuuugaaacggagucuuguucugucguccaggcuggagugcagcggcaugaucucagcucacugcaaccucugccucccgcauucaagcgauucucccgccucagccuucccaauaguugggauuacaggugugcgccaccacgcccagcuaauuuuuguauuuuuaguagagaugggguuucaccauguuggccagacuggucucgaacuccugacuucgugaucugcccaccucagccucccaaagugcugagauuacaggcgugagccaccacgcccggccaaaaaaacauuuaaggugcuauucucaaaaaccaucucuguuagcuagcuauucaucucuuaagaagguggugucuaauugucacaauguccugguugguccuccucagcucaucugaccuucacuuuuucaaaacaauucaguggaaacaagauaguagguggaacuaaauuuauuuaaaaaauaaauuccuucaacaagcucuggauaaaauguuuccuuaaagacauuuuaccaaccaagauaucgugaaccuaccuuuuaacccuuucuuacuucaucuucacccauaguaguacccaacccuuacauaaggcuauuaauuuuacaaagcacuuucaaacauagcguauugcaaugcaaguuaguucauuuguuuuuuuagacagggucucaccauguugcccaggcuggccucuaacuccuaggcucaagcaagccuccugccucagccucccaaguagcagggacuacagacaaaguaaguuugaauuaacuucauccugggaaaauugugugccuaccaggcacuuaauuucucaaggccuuuguaaagaagagaaauauguugaaaaacuguuuaaaaaauugggggcugggcacuguggcucaugccuauaaucccaaaaugaaaacaacaaggcuaacgcgggcagaucaccugagcugaggaguucaagaccagccuggguaacauugugaaagcucaucucuacaaaauauacaaaaauuagccaggcauggugacgugcaucuguagucccaagcauuugggaggcuaaggcaggaggauccccugagccagggaggucaaggcugcaguaagccauauucaugccacugcacuccagccugggugacaaagcgacacccugucucaaaaaaauaaaaaauaaaaagcaauaaaaacuguggaucagccaggcacuguggcugauacccauaaucccaacuauucagguggcuggggugggaggcugccugagcccaggaguuccagaccagccugagcaacauaguaugaccaucccccaaccccauaucuaaaaaaaauuuuuuuuaaaaaugggaucacaggccagauuacaaauuagggggaaaauacacaucuuucuuucuuuccuuuuuuuuuuuuuucgagacagagucuggcucugucagccaggcugcagugcaguggugccgucuuggcucacugcaaccucugccucucagauucaagcaauucuugugccucaaccucccgaguagcagggacuacaggugugcgccaccacgcccagcuaauuuuaauagagagaggguuucaccauguuggccaggcuggucucgaacuccugaccucaggugauccaccugccucggccuuccaaagugcugggauuacaggccugagccaccaggcccagcccacacacaccuuuccaaagcaguauauaugaaguacaacgugucagugaacuucuucucauauacaucagggcgccguggcucacgucuguaaucccagcacuuugggaggccaaggcagguggaucaagaggucaggaguucgagaccagccuguccaagauggugaaaccccaucucuacuaaaaauacaaaaaauuagccaggcaugguggcaggugccuguaaucccagcuauuugagaggcugaggcaagagaaucccuugaacccgggaggcggagguugcagugagcugagaccgugccacugcacuccagccugggcaacagaguaagacucugucucaaaaaaaaaaaaaaaaaaagagaaguauauacaucaguauauacccuaagucauaugccucuaucacauuaugggcugaccuuaucuacagaagcuggcagaggggagcuguucggacaaagccccaacaucugccugcgaugaggcaacuuccaccaccacugagaaaacgaucuugcacucaaauaaaucccacuuaauuaaugguacaagagauaauguuuuuaguuucuugacuuccaguuagcaguuacgggaucaagaggcacacuuggcuggaaacaagaaaaacacaauucuaucaaguaucugacauacuuaaguagacuggcaaggcagaaaccaguugcuccuaaaacuuccacaguuaccuacaugcaaaacgccaguuaucauggaguacgucuaauccauauugucuuuccuggggcuauuccugguaagagagcuuuccugaucugguuagaaggaauucucaaaacgaaauugcacacagacgcuggaucuguaauaguuaacuacauuuucguaagaguauauaauuguguacaauuugauuagcaacacaguugguccucaguaucagucggggauuggcuccaggacuccccauguauacaaaaauucacggaugcucaagucccuuauguaaaauggcauauuacagucagcccucuguaucuguaauuucaguccgugguugguugaauccaaggauacaaaacuguggauacaaaaaaaaaagaccgcacuggccgggcgcgguggcucaugccuguaaucccagcacuuuggaaggccgagguggguggaucacuugaggucaggcguuugagacuagucuggccaacacagugaaaccccgucuccacuaaaaucacaaaaauuagccgggcgugguggcgcaugccuguaaucccagcuacucagaaggcugaggcaggacaaucccuugaacccaggaggcggagguugcagugagccgcgaucgcaccacugcacuccagccugggcaacagagcgagucuucgccucaaaaaaaaaaaaaaaaaaaaaaaaagaccacacagagauauaucuauuuauacacacaacagaaagucucuucaaacacaccaagaaauacagagcaugagaaggaaacaggaauaaacucuugcccaucccucuuucugccuucuacacguccugaguccuucugaggucagaaaagugucaaacgugucugcauuuuacuguuuggucucugccacgugcaaggaugaaagggcacugaggauauacaaacacuuucuccuacccuuucaucuggcuggcucccacuuggcauucaaaggucaagguagccuccuccaaacuccacguugagcugcaccuccccugagcucccacaucugggccucccucucccagggcuaauccagcugucauguauuucuggcgugauguggcugucucccuugacacgcucugggcucuuccaaggcaacagccuggucuugguaacaaccguguccucggucugcugucuggcacaaacaaggugccgugaauauuugcugguugcaugaaugaggacagcagucccacccugucccgggagugccuagaauuccacuguuuguggccaacccagaauacauaaccugggggccggagagccagcugggacccagaggcccggguuccucagaacgguuucucuccaaaacgugggcaucccaccuggcugacgguaacggaggagggucuaagauuuagagauacaccagccuugaaagagaggcugagugaaccuuuggcuggccucuaucgggagggcccagccugggucugugagggucaguaaagccggccacaaugugagagggcugaguucgggagcccccagaugagggacuuucuacgcggaugagagggacagccgagcaccaggguccccucuccaagggaauucucucuguuguggaugccgccuaggguagccccccuaaauuccaagggucaguagggccccccuuacacuuugaagugaucggaaagugaugugacgcuccggggaucccaccaggcucagagauaccccugguuagggcuccgacaagucguuccccucaaaggcucgccgcggccgcccuuacugcaggcgauggaggagaugcggaugcagcccgcgccccgacccgcccugccagcucagcgcccgcgccgcaggccccggagcccagcccguugucuggccgcccgcguucccugcacgcugggccgagcacacuugcccucuagcuccguggcagccgcgcagccccacuacgcccagccagcccgcagcgguaaccgcuagagcgucgcgccaagcaggcgccgcggggcagcccugccgccgggguccucgcagggaaaaaggccgucgccauggagacgcgggggcgccggcggccguugggccgcgcaaguacugucaaggacaguuuucgggacgggggacgcggcuccaggcacccaacagcacugacggcgaacacuucacgggcgcgcgaugccucgacaaggcggccgccaccaccaccucagcugcccucgcgggcagcacggcgcggcaaaagcgcacgucgccuagcgauggcgcggggcggggacacgggcug

SEQ ID NO: 17493 - RNA, 8359 nt, Homo sapiens
cuguuacacauaaucuguacugaagucauaagcaucauccucuucaaugauuuuauccaagauaaaagaccuuguagacuguucaccuauauugcaggaaaauaaagagauuuucaaaaaguaaaagugauucuauaccaugcugcuucguuagaaccccuuuugccugccucaccugcuguagucuccucagacagugccuccccugucucuucugcagcaaacaugccugagcuguuuuccugugugacaaagaaaaauagugcuggauuaguagcccuugucugcucauuuaauccaaguaguuauguaccugaaaaauuaacucuuuggagguacauauaacgggaugugcaaaauuaaggcuaauggaucacaagccucaaauauuuccuaucuucaguuccuuccauuauguauuauaaugcuagaaaacucacuucaguuuuaacucauggaggacacacuuacaucaacuucuucaucaacaguuuccuggucacugucuuugucauccucccucuccuccugcuuccuuucuuuccguuuuggcaauucuucauguauguccuuuucuucuauuauuccauuugucagaccggaagacuggaaaaggaugcuauuggccaaaugagggcccuugauggcugggaaagaaagcaagcccauguaaacagguaagagcuccacuggccugucagcugaugaagacagcagcgacacacaauucucaccucuuaugcucugugcauuguucuuuuccaguucuuccagauugaagccgcuuuucaugucuaccacaauacucucauuaaaauauggaggaggaguccaagauguagggggauggcaauaguaagcuaaugaggcacugauauuaaaaauaagaugugucaaaagaagguuuauucuaguggucaccaaaaugccaacagaaaagaaagcuuacccuguccacucagaccacagcaguuuggcagcaccuucaacauuugggauuccaccuuuuuggugcauaccucuucucugagcaagcacaguaaaaaauuccagagaauuccuguagccugggacaguauauuucaguacuaccuuaaaaaaaaaaccaaacaaaggagcuguccuucaucugacaugccaguacuuuaaaacacuuccaagauuuuucuacucaaaaugcuuaugaugaaagaagauggcuccaaggagcucaugagaagggguccuuuuaccugucgagcaucagccugggaaaggauggcacuggcagccuccaucgguuuuacuacuucaauacuugcuggacuucgcagagcaagcgcagaggaggaauuaaguggagauacgaugaagcucggacuaucuaugauugugaucuguuuguccaaggggacaacuugcaugcuccugaaagaagagcgauggaauugaugggggcauuggucuauuuggagguuaagagacagaacaugaagcucaggguuggauugaacagacucagcacagucagucagauccaguuuaucaucauuugcuucacauuuaucuaaaacuguaacagcauacccgacuguucuaaagagaacacuacauguuauagcuuauauauuuacaucaaccaaaacacaugcuauuuccuuugcuauaaauaugccaccuucuggcugggcgcgguggcucacgccuguaaucccagcacuuugggaggccgagguggguggaucaccugaggucaggaguuugagaccagccuggccaacaugaugaaagcccugucucuacuaaaaauacaaaaauuagccgggugccuuugaucccagcuacucaggaggcugagguugcagugagccaagauagcaccacuguacuccagccugggagacagacuccaucucccaaaaaaaaaaaaucuaaaaguuggccaggcacaguggcucaugccacccaacacaaguguaaucccaacacuuugugaggccuaggcggguggaugacuuaaggccaggaguuugaggcuagccuggccaacagugaaaccccaucucuauuaaaaauacaaaaacuagccaggugugguggcagacuucuaucuggcaaauuucuauuaauuucucaaggccagguucaaacaucacuuccucugagggagcuuuccucucucucaaucuaucugcugaacuugucuuucaaacuaaauugugggcagcugucccacuccaaucaguucuagcacuggcuuaaaucucugcuuucaccaaaagcuuuaaaaaauaaaaauaggccgggcgcgguggcuuggccuguaaccccagcacuuugggaggccgaggcgggcagaucagcugaagucaggaguuugagaccagccuaaccaacauggagaaacccgucucuauuaaaaauacaaaauuagccgggcgugggggcacaugccuguaaucccagcuacucuggaggcugaggcaggagaaucacuugaaccugagagguggagguugcagugagccgagauugcgccauugcccuccagccugggaacaagagugaaacugucucaaaaaaaaaaaaaaaaaaaaucaccuuccuugagauaaccaaaauaaaauagugugucacuauaauauuacaauuauggacaccuccauuuaccuuguaagccccauggauacaccaacauuacacaucuguucuuguuuuaagcuauugauaaugcugcuuuuccccacauuugggaaaccuacaaauaaaugggaaauccagauauaaaaagcauuauauguuggcacuuaugaaauuuucacugccuaauuuuccauuucccugauguuuagggcaagaucagaguuggaucucagugucuucacuucaauacuaagaccaauuuuaguuucuucauuucuugcacaaguaaugcaaaggcaggaaaauacuauaaauucaaacaaaccaagaacuuuuagaaaccagcuuccuacaguaaucagucccaacaaaaaaccugaaucuggcagcaguuguguaaguuuuuuucuuuaaauugugugugguuaugugcuuucaguaagguauaagcaagaagcuaguauuugagugagccuuuuacuugacaacaacuccauacacugcugcuugggcacuuggagagcuggcuaaacuucuuaacuauuucaacacuuaaaaaguaaaaaguaaugaacugaaacucaccaauuacuccaacccgaauggcuuugcugcaaguuuccugaaaaccuccaagaaguuuccaaaggcccucuuucccaaagcagacuucacuucugaauggagcagcauucuucuuugccuucacacgcuaaaauuccaaauaguugaauuauucuggcaacuuaccugauaaauuucaacaaaccccaagcaaucaggcuccagagcccagcucuuaagauaacuacauugccuuucagaugaucucuggcugaaaucagaguuggaucuuguaauuuuucauucacuuaaaucaagauuuuguacacucaucauauuucaaccaaaaucugaaagaaucacauuucuuaccacuaauaaaggauaccuugguuaucuucccuuuauccuuugguuuuguugaggcucugaacaccacuguuggcaauucuuucuucaaauaauuuagccagcucuccaaauucuccuuugguaccagaucugauagcaauuagaaauaagacauuugcggccaggcacgguggcucacgccuguaaucccagcacuuugggaggccgagacaggcggaucacgaguucaggagaucaagaccauccuggcuaacacgauaaaaccccgucucuacuaaaaauacaaaaaaauuagcugggcgugguggugggcaccuguagucccagcuacucgggaggcugaggcaggagaacggcgugaacccgggagguggagcuugcagugagcugagauggcgccacugcacuccagccugggugacacagcaagccuccaucucaaaaagaaaaaaagaaaaagacauuugcuccaauguggcuauuuuguugagaugcauuugcaaaaucuggcaacuauagauuuuacucugguuuacauuuucccaguccuuucaaaaggauuuaacuagaaaaucagggcaggguaagcuccccuaccauacugcccguaucuuaacagagcucagcaucugcacuucucuauuucaauuccccuuguauugcucacuugaaaacuucaggacagacucaacgucuggauuacaacccuacuaacccuagagcuauguuuccagaauuuaccuuuagcuagcagccaauuguuucuucauuuuugagacgaaguguuguugcccaggcuggagugcaguggcacaguaucggcucacugcaaccuccgccucccggguucaagcaauucuccugccucagccuuccgaguagcugggacuacaagugcccaucaucaugcccggcuaauauuuguauuuuaguagagaugggguuucgccguguuggccaggcuuuucucgaacuccuggccucaagugaugugcccacuucagccucccaagcagccaauuguuucuuaaccccaacaacaauuuuagaucucauucccauuuucugcuuuguaauucucuguucuggguuuucuuuuuccugcugcucaaacucagaugcauaauuaugcauuucauuuaaauauuuugucacauacguuccaauuuauuucacucuugaacuaauacccgacauuguguagguguggggaauuugucacacugucaucacuuccuagaugaaauauacuacacaauaagcuggguauagcagcuuacacucuuuauuuaaaagaugguaaauacugaauggcaaaagaauaguagaaaccaguugagucaguuguaaaagucaccuggcuccccacugccuagcacugucucuggcaaagugcacguacucuggcuuugcugagaucagaguuggaucuaaucagucuucagugacuaucagacuguuuccucguaccucacccauguacacagaagacaaaggguacccucuuuacucaccugauuuauuuaauauaaguaccagcuuuuucuguccacucuggacaauggccucuucuaccugaggacaucugcaaccaagaggaucucuggcauccaacaccucuaggacaacaucggaggcuucaaucaccuaucaaggaaaaaaugaccagaacuacauuaucaaggagaaaaugaucagaacuacaucccuuguucugguaauaccuuccacaagagaguacuggcauuauccauuuagcaacagggugagcucagaguuggaucucaugucuucacuuugguaugaagaauguugacccucaucauuucucacacaggaaaguaaaacauaggcuugcucagcagucucugaucaagauggauuucaaaaaugcaaauaucccugucugaauccucccauagugaauuauauaguuugauagguccuucuggccuugccaaaagcugcugaggggcagucagguucuauccaugggggagugagcuugggaaaauggauguuggggaugggagugcuggagagcaacuacaccaaguuguccuccuucacuuagguuucaacagaguacuuuagagaccuuuagccugacacugcuuacuccaauguaccuuucucaaucucaacacuaugucaacguuuuuuuuuaauguuguaaaucaugcuuacaggcagaaccaguuuugugcaaauauuuagaaccaaagaaacuauuuccgucagguaaacauagcaggaaaggcauuaaacagcauaagcuagagucgagucacgaaaugauuuguuggugaaaaggugggaggagggagaggaucaggaaagauaacuaaugucguacuaggcuuaauaccugggugaugaaauaaucuguacagcaaaccccuaugacgcaaguuuacccauauaacaaaccugcacaugcacccuucaucuuaaaagguuaaaaaaaaaaugacuugagucuuuuaaaccucauuacuacugucagacacugaccuaggcuaagauaccuuuuuaaguucuuggcaguacagcuucuuugaauucuguuugcccgacuuggcuuuguucucaguuuugcaaagcccaaacuccuagaggauaaagggggaaauaacacaaaauuagaaguagagcaacuguaaccucuaacuccauuuuccacagcugaguagcagcccuugcaguuguuaaauagguaagauggagucugaacucaguugucuuccucccaagaagcucagcagccuguggaugugcuuuuauuucugcaucagaacucaucucucagccaggcacaacagcccacaccuguaauaccagaaacuucgggaggcugaguuggguggaucacuugagaccagccuuggcaauauagugaaagcccgugucugcuaaaaaaaauuagccaggcgugauggugugcuucuguagucccagcuacuuggagacugaggugguaagacugcuugagccugggugguccagguugcagugaguugugauugugccacugcacucaggcccaagcaaaaaaaccaaaaucaaaaccccugaucucucauucauaaagagaccuaaucauaccuuuuccauagguuccacauuugauggcuuaauaucaggauuaguuucaaguuuucuuuucuuuucuaguuccuucugccugucaaguuucugcugcuguuuuaguucuucaagcugucagagccauaagggaaauaggugaaccagugacuaguguuguuaccuuacucugaaaaauaucacacauaacacacuacaccacucaaugaaaauucuggcuaacauaacuuacccucuguuuccuuagcucagcuucccuaagaagagccuccuuaaagggagcacuguuuggaacuccugggucuuuccuaggcuucuugugaccccgcuuuuuagccuccuuucuuaauuuucgaugauguucucgaaccuauuaaaauaaagagauuuugucugcuuacaaaaauaucuuuauacuuaagcagaauucaagugagaaaccaaucuggcugcaauuuaguuaugccuauaaaauguccuaggaaaauggagcuuuaauuggaaucuuacaaaguaaugcauauguaaguauaaaacagcaagaaauuguaacuagaaggcucucuaugcagagauuaacaugcugaacaaauuuagagacuuaucaccaaaucacugcacuuucucacagcugcacuccugaugccuaagagcuugugcccauggucagucuauccaaugccauuucccaaaaccaaaucacauuaacccagacuuucccgcaaaggaacagggcaaaaucaguuuagcaauguguuugguacagcucucucaagcacuacacuuaccuuuuuuuggauuuuauaccgcuuauggcaggucaugcguuuacuugcuuucuuuaacucuacaaagaaacacaucacaaaucuguuaacccaaaugauuaguucuggguuaacgcacuauggaguuauauccuuuucuuguguuauuggcuaccaaaccuaacguuaagucuaaugcgaaaugccuaaugcaaacauacgugcuacuuucaaaucccagagaauuaaauucaguagauccagaauggagucaaaauucccugcacuuacccucacaauauuagaaugggaucauacacaacagcguaugagacacaaaacgacaaccacuucgugucaaacagcacgaaucauaaggcaggagaggaacacugagucugggaggcgauucucagcucucaccugggccagucugcacguggccacggaaagaaaauauugggccucaaaccuggcucagacgcugcuuccuuacgaaaaucuagccuagucuuccccacccucugcccggcuucguuccgcagaaugagcccgcgcgguuaacaugaucgccguagggacuuccaacucucgguucuaccaggaaauagggccaaggccuacgcguaggcucccacccccauaccagcagagacaaagccguagccguagaagagcgucgugguggcugcagcaacuuccagacgugggucccuccacgcccgccucccgaccccacuuacuaggccuuuucauauuggcuguagaaggaagcacaaacacaucaaccugccuccgcuggcgccacgugugaacugaagccacugacgagcgucacgcacuuacgcugccgccguaaagugcgucaccgccucucugcgugcgcgggcacgcagugucgcgcggagcagggaucgcuuggcggccgc

SEQ ID NO: 17494 - RNA, 41719 nt, Homo sapiens
uucuuuuuccuggggagcuuuuuucuagugugaagacaaacaacaucuugaauaaguaaaguguauaguauguuaggucaugauacgugccguagaaaaaauagaggagaacaaggggagaagggggucccauggucagagcagggagaaugguuuauauaggccucacugagaagucggcagcugaaccaacacuugaagaaacugagaaagugaauaaugugaauauccagggagaaaggauuccaggcagugggaacagccaguauaaacaccugaggagaaacaugccaggccuguuuguuaguaggagagugagccauuaaugaguuaguaagagauaagugccagggguagggugcauaucacauagggccucagagaccauuauagggauuuggguuuuuacugaguuaauggagugccaucgauuguuucaagcacagagugacauuugguuuagaucuuaauaggauugcucugccuauugguuguugagaauagacuguaaaaagucaaggcagaagcaaggagauccaccgccuaggaugcuguugcaauaauccaggcaagaacaaucaugcuucagaccagggugauugcaaaagauaguauuuugaaggucaaauuaauaguauucuugauaaauggaguguggggucugagaaagauaaaaaagucaaggaugacuccuguguguaagccugaggaacaggaagguugcaguuaccauuaacugaaauaaguaugauacuucaggucaggaaucacgauaauauggagcaauaauaaugucagcuuuauggguuaguugucaagaauaauggcuuucaucaaauucugaaggggugaaggggcacuagauuuuuuuuuuuuuuuuuuuuuuuuuuugagacauugucugguucugucaccuaggcuggaaugcaguggcaugaucuuggcucacugcaaccuccaccuccugggcucaagccaucuucccaccucagccucccaaguagcugggacuauaggugcacacugccagggcuggcuaauuuuuguauuuuuaguggagaugggguuucaccauguuguccaggcuggucuugaacuccugagcucacgugauucgcccaccuuggccucccaaagugcugggauuacaggcgugagccccugggcccagccagggauauuagaucuugaccuucaaaaagauuauaaaccacugucuuaaaggaaugucugccacucaugugaucugaccccaaauauugauguuuuaugucuuuguuugguucacaaguccaaugacaaaugcuuaguucuguuuucaucaugaacgucucaggaagaaaaccuggucauuagauaaaacuauuaaguuuugugccuugauauuaaguuaaaaaauuuuuuucacuuggaaaaauagucaaauguuccuuucucuuuuucuaaguaucuuuucauguguuuaaugggggaaaaaauuaaugaaguugucuuaccaaaacagccagugaaacuccucugaaugguacacauuacuaaguuuuugguuaaugcgauuuuuguuagauuaauccuucaagaaggaaacuauuuuaauguaauuuauauauuuuccuccccaagaauugaaaaaguauggguucgagauggagcugcauauuuuuauggccccaucuucauucacccagaagaaacagagcaugagcccacaaaaauguucuacaaaaaagaaguauuucugaguaaucuggaagaaaccugccccaugacauguauucucgguagguauuugugcuuuuuuauuuaaucguguuuauuccaucaaaauugauggaauacuacuucuguggggcacuguucuagguguuagguauagagcagugcccaaauccaaaucucuguucucuuauguuggggcagagauuggggagucagucgauaaauuaaaaaauaaauauauagaauaucaggugguaauuagggcacaaccaaaccuuucaccucagccuuccaaguugcugggacuauaggcaugcaccaccgcacugagcuaauuuuugaaagauaguuuuccuagauauagaauucuccauugauaguuuuuuuuguucaugucuuucaucagauuuggggaguuuuuggccauuucuucaaauauucuuucugcuccuuucucugcuuccuucaggaacucccauuauacuuaacguugguacauuuaauggugccucacaggucucucagacucuucauuuuucuuuaccuuuuuuuuccuuucugcuccucagacuggauaacuucaaauggccugucuucaggugcauucauccucugccugcucaaaucuucuguugaacccuucuaauaaauuuuucauuucaguuauuguacuuuucagccccagaauuuaguuuuuauaauuugucucuucauuuauauucacuauuugcaaugacauuuuacugguuuccuuuagaucuuggaguauauuuaaaacaguugauuuaaggccaggcaugguggcucaugccuguaaucccagcacuuugggaggccgaggcggguggaucaccuaaggucgagaguuugagaacagccugccaacauagugaaaccuugucucugcuaaaaaaaaaaaaaaaaaaaaaauuauuugggcaugguggcacaugucuguaauccuaguuacucuggaggcugaggcagaggcagaggcagaggcagaggcugcagugagccaagaucacgccacugcacucuagccuggaugacagagcaagacugucucaaaaaaaaaaaaaaaaaaaaaaaaagacaauugauuuaaaguauguguuuaguaaauccagugucuggaauuucucaggaacaauuucuguucauuuuguuuuuucuuaugaaugggcugugccuucuuguuucuuugcaugccugauaauuuuuuguugaaaagugcucauuuuggguauuauaacaugauaacucuggaaaucagauucuccccauccucaggcuuuguucuuaauacuuauuauagguuaugguuguuuguucagugacucuucuaaacguuuguuuguuuguuuguuuguuugguuuguuuuaaagauuguauuuuuggcugggcacaguggcucacaccuuuaaucccagcacuuugggaggcugacaugggcaggucgcuugagcccaggaguucgagaccagccugggcaagauggcgaaacccugucucuacaaaaaaauacagaaauuauccaggugugguggucuauauccauggucccagcuacucaggaggcugaggugguaggaucacuugagcccagggaggucgaggcugcagugagccaugaucaugccacugcacuccagccugggcaacagagugagacccugucucaaaaaauaaaagauuuuuguuguuguuguauaugguuacuacagucucuguucuauaagcuuagugaucagccagugauuugacagagguuuucguaaauacguggagccaauaaaaccauaaaacucccagucuucacugcugacuucucugcguaugguggagcacaccuucaacacucagccaugcagauuacaacucugcuuugccuuuacuuccuacuugugcagagcuugaaggucagccagaaaugagaucuuagggccuucuuagguccuuucugagcauguacacuauuguuggcauguguguggccuucuaggcucccaggaauguguggaaacuuuucaaaacccuuauuggccaaagcaucucacuccucaucuuuuccucugaggccuuuugucauaucuacuguugguccugacugauacccuuugccccagccggcaacagcugguucauuugacuuuaaaugugcugugauuugaauguuugugcccccuucgaaauucaugacuuaaaguguaaucccuagugcaacaguguugggaaguggggacuuuuaggagauguuuaggucaugagggcuuguccucgugaauacaauauugcuuuuauaaaaagggcucauguaaaugggucugcucugucugaauggguuugcugucucuuacacucuugcccucugccuucugaaauaugaugacauagcaagaaagcccuugccagaugcuggcaccuuuaucuuggacuuuccagccuccagaacugugagaaaacuguucuuuauaaauuacccagucugugguauucuguuauagcagcacaaacaaacuaagacaaaauguuuuugacaaaaaaaccuagacacuucuccaccaagggaauuccaagcuaagcacaauaaaggcaagcacuuugcauuaguguuuagaaagcugccugacaggucaaaacagaugaccacaguucuuggagcauggagcuguuuugcuuccucuaucaccacaaucuuacaccaggaauagaggcugccaucuucaaggcugccacugagacagaaaguaaggaauggagugaggguaaguuaaaaugccacagagcuuuccugccaaguuucagucacuuuuuuucuuaauuaagcauuugcuugguugcuguaaaccuuugacuaucuuacagaauuccaauaaaguuuauucugcuuuuuucacuguuucugugaaguaauggcccuuagagcucacuacuccuccauauucacugacauaacuuggaguaauuucuuucuaaagaugccuguuagaauguguuacauucuggccgggcaugguggcucaugccuguaaucccaguacuuugggagguugaggcaggcagaucaccugagauuaggaguuaagagaccagccuggccaacguggugaaaccccaucuuuacuaaaaauacaaaaauuagccgggcgugguggugugcaccuguaaucccagcuacuagagaggcugaggcaagagaauuguuugaacccgagagguggagguugcagugagcugagaucaagccacugcacuccagccuguggcuggagacagagcaagagacucuauguaacaaaaaaaaaaaagaaagaaagaaaauguguugcauucuacaguuuaucuaccaguuuuauauccaggaucucauuuaauuuucaacaugacccuggaagaaagaugcugauauugucagaaaggugaaguuacuacccagggagugggccagaacuaaaaccuagguuuuccuaauucuucuuuaguuagucuacagcuagcuggcacacuuuugagaauuaaaggaggugccaguaauaucagguaggacaacaggcauauaaugaaauauaaguaacuucaucuugagauaaaacccaaaagaaaaugcaucuaguaaucacaaagugggauuucagccuagcuuguggaauucacuguccccagccuccaaggaaaaaggguuuuguuauauaagcuuuagagaauuuauaauuucauuguauuaacucuaaccacuauuaaauguaaaucauauuuugcacuuuuuugugucucugaaauagaaguuuugaagauaauuagaugagguguaucauuuuuucaucuucuguuacauacaaaggagacaauccuguuuuuccaacgguuauguucuuuuuucaguuucguugaagaauuguuuucauuuacuuaaacaguaaucaagcugggcacaauggcucacgccuauaaucccagcacuuugggaggcugaggcagguggaucacuugagaucaggaguucaagaccagccuggccaacaugguaaaaccccaucucuacuaaaaauacaaaaaaaaauuagccagcugugguggugcauuccuguaaucccggcuacucagaggcugagggaggagaaucgcuagaaccugugagggagagguugcagugcgcugagaucacucuacuggauuccagccugagugacagggugagacuccgucucaaaaaaaaaaagaacuuaaacaguaaucagauggccacauguggcagacaguaccucuacccuuaaccccuuaggugauaaaauuuccaggaaccugggcucuugaaacaugccgauuccuaauuuauuugcagguuuuguucccuucacaguagauuuuuauaacguuucauuaauuuaaaaacuguccucaguaaggcaaggaagauaaaagaucuaaagauuugaaaggaaaaacaaaagggccuuuuuuuuuuuuuucaaaaauauuagguauguagaaaauccaagagauauucagauaaacuauuaaaauuaguaaaugaaaauaugaaguuuuuuuuguuuuguuugagacaagaucucgcuuuguuauccaaacuggagugcaaugguacaaucauaacucacugcagccuccaacuccugggcgcaagcaauccucccaucucagccuuccaagaagcugggacuauagggauguaccaccacucccagcuaauuuuuuuuuuuuuuuuuuuuuuuuuuuuuuuuggggagaugagguaucccucuugcucaggcuggucucaaacuccuggccucaagcauccucccugcucagccuccccgaaagugcugggauuauaggcaugagcuaccuuaccuagccccaauauuucuauuucuguaucuguaucccaucagugagcaauuagaaaauuauuaccauuugcauucaauaccuaggaauaaaucuuuuuuuuuuuuuuuuuuuuuuuuuugagauggaguuucgcucuuguugcccaggcuggagugcaauggugcaaucucgguucaccgcaaccuccaccuccuggguucaagcuauuccccugccucagccuccugaguagcugggacuacaggcaugcgccaccaugccaggauaauuguuuguauuuuaguagagacgggguuucaccauguuggccaggauggccuugaucuccugaccucgugauccaccuuccucagucucccaaagugcugggauuacagacgugagccaccacgccuggccaaucuuuuuuuuuuuuuuuuuuggagacagugucucguucugucguccaggcugcagugcaguggcacaaucucggcucacugcaaccuccaccuccuggguucaagcgauucuccugccucagccucccgagcagcugggaccacaggcgugugccaccaugcccagcuaauuuuuguauauuuaguagagacagcauuucaccauguugaccaggauggucucaaucucuugaccucgugaggcgccugccucggccucccaaagugcugagauuacaggcaugagccauggcacccagccaggaauaaaucuuuaaaagauagccaacgugguagcucaugccuguagucccaacacuuugagaggccaagaugggagagucgcuugacaccaggaguucaagaccagccuggacaacagaaggaaacucuaccaaaaaaaaaaaaaacgaagaaacaaagauguguagggcaccugcacacgcaugugcacacaugugcgcacacacacacaacuauaagaaaauuauugagaaauugaagacauaaguaaaugaaaguuauccaucauauuuauagcuggaaaauucaauauuaaaaagaugccaguuccccccaaauugaucuauugguucguuccaauuccaaucaaaauccagcaggucuugauaauuuuuuuauacuuuauuaaaugaaguuuucuaaacuuucaucuuuucccugucuuuugggggcuugguaggagcuccaagucaggacacagagauaccaccuccauuccaaagccaccaaucacuuuuacucuuugguuguaagcagaauuauuauuuuuuccuaaugucuauuuuuccuucuauaaaauauggaaaauuguaauuaucccuuuucugaauuaaaaggccuuugaauuauguaaauaaaagugcuguguaaguucaaagcagugauaguaauuguagcuauuuuaagcuuuggaaauguuucugaccuguuuuucauauacauguuuaguaaguuguuagcuaugaacauuccuguuaaggucaagagcaaaauagggauguucuggcugggugcgauggcucaugccuguaauuccagcacuaugagaggccaaggagggcggaucaccugaggucaggaauucgagaccagccuggucagcauggugaaacucugucucuacuaaaaauacaaaaauuagcugaugugggcgugguggugggugccuuuaaucccagcuacuggggaggcugaggcaaaagaaucacuugaacuugggagguggagguugcagugagccaagaucgagucacuacacugcagccuagcgacagagugagacuccgucucaaacaaaaaacaaaaaaagaaaagaaacaaaauagggauguccuuaucacacuuauuuaacauuguucuagagguacuagccaguggaguuagaagaaacagaagucuaaaauaagaaaaguaaggaggugaaaauucaagagcaucaacuaagaaaucauggcaaacaguaagagaagugagaugauugaauauaaauaaauaacaaaccuauuaucuuaaaagauucaguacuaauaaaauaccuuagauaaacuuaacaagauaugccacaucuguaugaaaaaaguuuuaaaaugcuauugaaugaaugcuugaacaaauugcaaagcaguaccauaugccuagguagguuucaaugucauaaagauguccauccucccuaaauuaaucuuuaauaugaucccauuagauauaccagugggaauuugcuugugaggaaguugauacuaugugaacucauuuuaaaaaucauauugaaggccgggcgcgguggcucaugccuguaaucccagcacuuugggaagccaaggcgggcggaucacgaggucaggagaucaggaccauccucauuaacauggugaaaccccaucuuuacuaaaaauacaaaaaguuagccgagcauggcggcgggcgccuguagucccagcuacuugggaggcugaggcaggagaagggggugaaccggggaggcggagcuugcaaugaaccgagaucgcgccacugcacuccauccugggaaacagagcaagacuccaucuaaaaaaaaaaaaaaaaucauauugaaaaagaaacuuagaaucgggugcaguggcucacuccuguuaucaaucccagcacuuugggaggccgagguggguggaucacuugagccuaggaguuugagaccagccugggcaagauggcaaaaccucauuucuacaaaaaguacagaaauuagcugaguggcacuugucuguagucccagcuacccggaguagggggcugaggugugaggaucgcuugagcccaggagguugaggcugcagugagcagcugucaucucaccacugcacuccaggcugggcaacaaagugagacccugucucaaaaaaagaaaaaggaacucaggaaaauucugaaaaguauagugaaaggggaucuauccuuaccagauauuaaaacauuauagcacuacaauaauuaaaacuauaugauauaugaguaaacagguuauuugaacaaaauagaaaguuuagcaaauauaugguaaaaguggcauaucagguaaguggggaaagaaguauuuuucuccaaaugguguuuggaaauucaauaaccauuuggaaaaauaaaauuguagccauaucccacaucuuaacuucaggauagauuuccagaugaauuauaaauuuaaauaaacauaaaauuaaacaacaaagauaccaaaagaaaccaugagaaagaaauuuuguuaaucucugacauaaaagccagaacucauacaauaaaauacugauaaauucagcuguauaaaaauggaaaauaucuauaugaccaaaacuggcaaaaacaaaaaugacaaucuugagaaaauauuugcaauguuuaucauagacaaagaucugauuuuccucauagaugaagagcuccuauaaagcaauuagauaaagaucaacauccagcagggaaauaggcaaagaaaauaaaggagagcagaaauaaauuacuagggcccagugugaugacucacaccuguaaugccagcacuuugggaggccaagguggguggaucaccugaggucaggagucgaagacuagccuggccgacauggugaaacccugucuguacuaaaacuacaaaaauuagcuggacaugaugguaggcaucuauaguccuagcuaccugggagacugaagcaggagaaucacuugaacccaggaggcagagguugcagugagccagaaucgcaccacugcgcuccaaccugagugacagagcgagacuccaucuuaaaaaaaaagaaacuaccagugauucuuaaacaaaugaaaauauacccggcugggcacggugguucacaccuguaaucccagcaguuugggaggcugagggaggcggaucaucugaggucagaaguucgagaccagccuggccaacauggugaaaccccauuucuacuaaaaaaaaaaaaaaaaaaaaaacacaaaaauuagccaggcaugguggcacacgccuguaaucccagcuacucgggaggcugaggcaggauaauugcuugaaccugggaggcagaggcugcggugagcugagaucaaaaaagaaaagaaaagaaaauauacccaaccuuggccauuagagaaaugcuaguuaaagcuacccaggugcuuuucuucuuuucuuuuucauuuuucuuuuuuucuuuuuucuuuuuuuuuuuuuuuugagauuaccuaucaaauugucaaagauccagaagacauuucucacuaguugacaagagcaugaggaaaugguauuuaccuacuuuguggguagucugugaauuaggacacccuuuauggaaggcaguuugauaauaccuacaaaaauuuaaaaaguguauacauacccuuuaacccagcuuuuauaguucuagaaauuuaugcuucagauguauucaccuacgugcaaauugauaugucuuaaauuauuuauuucagcauuauuuagcgucagcagaagagcaaacauugggaaacaacauagauacccaucaauagggaacuaguugaauaaacuuaguacauucauacaagccgugaccuccaagacauauuauuuugugacaaaauucagaugcaaaacaguuuuaagugauaugcuaccauuuaugggaguuuuuuauuguuuuauauauaugucauagaauucaucauuuuaaccuuuuuuuuuuuuuuuuuugagauggagucuuucucugucacccaggcuggagucaguggcacagucucggcucccugcaaccuccgccucccagguucaagcaauucuccugccucagccuucugaguagcugggauuacaggcgcaagcuaccacgccuggcuaauuuuuguauuuuuaguagagacgggguuucgccauguuggccaggcuggucucaaacuccugaccucaggugauccgcccaccuuggccucccaaagugcuaggauuaccacgcccagccuuaaccguuuuuaaauacacaguucaguggcuuuaaguccauugacaauaccguacagcuaucaccacuguucauuucuagaauuuuuucauuaucccaaauaaaaacuuuguaccuguuaaacaacucuuuauuuuccccuucccccuggcccuaguaaucacuguucuacuuuuuuuguucaugaauuuugccuguucuauauacugcauauaaguggaaucauacaauauuugucccuuuggaucuggccuauuuuacuuagccuaauguuuucaaggcucauccauguuguaucauauaucagaauuuuauuccuaaggcuguauauuccauuauauguauacuacaucuguuaauggacauguagguuguuuucacauuuuagcuauugugaguaaaacugcucuuaccagugguguacaaguaguugauccucugauuucuuuuggauauauaccuagaaauagaauugcgaggucauaugguaacucaguguuuaacuuuuuggagaaacugccuaaauauuuuccacagcagcugcaccauuuuacagucccaccaagauacaaggguuccauuuucuucacauccuuaccaccacuuguuauuuucuguuuuggguuuuuuuuuuaauacaggcaucuuaauggggugugaaguaguauuacauugccguuuugauuugauuuuccugaugaugaaugcuguuaagcauuguguuuuuuuuguuuuguuuuguuuuguuuugagacagagucucgcucuuucgcccaggcuggagugcaguggcgcaaucucggcucacugcaagcuccgccuccuggguucaggccauucuccugccucagccucaugacuagcugggacuacaggcgccugcaaccacaccccgcuaauuuuuuguacuguuaguagagacgggguuucaccguguuagccaggacggucucgaucuccugaccucaugauccacccgccucggccucccaaagugcugggauuacagacaugagccacugcgccuggcuaagcauuguuucaugugccuauuggacauucguaugucuuuuuuuagagaaaugucaauuuauaucuuuugcacauuuuuuaauuggguuauauauuugucuuaauguugaguuguaggaauauauauucuguauacuagacucuuacuagauauaugauuugcaaauauuuucuucuauggcuuaucuuuucacuuucuugauaguauccuuuggagcacaaaaguucuuaauuuugauaaagccccuuuuuuuuuuuuugagacugagucucgcucuauugcccaggcuggagugcacuggggugcucuuggcucacugcagccucugccuuccggguucaagcaauucuucugccucagccuccugaguagcugggcuuacaggagcgcaccaccaagcccagcuaauuuuuuuguauuuuuaguagagacgagguuucaccauguuggccaggcuggucucgaacuccugaccucaggugauccacccuccucggccucccaaagugcugggauuacaggcaugagccacugcacccagcccauuuugaauuaauuuuuuuuuuuugagacggagucucgcucuuucgcucaggcuggagugcaguggcgucauccuggcucucugcaaccuccgccuuccagguucaagcaauuuuccugccucagcuuccugaguagcugggaguacaggugcacgccaccacgcccagcuaauuuuuguauuuuuaguagagaugggguuucaucauguuggccaaggacggucucgaucucuugaccucguguuucugcugccucggccuccccaaaguacugggauuacaggcaugagccacugcgccuggccaaauuaauuuuuauauaugauaggagguaggaguucaacugcauucaugugcagaaguggaaauccaguuguccugguaccguaccaucuguugaaaagaguguucuuucccccaaugaauugucuuggaacccuuaucaaaaaucaauuauccauaaaagcccuauuauauugguuuauuucuacacuuucaguucuauuccauugaccuauauauucuauccuuaugccaauacauauuguauuauaucuuuuuuuuuuuuucuugagauagggucucacucugucacccaggcuggagugcaguagugcaaucacagcucacuguagccucagacucagacuucccagacucagaugauucccaccucagccucccgaguagcugggaccacaggcaugcaccacaacauccagcuaauuuuuuguauuuuuuuguagaauuugggggucucacuauguugcccaggcuggucucaaacuccugagcucaagagaucugcccacuucagccucucaaagugcugagauuacaggcuugagccaccaugccuagccccuuucauaucuuuaaaauuguuaauuauaugaauguauucauccaaaaauaauaaaauguuaaaacaguuaguaacuaugaccacaguuuacuccuuuaauuucuuucuaauuuucucuuucaggaaagugugcuguguugucauucaaggacuuccucuccugcaggccaacugaaauaccagaaaaugacauucugcuuugugagagccgcuacaaugagagcgacaagcagaugaagaaauucaaaggauugaagagguuuucacucucugcuaaagugguagaugaugaaauuuacuacuucagguaaagcuugaaaaacuuaaggaaaaaagagcacuuccauuaacugauagcaacauaguguaguccaguguuuuuaauuuuuuauuagaucuuaaacuagaguaguaaauauuucaaauagaaaauauuuauucacuuaaagauuaaaggaaagacuucauaaucugcugggaccugguggcugcucuaauagugcccuuggcguagacuccaauaauuguggaaugaggcagaaacacuugguucugguuuauauccugucaggagauuucucaguuccacagauuaugaaaacucuuuuugcuguguauaggcaacuagaucccaacuuuggacacaauacuuuuguggauauucagcauaauuauuuaaaaacaagcaucucuaaguacaaguaauuucauaaauacacauuuaaacucuuuccaugcugccuuuagagcauauauugcagauugcaggaagucacuucuaguuguuaagguggaacacugcuuuccggcuuauucuggaggggcauuaggugauuuuagguuuuuuaugucacuuuuuucagaaaaccaauuguuccucagaaggagccaucaccuuugcuggaaaagaagauccaguugcuagaagcuaaauuugccgaguuagaagguggagaugaugauauugaagagaugggagaagaagauagugaggucauugaaccuccuucucuaccucagcuucagaccccccuggccagugagcuggaccucaugcccuacacacccccacaggugaaggugacagguuccuguuacuuaucuuauuaccaccuuugguuugcagcagacucaaaaccaaaguaaagugacauccagccccuccauaugugagcuuuaacuuagaauucugcaggaaggaacagauuuugucagugccaugauuuauucauuuauuuuugauugacaaaaauuauaugucaucccauuaauaauuuauauuaauaccauuaauaauuuaaaauuaauaucuuuaaaauuucauagcuauuuuaauggugggcuuaguuagaagacucuuccuugugcugaagaaaagcaguaaggagcaacaucacccuguuugucuuuagcuuuuauuacccgugucuuuuuaaucucuccuuauguaggaccucaucuuuugguugaggugauuguugguauuuuuuucucauucagaauuuuuacaagacuuggccaggcaugguugcuuaugucuguaaucccagcacuuugggaggccaaggcaggaggaucacuugagcucaggaguucaagaccacauugggcaacauagugagaucucaucucuacuaaaaauuuuaaaaauuaggcauggugaugcacaccuguagucccagcuacucggcaggcugaggcaggagaaucauuugagacugggagaucaaggcugcagugagauaugagugcaccacuguacuccagccuggugacagaacaagacccuguaucauuuaaaaaaaaaaaaaaaaaaaaagaauuuucucaagacuuaauugugaggucaccauuacagauugcacccauggaauucagugaaacuuucauuucuuuuuuacuuguaauagauaaggaagagguguguuuugaccaagaaaauagccagcuauaaaccaaacgugucaauaaagcaguaacuagugaaucacguguuccuggcuucugaaaaauuuuuuuuuuuuuuuuuugagacagagucuugcucugucgcccaggcuggagugcaguggcgccgucuuggcuuaaugcaagcuccgucucccggguucacgccauucuccugccucagccuccugaguagcugggacuacaggcgcccgccaccacgccuggcuaauuuuuuguauuuuuuuuuuuaguagaaacgggguuucacugugucagccaggauggucucaaucuccugaccuugugauccaccugucucggccccccaaagugcugggauuacaggugugagccaccgcgcccggcuggcuucugaaauuuugagcaguuaaccaaauguaauguuuugaugcaccauaagaccuuucugucuuacagucuaccccaaagucugccaaaggcagugcaaagaaggaaggcuccaaacggaaaaucaacaugaguggcuacauccuguucagcagugagaugagggcugugauuaaggcccaacacccagacuacucuuucggggagcucagccgccugguggggacagaauggagaaaucuugagacagccaagaaagcagaauaugaagguaaauagagccuaggcacaacugucuuucgaagcaaggggguguuucaggaaugcacgcgcacagacagguuuuacucuuguucuuaccacuugcacaugaacuuuuauuuuggggacuguuccaaauggcacccaaccaguauuuuagaugcuagccuuguccugacugagcagagcacugccccugacuuggccucugauccugguguuguauuuuccccugcaaauuucuccaaaauauuuugcuacuaaaaauugcaugauuuuuuucuuucauugagcccuguaagcacacauguugagcuagggaauuauuguacaaugauguuaaauauaauuuuaauuaaaauucgucugaaaagggccucuuaaaaucagugaucuuguguuacagcucuugguaagccauauauuuaaacuucaggcugagucuuugcuaaagugcuugguuuccuaggucaguccuggccuauacugugucuguauucauagcuacuucuaagguauuugggucuuuuuuauaaagcucaacugccuuuauuuuccuuuuauucuaauuaaaucacuuugggcagugagcugucauucaagaauuuggugguucuuagccauuuagagacaaauacuugagauuuuuuguuuuuuguuguuggguuuuuguuuuuguggguuuuuuuuaaauaucagacauggacuuaguaaagaaauuaguaguaagcauuagauuaggcaguacuguugcccuuugagcuauauuuuuuccaucuggaauuuuauauauugguucauuuugccaguuuagagcuccucucuacaauggucaaccacuacucuucuuagguggguacaguucuauuauuuucuggcaaacauuaauuauuuaggcugccccuuuuauuaaaauuuuugaagucuccaaagaaacuucuuuaaaaaaaaaaaggucauuuauuauaauuauuugauuacuaugaaauuaucugacaggcuuccccaaggaucuucugcaaagaauccuaauccugcaagauguuuagccaaaaaacauuuuguggcaaaaccaguuugagaagcauuccaaacucucucucuuggaaacuuauggugcauauucccguauguguguugucaggcccaagggccuccucuguccuuaucaaggggagugcuaaccuuuucuccuuucauacagcaugcauauucccauauuaaaggcuuuaagaccaccaguaaauaagcuguuuuauauuaucuggcauuuucugaaauuugaccagguauuuauguaguaccuaugaauacccuaaagaacuaacauuuugcagaauauucuuuggaaaacccuagucaguuccauaagaaccuagaacuuuguggagcuuugauauuucugaccuuauugaaaguuaagaccuacuacaccacugagcuggaggaguguugaaaaucaagcucacaugaauauugcugagcgagcagcacagcagcagcagcaaggcaaauggagccagugcuggauggcugguuauuuagagugugagcaggagagagauaccugaagacacugugaagguaaaaacacuggaguaggaaugaagagagggagaggugauggcgucuggaacauccuuccaaauucaaaggggagucugaaagugagugagaaccuagugaggggggaguuauaugacucagcagcaucuaccugagacauaaaaucugaacuuuugauguuuucucucauugaauucaaagcccaaaguuuagaguuuggguagccaguccaauauucaauccacaggccuuauuuuuuuuuuuccauuucauuuuuuugcuuucccacuuuacugugucacuuguauaaugaaaauacuagaauuugaaguggaacccuaggucgauuuuuuuuuuuuuuuuuacugcuagcucaaguaaauaguuuguucaaauggccuucguuucucauacucauuguacaaagggucuguaaacuaggacagucuuagugaugauaaggcuaugcaggcaacucugucacagccaagaggccuuugauugcuugacuuucauauucuuaaaggaggacuggagcuguagcuucuugauucucuguaaagccauaugaccucgagcuauuuucccccuccugaaaucagugguguugaguuccauguuaaaggguuuauguguggcaguuggagugugauaucaggaguuagggccauaggguugcugguucucucuauccuuggacaagugacugccugucucccagccuccauuugccuaugugaugaguggggggaucuucuauuuaugaauggugagacaagaaacccuguauggugggagcuuuggaaauacagcauuucaggaguucuucaguagggguucagucugcuagcucacaaaaagacuggaaacaugaucauuggagcucccggcucuggagaugcagaguagcucagggccggggaguggggagguagcaggauguauucuacggcccagaacugccacagcaaaugcucuuuuugcauuuugaaugaaguaagagggauucuggaauuuucauugauuuagggugguuuauggucaguauugaacugcucagcuucaggaaaccugguucuuucaguacauuguccauugcuacauacguguuuauuuaauucucugcuucugaugauuguagccugaaguauaaugcauuuuuuuccuuugggguuuauuaaacaugacuucuuugcuucauuagaauguagaaauuaguuguuucccuaaaaccuucugaaggaggcagucagcuacuuuucccuuacagaguuaauuuucuucagcugcuaaacuccaugacacucgugaugaguccucaaaucuuaguaaaauuggguacaaagaaucaggaaauauauauaguaaguaacaauuguaccaaaaauuauaaugggccauggaauugcuucauauugaaauuauaaauaaucuguaaugcuauuaauacuagaauaaugguagcgcuucucaucuucagggugccucgugagauuaaccauggugguuaugcuggugacguguuuacauaaaaccugugcuuucugaauguguguugcagucuuaacauucuugaaaucuuugcagaccaguucucaagaugggauaggaaagcuggacucuagguuaccaagugaaaucggcccgacuccuccuguguugagacuagucaucuacuguuccuuccauugagacagaacuguugccuguguuuuuacuaguccuguugaaugcaauggaugguauuuugaauuccuggguuaaaaacagaauugaaaaucugaaaugccuuuacagagcgggcagcuaaaguugcugagcagcaggagagagagcgagcagcacagcaacagcagccgagugcuucuccccgagcaggcaccccugugggggcucucauggggguggugccaccaccaacaccaauggggaugcucaaucagcaguugacaccuguugcagguaaaaacaggagcuaagaccauuuuuuuccacuuuaagaaauuccuucauuuuuuuuuucuccaauaaggaguaggccacagucuauugccuuuucucaugacagauucaaaguuugaagucauccauguuguccuauauugccuuucccauaugggcaaugccucccuucugccccagaaaugggcccugggcccaacccugguaauugguagggagcagcucuucccuggcugugggcauggucuggugauguucuccaccccagccugcucuugauagagcacuauagcagaaaauaugaaaguagacccugaauucuguucuagagggacucccaagagaaaacacaaaacuagucuuuaggugguguugauuuucccaucucauuccaguauucaguuugccuuguucugcugcagccauccuuaaaagacugaccguuuaaaaggauuuuuugacaaugaauuguaaauccuuucuuggucaccaaugugcaugacugcuaaauagaauacaaaguccuuauucaauucauugugcccacucuguaaugcuuuucuauuuaauuacauuaaacugcauuuucuguuaguaucccagucacauauuuaagaaaaaaaaaaagaaaaagaaaaugaugaaugugguuugucuguguguguugucucugguucugguagccauagcaaauuugacuguucuugaauugaauaucuuugucugacaugucuccaaugagaagucugcagaccacuucucgggccccuucuuugagaucucuccaguccuggugaggucuguacaagccaccuguguuucuucuuaagcaagcagucugaccucuuucacagggaguccaaaauaguguuguucaaggcaggcuuguugggaugcuguuuuugcuguuucguuuuugcuuuuuaaggaagaguagcauaggauaacuuuuccauugucgcuccuaacuuuugugauggcaaguucucaaaugcacugucgcugaacucagcaguugcacucgccaaagcacaucugaaucauggcuuucagugcuuucaguguaacugauguugaucuaacaaaucucauaaucgccugcucuauuccauggcccauuuugguuaaugggguuccagagguuuuuagaaaucaggccuugaacauggggacuuugaaaguuagaauucccucguugacauuguguuuuguucuauuugaugugugacguuguggcacugugcccuugacuucaaaacccaggggcacauuaacaaaaugaauacaaacagcuaaaaacaauuaaaaaaaaaaaaaaaacagcagcugcagcauuuuagcucccuguuggggaagaacauuauagaacucuauggaugaggaagguggucccucuagaaagccccugcuccauuauuuagggugugcuggcuagacuucugggcccugggagugaaaagcaagcauucucugcaguaaccacucuuugguccucauggggaacccugcagcuaagagggugauuuuucaugguuuuacagguuucuuagggccugagucuuacuuauuagccuuguugcugucuugagaccagcuuugcuuacaagcauugaagcucauuugaacacaugugacugggauaauaaaugccaaaguacaguuuaaugaagacaagugucaugucuuucaguucuuaauaauuuccucaaccacagcccaugaaggcugcguucagaugggcuuuuguaauugaaagcaaagccucuuaacauccuuaaauuucccgccuacuuaacccuaaaugcuauaacugguggugugguuaaaagauugguagcauuggaucucuucauguuuaauuaagaugauggugucuguucaaaaguaguuuuuacuuucugaacucuucauuuaaaaaaaaaugaaaacucauaaucuuauguauagagagauuauuauucaaauuuuugucauucgguuuauguaauuguaaguuagucagcuuagguaugacuagugaagcagggugaaucgaccucagaauuuuuaguaauuucauagccuuaaaagacuaaacuuuuauaaauaaauauguuugaaaucuucagggaaaguccaagaguaaaauucucagaaucugaaguuuuccacuauuugacagagucccucugcaaagaguauuuuauaaaaaugagguuuggcaccagucccucaacccucccuuugcaagaagcugugaccaaaggugacugcauuuuggggggagcuuuguguucuuauucaucaugaucauuacaaaucccagaaaagucaaguuguuuuucuuguuuuaaaaaaaugccaugugguuuuaaaggucuuuugauaggugaguccuugacauuuugaauuuuuuuucuuacauuuauuccuucugccaaaaauacuuguuugcugaaacucuucucuagccaguagaaaauauuuugucauguguagguacacuuugaaaauaaaggaauaaaagccucuguucacagaaauuguguaccucaaauuaaaaugcucccuguuaagguuuauaugaggacauuugagcuuggagacugauggcauuuggcauuuucucauaucagcagagcccaauucuccagccauuccuccguaaagucuguguguaggcuccugagugaccuggacuugguuggcuugguugggaguguuuagguuuuaucuuuaucacauuuuuagaucuaaagaaggaaauaucauucacugugaugguucuuagaagcuguuccccaacucaagcccaagcacaauccauucuuaccagcagugguaaggcuagaaaggaggaguagauguagaagucuugaacaauuccugccccaaagcuggagaaccaugcuuugugaucaggacuaugcgcucauuucccucccuuccuauuuccccucauguguacccaugauaggcauaugagugugggcagaguggaaugaugggguuuauacuauucaguuagaauugcagucagcagaacuggucacucuguuugaacagcuugcaauaauuauuuccuugggaaggcuguuacuagaacucuuuacuauuauuuaacugaaaacaugcagcauauuuaccccagggaaaauaacuacaaauaauaguguacuaaguacuaauucaucccaaaauguugggucucauauuuguaacuuuuuauuuuguucauuauugcagcaaaauaauugcacuaauugcuguuauaucaugcaguacuaagggugcuuuauucauugguagugcauguggggguugguuguuauuacuuagcucauguugcauguuaaugaugcaugucugaaauuuguuguguccuucaaggcaugauggguggcuauccgccaggccuuccaccuuugcagggcccaguugauggccuuguuagcaugggcagcaugcagccacuucacccuggggggccuccaccccaccaucuuccgccaggugugccuggccucccgggcaucccaccaccggguaagaacuucauccucauucacucauuaaucucaucuucauauucucuuuuuccgcuuucaaccaguuguuccaggaggcacccguggcccauuguggccaggccuucccucccugagaauccaaagguugucagcagcagggcaugucuugugcauucagcagguggcccagcacuugugcccuugugcaccuggcugcuggcagcagcacagcacacauggcagaggccagacucagcaaaccaagggacaagaggcauacucuaucgauaaucacucaacuaauuugacauguccuugaaaagccagacagccuagaaggcuguguccucuuaucagugaaugaaguuucccaaauugcuaguucagaguaacauguaaaagcauuuuuugccccugaguugcauuucucccucuggugcaauucuuaucucacaggguauagaguaucuguuccaucuccuacuucuccucaagcagccuuucuaaggggauugcagagcugcuaagguagaacucuucagaaaucuuucacucagucugucuuagaacaaaaagcagggagggaaugcauuuucacugaauuaguguucuguaugugaguucccuaagaagcaugacaugccagguguaauggcucaugccuguaaucccagcacuuucagagaaugaggaagguggaucacuugagcccaggaguucaagaccagccugggcaaccuggugagaccccaucucuauaaaaauuagccagguguuaggccgggcacgauggcucaugccuguaaucccagcacuuugggaggccgaggugggcggaucacuugaggucaggaguucgagaccagccuggccaauauggugaaacaccgucuuuacuaaaaauacaaaaauuagcugggcgugguggcgggcaccuguagucccagcuacucgagaggcugaggcagaagaaucacuugaaccugggaggcagagguugcagugagccgagauugcaccacuacacuccagccugggcgacagcaagacuccgugucaaaaaaaaaaaaaaaaaaggaaaaauuagccaggugugguggcaugugccuguagucccagcuacucaggaggcugaggugggagaauuaccugagccuggggagacugaggcugcagugaguggugaucgcaccacugcacuccagccugagcgacagaaugagauccugucucaaaaaaaaaaaaaaaaaagccugacauuaaagaacagccuagccuacccuccuagcuguagauacugguuugucugucaacagaagcuuagaaguucuuuuauauagaaauauauaaauggauuccagaaauagcgacauucauuuucacuuuaaaaugugaauuagcaaguugaaagauuauuuuaaagaaaaccuaaaugaaaggaaaaucacauguucccauauuaauugccaucauaugcaaaagaacucuuagcuguaaucuggauggagggaaugugaccuuuggaagacucggaaagcauuugguccauuaccuacaacaucagcuaagggcccaacccaaaugguaaaaugugguuggaaacuuguuaaauuugcuuguaccaguguuggaccuaccagugauaggguuuugcaggguaccaaaugaugcuuuggagggugcacccagcagugugcagagugagcaaacuugguggccuggccuggagccuccagccacacucuuugugagaguugcuuagaauauggccauaauuccacagaagcauuugcuccagguauugccagaggaggaaguguuuguaggguuaggugcuucauaugaaaacaguggacugugugaauugcuguugcagcaggagucagucauaagguaaauguucccauguggcagguagacuuggccuuaauuuuuugcccucucaccuugauacaggguaucacugagccaauaagaccaggcuggaguuuacaccuucuaggugcacuuagugggauccaugucuaaugccaguacccucuagguugcagaugucuuuugguggguguugggacauagcugucuuccuuuccaccuuccugaaauccuaaauucaacuggagggaagcccaacacaccugcuuagaauugaggagacagggccggacacagugacucaauccuguaaucccagcacuuugugaggcugaggugggaggauugcuuugagcucagcaguucaagaccagugggcaacauggugaaaccccauaucuauuuuauuuaauuaaaaaagaagccaggagucagggaagacccccucuuagugccuacaaaugcacaugucugagcaggcuuagaggaguaggggauucauugagcucuuuuggugacucagcucagauucucaccggcugcccaaguauggcauuugucaauagaggaagcagaagaguuugcugauuugugcugcccugcaaagcaaugauuuacacaguuuagggagccacaccguguucuggaaucuaaggugggugagugucccagggcacagggaggugaugggcacagagguuaauaauauauugcuggggcaccagcuuacccaccacaaccucuucauucauucacgaauaaucaucaggauccuacuuuggugauccggguggacuucuggguacuuggaauauaaaacucccugcuuuuuaaacagaagcuuuuuuacuuguuauuuucuaacaaauaagaggcucucuuaugcuuccuggaaguggcauuuaacaauucugaaccuuagugcucgcuucagcagcacauacacuaaaauuggaacaauauggaguugagcauggcacaaggaugacaugcaaauucaugaaacaguucugaacuuuagaaugaggagcugcuucugccuggacaaaauauuacgauuuuuaauccgaagggacuauacacuaugaaguuauaccuccucucgauucuucuacacagccagcaggauuuguuuaaguuuucaagaacaguucaccacaguuuuagguuuauuugauuuuaaugaacugggucccuugccuauuucuguauuuuaucagaauagcaaauaugcacccugaaaucaaaagagccucugacacuaaauuuaggacaucucauuauuaucagcugugccugugagacaacaauugcucgugagcauucacugagggaagcuuacaaaauuauuaucagggacauaguacaaaucuaguagggccaugaagucucucuguuccuuugucauuuugcauauaaagcaauagcaacaagguuacuucacuucagaugauuccuuuucagagugcuacucuaucagauggaaguguucucucccugccagcacuagugacuccaguuagaaccagcugcugauggucugggaggggauagcaaggcugugccuucagccuucacaaagcucauuuaacuaugcacuuccacagccucuucccuugugucccugcuguccuagcacauugcuuacugcugagccugauuccagugccauuccugcuuaaauuaaauacaggcuucaguugcaggagaauguguugucagaagaaaaacaccuugaauguagagguauauucugacaauagcuuaccuagagaaauacuagaauuuuaugcaagguucaaaucauuucuaagccauaauugauguacaucugacagauuguucuaguauuauacuuuaaguaccuagaaacaaaacaacuuucuauucaaauccuauuggggugcuuaagauuccuagccacaaagauucaagggcagagguacauagguuugaauuaugaauggcaucauuucuuaucagacaguaguuuuucagucauuucaacccagagccucuaacugugccauugcauucugaauuauaggugugaugaaccaaggaguggccccuaugguagggacuccagcaccagguggaaguccauauggacaacaggugagccucccaguuugauuuucuaggacuugacagaauucgaguuauccuucucagaacaugugcagagucucuuuuugccucaccaugugguccugugcucuuucaggugggaguuuuggggccuccagggcagcaggcaccaccuccauaucccggcccacauccagcuggacccccugucauacagcagccaacaacacccauguuuguagcucccccaccaaagacccagcggcuucuucacucagaggccuaccugaaauacauugaaggacucagugcggaguccaacagcauuagcaagugggaucagacacuggcagguaagauuccuucuaaauaagccuuugugaaauacaugcuuccucaaagcugucuuacugcuguuagcauaguauaucauacaauaaacaccccuuuuucuuauacaauuaaaauaaauuauauauuucauaaaugguuuggaguuucuuugcauguuuacguaacacacugaaaaugguuuguuuuguuuuguuuuguuuuugagacagggucucacucuguugccuaggcuggagugcaguggcgcgaucuuggcucacugcagucuccgccuuccagguucaacugauucuucugccucagccuccccaguagcugggauuacaggcacaugccaccacaccuggcuaauguuuauauuuuuaguagagaugggguuucaccauaucagccaggcuggucucaaacucuugaccucaagugauccaccugccucggccucucaaagugcugggauuacaggcgugagccacugugccuggccugaaaaugguuuuuggguuguuuuuuuuuuuuugagacagucucacucugucgcccaggcuggagugcagugguacaaucucgacuuacugcaaccuccgacccccagguucaagcgauucuugugucuuagccuccugagcagcuggaauuacaggugcucagcaccacgcccagcuaauuuuuuuaucuuuaguagagaugggguuucgccguuuuggccaggcuggucucgaacuccugaccucaggugaucuauucaccucagccucccaaagagcugggauuauaggcaugagucacagcgcccugccuaaaaguguuguugugguuuuuuuugccaaauuucaaagccuaguuuucucauaaacaucacugccaucuuuuuaaguacauuguuuuuuguuuguuguuuuguuuuguuuuguuuuguuuuucaggcauuuggacauuaguauagaugcauuggguaaauuaaaaauuauuggccaggcacgguggcucccacuuugggaggcugaaguggacagaucgauugaguucaggaguuugagaccagccuggacaacauggcaaaaccccgucucuacaaaaaaauuaaaaauuagccagaugagggccaggagcgguggcucacgccuguaaucccagcacuuugggaggcugaagcgggcagaucacuugaggucaggagaucaagaccauccuggccaacauggugaaaucccaucucuacuaaaaauacaaaaauuagcugggcguggugucuggugucuguaaucccagcuacuugggaggcugaggcacgagaaucauuugaacccggagguggagguugcagugagccaagaucgcaccacugcacuccagccugggugacagaauaagacucugucuaaaaaaaaaaaaaaaacuauuuuaccucaguuuaacaaaaggaaaaaaauauuagaaaccgauuaggcuauucauuuaguucaacauacuuauguauuuucaguauguacuaaaguacuuguguaguuucuggagagaaguuuggaaguuucuacuuguucuugauuucuaaaccaacuuuggucaucucauuucauuucuuuagaguagaagguauauuuucccuuucuucacauguuuaccuuuuuaggaauuuuuguuaacauugaaguaauuauuaaauaucagggaugccuacaaaaaaauaaugaucaggccgggugcaguggcucacaccuguaaucccagcacuuugggaggccaagguaggcagaucaccugaggucaggaguucaagaccagccuggccaacauggugaaaccugucucuacuaaaaauagaaaaaucagccaggcuugguggcagauuccuguaaucccagcuacucuggagccugaggcaggagaaucgcuugaacccaggagguagagguugcagugagcugagaucgcgccacugcacuccagcgagggcgacagagcgagacucgaugucaaaaaaaaaaaaaaauuuaugaucaaaucuuuuagugccuaguaaaaugauauaagaaaugugccuggaaauauucugcaguuaaaauucauaauauuuaauaaauauucaauguuuuguguuuuaauaaguucgucagaccuuagaacugagggaaauuuugccaacuuaaaauucuaauuucugucucucuguacuuuaauuuucagcucgaagacgcgacguccauuugucgaaagaacaggagagccgccuacccucucacuggcugaaaagcaaaggggcccacaccaccauggcagaugcccucuggcgccuucgagauuugaugcuccgggacacccucaacauucgccaagcauacaaccuagaaaauguuuaaucacaucauuacguuucuuuuauauagaagcauaaagaguuguggaucaguagccauuuuaguuacuggggguggggggaaggaacaaaggaggauaauuuuuauugcauuuuacuguacaucacaaggccauuuuuauauacggacacuuuuaauaagcuauuucaauuuguuuguuauauuaaguugacuuuaucaaauacacaaagauuuuuuugcauauguuuccuucguuuaaaaccaguuucauaauugguuguauauguagacuuggaguuuuaucuuuuuacuuguugccauggaacugaaaccauuagagguuuuugucuuggcuugggguuuuuguuuucuugguuuuggguuuuuuuauauauauauauaaaagaacaaaaugaaaaaaaacacacacacacaagaguuuacagauuaguuuaaauugauaaugaaaugugaaguuuguccuaguuuacaucuuagagaggggaguauacuuguguuuguuucaugugccugaauaucuuaagccacuuucugcaaaagcuguuucuuacagaugaagugcuuucuuugaaaggugguuauuuagguuuuagauguuuaauagacacagcacauuugcucuauuaacucagaggcucacuacagaaauauguaaucagugcugugcaucugucugcagcuaauguaccuccuggacaccaggaggggaaaaagcacuuuuucaauugugcugaguuagacaucugugaguuagacuauggugucagugauuuuugcagaacacgugcacaacccugagguauguuuaaucuaggcagguacguuuaaggauauuuugaucuauuuauaaugaauucacaauuuaugccuauaaauuucagaugauuuaaaauuuuaaaccuguuacauugaaaaacauugaaguucgucuugaagaaagcauuaagguaugcauggaggugauuuauuuuuaaacauaacaccuaaccuaacauggguaagagaguauggaacuagauaugagcuguauaagaagcauaauugugaacaaguagauugauugccuucauauacaaguauguuuuaguauuccuuauuuccuuauuaucagauguauuuuuucuuuuaaguuucaauguuguuauaauucucaaccagaaauuuaauacuuucuaaaauauuuuuuaaauuuagcuugugcuuuugaauuacaggagaagggaaucauaauuuaauaaaacgcuuacuagaaagaccauuacagaucccaaacacuuggguuuggugacccugucuuucuuauaugacccuacaauaaacauuugaaggcagcauaggauggcagacaguaggaacauuguuucacuuggcggcauguuuuugaaaccugcuuuauaguaacugggugauugccauugugguagagcuuccacugcuguuuauaaucugagagaguuaaucucagaggaugcuuuuuuccuuuuaaucugcuaugaaucaguacccagauguuuaauuacuguacuuauuaaaucaugagggcaaaagaguguagaauggaaaaaagucucuuguaucuagauacuuuaaauaugggaggcccuuuaacuuaauugccuuuagucaaccacuggauuugaauuugcaucaaguauuuuaaauaauauugaauuuaaaaaaauguauugcaguagugugucaguaccuuauuguuaaagugagucagauaaaucuucaauuccuggcuauuugggcaauugaaucaucauggacuguauaaugcaaucagauuauuuuguuucuagacauccuugaauuacaccaaagaacaugaaauuuaguugugguuaaauuauuuauuuauuucaugcauucauuuuauuucccuuaaggucuggaugagacuucuuuggggagccucuaaaaaaauuuuucacugggggccacgugggucauuagaagccagagcucuccuccaggcuccuucccagugccuagaggugcuauaggaaacauagauccagccaggggcuucccuaaagcagugcagcaccggcccagggcaucacuagacaggcccuaauuaaguuuuuuuuaaaaagccuguguauuuauuuuagaaucauguuuuucuguauauuaacuugggggauaucguuaauauuuaggauauaagauuugaggucagccaucuucaaaaaagaaaaaaaaauugacucaagaaaguacaaguaaacuauacaccuuuuuuucauaaguuuuaggaacuguaguaauguggcuuagaaaguauaauggccuaaauguuuucaaaauguaaguuccuguggagaagaauuguuuauauugcaaacggggggacugaggggaaccuguagguuuaaaacaguauguuugucagccaacugauuuaaaaggccuuuaacuguuuugguuguuguuuuuuuuuuaagccacucuccccuuccuaugaggaagaauugagaggggcaccuauuucuguaaaauccccaaauugguguugaugauuuugagcuugaauguuuucauaccugauuaaaacuugguuuauucuaauuucuguaucauaucaucugagguuuacgugguaacuagucuuauaacauguauguaucuuuuuuuuguuguucaucuaaagcuuuuuaauccaaauaaauacagaguuugcaaagugauuuggauuaaccagguuugguuguucuguuaaaguggugucagauguuucaagcagauuuaacuccugcaagcccugauuucaugcugacaagguuguaugugacugccaauuuaagagaacaaagcuccacagauggagaugaaagucaguguccagaccucugguucagggcucgggcugcauuaacacagagccaaauguagucagacugcagacugaagugccccacgccacgccucaggcuggcagucaaggaauuccuacauguccucagcaugggcagaaaugcagguugaaauuaaaauuggagaauuacugagggcggaaagugaggaaagcauguaagcaguauagcccacuucaaauagcuugucuguggccagaagaaacagguggcccaggugucuuuaacaucuuuauaaacucuuaaaacaugaccaugcuuuuaauagaaaguguugguaaaagcaaccaacuguuuuccucuaauaucacuuugcaaaucccugugguucuguucuccugaauuuaggauaguaccggcaucugugccccugagcauauuuugaacaaucauugauguauagcuagacaucccaucugaacacugagcaaacaaauauugcuauuauucuguuccuuuuuuuuuuuucuuuugagacggaaccucacucugucacccaggcuggagugcaguggugcaaccuuggcucacugcagcaugcgccaccaugccuggcuaauuuuugaauuuuuaguagagacaggguuucuccauauuggcuaggcugguuuugaacuccuggccucaagugauccaccugccucagccucccaaagugcuaagguuacaggugugagccacugcgcccagccuacucuguuccauuuuagccuggaaguauguuaggucccugaaugaaaguucagaacuaaacaaauuaauggacugucccuuuucccuguuuuggcuauuucaugguauuuacaucuugcagauagcacauaaaugagacaagaaacuccagauuuaauacucgugugaagacuaagcacuaacaugcuuuacuaggagauaaauuacuuuggaaaacaacaggguccaagagugugugugugcguauauauauauauuuuuguuguugucguucacgccauucuccugccuuagccuccugaguagcugggacuacaggcgcccagcaccacgcccggcuaauuuuuuguguuuuuaguagagaugggguuucacuguguuagccaggauggucuugaucuccugaugucgugauccgccugccucggccucccaaagugcuaggauuacaggcgugagccaccgcgcccagcuaagaguauauuucuuuaaagagaguuaauucagugugaaaaauuuaaacacacacacaaaauggagauuaaauaucacaucagggauguagguaagacuuccaaaauagaacugcuagaugaacaaaaauaacucauuuauucacuacuuuuuuucuuucuuuuuuuggggggggcuguaauacuguuguacuauuauuagguacuuucucuauaaauucagauaauaaagugacacuccaaagcccauauucuuuccccaacaccacaguggagguagaguucuaguaauaaaugcuaaucagguuuucagcauucugcaauaaguauaguucuugaaauuuauuaaaauuuaugcccuguaguuuacaguuggugguacugcaauucuuuucacggcuuuuuuuuuuuuuuuuuuuggagacagggucucacuccauugcccagguuagagugcagugcugggaucauacuuacugcagucuugaucuggcucaggugauucucccaccucagccucccaaauagcugggacuacaggugcacaccaccaggccuggcuaauuuuuuguacuuuuuguagagacaggguuucaccacguugcccaggcuagucuugaacuccugggcucaaguaauccuccuaccucagccucccaaagugcugggauuauagacaugagccacuacuccuggcgcccuuaaauaguucagugucugauaaguaggauagagucauuccuaguaggagaguuaaaaauacuuuugaggaaaaauuaaaagcuuauauaccuuagcugggcacaguagcucaugccuguaaucccaacacuuugggaggcugaggugggagcacugcuugagcccaggauuuugagaccagccuggucaacacagcaagacccugugucuacaaaaaauuuaaaaauuagccaagcaugguagcuagcuagucccagcuaccugggaggcugaggcaggaggaucgcuugagcccaagaguucaaggcugcagugaacuauaaucaugccacugcacuccagccugggugacagugaaacucaucucaaaaaaagcuugcacccuaacaaaugaguucucacucacagcauccaaacuaaugugcucugaaaaccuaucuuccauugaauacaauaauugcuuugguagucuaccugccuaaaagucagaaguuguccaaucuuuuuuuuuuuuuuuugagacggaguuucacucuuguugcccaggcuggagugcaauggcgcgaucucggcucaccgcaaccuccgccucccagguucaagcgauucuccugcuucagccuccugaguagcugggauuauaggugccugccaccacacccggcuaauuuuuuuuuuuuuuuuuuuuuuuuugagacggagucucgcuuugucgcccaggcuggcgugcaguggcgcgaucucggcucucugcaagcucugccucccggguucacgccauucuccugccucagccucccgaguagcugggaccacaggugcccgccaccacgccuggcuaauuuuuuguauuuuuaguagagacgggguuucaucguauuagccaggauagucucgaucuccugaccucgugauuugcccaccucagccucccaaagugcugggauuacaggcguaagccaccaugcccagccauacacccagcuaauuuuauauuuuuaguagagacgggcuuuuuccguguuggucaggcuggucucgaacuccugacuucaggugauccaccugccucggccacccaaagugcugaaaguacaggugugagccacugcacccagccuucuuuuuucuuuuaauagagacggaguguauguugcccaggcuggccuugaacuccuugccucaagcaauccuccugccugagccucccaaagugcuuggauuacaggcuugagccaccaacccuggccaucauuuucaaagucuguuguccuuaaauaaauuaacauucuaauggaaagaagaaaaagaaauggagaggaaagcucuagagaaggccaacacaaaauucagucuaaugguucucugugggguggaagcagggggaugggccagggaaugaacccacagcagacacaaaaguuagccaaugguuuuauuaguguuuacuauuauucuuuguaaaagguaugacguauuuucuauauguaucaaauacuaaacuccuaaaacaagguggguuagggcaaacauggaguauggccauauaauugagaaucauacuauaguuuuuauacagcagucaagucacuaaaaaugguuuaucagguuagguuuaccaggaauccuagaugacacaacugggcaugagaauacgaugaaccaccguccucucccugauggcagaggucauuacuggccuuucacauucaagccaucucccagcugugacucugggcuugcugcacuguaguguagguagugcuuuaaggagaugggaguaguuaguuaaugguucuuuacugaauugguucuaagauaaguggacuaaaauuagaagaaaaaucuagaaaaaauuaggagacauguuuguggcagagaucauuaacuugaggauacccuauggccuuaagcaucagcuuuauucucaugcaauaguuagaaacuauucugaaacuuagucuuuaguauguagauuuuuuuuugcuugaaacgauguuagauguggcuaugcaagcauggaaagguaucugcuuuuucuaccaggcugauccaaacuuacacugggucagauugccaaaucacucaauagacugagccucugauuuagcucaagucugggaugcuuuauacuguguagguucacuuucucauggaaggagcaacuguuucuagcagcugaaucgaacagcaacaucuucauccuagaguagugugaaaccuguugcccacaguccucaugaagauccagcccuugcaguuuaggggagccaagcaagggaggagcauauuucuguucacaagaacacuagcaugagaaaugcguagucaaucaagaauuuccaccacccuagcaaaaaguuuauagucuaguagcuggcagaaauacaaccugcauaauuauccugguuuaaaugaucuggcaauagagaauguguccauaauuuaauuugaauucugcaaaaaaguaaauaagguuauaauuaguugccuaaaaacaaagauugccgaaaacaauucgggcuucacugaaaagcauccugauugauccuugaauuguuuaagaaauauuucauggacuagauucaucgagugaguguuuuaggaggaaauaauuuucccacaagugcuguccagcagugacuugggaaguacucaagcagagacagaacuauaaaaauucuuugcaaaaacaguuauuggaauauugugcagcugauaaaggacaagcugugucagaacaagagaucugaaaaguauauuuuaaaaggcacugaaaccaauaguaaaaauucauauugacuuuauugacugcugaaguucagucucauucaucuuccagccuucucugauacugucuuucugaggcuuuucuacgguagacaucaucuguaucaaacaaaaaguugcucagauguuuaagaaacauauuuaaaauuaaaacaaucugaauaauuuaaccaauagucuaggucugucaccuacuucugaaucuuggcauuaauauuuaacucaaugccaaaauaaacuuaaaacaaaacuugaguuagaugaggacuaugauaauggaguucuagacuuaaauaggguaaaagucagugucuugaaagauagaaucaugucuuagcacaucucuuaguguuuuaagaugucccucacuuccuucucccccauaauuucuauucugugcucugaagucauccuucuuaacuaaaaccuggcuccucaaaggcacuucuugccucuuggcucucugaugcucccucucccauauccagaaaccuucagguggggagaggagaucaguuuccuuguuccagcugcugcuuugccagaccuuugacucgccaccuucauguaaagaaucuucuuuccaggccgggcacaguggcucacgccuguaaucccagcacuuugggaggccgaggcaggcggaucacaaggucaggaguuugagaccagccuggccaguauggugaaaccccgucacuacuaaaaauacaaaaauuaaccgggugugguggcaggcaccuguagucccagcuacucaggaggcuuaggcaggagagucgcuugaacccaggaggcagaggcugcagugagccaagaucgugccaccacacuccagccugggugacagaccaagacucugucucaaaaaaaaaaaaaaaaaaucuucuuccuucauggcucaugccauuugucugccaccaucuuucuuuggcaccugcucuccaucaugccccuucagucaccaaaagugcuggccucuggcucagguuccuugacccuguccugugccuucuccccagauaccaccauuacccauggggaugaagcuccaguacccuucaccuucaacaucuuccagucacuugcagggcuccucugaaggauuucuguucauaccacaacccccguuaccuuuccagcccuccuguccuuggaccucacguuucuuccccagguccuuggccccgucuuacccgcucagccgcuucuuguucucucuccuggcaaaucagcuaaaauuccuucauacucuugucaauaucuuaacuuccugacacacccucaaaaccccaaccacagauuaauccaacuuccucccuuccccaugcuucacccugcuugcuguguccugaggggccaacugaugccucuaacuggguccacugaggugucugacaauccuguuuccucagccaucauccugacucuuuuucacccacccccaaauggccauuuccucucuuccuucacagaggaaagucaucauaaggaacucuuccagcuaacuuccaagggcuuacuccugucacccagcucuggucccacccucucaaggguccaguaucuccagccucucuccacccucuccuucuagaucauuauuugcauauccugcagucucuccuagaggaagggggguuaccuccccuucacagagccagauguauuuaaccuccugucuucugugauaacaaauccuccugguuucccuccuugccuuucuggccauucucaguuacccuuaaaauguugggauuugggccaggcgcaguggcucacgccuguaaucccagcacuuugggaggccaaggugggcagaucaccugaggucaggaguucuagaccagccugaccaacauggagacaccccaugucuacuaaaaauacaaaauuagccgggcgugguggugcaugccuguaaucccagcuacuccagaggcugaggcaggagaaucacuugaacuugggaggcagagguugcggugagccaagaucgcaccacugcacuccagccugggcaacaagagcgaaacucagucucaaaaaauaaauaaauuaaauuaaaauguugggauuugacuuccaucauaauuugcuucugaaugguucacaaaucccaauuucuggcccagauuugccuccugagcuucagcucuguauaaccauaucuaccucgucacgucccagauggugcccaggauggcccugccuguguucggcaccuucaggaaaugcacuacccccugccccaggugucccaccagaagccuccacuccucaucuccugaguccacuuaaucaccaugcccugucaguacuaccucugggcugucuuuuacuuccaucccuucuugguauccuuucugccccaaccuagaccaggccacugucucaacucuggacagccauacagcguaacuguuccuaccaaucuguccacaaggagccauucuccacauguuaaagccucucccuaaaaugacucaauccuugggauccauucuugguucuccagucccuuugccacccugcccaggcacccuucuagccauccccacuuuguugaucugcuucaaucccucaaacacacagcauacucucacacaagugcuccuaccacugccauggagaugcuuucaauuccacacaccuuccccucaucugacugacaccuacucagucuucagguccuacuuuacuugguagcugcuuccggaagccuucccugcaccaucuaguccaguugaggcgcccacccgagaguccuauguuccucccacuuccuucucacagcacugaucacuuuguaugcuaauugucuuuaucaucuucuuucccauuagagcucuucugggguaagggacaccucugccuuguucauuauagccccucaagaaugcucauuaaguaucaaugaauggaugaacagaaggacuaaggaucuuuaggaaucacuaauguaacaauucuuuaaaauguggguuggcaagucacaagugauagcguuucaggagaggggcaaagcagaaagggccgagggguuggggaaguccuccugaaaggaacuggccuguccagaguuaaugcucaguaaugcagugccaggcguuaccacuaucuuuacagugcugaucaucuggacccagaccaaagaccuggugccaaugacuguccuguaaagguagugguaauuagcaaagccaggcagaucagcucccuccagaguuuggacagaagaauccaaagagaaauggcuaguuagcaggaguuucccugaccccucauauccacccccuucuacgauuguugugagcaagucuguuccuuaagcccaaacgaugucaccggcaggggugaagggcaggcaugagagggcuggaagaagcacgugaucucgccuguaagugcagggaaggucacaaggcuggacgccaaugugcccggccuacaggagagccaggccgcccugacugccaagcgaauggaacugcacucgcccagcgcucugaguggaaugcgcggucugcaaucugagaauacuccccagaaaaacggaucccuaccgccucgugccuuccugaaaggaaacagagacugcuacccccucacuuacagaaggucuccuggcccacgcgcacuuuaaucaugauccacuccaucguuccucccaggacaaaaaagaagggcaggaaccgguagaugccaaaucgcugcuucccgggcacccgcugcagaauccgucucaccugggcccuggugaacaugcucgaccgaggucguggagagggauaugacggaacuaagcacuggaucgcccggacgcagccgagaccgccccgcccguucucgccguguaccgcgaccugggagacuagcgagcgccguccuccgccacugucugguaggcgcacgagugc

SEQ ID NO: 17495 - RNA, 47228 nt, Homo sapiens
cagagcuuccccaggucagugaugguucuucccagggaccccaugccccauaggcccuacagacaccuaugaucucuuagaggucacuucccccacccugaauacugacuggguggcggggggcacagaaagccacagaagagggccaaaggggaaaugggacugagggccugaaucuggggugagugacgggaccuccccaugcucccugccccagaacagucgccaccucaccccaccccagaacccuacacucagaaccugaggcccugggcacuaaagagauuuuaauuuugagcuggaguuugaguucccaggauucuaacagcuccugcagguugggccucccacauggaccggccugggcccucugaugguggucagggaacuugcggggcacucagagagggaaggaccuggcccaggccacagagcaggcugagaauggguccagcucagcucugccccuuccugggacccuccuuugcuucugggcguuguugggaguauggggaccccacccuccuccccuaccucaauccugaaauggaaacagguuggcuucuugggucagcaugacaggucucagagaccuacaacucugccucccuguccccagcucccuucacucacacaugccuucuucagcagggggcuggccuggaggugggcaaggggcugcccacagaggccagugauggagcucagcccagcccugccucuggcccugcuggagagccuuggccaaggcccuuccaucucugggucugccucuuccucccagggccagggaccagccacccuggguguaagcagccuucauaaccugaugagugggcuugcgcaggggcugcugucagggugaccauauccugggaccuuggaguggacugcuucugucucuguuucccuggggagguguggccagcacacugcccaagcuggggccaacuucuaacuggagacugagcuaggcagcccuucagccagcaugugaccaccagcggcgggcaggaggcccaacacuccucagccugccagcccauccuggggucucagcucagccagacacccagcaggggcugcagggaagccugggucgacuggggaagggugugggggcagccuacuccacacugcggaaagagccuguggcaggcugggaguccgaacucuacuguuaauguguguggccucagucagguccucuccuucucugggcuucaguuuuccaggccugggggcagaggguagggaucgucucuaaaggccccccugcuugccagcugcaggugggaaagaccacaagggugcuccgaauucgaggaucaaugggcccagacacgggcaucgugugucaucuaguggacaaagaaggaacugcaggaggcccccaaacucgcugugucaggcccuguguugggguagcagggccacccagcagaaacagcagccucuugaggacgcuagcaguaaccaggcaaacacaauauaaagaagcaggagcaguggaagaugcuccagugauugcucuugauggaggaaaucaagggaggcuucauggaggaagcacuauccaagcaaaagcccagaaauggaaaggaugcagcaaaacaggcaaaacuaggugaugcaugaaggauacaaaaugccauguacuggugggagauggugagcugggcugauaccuaugugaagugcguguucaugcagcaggugccaccagguggauauguggagggucacagcccagccucucccagccagaauucuggggugggcaugccuggaaggaauggaugcccccaguccccuccccaccaauuucauggauggaacagggauauuaggacaaugccaugcccccuccacccccacggaccuccagcugcuugcagagggugagcccccccacuucccaucagccaucccucacagcuccucccgccccaccccaacccuccuacaguaucuucuggggcuuccaucugcaagcagggccauucaucuccuccuccugucccaggaccugucccccuccccaccacagcugaugaaaagagagccaggacguggcagagcccuccuucccccacugccccuuccugacaauccucacucccuucaacccgagcacacguggcccuugucugagcuucccuggaccccauaucgcuucucagcuugggucccuuucucuguucccuggguguugcccacacccaccaucuccccuguacuucagcucacuccugucaggcucccaccccucugcuccacggaaacccuccugcucaggcggcugaggccugggggccugcaaguucccaaacccuggggccaccagacaaacccaaagugagugagauucuacagaauaacuggccucagcucuucagaggugaugaggaaacacugaggaccgucacaggcugguggggaguaaggagacaggaggacgaggucacguuagugccaucuuggauugguuccugcuccaggacaaggacuuuaggacaacugacagaacuucaauaagcugugcagauuaauuagcaguguuuaugucaauauucauuuccuguguuugauccuucugugguuaaaauguuaacauuuagggaagcuaggguaccuguaaaugggaguucuuuguacuauuuuugcaagccuggaauuucaaaaugaaaagaaaaaaagcaaaaaaccccacuaaaaccuaguguugggaaguaagcuccacuucccaauaccccacggcugaaccugugucuccucccagcuuccauaucucaggaaauggcaguuuggccaaaaagcuaagggucauuuuggauuuucuuauuucucacccuucacauucaagccuucagcaaacucuguccauucuaguuccaaaaugugccuugaauccauguaccccugcccacucuccccagcaccccacuguacuggaagccaccgggcuuucuugcccaaagccugccgccacuucaggccagcuccuagcuccgucucucccaccccuuuugcccucugcagccaucaccccuuacauugacuggguccucauggggccuggcacugcccaugucucccaagacugcuggggcuugguuuccagcccaacacugccuuucugcuccugagaccuucccagucuuucuccauggccucccauggcugguucccugugguucccccagaucucaugcagagucagcuccucuagggagcuuucccagaccacuguaacucaugggcccaccaugccuccaguccccacuccagcccacgcuggcuuucccacuguacucaucuccuuaaaauuccaccagauuaggccgggcacgguggcucacaccuguaaucccagcacuucgggaggccaaggugggcgaaucacuugagcucaggaggucaagucuagccugggaaacauggugaaaccuugucucuacuaaaaauacaaauauuagccgggugugguggcaggugccuguaaucccagcuacuuggguggcugaggcacgaggaucgcuugaaccugggaggcagggguuacagugagccgagauugugccacugcgcuccagucuggugacacagcgagacucugucucaaaaaaagaaaaaggccgggcgcgguggcucacgccuguaauccuagcacuuuggaaggccgaggcagguggaucacgaggucaggagauugagaccauccuggcuaacacggugaaaccccaucucuaguaaaaauacaaaaaauuagcugggugugguggcgggcgccuguagucccagcuacucaggaggcugaggcaggagaauggcgugaaucugggaggcagagcuugcagugagcugagaucgcaccacugcacuccagccugggugacagagugagacuccgucucaaaaaaaaagaaaaaaaaaauccaccagauuagggacugggccucacugugacaugccccaggauccagcccugugcugugcgcguggugggugugugagugaaccacuggguggugcaccggcugcuggugcugcccgauguggcgcuuccuuuuauccucggaugucacccuuccugggucacucugggugucuguagagguccccaauucuccagcucacaagggcaggccugaagggacuccucucugcuccccucaggucucuccagggaccagaaagcucuugcuagcgcuggccuccaucagaggcauuuuuagaauuccaagaccaucucuggaaugccaggccugucuggggaaugccaaggcuggggcacaggugcagagagaguggaguggcugggcggggcaaggucagcugacggcauucuggcuacagccugggugcugcuggcagcugucccuccugcgaacaccucugcugacacuuccacuuccuugcagcccccaacgcccacgccuccaagacagcaucacugucuggcggcagcucuggacugggugcucccacuaagcugagagcugccaggccuugggccuccaucccugccagggagagagacugggccacaagagaugagccucugagguucacgggaacuggaaaucauguccauuuggauguggcccauccgacagggcccuuggcuggaagccaguuggcucugcucucccccacacucacuggaugaccuugacaggucccugcaccucucugggccaaacaggugaggggagauagagccgacuccaugccccucugucccugggagucaauguugcuggcaggaaauacaagcaagugggcggguggacuagcacugugagccugcagggaccccacaggcucagcuccauuccagccacggcugagagguaacagggguugcugugccagggagcauccaagggccuggcuguguaccacagugaaccacucucuccaaguagaggaccccuaggcugccacagugguugaccaaagugauggcccccaggaacuuguggggguucuaggcccccacagacuccagaugcugaaucccuagagauggugccugggccugaggagugauagagggcagcaagcagggcaggccacacggcagucuccgaucucaucucaccccccugcagaaggcaguguggagcgguggucaggcgccaggcucugcagccagccugccuaggacagggaaggaagcggccauuggguaagaguggguccuggggaugaguccacggcccagggacaccagagccagauagcagaccuugggagagcaggcuuuauuugcaucccccaggacagaucuggggagggagucgggggauuugggguugaggacauggccaggcucagguccugggaccccgacccccuccccaaccccaggacucagcuggaguuggaggcugggcauaggcagcucugggugaaggucagcaucuacuccacacccuucaugaacuccaggaacucuguggaaagaggggcagguguggguugaggguaggggcugggcagggcauggaggcaggagaucagcccacccacccgcuuaccaucauagucgaugcggccgucguuguucuugucuccguccuucaugagcuccucgaugucguccuccgugauggucucgccuguagccugcagcauuaucuucagcucauccaggucgauguagccaucagcauuucuguggggagggggcucaggguagggcuguggggagggcaugaggcagccccacccaugccccaggaggcagagcagggacacugggagauggggcaucccucuccccuaucaggcagaggccacagggucccuaggccuggaaucugagacugcccuccuguacagcucggcuugagugugggucagggucagaggucaagggucacgugcucacuugucaaacaugcggaagaggucagacagcuccuccucagauuucccuuugcugucguccuucaugcaccgaaccaucaugaccaggaacucaucaaaguccaccgugccgcugccugggggugggcagcauggccguuacagaggccaggguagguacugcaggcagcaccuucgacacgaacccccauguucucaccgcauccucacaccaaacgccaggcuuguguagcccuuaugcccauuuuauagaugaggcaaccaaggcucggauaggcuaaauugcucccagcuaaacagagccagcauuccagcccccagccagcugggguucuucuggagccuggggaggagggggcucaccguccucguccaccucaucgaucaucuccugcagcuccucaggggugggguucuggcccagcauccucaucaccuugcccagcuccuuggugcugaugcagccauccucagcgcccagcacgaagaugucgaaggcugccuugaacucuguguucagggguuggggggcacaguagucagggcucagcagccaggaccacggagggccagaacccuggggccaccugccaaccugcccaccucccucggagaccucucugagggcagagcaagagggaccaagccucuggucucuggccugggguccucuucugauaagggguccccaugccagccuggacccgcuggucucccacaugugugauagggauucucaccauuuuucugcucuucugucagcugcucuaccuagaaaggaaagggaaucucaaggcucagacucagguauagcugcugcugaggaaaccaacccauuccacaggugagaaggcuggagcuggaggaggcaggcuauuuccaggccacagaguggaggucucaguccucccucccugcccccaaagcccugacgugacccagcuggccucacugcgacugggcucagggccagggugacaggugggcacccccuucaggaccaaggugacccucaguaacaauagucagugaccacucaaugcccuuucggccccugaugaaacucaagcuggguggcccgaaggacagcugucccucaaguugggauaauaaaaccaguguggaggcaggcaagccacccacgguaaccugaccaggguggccacugggcuauuuuuaacgaggaacaaaguuaaaccuggugauuguucuggggacuuuggcaugcaggggguggggcagcguuaucuggcccccuggccugcuagugccgccucagaagccaaaauuaguccccaacuccgccaggccuuguaugggcacuggguggagggcugucccaaccccggcuccauggacucccacaggauaagcaggcgugcccccagagcuggcuauagcacuucccugcccaggagugagggaggcugagggagggguuccccuggggacagcuggccaugccaggauguccuugcucugggguugggggaggucaccaccacccaggauagaauagcaucugaagacccucagugacccaggagguugcaggggcuuggggugaccacucuccagcccucauucccucgcucucaccccuagcuaagccacugagcccugagccugccaggcaugaugggagcuggggccccaguucucuguuccuucuuccuugguucucccucauguccagaacuucccugccucaaacuucaaagccccaucuccagcccaggacucaggcucuacagaccccuccucucacacccuccacccuccaaagcaucuucggcccgccaaggggcuggagugggguggcagauuuugagcaugugagaagcagaaugugaggggcagaaauggggguuggggacagggagacaguaauggggacucagacagcucaggaggaagagaugaaaagagaaaggcaaaaacguccagagacaaaugcagagacauguggcugagcgacagugccacagaccacagacacuuggaaacagagagugagacacgaugcugaaagcugcaaccuccuccaccacccuucagacccggaacccccuaccccuucugcauccucaaacaccagaaucacugucccugugagggccuggguugaaggcacguaggccuucuccuugguccccaccacuucccuggggcuacuaaccccgcacucucagcugagugagcccccagugggccugcccaccccagcccuacccagcccugucccucaccgcagccuuguagaugucauccaugcuggcggcucacaggacagcuugcugggguugccagccggcccuugacuuaaauagcccugccccgcugcauuccuggcccagcccagcccagcccagcccaccccugcguguaguauccuccagccccuccucuggucccagugaucucaggcuggccugaguccccacguccucugcccagggcagggagcagacgaacggcuacaaggaccagguuucuuucccuccugucccccacacuccccaaagggacucucugaaaagguuucuggaaugaaugaaaacauaagcccagugcaggacaggagcuacaaagucgugggccccaggcaaggugcaacacaacagcucaggcucccauccaaccagguuggcggguugccaugaccuccacuuuccagauaaggaaacugaggcucuggaggaguggugacuugcccaagaucugacugacuugguaacccccgccuuuaacuaaaccucucuggaaugggggugcaaugugcaaggagaggcuaggagugcagggcccugccaagagaagccucgaaugccaagcucauaguaagaugcuguggaacuggugaaggaggaagugacugacccaccuuaggacaggguggccaggagcccuucugccagaggagccugucccagaccucccaucugcccagggagaaguacccacuucgggcuuaagucagcugcucucaguuauucaacagcaccccuauagaugccccaucuguggcaggcucuuucccuccucacccuccaauuagguuaccaccucccucuucuaggucucaucuuuccccgguuuaggauucagcacuguaguuccuggguccagaucaaccugucucccucguuuugaacuuuggcaggccaccccgugggguucuugugcucaguggcagcacacaccccuccauccaccuacaccuuccuucguacagaguucguaucaaguuuaucccucuugauaaacacgcucccugccucgagcacuacugcgugcugggccgcgcaucaaucaacccacucaguuguccagaagccccacugacaagagaucuccgaaucucagagagguucagaacuggcccagaaucacucucgcccugcuccggcgguaagcacagguccuauuuuccccuccaaccugccuugcccuaaagagaaagagcccaacagccaggugaggcacuauuauggccuccuuuaucaggaggaguaaacugaggccaggaagagcagugacuugcuucguguggccugggagacucgggaccuucuguccccucuucccgaggacccaggggcgaugcccagagcugucaccacccggggucucaguuucuagcaggcugugcaggguaccgccggcggcgccacgcagguagauuacgcaagcgagcaccucgcacgcgcgcccugaguggccccugucagucacgcgcgggggcggggcgagggcgcaggaagaaggcggggccaagauggcggcgcagcgcgcggcgggggcgacgggcggcgggggccggggggcggugggacguugaccccgcccccugcugcugcuagucugcgccgggcggcgguggcggcggagacccgaacauggcgaccgcgcgcaccuucgggcccgagcgggaagccgagccggccaaggaagcgcgcgucgugggcucggagcuuguggacacuuauacgguguguugggggcgcgggcacccgaagcgggggugguggcuggaaccgggaguccgacucgggggcuuggggagggguccgggaucugcagccccgaggagcggguagaagggucugcgauugcgaggagggggcugggacgggggaucuaggaaagggaucugggccccgcagguccgggagaaggguugcucggggcccggggaggcgguuuggaaaaggguacgcgaucagaaagggaggcucggguugggggcggcaucuggggauaaagggggcuuggggaggggggugucuagaugaggcggaaccccucuagauccucuaggacuggaggggccccggccuggaagaccguuacagggguccaggaggaaggcgauggggagagggucucugauggauggaaucagggaaaagggucaggcuucgcaggccuugaagaaagagaaggcgucaggacccugaucuggggagccugagguggugguugagauuuucucugagaagugcaggagagaccuggggagcagaugccuugggggucgggcggagacaagaccggaggagggguggagcccaucuauggagaaauggggguggucucagugcuaaagcgcaggcccuauaagccuuaggaaucuucgugacuuugggcugugggagcgagauggggcaacaagcugcccacacacacuucuaagcuaugggggagacagaggacaaauagcggguaguucccgacuuugacgggguuggaugccaggccugugagccuggugggcugccuggcaaaaaccggcccuggacuaggcauagagcaccucccugccuccuccccuuuguucccgcaggguagggagugggugggggccuugggccugccugcaccuccccucccuggcccucauccuaaccuuccgcucugagggccauucuucuggcucuuuucuccuuuccugaaggcaaggggaaggaaucaggcaggaugggaagaggagagggguggaucuugaagcaacaggccagccuggagaaauggcugcuccucagggcuggaggaggcuucagcuccaugcugcagagaggagggggaaacuaggugcaggaggcgggugaggucucuaagcugauggcugacuggccaucagcuaugggcacauucagccagagggccaucuucaaaaagcucacccuauucuggacugcgccccuccucugcauguaugucgggggagguggugaucuaguuuggacccuaccauccucugucuccgggugugccgaguuggacauuauuaacacaccuaccuuuugaacacuugccaugggucaggcccauguacaaagcauuuuacaugcauugccuuacuugguccuugauucuaagauggaggaacuaaggcucagagagaacuuaggcuccaaguuacuuauauaagugacacauaagcugcagccaggaaauggcagaaccagguuuuuaacccaggccuuccuuaaccucuaggccauauugccuccugauagagcuuaguugcuaccacucccuccccacaucagcugcuugugccuugauuccuggcucagcagcagaaaucacagccaugaaccaguugaaaggguuggaaaaugacuugcuuccaggagguagucagggcaccuggaaagaaguacaacagagaagaugcucaggcuagaacuggcccugcucugccucccuuggaagaaauggccuugccugcagcuccgguuggguuuugaguuaccuagaggcaggagguaaaaaacuaaagaggugacuugugguaaucaccuuuuucauuccuuacugauggauggagccacaugcuugucucaugugccucccagcccuagugcuugggccauggaggaagcugagaggggcccugcuggucagcaagggucaggugcagaggcuggugggcaagggcagccugacuuuggccuuggggugggucugaguugcagagagaaagacugauaaaagauaauugggaaagauaauugcagcuuuugcugcugggggaggagacuccuuguugcugggcucccuugccacaagggcuguugguuuccccuuuuagguuuacaucauccaggucacugauggcagccaugaguggacaguaaagcaccgcuacagcgacuuccaugaccugcaugaaaagguaacuguuaagagcugggagcacguaucucagggcugggggacccguaggccaacuuuccauugugccacauauuaguuuuagggcaaaacagguuccaucucuauaguucuuuaauaaaccacuuuguuaauauaacugcguucauuaauauagcauguaaaugcuagccuucagcucuagcaugagccacucugcaaggagcauauuugaauuucaguuuuaauauuuccaguccuagcuuggguaugagaugcucagacaguuuccugggaaggggacagguuugaacuuguuugaucuagcgauagcuauuccaaagccuuacuuuaauaucuggcugugauuccaucucuuuuuuuugcuuuuggagaugcugucuuucucugggucauuugcagcauaacuguuuuaaagacacaccgcugcccugauugguuuuuacucuggcuuggaaaagauggcaauuuuaggggcaaaagguguuacuuuucugaaugucucuaaagucuccagauggaauuccuugucuagaauuguauugguauuucuaaugcuaauuggauuuaaagaggccaaaucccaggugcacuaguuuggucacugauuuugguacuacugcagggaggggcugugcaagugcugacaagcgccugcccucaagcuucuugccuuggucuuacauaggcacagagccucuuagucugugguugaugugcuuauguuuuuuuacagcucguugcagagagaaagauugauaaaaaucugcuuccgcccaaaaagauaauugggaaaaacucaagaagcuugguggagaagagggagaaggaucuggaggucuaccuccagaagcuccuggcugccuucccuggcgugacccccagaguacuggcccacuucuugcauuuucacuucuauguaaguuccucaucggguuuucaccugugccugcaaacccacaacugccaaacuugaggcagcaaaccaggggagaccucagcuuugaggugggcugggguuugacccuagguuagaagauggaggaacgucacccugguuaggaaugcauuguggccagaagcauguuaguugacagauuugccguaaauuagacuaaauguggccacagagaugcuuuccuccaccacaaggcauuuuguuuagcaaaaauggccuguggguguuuaagcuagguuuccauccagauggaugaggcuggauuagaaauagcugacaccugggauagacuauuguugaguuguuggugcauagcccaaaacuaauuaagggauuagucugugaugguggaauaucaccaucuuggggcgugucaucaggguccgcgcugccagggugcuaagguugaggguggacaccuuccugugaugggagagugugucauagaacagcucuguacuccguccuugaaagaggaacaacuuucauagguugccggugacagaaugcguugucagacuuuaagaagggcacuuaggcagugugaaaccacaauauuugugcuuuugagacggagucuugcucugucaccuaggcuggagugcaguggugcgaucucggcucacuacaaccuccgccucuuggguucaagcaauucuccugccucagccucccgaguagcugggacuacagacuugcaccaccacacccagcuaauuuuuguauuuuuaguagagaugggguuucaccauguuggccagacuggucuggaacuccugaccucaagugaucugccugccucagccucccaaagugcugggauuacaggcgugugccaccgcaccuggccaaaaccacaauauuaaauagcaguucuauuuaugagaauuucuucuaaggaaaaaucaggcagccgcaaaaaggauauaugaacaaagguagucauuccaggauuguaacaaaauaguaaggacaacccuaaagucuaguagaagagguuaaaaaaaaaaaaucaggccaggugcaguggcucaugccuguaaucccagcacuuugagaggcugaggugggcagaucacuugaggucaggaguucaagaccauccuggcuaacauggugaaacccugucucuacuaagaauacaaaaauuagcuggguaugguggcagaugccuguaaucccagcuauuugggaggcugaggcaggagaaucgcuugaacccaagaagcagagguugcaguaagucgagaucaugucacugcacuccagccugggcaacagagugagaguaagacuucaucucaaaaaaaaaaaaaaaaaaaaaaaaaaucaaaggguacagccaggcugagcacaguggcucaugccugugaucccagcucuuugggaaaauaaaacaaaaaagaaaucugcagcuccaccaucauuaucccagcagcacaccagucuucccagcagacacugucucaaaaaaaaugcaacuuucuuaagcaguauccaacuguauggcuguacuauuuuuuuuuuuuuuuuuuugagacagggucucacuccauugcucaggcuggaggacaguggccugaucaugggucacugcaaccucaaacuccugggcucaagggaucuuccugccucaacuucccaaguagcuggaacuacaggugcaugccaccacacccagcuaauuuuaaaaauuuuuuuguagagauggggucuugcaguauugcucagguuggccucaaacucgaacucaagccauccucccaccucugccucucaaagugcuuagacuguaggugugagccacugcaccuggcugacuauggucucauuuuuacaaaaaacaaguugauauggacauauuugucuaggaaaauucuagaagguuuacguauaccaaaaugcuaagaguaguuuucucugagugauagauuuucagauaauuuauauuuacuuguuuuccuuuuauaugaugaagacagggaagaauccacucccuuuucaggcucaccuugaaguaaccuguggauuaugguccuaaaagcccagcuguauuuaaaauacaacuuucuuggccaggugcaguggcucacgccuguaaucccagcacuuugggaaggcccagacaggcagaucacuugaggccaggaguucgagaccagccuggccaacauagcgaaacccugucgcuacuaaaaauacaaaaauuagcugcgcguggugacucaugccuguagucccagcuacucaggagagaggcaugagagucgcuugaaccugggaaggggagguugcagugagccgagguuaugccacugcacuucagcaugggccacagagacucugucucaaagaaaaaaacaaaaacagaagaaacaacuuccuuaaacucuuuucagaguaagacaguugaaccuuucuuggaucacuaaagagccuagaaauuugguggcgagugcuaaccuggggccacugagcuuggcagggacagguggaaaaguagauagcauucacagaugggaccuguguauaugcuuuggauuuuauuuagcauauaccagcaaguauaggguuagcaacauacccuuucguaaacauauuuuuauacuuucuuaugugagaaaaaauuugcauuccuuaugcaagucuuucagauaaacuuuacugguuaguauuuuaagaaauaauguacuuuaaaggccgggcgcaguggcucacgccuguaaucccagcacuuugggaggccgaggcggguggaucacgaggucaggagaucgagaccauccuggcuaacacggugaaaccccgucucuacuaaaaauacaaaaaauuagccaggcaugguggugggcuccuguaguccuagcuacucgggaggcugaggcaggagaauggcgugaacccgggaggcagagcuugcagugagccaagaucgugucacugcacucuagccugggcgacagagcaagacuccgucacaaaaaaaaaaaaaaaagaaauauuguauuuuaagaaagcuuugguuagccauuuagggaugaaaccugacaugcaguccuuugacgguauuaauuccuugcuugagaccuaugccuuugaggagaggaggucucgcuggcugccucacgugugccuggcucugaggguggaaaggccuggacugcucuuuugaaacugguuugccugagaugugccuggggccggcuacaucugguucugguuugaggcaggcuccgcuacuuguagaaguuuugacauauuuggaauuaguauuaucaaacaggucccuagguuauauaaauccuaggauuuaaaaaagcaauugaacccaucguuggauuaaacccacaguugaucagccauagcacuguugacauuuuggacuggauaauuuguuucuguaaggagcugucccaugcauuguuuagcagcacccuggcuucuacccacuggaugccaguagcacuuccccacccagcuauggcaacuaaagaugucuccagacauugccaaaugucccacuggggggcaaaauugccccccacuugaaaaccacuggauuagaucuucauuuggggccuaaagauuugucagccuuuucuccaggcugggagcucucuggggaauguuucucuuaacuuuuauacugucuguauccucucugaaauuguuccacauguguucugccucuuguguugcugacauuggauaggguggacccagggaacccuauuuggcuauggugugaauuuuuuuauuuuuauuuuuugagacggaguuucguucuuacuggccaggcuggagugcagugguacgaucucggcucacugcaaccuccaccucccagguucaagugauucuccugccucagccucccgaguagcugggauuacagauggcccgccaccacacccagcuaauuuuuuguauuuuuaguagagacgggguuucacuauguuggugaggcuggucucaaacgcuugaccucgugauccaccugccucagccucccaaagugcugggauuacaggcaugagccaccacgccuggccaugguguggauuuuuaaaaauugagauauaauuuacauaccauaaaauuaacuuuuuaauguguacaauucaguaguuuuuaguauauucacaaaguugagcgaccaucaccacuaucuaauuccagaacauuucaucagcccaaaaaggaaccuguaccuguuagcaggagcuucccaucccucugucccccagccccuggcagucacuaaucuacuuucuguccuuauggauuugccuguucuggacauuucauauaaauagaaucauacaguguguggccuuuugugacuggcuucuuucauuuagccuuaucuuuucaagguccguucauauuguagcaugaauccauugguccuuuuaugacggaguaauaguguauuauuuggauaugccacauuauguuuauuuauuagcaguugauggauguuagguuuguuuccauuuuuggccauugcaaaugaugcugcuaugagcauuuguauguuaauuuuugugugaacuuauguuuucauuuuuguuggauauauagccaaaaguggaaccugaguuauaugguaacuauguuugacuuuuugagaaacuaacaaauuguucuccacaguuguugcaccauuugacguuuccaucggcaguguauagguucuaauuuccccacauucuugcuuaacacuucuuguccauuuuuuuuuaaaucuuaguuguucuggugggugugaagugguaucucauugugguuuuaauuuacauuucccuaaugacuaauguuauugaaccucuuuuuuuuuuuuuuuuuuuuuuuuucugagacagagucucgcucugucgcacaggcuggggugcaggcaugugaucccggcucacugcaaccucugucuccuggguucaagcgauucucgugccucagccucccgaguagcugggacuacaggcgugcaccaccacgccuggcuaauuuuuguauuuuuuucauuagagacgggguuucaccaugucggccaggauggucucgaacuucuggccucaagugauucgcccaccuuggccucccaaagugcugagauuacaggugugagccaccacaccuggccugagccucuuuucauaugauauuuggccauuuguguauuuucuuuggagaaaaguauccaauucuuugucuuuuuaaaaaucagauugggccgggcgcggguggcucaugccuguaaucccagcacuuuggaaggcugaggugggcggaucacuugaggccuggaguucgagaccagccuggccaacauggagaaacccugucucuacuaaaaauacagaaauuagccgggcaugguggugugugccuguaaucucagcuccucgggaggcugacgcacaagaauggcuuaaaucugagaggcgaagauugcaaugagugagaccacaccacugcacuccagccugggugacagaguaagacugucuaaaaaaacaaaaaaaacaaaaaaaacagauuaucuuuguuguugaguuguaagaguucuuuauauauucuggcuacuagacuuuuagaaacaugcaaauacuuuuucacauucugugaguugucuuuuuuuuuuuuuuuuuuuuuuuuugagacagauucuugcucuguugcccaagcuggaguauaguggcgugaucucgacucacugcaaccuccaccccugggguucaagcgauucucgugccucggccucccaaguagcugggacuacaggcguacgcaaccacgucuggcugauuuuuguauuuuuaguagagaugggguuuuaccauguuggccaggcuggucuugaacuccugaccuuaggugauacaccugucucagccucccaaagugccggcauuacagccugagccaccacauccggccugcccagcuaauuuuucuauuuuuaguagagacaggguuuuacuauguuggccaggcuggucucgaacuccugaccuuaggugauccaccugccucagccucccaaauugaugggauaacaggcguaagccaccaugcccggccaucuuuucauuuucuugauggucuucauugaagcacaaaagauuuagauuuugauuaaguucaauuuaucaauuucuuuggucacuuguguuuugguaucauacaugagaaaccauugcccaauccaaggucacaaagauuuauaacaauauauuccuguauggauuuuguuuguuuuuugagacagggucuugcucuauugccuaggcuggagugcaguggcaccaucucggcucacugcagccucaaccucccaggcucaagcacuccucccaccucaaccccccaaguagcugggacuacaggcauaugccaccguacuuggcuaauuuuuguacuuuuuguggagaugggguuucuccauguugcccaggcuggucucgaacuccugggcucaagugauccacccaccucggccucccaaagcgcucgguuuacaggcgugagccaccacacccagccugcaguguggauuuuaauaacaaggaaagaaagcacuacuuguuuaccagcccacuuuaggugggagcgcagggguugccgccuguaugagugaggggcacacuguggcacuggccuguugcuaugcugcucuucagauugcuguguccugacccuccuggacgcguggugacaggccucaucccagaaccccuggaacagagguuuccaaacucagugaaauggaaucccauccggaauucuagcacaccaugugggccgggaccuccaacugugguggacuuggaggcaggcagaggcgaguuuaucucccaccccuacuucccaacgguuuaguccaagucagucauuuaaccugccugugagcuggaggcuggugagcugggguccuugugaggccugcaagagacugugcagugaaggucaauggcuuagaagaguguugggccugagguuagggcugaccaugugcuagccauuacuaggugguucgggaaagaaaaggaauucauuucucuugaaagguguuuauauuguugucuucuuuuaaaguuaguuggcuagaacaaagauccuuuucaaaauuuggaaucaggggcuauguugaacuguuacaaucuuagcauuggcuuuagcauccaauuuauuuccauaauuuguuuuaguugcaaaguacugaggcugugaauuacaacagauuuucuuuugaacuuacagucuugcaacucucuucaguuaaagcugagguuugaauccaucaauggggaauuuuagcuuaaaguugaaucacacauauuaugccugacuccugcuagaaugccucauaccaacauaaauuaaagugagacgaggagggccgggcauggugacucacgccuguaaucccagcacuuugggaggcugaggcagauggaucacaaggucaggaguucaagaccagccuggccaacauggugaaaccccuucuucacuaaagauacaaaaaauuagccaggcaugguggcacccaccuguaaucccagcuacuccagagacucaggcaggagaauugcuugaacccaggaggcggagguuguagugagccgagaucgcgccauugcacucagcaugggugacagggcaagacuccaucucaaaaaaaaaaaaaaaaaauagugagacaaggauuccagcucuuagcaugugugucucagccacacuuggggauggccucagugacauguaauucacucgcugguuagugccccacagauaagcacgcugccugggugugugccaagccgaagcaucuaggccuggccugggguuugcauugaguguagguguauguguuuugaaguauacuugguugcagggcaugugcgcaggcauucuuagugagaauuuaaguugcaggaccacagcccagcuaguguuuacaugaagcucaaaccuuugcccacggcuacacaccaacacagaaucccggcagguggugggcagguggugcggcugaucucuuggucaguaacacacugggagggugaguguuaacaguuuguaaacauagcugacacuaaguuucuuuuucuuuuuuuuuuuuuuuuuugagacagagucucacucuuguugcccaggcuggagugcaaugaugcaaucucggcucacugcaaccuccaccuccuggguucaagugauucuccugccucagacuccagaguagcugguaguacaggcaugugccaccaugccuggcuaauuuuuguauuuuuaguagagacgggguuucaccauguuggccaggcuggucuugaacuccugaccucaagugauccgcccgccucggccucccaaagggcugggaugaugggugagccauggugcccagccgagaauguccuucaaaaaaauacauuucaauucagacauuuauggcaccccaaagcaauucaagucccuucagcacagaugggguagggcaugugggcucgggccacucacaccccaccccgccuccuccuggcguggggaggccugacucugcccaccuuuacucaugagcccaccguuugaccagcgaacucucugaggaggcccaugugcuagguuugggggcugaggcauuucugugcucuucucugguucagucucccucccaaggugaaaaacagccuggaaaaccaaguagaaaguguugcagcaguauguacuucugugcccuaaagagcaaaauuguuacacaaauugcuuugagauuccuuagaagugaaagcuuucucuuugcuuagcaggagccgguggcccuuacuuucucucaacuuuccauguguuccagaaauuccagcccuauccccuuagaggggcugucauccaggaaggugauuucauuuuucuuuuagagagacagggucuugcuguguugcccaggcucgacucugaacuuaggggcucaagugauccuucugccucagccucccaaguagcugggacuacaugccuagcccagggugauuuuuuuucucuguguucuuucugagcugacaccagcuacuugaagaaaugugccauuggccgagcgugguggcucacgccuguaaucccagcacuuugggaggccaagguaggcggaucacuugaggucaagaguucaagaccagccuggcuaacauggugaaacccaucucuacuaaaaauacaaaaauuagccgggugugguggugcaggccugugauccuagcuacucaggaggcugaggcaggagaaucacuugaacccaggagguggagggugcagugagccaggaucacgccacugcacuccagccugggagacagagcgagaccccgucucaaaaaaaagaagugugccguugaaaaugagguuuguucaguacugaucguggggaacccuuucuccugagauaacuguaagagccuuguguccugagaggcccuggagcuauucuuggggaauugaggugggcagagauuggcagccccugggaccugcuuggcuccaggcgaucugacagcagggaggauugcgaaguacagaucuguagacggggcgugguuuucaaaaccauccguggaggcucuuccuaaucuucaguucuucacagcugccaaggaaaaugucauuuagcuuaugugguugcaagagacugaaguugaacuucagagcacacccaccaccucugcccucacuuccagccggagcccuguccugcucugugccugccgugccccucuccuugcccuuuuccauucggcccugcacccugccggucccuuaaagcuguggcucugugugcucauuuugcucccuuugcuuuuuguccacgggauacagggaggaguuauucucgugcuguauauaaacugaauuucaagcagauuaaaugaauaaacacauuuuuuaaagaaccaaaagaaaauuaagagaauauuuuuauaauuguggagugagagaagaggcccaagaagucaugaaggauaaaaaaaaauuagagguuaaacaauguaaaaaugaaaaaccucugucagaaaaagcaccaugaacaaagguaaaagguauaugcagacugggaggaaauguuuacaacauauaaaccaccauuaaaauggccacaguguauaaaagauaagaaagagacaaacaacccaagagaaaaacaggaaaaggacacccugucuccugugucuuuagaaucccauaaacacgugaauugcuuguccugguggaagcgauguucccaauguuccugugaguuaugaggauuaugcagccuccaucuggagcuguuuacgaaaaggccuguuggcugccaucugucgaugaguuaaaauuccuaccugugggauguggggguggggggcugagggccuugggggcacugccaaccccacaguuauuacacugaacugcugaggcaacggguuucauaugcagaggcccaaggccaagggcuugaguguggcuuugcugguuuuuagccauguaaaauugagggugucggcgcuuguccaccucagguuguucauuugugaaacggagcucaagauagaagcuuccguugcugggugcagugguucacaccugcaaucccaacaacuugggaggccgagguggggggaucucuugaggccagaaguucaagaccacccugggcaacauagugagacccugucucuacaaaauauuuucuuaaaaauuaguugguuggcuaggggcaguggcucaugccuguaauccuggcacuuuggguggcugaggcaggguggauaacuugaggacaggaguuugagaucagccuggccaacauggugaaacccugucucuacuaaaaaugcaggaauuagcugggcaucuuggcacaugccuguacuaccaacuacuugggaggcugaggcaggagaaucucuugaaccugggaggcagagguggcggugagccgagauuacaccacugcacucuagccugggcaacagagcaagacuccgucucaaaaaagaaaaaaaaaaaaaaaagcagguugugcugaugcacaccuauagucccagcuacuugggagguugaggcaggaggauuacuugggcccaggaguuccaagcugcagugagcuauggucauaccauugcacuccagccugagugacagagcaagacccugucucuauuuaaaaaaaaaaaaaaaaaaagcaguuaucgcuuuuccucuuguaggauguugggaggauucaggagccuucaguggcucagggcaugacccaguaugaauuaggauccaagcguguuguuuguaugacugggggcuuggccuuguccugcccuucaucacaucauuuaaaaaggaaauccuucccgcuucuuucuugggacccuggggcugaguguuacuguugugaaucuggaagggaugaacacaagaagaaaacaaguguucacucuuuuccugagacacauuugaaacgugagaggaaguggaaauggucauucccagggaggguuagcucugggugguccuucaucccaccagggugauaagagccucucuuccagaaaaaacaggacuuuucucucugccacacccucuccuaggaacacccagagccaguuuugggagcugcuggcuucccaaaagcccuuagaguaaugcagcucugcuggccuccugggcuacagugcccuuggcccuauggacuggagucgcagcauuaggcugauuucccuucugcuuuggaggagacauuucagguauccacauaacuagaauacuuaguuucccuuucuaagcuucuugcuucauuguagguuuaugcccuccuuucuuuaguuuaacuuccuagagagauggcacuggcacaacagaggggauagauagcggggaaugugaccccagggacuggggucagguggacuuucuaagggcaaauuuuguguucucugcaggagauaaauggcaucaccgcggcacuggcugaagagcucuuugagaaagguauguggccacaugucccugaaauacugagcauaaguuguguaguuuuaugaggcggccagaggcacaggauggcauagaagucacucuggagcccaccuaccuccccuguagguggccaggucugaggagcugugguccuucaguacucuugaguaccaugucaggggcucagcccagacuugggcuguguuccaaagcgcuguggugggugcuggaagguggguagcacacugcucccucgcaccugguuugugcuuaccugaaagggcucagauggcagauagaagcugacccugggucccaucccugccagagagcacaguuauaguagcucaugugugaugaaugcuuccuguuugcaucuuacugccuucccccaggagccacagguauagggaaggauacggggucagcggcccagucaccagccugagggcacauggcugggaggaguggagcgaggaccaagcagcagucaguugggcucagaacccauccugcuuccaggcucugcaccacgcuggcaccauaggccugcgccugaccuggguguuugcauuucggagguugcagcauaggugugucacccagaaugcugucccucuccgcagccucacucuggcccagugccuuuggucucgacucggccucacuccucccucaguggcuccccagccucacagccccacagcccugcccuccucugucaucacaugucuaggguugcccugugccuagcaggcacccaggagggcagcagcuccugcaugcccagggcgcuggcuuugcccugacacagugggugcuugccaacugcuuguugacagaaaagguggaaauccuggcugcacgagggcuggggcugcggcuggacacuuauccuucagggcauggcucuugcaggagaacagcuccugggggccggcgaggucuuugccauuggaccccugcagcuguaugccgucacggagcagcugcagcagggaaagcccacgugcgccaguggggaugccaagaccgaccucgggcacauccuggacuucaccugucgccuuaaguaccuuaagguaaagcugcagcagcucagucauggagagccccgcagucggugggggugcaaccugcgggggacuggcuggcaguuugugugaaggagaccaugggggacuguugguggaaggaaggccgcccgguuauucuuggcacuaugcuucuggcugugggcaccagggggcggucgugacccagugucccguuaaauuaaguccuggccugagccugcuuuguugaagacagaaguggucaaaguugucuucaacuugucagcugcugcagcacuccccgaugggcaugcgacacuguucccaauuuaagccuuaucuuuggcuucagguuucuggcacagaaggaccuuuugggaccagcaacauucaggagcagcuccugccguucgaccuaucaauauucaagucccugcaucagguggagguaaggcccagcgcugcacagcauccucucgcucccaacucagaggcuagagaguguuugugauguuggguguccuaauuuaaucauaaggugcugugcuuucguguuuggcaguaugugacagguucugcguaggugaccaggcccucugaaggcggagaaagagaggccucuccugucccuggcuggucugcacacaccuucccuggcgugagcugcaggggcgguuagccaggguggagcaccagcaccuggcucauucuaggacuccucauaggggcagggggcauguguaccucaaguucaaguccugggaagucauccugggggucagacagaacuaaauacaagucuguauuucccaaggccgauuggcaaagagcuuugaagaugcccugcccucuggggcacccacacaagaaacacucugcaucugucacuacuggacucuuugguuugcgaugccaauuuuagcauuuuugaaaagaaaagucaguaaugaauacaaaaaaaguuuuaaagcauaauuuuuugagcauggcuuuuguguucugcccuguggccccaugucuccuugauugaaucuucccaacagccccgugaagagggcacuuuuauuuccauuuuacaguuggggaaacugaggcuugggcagauaaggaaguuuggccagggccacacaguuaaugagcggaaaccugggauuugaauucagcugagacugccuccagagccucugcugugcacugggcuguuccgucuacaguggucuagggaaacuuguggugugcccugcugccgauugaggacagggaagugaaggggaaacccgacccagcccugccaagcaggcugaggcucuggaucugggucuugggugugcuugggcagguggcuuggggagugugcuuugaccuguggccugccccuccucaccacaagacagcucaguuccauggagugggggcugggugaacaggaggauccaccccacucgcugugcuguggaggccccuuguucuccccagcaguuuccaugacccacacuuuauguucaccugccaagccccaggcagcccuuacagaggaaauggaauuugugguccauugugagucugaggggccaggcaccuuucuuacuagauacuucagggaauguuuggucggcacugacacugggaaaaagagacacuuuggucuugaguggccucccaucucugaggauuuggguugccugucauugugcuuuuguauggggguaggaaacaccugcaucuggggacuucugacggagcaaggauucuguuucugagaugcagcuguucuuuguuccagauaagucacugugaugcuaagcacaucagagggcuggucgcaucgaagcccaccuuagccacgcugaguguccgcuucucagcaaccucgaugaagguaagcuucaccuauauccugccuggggcaaugucuguggaucaggguccugggcuguggucuccaccacuaaggaugggugaggacacugcuaugucuaucaguauucagaggcuggaccuucugugggguaggcagacacucauggggggccucccagcacuugacagccccugggacacuuuaguucacaucugcauaaaaaguucguguuguuaacaggacauuuuaaggaacuuggcuucuuuccccaaaaaauaaaaaaugucauugguguuuuuguguuguuuuguuuuuguuuugagcuagagucuugcucuguggcccagacuggaguacagugguaugaucucagcucccugcaaccucuaccuccuggggucaagcgauucuccuaccucagccucccaaguagcugggauuacaggugccugccaccaugccccgcuaaguuuuguuuuuuguuguuguuguuguuguuuuuugagacagaguuuugcucugucacccaggcuggagugcaguggcgcgaucuuggcucacugcaagcucugccucccggguucacgccauucuccugccucagccucccaaguagcugggacuacaggugcccgccaccacacccagcuaauuuuuuguauuuuuaguagagacgggguuucaccauguuagccaggauggucucgaucuccugaccucgugauccacccgccucggccucccaaagugcugggauuacaggcgugagccaccgcgcccggccuagguuuuguauuuuuaguagagacaggguuuuaccacguuggccaggcugaucucgaacuccugaccucaagugauccaccagccucagccucccaaagugcugggauuacaggcaugagccacuucagccggccgucauugguuuuuuaaugaacaaauugcuaagcuguggcaaguggcgggaccuuuauuaauuagauugauaacuaagcuuagauugcuccucuaagcuuuagcaaucccuggcuaagcacucauuuguaucuuuuuccccacggcuugauuagaaggugagguuguggaaaugcuaggccauguuguuuauaugugagcagcagaaacauucaaauugggaauguuucuguuuaccuuuuuauggauuacaucuugcuaauguuaaaaucuuucccuggguauagaaaaggcauguaguggcuaauauuaugacuuaagguuccugaucaagacuuagguuugggccaggugugguggcucaugccuguaaucccggcauuuugggaggccaaggcaggaggauuccuugagccuaggaguuggagaccaaccugggcaacauagggagaccuugucucuuaaaaaaaaaaaaaaaaaauuggauuuggugaaaaauuuuccucuugaggcuugcagagaguguguugggccaccuggucccucuccgagcacuucucacugucuugcugaaggagcccagggcgacccauugugagaagaaaggucuugucaaaacaaauaggccugccuuucuccauuuugauggucucugggcuuugugcuacuccccuuaucuuagcauugucugacuuuauuccugugaaauaaugguuuuaaaggccugguguccacagugaggaccacaucaucagcuuggaaagcacagcugccuggaaacugaauucucaccuucagccucugagaagcuagaaaagacgguuggcuggccaguagcaguggcuugcaccuauaaucccagcacuuugggaggccaaggcaggaggaucacuugagcccaggaguuugagaccagucugggcuauguagggagaccucguuucuacagaaaaaaauuuuuuaauuagcugggcaaggugguguacgccuguagucccagcuacucaagaggcugagaugggaggauuugcuugugccugcgaguuugaggcugcagugagccaugauggcgccacuguacuccagccugggugacagagugagacugugucucaaagaaaaaacggcuaggcgcuguggcucacgucuguaaucccagcacuuugggaggcugagguggguggaucaccugaagucaggaguuugagaccagccuugccaacauggugaagcccccaucucuauuaaaaaugcaaaaauuagccaggcauggugguacacaccucuagucccagcuacuggggaggcuaagacagaaggauggcuugagccugcgaggcagagguggcagugaacugagauugcgccacugcacuccagccugggugacagagcgagacuccaucucaaaaaagagaaaaggcuagaaaaggcaucaccaggucaccagggcaaaggcccuuugggcuugaaaagcauugcuccuaaagcagggccaggacuuaauucuaaguggcuguuaugugguaaauuguucagcuuugaacgauuucacaaucguuuaaagacauaggaaccaaaggcaugcuuuaaugcaaguuuacuuccacaugcuaaauaugcuccagcccuuccuuaaauucugcaacgacuguguucccagugaguguugcgugagggcccgaguguggugcuccacacagauguuuuuaugcaggaaguccuuguuccugaagccucagaauuugaugagugggagccugaaggcacaacccuagaaggcccugugacugccgucauccccacuuggcaggcauugaccacgcuugaccugagccacaacagcgucuccgagaucgacgagucugugguaugcucucagcagcaggugccagggguuucucuggccccaccaaacccugaguuugaguauuuaacucagcuuuuuuaggaaggaccacggaaaaccuauaucuagugcucugugcauugccugccauuuuaaguuaauuacaaaaugggggcugggcguggugggucacaccuguaaucccagcacuuugggaggccgaggcgggaggaucacuugaggucaggaguucgagaccagccugaccaauguggugaaaccccaucucuacuaaaaauacaaaaauuagcugggugugguggugcacaccuguaaucccagcuacuuugggaggcuuaggcaggagaaucgcuugaacccgggaggcggauguugcagugagcugagauagggccacugcauuccagccugggcgacagagugagacuccgucucaaaagaagaaaaaaaaaugggaucauuuaaaauuggugagguaguacuuagaaccaaauaaaacauaauaauuucauguaaauuugguaaacuauaacacacuaaaugaugacauuugcuccaaagaguggagcagaaaaaucacuccuuagaugacagaugugcccaugaaagaaugacacccagagggcauuugggcaguaagagugucguucccguguuugcgcugcucagggagugugggcaggguugaagaagaacagacucucuucucugucugggaccuugcugugugucauuuucacaagccaaguguuccaugaaaacugaguagugcccagcacugggggcccugugugugccuuuggaugugcuacuggcugggcagcgggagaugucccaccagugguccugcagggacggcccgugggaguccauggucgggaggaagcguccuggggugcccguccacugugucggggaccguguuugggguccagcccccuacaguaacaucggguguucuuuucuuucacaagaaacugaucccaaagauugaguuccuggaccugagucacaauggauugcugguuguggacaaucugcagguagugccuuuggagaccagugcugcccgcacacacucccaaggccccgcccugagauuucaggagacugacgcagccuugggaauuggccagggguuguaagggcagggguugcugucuucgcuuuaggaucccagcaaugcacugagugauuguugcucuaguuccaaagaauuaggaagcaugaguaaauacaaaccaggcaugaugaugcaccuccguccugaagguggacagccauguuuucaacgcccaccccaacugucugcaggggugccacugugcuguggcaugugcggcagagaagagggacuucccuuccuaaaauaacugucagagugacuugcagaacuggguaguuuggguuggaaggcccauccugccauuagugucaggccccuaucuuuggagacuugaccugagccacuuuacgcuguucuccacgccgcugcagcaccuguauaaccuugugcaucuggaccuguccuacaacaagcucuccuccuuggaagggcuucacaccaagcuggggaacaucaagaccuuaaaccuggcaggcaaccuccuagagagucugaguggccugcacaagcucuacucacuggucaaccuggaucuccgggacaacaggaucgaacaggugagcccaaggaccucacaguuuugggauuucugugccuugguguguaucauguuaaagaagaauguuaagauuccuuucauuuaaaagagaccaugaaacguguuggcguguugcugaaguguuaagagaagggaccaaaggggauggaacucauaccuugcagauggaggagguccggagcauaggcagccucccgugucuggagcacgugucucugcugaacaacccucugagcaucauccccgacuaccggaccaaggugcuggcucaguucggagagagggccucagaggugagccccagcacagucagaagagcccagggagaccuucgggaugcagucaagucugcaugggcgguagggggauauauguccauuguucuacccuugccugcuucagaaagagguccugucccuuaggggcuuuucaguucugggaaguccacuaucuccccaggaaaaagcucccuugcaucuccugccccuacugucugggauaacauuguuuauucuaggaaagggucagaaauaagauccuuaaaauauucauaucuccuggacaaccuguggccauagugccugacuguaaacccaaaggguuugccuuugccaguguagcccagccuggugucugcugccccucgcggugucugugcaccugccacgaugcugaccagacacccuuaaccagguucacccaucgccugggccuggagcaguccccgugaugcucugauugguccuuggaccuucuguucucccaaaaucccaggucagaaaauaccuggaagucuauuugugucccaccucccucuuuguggccgcaagugccccuuccuccacacagucacaagaccaugagaugccaucuccuccccuccugggcugcagacuuugggaagcucccaggccacagagugucagcuccuguccaggcccuugggaccuucccucauucaaccacccuacccaaccccccacugccugccagccaccacucccucccacauuugcaggcgggggcccugcccucuccugccgcugguuccccuacccaggaggcucucccaucgcucuuuugagagucugccucccaccucuaacugggggcuuaguucaaguugcccccuuacccuagucccagcugcccaagagcuugcugccuccuguucuuggugagggacuccagagacagaugugagaccucccuggaccccuccaaggcauucccaggucacuuccaugaguagugaagagccgccucugagcaggcugagccucccucagccuaugguguccucacguggccuggcccacagcaggugcucacgccuccuccucagcagagcccuaccauccuccugccaugcucaccaguccccaugcugauagccaucaccaguccccaugcugauagccaucaccaguccccaugcugauagccacuuucuggaugcucuaggucugucuggaugacacagugaccacagagaaggagcuggacacuguggaagugcugaaagcaauucagaaagccaaggaggucaaguccaaacugagcaacccagagaagaagguggguuuguguggcaggugggagggcaguggugcagagccagccgggauaggagccaguuuggggggcuugggccaugggacugcucagggcugccgagucccagcugcgccccucccuggcugcaugaccucgggcaagucgcggccucucuguucucugugggguggggacagugguaguuccugcucuaaggauaugaugagaccaucuuuaccacccaguuggugggaaccguugcgcucccuccucacaccccuggccuuggggagcucugugcuuccucuucucucccgggcugacucaagcacucguccucaggguggugaagacucccggcucucagcugcccccugcaucagacccagcagcuccccucccacuguggcucccgcaucugccucccugccccagcccauccucucuaaccaagguaaucguguauguaucuugcuucuaguggagccacacagcccugccugggcccccuggcugggcugggguugggggagaggugccagcaccugcuuccaacagggucagacacagggagggcagugccuucugcaggcugguccucgcggggggacacauggcaggggugccuggccugaugccagcuguugcuugcuuggugaggacucccaauugcucugaugcccacauccagcuccucuaggagaccgcagggugucugacaggcccugaggcugcccucugaacaggcucggggcuguuggcucaugggacccauucccucaccggcagcacaagcagguuggcuccugguuacaggaagccgggcuugugacuuuacugucuggagcccgaaucccugugcagggaaaagcuugcuuuuaucacugccucaucucuguggggugacccagccccagaacaccauguuuguggggccaagaugggccaucucugucccuguggacccauggaagaccaggcccauucgucugcccacuaucuuagcguuuucaaagggcuuucaccucugaacccaggcauccucggagaugagugagugaagcaggucucaugagcgugucugcuggcccggcccccacggaagaggggagggugugccgucccgaguggagccgaggcucgggacacgcaggaaaggacgccgccugcccgggcuccuggagacgcagaacuuggugugaggucuugggaaaacaguucaacccgauguuuuaagagccagaaaaacauucccaccccuugaccugguaaccccacugguggggauuuucucuuagagggauaagauaccgggaaggggaggugaaaugcucaccacugccaaaacacgggcugcaacugcaacaucggaggaugagagggagagucggcuguggugcagaaugcucagcagcccucccagcagggacaggaagacugggcaggaagaggggagaagcauucaaguuaaggcaaaaggcccaacgcagagcagcacacugaggucacaccugugagauguggaagagaauuccugagcguggagcgaugggguuaggugccaggaugauugcccauuuugcuucugucagacucuugacuaaggauuucugguugcauuuuauuacauaaaagccagggagguuauaucacggugagaaagcuucccugacgcugccuccuguagcgcagccaagcgagccuguggagguaccauaugacuguaggccucuggggacagggagcugcaucugcuucucaaggccagggacacagccauuucugccagcaucuguugaucagugagugagugagugggcagguagagcaggagccagugaagagcaggcccuggauggguggggaugcaccauguccccaggcugcagcugcaggcagccccccacauugucggagaagccucugcaccagcucagcccccuccucacuccccuugugcccuggggacacucugcagaggggcacucugcagucuguccccgccaucgcuggacuucuggacauggccuccagauuugcaccucuuaaauaaaacugcaguggaugucuuugugugcaccucucuuuccuuuuggugagaaacagcaaagaucggaccccuaaggacucuccugaugucuccgcucuauccgcugagugcccuuucugaccacuuguuuguacaggccacgguccaggacgggagcagauagacugucccugucccuguccacauuuccuugguccaaacagggcuugugggagguaguggcaaaagguguuggucuuuuucucacugauuuggaggccuccccguguguuuuuucagccgcguguuccugggucuugccuggauggacaggguuuuuuagcgcgugggagcagcuuugcugacccaugccuguugcuuccagccugauucccgagaagggagccugcuugcgaaggaacuggcacucgggccugccugaagggggcgcuguccagacaacacccagccucccgucguggcaggcgcugucggagccauggaugauugugaccaauagggguggucgccagaguugauuguccagccaggcccaggggcugagaggaggcuguguggagaggugguuaggagccagggcucggucagcugaguucgcaugccagcuuccuagcugugggaccucaagcaacuuguagccccucugaagcuguuuucucaacugugaaguggacgcacccuacuucauugauucuaagaggcacgcauuuccaccuugugacuucucugaaacugaggugcgucuuucagucaguggcgucucauagucgcugucagccagcugguauucgagauggagucguggaaaacccguggacaccuuccgcuaggaccaagauggcgccaccugccgcaucuuagauuugaugaaaugugguaaauaacgagaggcaugcaugagcgaaugcuggggaggcgcuuggcacuacccagagcuccacagagguggucgaugagggcugcccuuucccacauccuuaguaggggguucaagaugacccagacugugccccuggggagcuuggagccaugcgggaggaugagccaugugcuggaggagaacaggguaggaugguguggggcuuuuguagacugucuagagcagagaaggucugcaguggagguggugucugaggugaaucucgaaggugaauaggaguugaacguuagcaggcagaggguggauugcaggagagcagcggccugggcaggugcccagcguggcccaucagggugcuucaugcauggcugugugcuugccauccuuccugccugccuacccccugcugcuucgcuucgugggggcguuugagcuugggcccaccugccugccucgcuugugggcagaggacccaggcugugugaguuguccugucccggggagcagcugagcuggucgggggucucgaccuguggggcucagaggacucggggucauuucacugggcuguggcgaugcugggcuguggagguaggccuagggcuccuguaggccucagugagacuggcggccgaugcccaguguucacccugcuggcggcagucaggaacauguucacaaaggcuuuaccuucaaguggucuagaggugaucugagguggaguaacagguccagauaggcuacguucauaaaacagcuucagcgggguuuaggaacacugugcauuuacgggacgcagugggucagagugcugcuguccgugggagguggccccagggcaggucagugggcacguccugugguaagugggacuguggaugugggcucaggcuggacucagcagcccugcuggauaccaaggccugcaagggcuggcccccuggugaauugucccgugcccuguguaucuaugaguccugcagagaugacaaaucaggggacggggucaugucuagucaccgucugggaaaaugcuccaggagugaacacauuucaggcucuugauggauguaccuccaaacucuucucuggaugggugggccagcuugcaugccugugccggccucugcccagcgaggucagggccaggccacacagucagucugacuuuggcagaaguugagaggcaacacuugucucuuguuucagcuugccuuucuuuguguacuucugagagcgagcauucuuuucauguucuauccgcuggccguucuucugcggaaugucuguucacguccuuugcagucuguuaaugagguuuccaaccuucccucauuuuuguaaucuguaagaacuuuuuacagacuagcgauauaaauccuugucaaauauugcaaacacuuuucucauuucaucugguuuuaaucuauccugguuuuuaaaaaaugugucuguggaaguuuaauuuuuauguagucacaucucaguuuuuuuccauugcauuuauucucagaaugcuucucccugcccugagauuagauaagcagucauuuguucuuucuugaguuauuuugagauuucaguuuuaacauuuucuucuauaauccauguggcuggguuuugggaucuggcuaacccccgccaugccaguagccugaggggcccagccccacuuguugaacagccgcucuccccgccccacccacccugccugccugcccacccgcccuggucucuccaggaaucauguucguucaggaggaggcccuggccagcagccucucguccacugacagucugacucccgagcaccagcccauugcccagggauguucugauuccuuggaguccaucccugcgggacagguaaugcccucuucccgcuucuggggaccauacaucuguggguggacucuucugcuugggguugugugcaguaggaaguggccuagcuggagcugaggcagaugcuuccaggguuuggcguccucugcuuugugccacggucuuucucuuggaccugucucugguugagugucuuccugacaaacacagugguuaaggguuuauuuucagccucccuccuucccuuccccacccaccuugguugaugggaacaggcaguucucugucacugggcccagggcacgaggggggcagguggagaggguggcccuugacccugugagcaggcuucccuggggaaggcauuucaaaagacccucgugcaggggcuuguuuggguuucuucucuguuuccuggcaccccuggagccacucggcgccuuuccgcaugucacccugguggucugggaaacagucucacucuggcgccuccucugugguuguuacugagaguucuggggccccuuccuuuguccugaggaaagacaggaggaaagcaagggugcuugcugugugcuucgcaaaugugcuuggugccugggccucccuccagccccaucucugcagcagcacaagguuauggccuugugacacugggacaguuugcagaguccuugucuguccucaguacuccacaguauucugccaucacccuuuccagggucacacagcaagagauucccaagcccuagguauuccccagugcacagagaccauugggagggacuugccagggcuguguccacugcuggccaguuagggucggaccaaauuuguagacugucuaccuggacccuugcguggcacaaggagcagucagaugcuggaucccuggagaguggcgagaggcucuggcccuagguugcgagugggaaucccagcccugcugugugcuggugggauaaccaagugggucucugcccuugggucccagagugggccccagggucccagagugggcuccaggguacagcguggggauggggagccuccucagggcggugauggagggcagaaugcccagcucagggucuggcaaccaguaaauggcuggggcuggcugcaguagguggggacugacuguguuucuuucuccaucaggcagcuuccgaugauuuaagggacgugccaggagcuguugguggugcaagguaaggaagagguuggaaagggaccugggccuggccacacagccuuaugcacacacacugcugugggccagggguggccagucagguuuuuuuaaaaauccguucacagaaggccuauagaacuauuucuuccucuaaagagacacagaugagauggacuuuucaaucuguuuccaaauucuaauaccuaaacucugcucagcacauguugcccuacaccagggguuggcaaaucaaggccuguguguggcccacagccugggagcuaagaaugacaguuacauucuuuuuucuuuuuuugagacugagucucgcucugucgcccaggcuggagugcaguggcguguucuuggcucacugcaacccccgccucccagauuaaugcaauuuuccugucucagccucagccuucugaguagcccggaccacaggcgcacgccaccacgcccaacuaauuuuuuauauuuuuaguagagacagagauucaccauguugccuagcuggucucgaacuccugaacuccagugauccaccaaccucggccuccuaaaguacuggaauuacaggcaugagccaccgcgccuggcuagaauaacaguuacuuuuuuuuucuuugagacugagucuugcuuugucacccaggcuggagugcaguggcccgaucucagcucgcugcaaccuccgccucccggguucaagcgauucuucugccucagccacccaaggugcccgccaccacaccuggcuaauuuuucuguuuuuaguagggacaggauuucgccauguuggacaguuacauucuuaaagggcugcugaagaucguauggacaugguagcccauaaaucccaaaauguguacucugacccuuuacagaagcuuacuaacucccacucuacaugugagggcugcgguggccaagaagagcuggaauuuaagugugaagguccuaagaccugccccagcccacuucccugccccggaggccaccaggggugacaaguagauucaugcccuggaguguuccuucucuccggggcuuauggcagcaacugaaugacuuagaaguccaugggagugcuucuguugugggaacucguguggucugggcauagcugugccaggcaccuaugguccaagccccuagaagcauagacucugaccaaacuggcgacccagccuuccagcaggcagcacuggcucccaccagggcccucauccugggaacugacuuggccaugugggaggcuugggagacccauggguugguuucucagggucaggguguagcagugggcuccagauguggcaggugggaggugggaggggccccucccagcaugccacugaccuggccucucccugcacagcccagaacaugccgagccggagguccagguggugccggggucuggccagaucaucuuccugcccuucaccugcauuggcuacacggccaccaaucaggacuucauccagcgccugagcacacugauccggcaggccaucgagcggcagcugccugccuggaucgaggcugccaaccagcgggaggagggccagggugaacagggcgaggaggaggaugaggaggaggaagaagaggaggacguggcugagaaccgcuacuuugaaauggggcccccagacguggaggaggaggagggaggaggccagggggaggaagaggaggaggaagaggaggaugaagaggccgaggaggagcgccuggcucuggaaugggcccugggcgcggacgaggacuuccugcuggagcacauccgcauccucaaggugcuguggugcuuccugauccaugugcagggcaguauccgccaguucgccgccugccuugugcucaccgacuucggcaucgcagucuucgagaucccgcaccaggagucucggggcagcagccagcacauccucuccucccugcgcuuugucuuuugcuucccgcauggcgaccucaccgaguuuggcuuccucaugccggagcugugucuggugcucaagguacggcacagugagaacacgcucuucauuaucucggacgccgccaaccugcacgaguuccacgcggaccugcgcucaugcuuugcaccccagcacauggccaugcuguguagccccauccucuacggcagccacaccagccugcaggaguuccugcgccagcugcucaccuucuacaagguggcuggcggcugccaggagcgcagccagggcugcuuccccgucuaccuggucuacagugacaagcgcauggugcagacggccgccggggacuacucaggcaacaucgagugggccagcugcacacucuguucagccgugcggcgcuccugcugcgcgcccucugaggccgucaaguccgccgccauccccuacuggcuguugcucacgccccagcaccucaacgucaucaaggccgacuucaaccccaugcccaaccguggcacccacaacugucgcaaccgcaacagcuucaagcucagccgugugccgcucuccaccgugcugcuggaccccacacgcagcuguacccagccucggggcgccuuugcugauggccacgugcuagagcugcucgugggguaccgcuuugucacugccaucuucgugcugccccacgagaaguuccacuuccugcgcgucuacaaccagcugcgggccucgcugcaggaccugaagacuguggucaucgccaagacccccgggacgggaggcagcccccagggcuccuuugcggauggccagccugccgagcgcagggccaggugagaucaagcacagcucucaggggccccgggggcaugggucuggcaugugugugaucucagcaucugcggcuagugugggcugggaguugcugcgagagcugggcccccucccccccugccccucgccccccccgggccucccucuacaucaccaccccagguuuggugccaggcugcuccuuaucucagugcuguagaagaagcccaggaaagcuguccucucacaaaauggguuggcccagccucuugccacccaugaagggcaggccaagggggcugccccaccuuugccugcccagugggagagcaacaggcugcagcacaccgaggccaggagagcugucacccuggcugcugugcuccucugggcccaagcauggccucugggcacuaccuccuccagggucacagucccacggauggcucugugggccaggaucugccuuaggcuucacccaccucaacaucuugcuguguuguucaggcuggucucaaacuuugggcucaaacaauccuccgccucagccucccaaagugcugggauuacagacaugagccaccgugcccggccgugcuguucuguucuccaauagagaagcugguggaaguccccaguaacccagaggugaugugugaugcacacagucuccucacucugaagcugcacaugcgaugugaaucuucauuugggguccgcuguuaauaugguguuuuucgggggauacagcaaugaccagcguccccaggaggucccagcagaggcucuggccccggccccagcggaagucccagcuccagccccugcagcagccucagccucaggcccagcgaagacuccggccccagcagaggccucaacuucagcuuuggucccagaggagacgccaguggaagcuccagccccacccccagccgaggccccugcccaguacccgagugagcaccucauccaggccaccucggaggagaaucagauccccucgcacuugccugccugcccgucgcuccggcacgucgccagccugcggggcagcgccaucaucgagcucuuccacagcagcauugcugagguagcggcccgggugugggugccagcuauggcacggccaguccugagggcgaggccaagcuuggcuucaggucagccucaggucccuggacuucccugaugucggaguccucagcugagcugcucacagcuuugaggaccugggcagugagguccugaguugcccuccccuggccauuugugcugugucaccaccuccugugccacuuccagccccagguagaccucccaccaacagccaucucccaccccucucuuccucucugccuugaagcauacggauucauuggugagccaagaggggcuucccaugucuccuuguggaagcugugggcaugucccugguaugugcagguugcuagggugguggagcugacaggaggccccccgucuucagguugaaaacgaggagcugaggcaccucaugugguccucggugguguucuaccagaccccagggcuggaggugacugccugcgugcugcucuccaccaaggcuguguacuuugugcuccacgacggccuccgccgcuacuucucagagccacugcaggguaggcacagggccugcuggggcucaggagcuuggagugugugguuggggcaggccuggggggucauucucuggagccagcuguguggcuucaggcagcagucagcgacuuggcugcagugggcugagaguuccuugucugaggaagggagcugucaugagggagggguccauggccagaugugaacgcagaaugcacugagccagggccuggugacugcuugggaacagccagugaugagaagggguuaggcagccuuugccccuggggcugcacaggaagcccuagccagcgaccuggugacuccccugagcuggaagaggcuccgacuccagagggcauugccuauggggcuuugcacggguggaagccaggccagccaagaggaccuguuccugcuggaugugcugcacaccuaggaaccuugugcuugccugccaccgccucccucugucccuuucuccaucacacagauuucuggcaucagaaaaacaccgacuacaacaacagcccuuuccacaucucccagugcuucgugcuaaagcuuagugaccugcagucagucaauguggggcuuuucgaccagcauuuccggcugacgggugggugacccucugugcuuuguccuauuucgggugaaggccagcaucaccagugggcuuccaccuuccguacguggguggguuaucauagacaguuaucucugugcucaagagccacuucuuaaccggggugggaggaagcagcuucaggaacugcugagagagcagaacucacgcuccagggcucagagcaggagguagggugugcggcaagcgcuggcccggacagaagcagagugggcccuggucucgggcaggauguuucugacucacauuuccugaggagagaaagcuaagcucuuugccuaaugucucugucuccccuuccagaaaaaugccucagcucuuccggccugaaggaauggccuccucccgggccccaugauucuuuccugugugggcccuccuggcccuggccucugggcugaggcuugcuagggacucgggguggcucuaaggggcagggauagggcuggggagcgccggccuguggcccugaccagccccuucucgugcagguuccaccccgaugcagguggucacgugcuugacgcgggacagcuaccugacgcacugcuuccuccagcaccucauggucgugcuguccucucuggaacgcacgcccucgccggagccuguugacaaggacuucuacuccgaguuugggaacaagaccacagguaccccugucuagcucaggcugcagacaggcugccuggacagacgucaugggccccaggguggcucucugugccccagaacccucucugccucuaugucucucuuuucucacuuagcuggccaggguuuuauguggggcuuuucgauggcagagucuccacuccagcagucccucaaccaucuggcagacacaucuccagugccugcuuugggcuccuggccugugggccccacacuuggagcauccucuccugccugucucaugccggggucucucgguuggcuuggggcccuuggugcucccagccccaccaggggccgguuccaggcuauagcccagguggcaucucucugcagggaagauggagaacuacgagcugauccacucuagucgcgucaaguuuaccuaccccagugaggaggagauuggggaccugacguucacuguggcccaaaagauggcugagccagagaaggccccagcccucagcauccugcuguacgugcaggccuuccaggugggcaugccacccccugggugcugcaggggcccccugcgccccaagacacuccugcucaccagcuccgagaucuuccuccuggaugaggacuguguccacuacccacugcccgaguuugccaaagagccgccgcagagagacagguaccggcuggacgauggccgccgcguccgggaccuggaccgagugcucaugggcuaccagaccuacccgcaggcccucacccucgucuucgaugacgugcaaggucaugaccucaugggcagugucacccuggaccacuuuggggaggugccagguggcccggcuagagccagccagggccgugaaguccaguggcagguguuuguccccagugcugagagcagagagaagcucaucucgcuguuggcucgccagugggaggcccuguguggccgugagcugccugucgagcucaccggcuagcccaggccacagccagccugucguguccagccugacgccuacuggggcagggcagcaggcuuuuguguucucuaaaaauguuuuauccucccuuugguaccuuaauuugacuguccucgcagagaaugugaacauguguguguguuguguuaauucuuucucauguugggagugagaaugccgggccccucagggcugucggugugcugucagccucccacaggugguacagccgugcacaccagugucgugucugcuguugugggaccguuguuaacacgugacacugugggucugacuuucucuucuacacguccuuuccugaagugucgaguccaguccuuuguugcuguugcuguugcuguugcuguugcuguugcuguuggcaucuugcugcuaauccugaggcugguagcagaaugcacauuggaagcucccaccccauauuguucuucaaaguggaggucuccccugauccagacaagugggagagcccgugggggcaggggaccuggagcugccagcaccaagcgugauuccugcugccuguauucucuauuccaauaaagcagaguuugacaccgucugca

SEQ ID NO: 17496 - RNA, 9067 nt, Homo sapiens
ggccgucgcgccuuggugacgucugccgccggcgcgggcgggugacgcgacugggcccguugucugugugugggacugaggggccccgggggcggugggggcucccggugggggcagcgguggggagggagggccuggacauggcgcugaggggccgccccgcgggaagaugaauaagggcuggcuggagcuggagagcgacccaggugaggaggggaccgggagggccaggggcuggggaggccggaugggcccgggacgcgccugccugaccaucacccccuccucuugucgccccacccaggccucuucacccugcucguggaagauuucgguaagagccuuuucucccugccggaccggggcuguggcggcccaccccugcgcccucacucaucaggggcuguccuucccuacugcuuuccuuuccucaucgcaggugucaagggggugcaaguggaggagaucuacgaccuucagagcaaaugucaggggugaguggcuguacaccagggcugccccuuacacccagagugcuggggaaggucccagagaacagggccccuuagggaagacagugccaggaacccuacguuguaaaaucucacagaaagcagcagccuugcucucugagugcccgcuccugaucaaacugauacuuucuuuucucccaaacuuuccuuagcgcuucccuuuuuguagcagcccccuccccaccccuaagcauccuuugguucagcugcuuuccuggccuugcagcgggaagaccccggucacacaaugucuuuugugcaguuguguaauguauuaauuuuagugugcccauguguccuuggcuuuaauccugacacaaagucauccuguauugauugguuggggugacaaggccccuccugggugcccacacuuagagucuuuucccagugguccugcagaauagauguguaagagaguagcaacaguagcaaccgugacugaaccaagaagucuacuuuaauuuccuggaacaaaagagacugguguggguguucauuugcuuuccugacugcauuggggcccacaagugagaaggagugccucaguuccucaucagaguuuuuguucuugucuuacuuuguguuccuacccugucccauccuuggcccucaguuccagcuuuucuucucuuacccagaacuauagacuucauaaggagacuggguggacuccuggagcaucacagucagaggcuuaugcuuugcucugccuguggcaggccuuuggugugugagggcacaaggccacuucagacacaguguugggaagaagccaggggagaggggggaucacagcaaggacaccugagugaugacgcagugcaaaggauuaaugggagaaagaagggaaugcugauugucuucuccccuuuggcugaucuggcucugccccuuacuucccccagcccuguauauggauuuaucuuccuguucaaauggaucgaagagcgccggucccggcgaaaggucucuaccuugguggaugauacguccgugauugaugaugauauugugaauaacauguucuuugcccaccaggucugcuggacucugugcuuuguuuggagggugggaugcugccauguuuuugcuugggaaguggaaauggaggaagacaggaggaggagauaggcagauucuaggggugguagcuacagaaauccucuggcagaacgaacugaacucuuaauucauuaaagggaacagcuuuagaguaggagggugucugaguccacucucuguguccucagauauccaguggguauuugguaggugcuuguuaaaugaauaaacauuaggcaaagaugaaaggagcugagaaggggaguuguccagauaugacugaccugcucuggauccccauucuugauguauaugggcuuggggcuugcagugaggggugcuguguaugggugacuauucuugguuucacagcugauacccaacucuugugcaacucaugccuugcugagcgugcuccugaacugcagcagcguggaccugggacccacccugagucgcaugaaggacuucaccaaggguuucagcccugagguaggcugcagugccuucauccuggcucacagccaacugggcagaucugacccugagggccacugggaaugcuaccacaugauauuggguacuauuaggcuguuucuuuuucaaaugauuguuuauguuacauuugacucuuaaauaaauuguguaaggccauuguuuuuagaugcaguugcggggaaaggacacaggccuagggagggaggagaguuuccuuaagucagaccaugucagaaccuucucugucaggacuuuuccucucaggccauguugcuuccuaguguccacuaauuaccaugcaaggccagcacaguccaucucuuuggggcuccagagcucuuuucugcccccaccagccuuuuaagaaaguucgucuguguuccuuccgauuccuggaaugccuccaggcugcucucugaagcuuugccuuccacccauaguccuaccugaggagaaauuauucugauacggccuuauuuucuuccccguagagcaaaggauaugcgauuggcaaugccccggaguuggccaaggcccauaauagccaugccaggugugugggagcugugggagcugauguggggugggaguagggggaguaucauuuuuugggcccugacucuguuuuuccccaggcccgagccacgccaccucccugagaagcagaauggccuuagugcagugcggaccauggaggcguuccacuuugucagcuaugugccuaucacaggccggcucuuugagcuggaugggcugaaggucuaccccauugaccaugguaggcaccaugagcuggaggccuguugggugucucugccuaccuccuagggagcuggggcucagggcccucugguaugugguacccaguggcagggguugucgguaccgacacccggcucuggcugggguuucacccuacaccauauugcccgaccagcuccugauucccuggcucaacugcucuucucugucuuccuucccacuccuggccugcccaaacucaggguuuccuucucgcugauuccuugucuuggucuccacuagggcccuggggggaggacgaggaguggacagacaaggcccggcgggucaucauggagcguaucggccucgccacugcaggguaagggcccugugccugcccuguucuacucucuggagcuguaccuacuuugggagggacagagaguauccaggugauuuguaaauugcaaggccauauggugaaucuggcaagaucaggcuuagaucauggguucucaacuuguugucuuauuuccugccugggcugccuguggccugcuccugggugggcugggggaggggcaggccucaguggagccuuaggcagcccaggucugcugguucacuuccagauaggccccucauacagcuuguuggaagguaccagcucaggugccuggcauguauggcuagucgcugccugccuguugggguggggccuauaccuacagcugcaggugugacugcagggagcccugccaggauaucugccucaaccugauggcggggccggggcgggagcugcucucacggcugcggcugugacugcagggagcccuaccacgacauccgcuucaaccugauggcaguggugcccgaccgcaggaucaaguaugaggccaggcugcaugugcugaaggugaaccgucagacaguacuagaggcucugcagcagguaggugcccuuucuuccuggccucugcccagcccaacccucccugcauuccuccucccuucccccacagcauuugucucugauucgugaacauacucucuuguagaucugggcuucagcuaaccacaucuuuucuuugcccccauugugggaaaggugggacuuggaguggggagggagaauagcuucuaaaaggaaguuuggguuuggguguuuuauuucccugugagugaauggguagagccaaggccauuauuccuuuagguccucagcccuuagcuauuuaagguagaagcccgggucuacccuuucuccucugagcccuggauucuguuguuagcugauaagaguaacacagccagagcugauucagacccacaagucucaagagucacagcugccugaggaguccaagucagccagcaacaaguccccgcuggugcuggaagcaaacagggccccugcagccucugagggcaaccacacagguacugggggguuugggaccucuuguggaccucagagccacccgcuaaugucugacaugggaggccuaaacagggaaagucuuuuucuggggauguccuugggcaguguucuucccccgucagaagguagagggagagcaguccuucccuaaagaaaggcaccuguaaagggccgcuguuaccacaggccccugggcccuucucuguaauguacacucccuuucuuguuuucucuagaggcgguuuuuuuuuuuuuuuuuuuuuuuuuuuuucuuccugcuucuuuuuucccaucucauucuuugcccugucucauugcgggaucaugacuuagagcuugcugacucccauugcaccagcuggcugggcuguucuucucugggaagugcugguucacagggccggggagacugugagcuuuucuuggagauccuacuggagguccugccuguguucuugcccugucucagauggugcagaggaggcggcugguucaugcgcacaagccccaucccacagcccucccaacaaacccaagcuaguggugaagccuccaggcagcagccucaaugggguucaccccaaccccacucccauuguccagcggcugccggccuuucuagacaaucacaauuaugccaagucccccaugcagguaagcugggagcacccuugcaggauucucuacuugauucucuugagaggcugcaacaggcaauuuucccaugugguuccuugguguucauccuuggcauggcugggucaagcugccugggccuggguugcuagguuccucugccugauaugaaaaggcccccacaacagcaggagcuuagggaggcagggagagcuccuuugaauuuaaucuaguuacguggcugugggauuaaauguuuaggucacgcuccuugguacaacuucauggguuggguuuuacuggcaaaauaaaggcauguguuucagggcacucuguuucucuuaaaaccccuccgugggguucuauccaguguaaguggguggcagccuccccacaagccaaggacaggccauggaacagcuggagggguuccgcugacucagucuggaaaaccauguuggcuuucucucuggcugugagugucuaggcucagccugggccgagcagcacuuguuuguaacugcccuggucuuugucccaggaggaagaagaccuggcggcaggugugggccgcagccgaguuccaguccgcccaccccagcaguacucagaugaugaggaugacuaugaggaugacgaggaggaugacgugcagaacaccaacucugcccuuaggucagcccagcuuucuaaggcuaccagguucuaggugcuucggaucccauccugaauaucucagucugugucugagaaugcccugcagcagauaauguugagcaccugcggaguuuggggcccugggggaggcuggcaugauggggcugaccccagguccccaggaaguuuuuggugggcugggggguaaggcugagcacguaagcuuauaucauguccuauuggaaguggccuuuuagccaggccuugaaggauugguuggggcagggauggaggagaugugggugguggggaggcagcuuugcuggaacacagggcauuggcaaaaggccaggagugggauggcuggaauagaggaagugucuuuugaggacacuuggcugcagcugucagaacuugaugccaggcuuagcauggcuaguucaaguugcuuggaccaaguauaaggaguuuuagggucagccccuggaggucgggauguauuuaagccauucuggguacugcuggguauggucaccuggcccguucccuugcuucacaucuucucgggccccacagguauaaggggaagggaacagggaagccaggggcauugagcgguucugcugaugggcaacugucagugcugcagcccaacaccaucaacgucuuggcugagaagcucaaagagucccagaaggaccucucaauuccucuguccaucaagacuagcagcggggcugggaguccggcuguggcagugcccacacacucgcagcccucacccacccccagcaaugagaguacagacacggccucugagaucggcagugcuuucaacucgccacugcgcucgccuauccgcucagccaacccgacgcggcccuccagcccugucaccucccacaucuccaaggugcuuuuuggagaggaugacagccugcugcguguugacugcauacgcuacaaccgugcuguccgugaucuggguccugucaucagcacaggccugcugcaccuggcugaggauggggugcugaguccccuggcgcugacaggugggccuuggacuggcucacuggccacuuggugcacccaggagggaggagggaaguggccaagugaccacaaaguguccugcacucugaugauuuucuugugaccucucuucccagagggugggaaggguuccucgcccuccaucagaccaauccaaggcagccagggguccagcagcccaguggagaaggaggucguggaagccacggacagcagagagaagacggggauggugaggccuggcgagcccuugaguggggagaaauacucacccaaggugagccuccguugugguuuucuccuuuaauccuggcagaggguaaggccugagcuccuccugcccaggugccaaguucuugauuggaacuuuggugugaagauugguggcuggagccaugugccagaagacuuucuggguugggugguggcaggggccuugauaggcauggacucgcugcucauccuugccucuagcugccuauugcucguggggcuuuguugcuggcccgccccgaucagaggugcaaugcuggguuuuggcaggagcugcuggcacugcugaaguguguggaggcugagauugcaaacuaugaggcgugccucaaggaggagguagagaagaggaagaaguucaaggugggugauuucuccaguugccugaucuggccucucccgagguccacugguggcugcucuggcaagauuggcuccagugcucucagucuucuucucuccuacagauugaugaccagagaaggacccacaacuacgaugaguucaucugcaccuuuaucuccaugcuggcucaggaaggugaggggaugcgcugcugucuuaacuggaaugcccugcugagggccguguccuucagcuccccuccccuggccucuccugaggcuugagcagaccuuggggcacagggagggccaugagagccucagcuccuggccugaggcagccagcaccugcucaagggucucuaccucuucgcaggcaugcuggccaaccuaguggagcagaacaucuccgugcggcggcgccaaggggucagcaucggccggcuccacaagcagcggaagccugaccggcggaaacgcucucgccccuacaaggccaagcgccagugaggacugcuggcccugacucugcagcccacucuugccguguggcccucaccaggguccuucccugccccacuuccccuuuucccaguauuacugaauagucccagcuggagaguccaggcccugggaaugggaggaaccaggccacauuccuuccaucgugcccugaggccugacacggcagaucagccccauagugcucaggaggcagcaucuggaguuggggcacagcgagguacugcagcuuccuccacagccggcuguggagcagcaggaccuggcccuucugccugggcagcagaauauauauuuuaccuaucagagacaucuauuuuucugggcuccaacccaacaugccaccauguugacauaaguuccuaccugacuaugcuuucucuccuaggagcuguccuggugggcccagguccuuguaucaugccacggucccaacuacaggguccuagcugggggccugggugggcccugggcucugggcccugcugcucuagccccagccaccagccugucccuguuguaaggaagccaggucuucucucuucauuccucuuaggagagugccaaacucagggacccagcacugggcuggguugggaguagggugucccagugggguuggggugagcaggcugcugggaucccauggccugagcagagcaugugggaacuguucaguggccugugaacugucuuccuuguucuagccaggcuguucaagacugcucuccauagcaagguucuagggcucuucgccuucaguguuguggcccuagcuaugggccuaaauugggcucuaggucucugucccuggcgcuugaggcucagaagagccucuguccagccccucaguauuaccaugucucccucucagggguagcagagacaggguugcuuauaggaagcuggcaccacucagcucuuccugcuacuccaguuuccucagccucugcaaggcacucagggugggggacagcaggaucaagacaacccguuggagccccuguguuccagaggaccugaugccaagggguaaugggcccagcagugccucuggagcccaggccccaacacagccccauggccucugccagauggcuuugaaaaaggugauccaagcaggccccuuuaucuguacauagugacugaguggggggugcuggcaaguguggcagcugccucugggcugagcacagcuugaccccucuagccccuguaaauacuggaucaaugaaugaauaaaacucuccuaagaaucuccugagaaaugaacccuccugugguugcuggccuga

SEQ ID NO: 17497 - RNA, 15823 nt, Homo sapiens
aaaagaacccuauauugcucauugauuucuaaaagaaaaugaaacccaccaagacaagaaauguguugcugaccuucacuuuuauuuaaauauagugaucuuuuaagagaauaaacaaaaaauacuuuacacagcaaauauuuuacauaaauguaaacaugcaugucuacuucauaauuaagcaaaaaaacuuuuaggcacaagauuuuaaaaauaaagaaugagacaaugaaaccaagacuggaauaacagaaguaacaaaaacucacauuuccuaacucuucaauuggucuugucuuccaaccuauugguuaaggccugaguuucagaaauccuaccuuccuugccaaauagaaacauccacuuuggcuguauauaacauuauccacauaacacacuaauucucuuucaaaauaauguaauaaauauaccauucauacacacacacacacacacacacacacacccugcugaaccagccucucaaauaggaaaauaaggauuuuggaauuuucaaguuuuccuacaaccaaagcacauacacacacauuaacaccuuacauagaaaaaaugauucugcuacagaaauaaaaucguuagugaguggcaugauuacaaaccucuaguucauuuguauuaaguuucuucaaucacaacuuuacuaaggcuuacuaagcgccucugacacuucagauuuaauuaaguuuuucaucucaucuaaaugacccacaguacaguagacauuguacagcacaaaaaaaaggcaauuuuaauaauucaguuaaagacuucuaaaucaugaaagucagcauggauacuuucagcugucuccaaaugccuggaauguuuuccuaugucuauccucugcacuucacuggcuggguagucuucucugccuucuaccccaccaggcuacaaccauuugaauguccauuccuguggauaccccagggaggagaugagaaugacagucccugcuuuuuuuuucccuuuuucuuuuuguagaaacagggucucgccauguugcccaggcuggucucaaacuccuggacucaagcaauccucccaccucagccucccaaagugcugggauuacaggcaugagucaccacagccagcccaguaccugcuuuuaaggagcucauaccgaccagaguucaagcaaaaaaaaaaaaaaaaaaaaaaggucaguauguacacacagggcacuccauguggguugaaaaaaaagacaagaguccacaaagaugguacccacagaaccucaaaagugggguauggagggagagaaggagaaugagagaaggcacagaggcaggaagaacaaguccgguuuggcuggcaggagggcaucugugagaagccaucugugaagccaaauucuugauuucuaaaaagaaaagauugcuuacucugguggguaaagcuggagggcagagggcagaaccaccaaaggcuuugugcagagaacaaaauugaagccgugcuagagaaaaaccauacaguguugggcaggacagaugacaggacaaacggucugaagcucaggaagcuugacucaccaagccagugccacgugcaagcauuuccuauagaaacacgucuugacccaacaugccaaaaaccauaguucugucuacagaaaucaaggcuuucagaaaaaaguuggggaggagagaaagagagagaggcuuaaauagauauuuuuaguucaaguuccuggaaccugccccaguuugagcaaguuaagagcagugaaacaauuccuacauccaguaacaauucaagucuccugaucaugaccuugugaaaccuucccugagcugucauuaccaaggaauuauaaagcaauuaucaauccacuauaaauaaguuccuaccugccauuaaauccaccaaaaucucaugaugggcugagagcccagcacgggguccuagcguagaccuauuaccuacacuaggguagguggugugagcaugcugcugggcaguggcucucugggcucacuaugaugaugaaacaguugacucuaugaaguuuaacucuaaugaaagccccuaugacagaccaccuauuuccuuucuaaguccagacugcuuccccuccacuagcuggggagggagaggccauaugaguggagggaccuguggaggaaaaauuauuauuacuaccuugauguccgcugaaccaaaguggauggaaauuucucaggacauauucauccaaacuacaaaaacagguuacuccauacugauuacaggaugauuuaucacacauucauuaaauauagaacauugacuagcaaccaguuuccuccaacaacagauccauuuggaaauggcacacuguagaaggcaaucuugugacuuccuucuaguuguauauaaaaaauacaaaucggucagggagucagguacaaaacagugguacaaaagcaugaauagauacgccuuaucaaagaaugugcucauuucauauugcagaacuucuaucuagauucugauuuuuagaaacuuacugcugguucauuuguucggagagguuucuucacaccucucuuccacuccuaccuccccuugcuaaaauccacugacugaagaauacuuaguauggauccacauggaaccaaaauccccaacugaauggagucacaugcaucagcacaguggcuaccgguuucaucugcucacccagccucauguauuuagggacugaauucaagcuagaagcacccaacacuuuugucuuuuggaaucuaauccaagugccaauguacaucuaaaagucccauguauaggaaucucuugauuccuacaaaugagauucaagggagagaacagugaggaaagcccagagagggggcaggagacuggccacaagccagguguguacuucccuuucuuagucuguaaaugacagguugagcuggcaggacuccaugguccucaccaacugacacucaaggacuccauucuguauucugagguccauuucuauccaggcuugucaggcugagucagacaaaacuuccuuaccacuuugugucaacaauuuaaagugguuuuaacauacuucuaugauguaguuugagguuuucccucucucuccuacccaucaaagacuucauuccacugguaccaaccacuuggccaaacugauggcugcugagguuuaaaacugaaucucuggccuggugaagauauggccuuugaguaacuuagaccagggcacauuuaucuguuuuucauuaacaauuuuaacuaaauagaaauauaauucuguuagcucuucuacaggucuacuuaaacuuugaaagaugagauuguucaaaaaugacacgagaaaaucacccaucaccacuaaguuaaagacuugaauaugugagaguuccagagccucaaacuccuacuacagucacugauccauaacauuuuccucuugcaauggacuccacgccaaaguagcucagucuugcggcauguuugugcaccaaaaaguagguuucgaaagauccagcacuagucaucacugucacugccagacucacucaacugcaagucauuuccuauuuaaaaaaaaaaauaaaguaaaaucauagaaucaaacaaaaguacagaauuuaaaaaugacuuccucauaauuuuuuguuaauugccuuggcuaucacacuacaguaaaaccuuguuaauucaacuuagggaagaaaaucaaauuggcucacugaaacaaaauggugcuuuugguuaucuacaaagcacaacaauacugcauauuaggguagagcaaaggagaaguaagcuggauaacuuuuaaaugguuuaauaaauagcaagaaaauauuuaaaauaugucugggcgcaguggcucacgccuguaaucccaacacuuugggaggccaaggcagggagaucauuugaggccagcaguuggagaccagccuggccaacguggcgaaaccccaucucuacuaaaaauauaaaaaucagccacguguagugggacaugcuuguaaucccagguacuugggaggcugaagcaggagaaucgcuugaacccaagagguggagguugcaguaagccaagauugcaccacugcacuccagccugggcgauagagugagacugucucaaggaaaaaaagaaaaaagaaaaaaaaaaaaaaagaaaauauuuaaaauaacugaucaccauucggaagaacugaucacauuaaguugcuuuauaaaggcaacuuaagaaaauauccgguaggcuucccauuaagaaaggugaauacuguuaacaccaguaauaugcuaaugcaguaucugcucuggcacaccucuguccaggauagucacguuaucuuaaauuucaaaucugaacuaacgugcuuuacaaaaccccagauuccuguuuacuaggcagaauuuagaagaauauaauuacuuaacauuucaaucuaauacaauaggaauacauauaacagaaccccaguugauaccacuuguagcaaaagugauuuucuuuauuuccaaauugcuaaucucuaggccaguucuccucaaagucuauucugaggacucgggguuccaugaaacccuuucaggggggucugauccugaggucaccccuuuucuaacuaccuagaaugccagauuuucuucauauacuucagucucuauguuaaagauggggcauauaauggcaaugucuugagauauuuuugguugucauggggcuggggaggugggaagagacugguacuggcaucuaguggguagacgucagggaugcucuuaaacauccuacaaugugcaggacaaccucccacaaagaagacuuaucuugcccaaacugcccauagugcugagguugagauuaucucugccugguccacaauaguuggauuaacuagguuaacuuccccacuguuaccucuagaccuuccaacuuccuuaaaggaagguguaccaagagagaacauucaucaggguuccaaaaagagaaaagcauagaaaauuagcccucuguucaccuucaaaacaaauaaauuuuuguucuuguuuuccuguuuuacuuuaguaucaacugcauuaaaacacaccgaggccaggcauggugguucaugcuuuuaaucacagcacuucggcaguuggggaaauuacuuguacccaggaggaguucaagaccagccugggcaaaacagugagaccuugucucuacagaaaauuuuaaaaauggcuggguaugguggcucaugccuauaaucucggcacuuugggaagccgagguggguggaucacuugagucuaggaguuugagaccagccugggcaauguggcgaaacccugucucuaccaaaaaaaaaaaaaaggaucaugccgcugcacuccagccuggacaacagaucaagacucugucugaaggaaaaaaaaaaaaaaaaaagccaccacacugucuggggacaguggauucuuuuuuauaaaaguucaagauaggcaggcauggugguucacacccauaaucccagcacuuugggaggccgaggcaggcagaucauuugaggccaggaguuggagaccagccuggccaacauggcaaaaccccaucucuacuaaaaauacaaaaauuagccagguguggugggacaugcuuguaaucccagguacuugggaggcugaagcaggagaaucgcuugaacccgagagguggagguugcaguaagccgagauugcaccauugcacuccagccugggcgacagagugagacucugucuccagaaaaaagaccaaugggcagagagcaguaugguggcagguagcuccccgaaagucugguauaaaagcaaaaacagccuaucuguucauguuuuaguguuuucuagaauucacaaacaccgguaugagccaguggggaauagaaauagaaagaacagauuuuucaucucauuucccuuuuuuacuguuuaguaacucacaccuuucugcuccaaacuauuuuuaacaagauccucucccaugccuuaaacaucuuuagguuuguaaguucuggcacaggauaaauagaagcugcaccuauggcccucucucagccauaaaaaggaguacacacuuacugaggguguucaugagcugguugcuuccuuguggccggcugguuccauuggcaacggcaggccuacuguuguagggcugcuggugugaaggcugcggaggagaggcugggccauuguccucgccuccacugcuggagcuaucgucaucacuucccgaagagcucucagagucugaagagcugcucccacugcugcugcucauuuguucaauaaugucaacuucagcccucagcucuggaauaaaggauaugacauggaucagcacagcagcccuuuucaaggcagugcauuggagcuucuauaaauaguaaaucagcaaaaccaacagcaauaagaaauaauuuaaaacaaaguccuacuucucaauaccuuaaaaaauguacaaacaaaauuaccaaaacaaaaacacagccuguuuccagagacacaauggaaacauuaaauucacucaaaauaaauaaaaagcaagacuguuucagaauaauggcuguucuguguaagaaaugaauuaaguccauuugccuuuaucuacuaaaagaaaaauuaugaauauuaugaacuaugggauaaaaccauaauucccacauaagagaagacaaauauuauguaaagugguugaaaaauauuugacuaggaguugggaggucugagugcuuguuuuggauuuaccucuaaccagcagugacaccuagguagaagucaaugaauuuuccaagccacucuggaaaaaugaaaaccagacagccucuaagguccuuuccagcucucaugucccauaaauaaauggagguuugcaggaagaaccauggugacuaaauaaaaaugguaaaacaauauucuuccucuucacucuuuacauauuugacugacagccaugccugucagguacugcauuuuuuacagauauaaaauaucaauguuaacuaaccauuucaagaaaggcgccagauuuuccugucuaggcauaccauguggccuuaaauggcuauggcuccuuuaagcauaauuggcaacaacuaaccacucaugcucugauuccuauucaaccuaagugaaaacuuccauaacagcauuccaguauccaugaggaaaaaaaaaaagggacaaaacaacuguacacagugcagagugaugucugcagccguucuacaggguggaaaaggcaaauuucccagggacaacucuuuauguuucccuacuauuauuauggauuuaguuauuuuauaaaacuuauaaauaugaaauaugaccucacaacuucuaaagagucuggaggacuaaaaccauucaucgugugaaggagaaagccaagguaagcuuuuuugucucagguuugcaguggagagaaccaaacuggaccuuuaacucuuucuaggccaguaucuguuucuauugguccucauggccucuuucauauuuacacacuuuguguuagcacaggacauuugcuuaugguauuuuaaaaggcauuuuaauccuuuuuuuccccccaaaaaagagauguuauugcccaggcuggaguucaguagcuaccaacaggcacgaucauagcacacuguagccucaaacucccaacuucaagcgauccuccugccucacaguagcugaaacuacaagugugcagcaccauggucagcuccuccagccuauauacuaauguagagcucagaaagguugccaccuacgcuuaguuuucaccuccaacaccuagaauccuuucuuucuccgaagccuuagaggugugccauauggagcuuagauggaagucaugcuuguuuaaauccuaggccucuaagcagaauggcuacaaagauagccacaaacucaagucacuauuccaggacucacccuugucaaaugagguaaguggcagaagcccccacccuccccaucucugaacagugagcucugcagacauuuuuuugauggcauugaaugccccagccacuguaucaauacagcagccaugugaucuccacaagaaaauucagcacucuacuccaaguugcuaucauggauccagaaaauguucucuaccucuuuugaugucauccaacugagguucaggugagggguuaucuuucaagggagaaguuuuggguccaacuggaggcuucguuggagcucugaauggcauaggugguggagguggugguggcugugacgucuguggaggacgagugggcugcuguuccauucgggccuggauuuuacugcugcccucagcucugaaaggagauacagacauuaaauuagcagggcaaaaauagugguucucaaauuuguccaggugacugaaaacucagaagucucuguagaaccccauguucuuuccagaccacuucaaaauacugauacuuguaauuuugucaugugagcuauucauucaacauuugagugucuacuguaauccaguacuauauuauguaucagggauacagacaugaauagaauauuuacugcccucgaugagcucaaauguauagcaaacaaauguaggauauaaugaaacuaugaaaauccauuuuacuaguagaaaauacauucaugcaucccuuaacaaugaggguaaguccugagaacugcaucaugaggugauuucaucaugcaaacagcagaauguacuuaugcaaaccaauauagcauauaauuuuuucacaugaaaacccaaaugucccaccaccauaauugaauaucagucauucccccuacuugaucugcaaugccaauaucaagugccguauaucagguuuccauacaugcuccauuagaaucuuaagggaccacugucauauauguaggucacuacugaccaaaacaucauuauguaauuauaaucaugagugcaugaguuccuaaauaaaguagcuccuaaaauauugcccagcuugaaaauuuuuuccauuaucuauauacugcuuguucauuucaucacaugccagcucuugcuggcagacaagcagaauuccaucccaagcugagaauauucuaucaguuaacaauuucuuuuguaaauggacuagccuagugcuucuaaaacuuuugcuuaugcacaaaucaccuggugaucucugcagauucagaucucauagguguugagauucugcauaucaucuagguaauaugauacuguuaguucccauaucacacugaguaguaagggaauauaccacaaccaucagauauuggaggaauaucgguagcaccugguucacuguagguaaugaauacaaauaaauagaguggcaggacaggagcaaggacucugcagcacacucuccgggguaggucaagcucucuaacccucagucuccguaccuuuuuuuuuuuuuuuuuuuuuuuagauaauagcaccuuucguacucacuucggcagcacauauacuaaaauuggaaugauacagagaagauuagcauggccccugugcaaggaugacacacaaacucaugaacaauuccauauuuuuaacaaaagaaguaaaaaauaauaauaacaccuuucuaaaaauuacuuguuagauaaaacaaugcauauaaagcaucuagcagagugccugggacaugauacccccucaauaaaugguaccuauuuuuauuuucuguggaaugaaugaaugaaaaaaaaauggcuuaacgaagcauaaaaaacaucagguugugacaaucuuuacaauuuaauuacuguauuauaauaauuacuguauuauaagugagcuaugauuaugccacugcacuccagccugggugacacagcaagagaccucgacucuuuaaaaaaaaaaaaauacuguauuauaugguaacaaauagaaccacuagguuauuucuauuuauagaaugaauuuuuauuuucaaauaaacucuaacuggcuucauuuuagacauguagcaacuguugaauuaaagaguucacuauauuaaaaaauaggcaaaguuuuauuuugguauuauaguaaucucaaauguaucuuguaaaaaaauuaauguuuucacuccaguuaaguauaguauauauugcuccuucauaauuauaagucuauaaguuaucuuaucccuuaggugguacuguagcaaucaugagauuaacaaaauaggcuuaauuauaaaguauaucccccuuucccuaaugguucccauguuuuaggucuuaaaaaacauuauuucuuuuuauugcauuugaggaagacauauuuuacucugagcacauauuuacauauuuugucugagcacagguaguguuaagauuauugauagaacacuaugagcaagcagauguucacaaccuuauaaaaacugaauagauaacagagguuuggaaacaugauauaaaccugcaucuggcuauucacauaccuuguuuucuucaccugaaugcugcuacugaguuuuuccagcacauauucaccagugucaugauuaauaauaagcacacagucuuucugguaaggccguuuguuccccuugaacacagucaugggugguguggaucccuauuugccacaaaaguauaagaugaucaaacuaaacauaccaguuaugaauaucaacugaauuuauagaugacuccaccugaugaaaucuuuuaucagagcuauucaaaaagaacagguugaacugauuucuauuuuaucuccuucugguuuccgaggcaaaaauaaaggagaaauaauauagcaagaauuugugaaugugcaacgcguucuaaguaaucaaaaagguaguauaaaaguuuuaauuacuauauacguuccaagagagaaaaauuaaccauuacuuucauuauacuaagcagaguuaucacucuguauaguaaaacugugagugaucucuauuucuuugucauuagagagaccaggguuuccccuucucaugucaagcaaccaacagagcauuuuccaagagaaggucauuauccugguuggcucagaauaaauaaaucaugucacucaucugccuaagccuuucaaucacuccucaauugcucucaggccaaaggauaaaaucuuuaaacuagccacuuggccuugcacuaccgggcccuucccuggcucuccaccucacccugcagcauacuccccugcgcaugugcuucagagcagaaggcaacuggcuucccuccuauccucaagcucucuccugccucugggcuuuaacaaggcuucugccagcuuuaacaaggcuucugccagcuauauccugcccccucucuuuaaaugacccaaccuccagaucugcucacagauacuuccuuaaggaagcugucccugauuuuguagaauaacugcuauauuuucuuguauuaauuuaaacuccagaccauaagcuccaccagggcaagaaaugugcuuguuuuguucaagguuauauacuucaugccuaguaaugggccaaugugugggaggcauuugauuaauauuuguugaauaucauauuuaaugccuugcuuagaauaaaaaacugcuuggcucuuugacuccuuauuuauauaguaaaaauauagagcuagaaagaacuuuagggaccauuuuucuaaaccuuucauuuuacauaugggaaacuaagguccaaagggagaugauguaacuugccaaagguaacaaguaaucaaacagcaguuugaaugggcaauuuuuccucaccacaaagcuuuccagaucucccuguccagagacuuuucauucugucuccagcuaccgagaacuuauguuccaggacaggggugugacaugcaauaacacauguucacuaagagcaucaugugacccuuuggugcuuugucauuagugcugccuugggcagagcuucacaaaagucuuucucugcaaggguucuuaauccagcuuucaauuuaguucuucaucccuaaaucagcugaaugugccacaccugugguuccugccugccuuaacuccuggcuugguugccucacacuccugagcuguuguggccauauaaucagcagggcaccuagggcuuuucugucuggaguugcuugggagaaaagcuauaucuaaaagaggggcuagguguccagacaggaaccuugucuacucaguagcagaugggggaaaaggaagauuggggaaaacgacgaauaaucuuuuuuuuuuuuuuuuugagggggagucucacucugucgcccaggcuggagugcaguggcgugaucuugguuuacugcaaccucuaccucccaggcucaagcgauccucccagcuccgcuucccaagcagcugcaaccacagacaugugccaucacccccagcuaauuuuuuguauuuuugguacagacgggguuucaccauguugcccaggcuggucuuuaacuccugaacucaagcuauccacccacuuccaccucccaaaaugcuaggauuacaagaauuauuuuuaaucaagcaccugccuagcaugaaguccaccccaccccacuccccaaaauuacuuuuuuccuuaaguugccacuuuagaaaucuaaacauuuuuaaaaguaggaaguuuaaauugcaauaauauaaaagacaaagauucauugugaucuuacauuaaaaaaaaaaaugaaauaaacucacagggauauguggcaguguaauugugacuucaucuccuuugccaacuugaagcucuccuucacaggaagugucuauagaugcugguuuaaaaucaucuaaagggaaaggaaaaaaagcacuuacccaccagguuacuuauaauaaggguuuccugggcaucuccauuuaagaauuaaaauuauuacucagaugaauggaaaauaaaaauaauuuagaauucuuaaaaaacuguuucguuauggaaaacuucagauacacaaaaguagagagaaucguacaaugagaccugguauaccauuauccaguuucaauuauuaccaacucagggacaaucuuguuucaucuacaccuccacauacuuuuccucugacccccuuuugauuauucuagagggaaaaaagaauuuacaggccauuuuauuaaacaaagauauucccuucucccaagggagagaggaaaauugucucaucauccauaauaaguugcuuuuuuaggguugugaggaucaaaaguaacagcauaugaaacagauucugugacuguaaacucuauaugaaauaugaaaggccacagcaucaucaaaagcugauuucauuccgcauagaaacugucaaaauuaggauuugccauacucaaguuccauagcuguuuuuuguuuuuuuuuuuuuuuaauagugauggggucucacuaugcugcccaggcuggucucaaacuccugggcucaagcuaucugucgaccucggccucccaaaguacugggauuauagugucagccaccacucucagccaguuccacagcuuuaacaaagacacuucguagauguucauagcagacaacugaacuguaucuccgcaaguuauccugcucguguuucuaaacugcaguuagaauacaacauaauagccaucuuaauucacauucacaccugccucaaacugcaggacaggugcacacaugaacuauaugauuuaaauuccacauugcccuucaccaaaagaaaacaucaacuuaguaaacucuucaggaaaugauguucuuaucuuauucccaucucuucucucugaaagagcuggaucugcugucaguaggaagcauagcaauggcauggcaagugacuacacaaagaugggauuucauuaucuaaaacgcccucuucacauguguugagucacaucuauuagguccucugacaaaaacaagucuuaacaacagcguuagcaccacggaaaccagaaguucaugaaucacggagggaugcucugucagccaauuccuaacugccaaaccuucacccaggacauaggguggaagugcacucucucaacagcgucuauaauuauguagaaaaagguccggcauaaugacuauuuggacauuccuuacgccugcucucuucugcuuccaaacguagaccaaucuuuaaccuaucccaggcucacgaacucugauuugacucuuuacccacaaggaacuuggucuggaggaaaagcccgggugguauaggugaccucaaaagacauccaagucaaaugaagcacagaaaggagauggaagaagacucugaugaggcgcagagaggaugccaauucuuuggcuguagaggggacaaagcacaguauuugggaguccaggaccaagucggaggagaaaagcagggaagagaauggguucuaaggcaguggaugaggcucauaacaaacaagaagcgucuuuuaaauguggagaacccugaugggagcaucggaaaggaggggagggguuucgagggagaaguggacccggauaagaggggggagguuugccuugggggagggagguuugccuuaggggcgagguugggggcggggagggauggaaauggaaagaggccaaagaccuuuggaacuaguguuugagacugugagguagaagaauaguagggagugacgaagauuugggagaaauaaucuggguaaaagaagggacaaaucgaugucccaaaggauuugggguucgagagaaaguaacugacgcuggcaggggguucccuggaaucugaagggccgagggaagaaaggaaggagucaagguugauauguggcggcuggagcggccgaagggaaccguggggagcgcugacuuacaacgaauaguguggaaggaggcccgcggccgcuucucgaagcucuccccgagccucaggcaauguuccucgcgguccagcagcggguuugcggucccauucauggccccgcaccugccucgcacccagaucggcgcucucccggugcagccgcgauccgagcuucuggcgcuggcgucugggaggacugugcuuccgggccaccgcucuggaagacaaggagagccgagccggcacccacccggguccagaagcaaguucucuccucugcgugggggugagagaggaaucugaggaggcaaggccgugggacuuccggcgucggguaggaacuuccggguuccuagcggaaguggcgggggcggugccauggcaaaagaacucccggauaauccgaauucgugguccucagaauugguuuaggguuguuucgcgguucuucccguauucugccuccgaggcccaguggggcuggcuguggggugagugcgccuggcccuagcccugcaggugaauuuaggaacugaugacggugagcccugagcguggcugacuaaauuaacgcgggucggcuagccaucauggacgcccuccucagggucuaggggcccaugcagccuagucuauccugaggguccugagauggauccucgggaccucagccacgcgucauugggucucuuucuccacuuugcccggugauggcggugcgagggucucagucccugcaaagugacgcucccucugguuccuaugacagccucuugugagugugaucaggaaaugagcccacccaggcuuagcuucauuucccccgaaaaaacggagguccgacccuugggaaacgaugaccucacuuguaucugacaauugaccacccgcuuccagcuaaggccauugugguuuuuaagucaccccuuucgcgggcaccgaaaauugaggaauauuuucuucgcaagguuucccagucaguucuugagagcguccuuuuucguaaacuaaaucgauuuauuguaauaguugacucaucug

SEQ ID NO: 17498 - RNA, 903 nt, Homo sapiens
ugaaaucaaauccuucaucccaaaaaaguguuuuuauaagaaguggguguuuuuuucuuuccccaaaggcagacugcauaauauuuggugcuucucuuuucugaauaauuuauuccguuucaguggaaauugacaguuucagacuggagccaauaacauuuuauuuucagagcuaugcuugguacccccauuauccagggaucugcuuuugccuacaacccuaaggggaguucagccaucaaaccguuucacaccagcacaauuccccucuuccucccuucccuuugaccagcuacuaaccuguucuucugaagacccuggagcagaauaaaugccuagagagagcauuuggagaccgcauccagguauacaaaagcauggcaaguuuauuguuuuucaggagcccaaucacagaaucgauccauaucuccugacccagguacuccacucagaagucuguucuuuucacagcucuccucuacaaaacauuuucuuucuguuguuucuuuccuaagacucuacaacucugaaagaaagcaacgugauucauuucugauccgugaaaguaaacauccuauuccauuccauuugucuucuuggaagcuuccacaaaugucuccuugcuagaaaacaaaaauacaaaacuuguacucauuucuguuccagacugaaauacaugggaaacuuuuauggguccuggacuauagucuggccuucaugaauuaagaagauauuuaagagagauauaacaauagaguuaagacuaggaaaauaguuuuaaaaacuucucagguugaaaacagcagcauccaacagcugcucagaucaagagugggacuagacuuagggugaccaacugcuauggacugaacuaaaauacauaucuugaagcccuaaccucug

SEQ ID NO: 17499 - RNA, 27455 nt, Homo sapiens
uauggcgagaggugugggaggaagauuguguugucgcgagaacucugccuuugggccguagguuaguguggggccgugucucaguccacccaaggucuccucggaucgccuggagaggcacucggaccugguaagaacgcugugggccggguggaggcucgaugaccgcuggcccgcugggcccgggcuuguccgccccuucccgacccgaccgacaccgggaccggucugccuucuccuucccuucccuccccuccacacgccaggcccgggcaccucuuccugccugcccgccgggcccgggccugucuucuccccuuccggccacacgccgggcccgggccuacguucucgccuucccgccacacgccgggcccgggcuugucuuuuccuccccgacccuccucgugcccggccgugggccuguccuuuccuccccgacccuccucacacccggcucggacaccuccugcuccccgccggccuuccccucucuuuaggugugacagcuccaaguuuccuguuucucucgccucuugcuuggauguggggcgaggcgaggucuguuuugccggacgggcacagaacauaauccauuucuagcuugucagguggaaaugcaaagaagauauuggguuuuuuuggcccucugugugccaaacacauacugucacauuuaauucucccaauaaucccgaaaaguagcuugauuaucucuguuuuacagcugagaagaguaaggcuugcucauucauugguucauuccaccagcaaucauuuauuuggugccuguauguucaggauguugaggauagcaaugaaaaaaauggacaccuaauucucauggaacuaaauucuuguuguggggaaaacaauaaucauaaucuuacguggcacgggauuuaacauggaaugaugccaucaagaauggcagaaguagaaugacagaagucagagugcugaauuuaucugaccccaaaggcagagcuuuuuuacuuuuaacugugccuuuuugugucacuuucuaaucagggucggguucaccacaguaauugccuuuuggauggacuuagcuuuccaccacgcacuugguaauuuggaacuaaguuuauagagacucuugaguuacuuauuggaaugaggauggcacaggaagucauaguuggcccauuuuuauaccgagauccuagugugacauuuccaaacuuuaaaguacuugagaccguuugagaaagacuuacccuaaggaugcaguggcuuaggcaauuuacuugguuuucucauuugaagauuugcuagcuugcagauuuguucagauaaguaaaugagauuauguauguaaaguccagcacaauaacguuccuuucauuuucuccuuuccugccuuccagggagccuuuguccuugggucucuaaggaaaauccuacucuuugaaaguuuugugguaguuuuuaucuaaauaaaucucuacaauuacauuauuaccuuugugcaaacaggcauuucggaaauggaaaaacauguugagcuauggaaggggaggaagauguccuucucaaagggagagaagauauuuuagaacuacauaguaccccucaccccccccuuuuuuuuuuuuuuauuaaaucaguauagcugugccagaaucucaggauccgguguagggguuucauaaaacuccauaggauauccugacacauaucccucccccgguugagagucccuaaguuaguguuuuauaauacuuucccucacauaguguuagcauucagagccagucauugcugcugcugauggacuuugaacucagucucuuauuucaaagaauuaguauuuucugcuugguuggugaaucuaugacacgaguucuccucuagguggcaagcucaccauuguguucucagggacuaucacaguagugucaguuuagguacucaauaaauaguuguuggaugaauacauaauaccuuaauacuuaaugauuccuucaacauaccaggugugguuagggacuuuggacucagaucugggauuaaaucuuggcucuucuacuugggaguuugugacuguagguaauauauuuaaccuugucaagucugcuuuuuuuuuuuuuuuaauuaauggugaugauaauagccacuuuaaugagggcuaauugagauagugaguuuuuuaaaaaaaggcucggcacauaguagacuagauguaaauacuuacugaauucauuuacucaguaauuaauuguugaacaccuacuauacaacagugaacaaaaagacaaaguccccgccauguggaacuuaccuucuaguauguuuucugaagggagaucagaaaauaaaugguugcuacgugccagacugugguuaguacuauggagaguaauaaagcauauuaagggggauuggaggcaagacuuuuaaaaauaaaagauggugaggaauggccucaaugagaagaugaccucugagcagacaccugaaggaagugaaggccugggcucgaggauaccuggaggaaagcgcaagggcccugaggcagaagcauccuuguuaagcuaaaggagcagcaggaggagaagaguaaggguagaggggaagaguagguagcagucaugagguuucugcaagaguccuggagagagaugaugguaaugaaauugaugaacuuuaugucuuucuuuguuauauccuguucuuugacuaaaaguaauaaaaauagguaauacuucuauagcucuuaaugugcaucaggcacuauuuuaagugcuuuacauauauuagucaucagaucuuuccaagaaaguauaccuagccucagaaaaugaagauuugucacucuuuaggauauacaguggaaugugcugcugguucagagagcacuuucucaagcaguacugaaaucagcagugaauucacugccucuguucacauacugguuagguugcaaaggcaagccuaaagugucgauaacagaccacccaaccaguauguaugcauuggguuaaguucaguuucauggaagaacuguagaaggccauggcauuuuuuauuacucuucuugcuacuuuuuaguccuuuuaaaauuuucauccaagguuuucaucuugacuuuguuuucauacaguuaugucuggacacauugcuucaacauagaacgcacaugaacaauguggaggucuaggcuggaaugggggcccaguugaccacuuuugcucuagcugguaggcauuaauacuaucuccaugcaugucaguuagaggagcugccauauuguccuuagcuuaucuucuuugauuguuaaaucauaacauugcaaugcuuaacuucugauaugaaugacuacagucuuaagucuuaaucauucuuuuuuuuuuuuuuuuuuuugagacggagucuugcucugucaggaggcuggagugcagugggcgaucuccgcucauugcaagcuccgccuuccggguucacgccauucuucugccucagccucccgaguagcugggacuacaggcacccgccacaacgcccagcuaauuuuuuguguuuuuuaguagagaugggguuucaccguguuagccaggauggucuugaucuccugaccugaccucgugauccgcccgccucggccuuccaaaguuuugggauuacaggcgugagccaccgcgcccggaccacucuuagucauucuuaucccaaguugucaucccuaauuuugcuuggcuugauuaaucaagauguuccucuuugggguuagcaguguguuugggggcaccuuuggggcuuaauauuccucuuaugcagcauuaccuaagugcucuacaaauauggcaguuugguucagugaaguagugaguagcucacaaaauagguuaaaagguuuuguugucaguuuggucaugggugagaaguuaagucuuuuaauacugagacaauuucagcuuucaaaagaagauaaucucagguguguuuugagcuuuauuuuggcauuauuguuaguccucuaggcuuuaaaggagggaaaauauuaauauuuuaucacuuguuggcuucuauggggagaaccacaaaguguuugccauauaaaaucaggauaaaauggcauuauuacugugauaguagguaaguuaacauauuuuccuauccuugacucuauuauggcaagaaguuucaaguugaauauaguccccccaauauucaacuugaaauucaguuagaauuucugugguacugccaacucugaagaaaaaauccagaguuggcuguaaaauacaguaaauguguccccuuuaacccacaaucuugcugcuauuugugugaauccaugaagcugagcuuugugguucuggcagcaggaaagacacuaucucagcacuuauucugggaucauacuuucaguggcaacacccuugccagcuuugucuuguuugaaaaaagccaaaaguaauaguugugcuagaaacauuuucuuucucugaaaaaaccuuccugcauuaauacaggccuuagugggacaucaaguugauuaucuauguuuaaagcagaacuauaccauacuuacuguggcuagucugaaccuaaacauuaauuuaucauauauucauccguuuguccaaaaugucuuaggccucuguugaauuuagggugaagcauuguacaauugccagggacauuuucucuuuaugucgauucaguggcacacauagaaugugaacgguugguaaugacaagguacugauaccagguugucugcuuaguauuaggauguacaaagcuauuaauucauaaauaagacaugguuucuucucucauggagcccucaggcuaaggaggcaggcauguaacaauaggguaacauauguuacaggcguccugccggaaacccauacagauuacagugguaaugcaggagggagcagccaacucuauuggccaaaaguauugaggagugaggugcucagucaggaaaggcuuuguaguuagugauggugacuugaaaagcagauagguagggagaagaggagagacuggcauugcugacagaacuggcauagccaagcugcacaagauaaaccaaacuauccuaugcauagaaaagcuguccaguagauuagggugugggagcuguucugggagacagcaggagagucagagugaggccaggaaauagacagcugugaugguuaauuuuaggugucaacuugacuggauuaaggacaucuagaaaccugguaaaauguuauuuuggggugugucuguuuccagaggauauuggggugugaauccaaguggauuagguggggaaaauccacccucagugugugugggcaccauccaaucugcuggggcccagagagaacaaaaacauugaaaaggcagaucuauuugcuggagcugggauacauucuuccucuccugucuuuggacaacagaacuccaggcuccccaggcuuugggcuucaggacuuguaucauuggcccccuggguucucaggccuuuggcuucagacugagaguuacaccaucugcuuuccugguucugaggccuuugcacuuggacugagccaugguacuggcaucccagggucuccagcuugcagacagccugucaugggaugucucagccugcuaaucacaugagccaguuccccuaauaaauccccucucauaucuauaucuguauauaucuuuaugucuauaucuaugucugucuauauaauguuccaucucucuggagaacccuaacucaggagccuuauugccuuuaaaagaaauuuggacuuuauccuguaggcaaauggggagccauaggagagcuacgcugcuuuagaugagaugaucuacuugggaugguugguuguuguuuugagacagcauagaaauucuugaagcagaagagagguaaaauaccuuaugcauuuuuccccuuuagaaccuaaacauuuuauaaagacacaagggcaaauacugaagcauaagggaguaaaaagcuacauguaaaguggucugagugcagaauuuuagauuuuugugauuuucuuucuccuuagucuuuuuauguuuauguaauauuuaauaaaucacaucauuauaguaacagcuacagcuggcuugaggagagaaacacaaaugaauauaacugugaaacucagugaacauauacauaggggaguagcugaagacuuuacugugcuggggcguuggucaggaucuuuuagagagagaacagagaccguugguuaaguaggugacggccaacaaaguuucuuuguauuuacauugugaucagccauuuuucagaggcacauaaaauagaugaaaguuccugacaugaguuauauuuuaauagaauuccuucuuuguugccauugauguaaauuaguacaaaggaccauaaaauuguaacuuuagucauucagaaguaugucuguuuuuuuugugucuuuacgaaauguauuauccaaggagggcuuuuggaauuagggagaaauuuucuuauuuuugauaaugaaugccuggauuggggucccagaaauuguaugcaucacagacaaagcaggcacuuccacucuguucaucugaaaucuaagggauacuuaauuuaggguaauggcuccuuaguguuccccuuugguguuucucaugugauuuugcuuuacucuuaauauuaacaaaaacagcuuuauaugcauagacaacagcaaguauuuuacauucaaaaaaucgacugaaagguaauagaauuacaacauugucuagauuucaucuuuuggccugauugcauaugcaggcuaugaggauuaucuuggagaaaagggaaagcuagaaguaccauaagcaugauagucacagguagguagggcuauauugccaggcacuguccuaaacauuuuaauucauguaauucauuauaguucauauauaauucucauugaguugggcccauuaucggguggagcaaguggggagaggagaggcuggagaggagccccaggugccauccgagguccuucuagcuggccuuacccugggggccgggcgggggcagcaggcgucuagcagggaggcccagcggggagggagcugcaggggggccgcgagcgccagcggggacuggcugggagcagggcaacaaugggcggaguuuuccgcuccuccccgcccuuggcuugagcgcuccagcucgcuaguggcccgggcgaacuggaguugccgugugacgcgugggcgggacgaggcccgggcucggggaccuuucgcacucgggucagggguaaagcagccugucgcuugccgggcagcuggugagucggugaccuggccugugagguacgucuggcagcccaggggccguagcgggagcccuugaggccgguagccuugcagggcuggcgccgggcaggagccgggucgcagcggcugacugcacaacugcgugcgaaucggcgaccggggcgagggcaagggcuccugaggccgcuuggaaagggcuuuugggaagucuagaaagccgcaugagucacuguugcuuucguauuagaaaugccuuguuuucgaauuagaaaugccuugcggucgguuuucaguuacuacuuuagaaaauugaugugcugggauuuauugcccucaguugcuuguauaaagguggacaaaucugagccuaguaaacucugaaguguuaaaucuuaaaauguucaauagugaauuuauuauuaucuuauuuuaaaucuguugcgauauuaacguuuguuugugugguuuuaaaaagauuacagagaaccagauucuggauuucagaaacugcuugucuugauaaggaauuuaaaaugggcuggggcuaagguaagauguauauaauccuugaguuaaugaguuguauaaaaaacaaccuuuaggccgggcgcgguggcucacgcuuguaaucccagcacuuugggaggccgaggcgggcggaucacgaggucaggagaucgagaccauccuggcuaacacggugaaaccccgucucuacuaaaaauacaaaaaaauuagccgggcguggcggcgggcgccuguagucagucccagcuaccugggaggcugagacaggagaaugguaugaagccgggagguggagcuugcagugagaucgcgccacugcacuccagccugggcggcagagcuagacuccgucucaaaacaaaaaaaaaacccaaaaccaaccuuuaaaaaaaagacggaagaaagaacgugugaagugaaaaaagucucaagguaaaauugcaaaauauuuuuuaacauaauuuuuuuaaacuaaaagcuuuacagacggucuaaugcagguugucucaucaaagauaaccaaauuguucaguuaguauuucgaguguaguacucauagaacacauagguauccuguggauagaugcugcgcuuggccuuuuagcaaugacuaggaugccaggcaaauaaguaaaaaguagaggucuuuggaggggcaggggcagguggcaaggggggcagagaaugugagaguuggaaggugagguuacagaugaucuagucugagcuuucauucuuacagacgaaugaagccuggaguggcugugauacagacguugaaucaaaacuauuugcauugguauuuggcaguguuuugguuuuucugagccuaucaugacauacaaggguacuguuuauuuauuuauuuauuuauuuugagauggaauuucgcuccuguugcccaggcuggagugcaauggcugcgaccuuggcccacugcaaccuccgccucccagguucaagcgauucuccugccucagccucccgauuagcuggaauuacaggcaugcgccaccacgcccggcuaauuuuguauuuuuauuagagacaggguuucuccauguuggucaggcuggucucgaacuccugaccucaggugauccgcccaccuuggccucccaaagugcugggauuacaggcgugagucaccgcgcccggccaguacuauuuuuguuaguguuauccaaggcagaagauucugaacaauugugguuauaauuuacugaggacuaugaaaauugacugaaaaucuuaacggaaguuauuucaauaguaauccauuggaauguuaauuuuaaucacuaguguuggcaaguaaaaauacuuuacaggugauaauacacuaaaggaagaacaagcucaucugggagagagaacccaggacuagaccuuggaaacuguaguucuaaacccaaaucuuaccccuucuggcuguggcccuucagaugggucacuuaaacuaucugggcuuuuguggcuucauauguagaaugagaguguuauauuaaagagaugaccaagauuuuuuccagcuuuauuuuuuauuuuuuuaaagaggcuugugaggagcuauuuuucagcuuuaaauuguaguuugugugggucacaagaguuaaagcucuuuggaaauuuuaugguuaagccauacaguaaugacuuagcuucauuacauaaccacuucauuugugguuaguugcucaauucuggugccaugaucuucagacuucacaaauagauuugugcaaagcauuguguaagcauggcauauauaguuuaaagaauuccuuguugcggaaacuccagguuuuguuauucguuugaaggguauguguguuuccuccuccuuuacuuccuccacccccaaauuuaggacagggauacuagaggcagggaaguuuuagaaagcacuuaaacuuuuaauguugucucaaaacauaaacauuuaaggcaguccucuuuugaagauggcaaggcaauauuuuggauuauaauggugaagauaaaaagacauuuuuaguaaucuuuuauugauuugaauauuaggaucagagcugauuugguccaaucuuucuacacguaagaaaacagucaaaaauauccauacuugguauauauuagaggauuuagacuauugaguuuuuggaguaaauaaaagauugccuuuugcugugcuguauagugaaagacuagauggaaaucuaauauuuauuaaauaagcacgaccuccuuaccccuaagucugugagucuauauuccucacauaugaauuaggaaguuagguuccacaagggcaaauggugcaaggucauagcccugauaaauggcuaaaggauucugucagguccuguucacagccugucagcuaaaccugauaacaauaaccacugcaauguggagggcuuacggugugcaggugcuaggcuaagugccgguagacauauaauaucucacuuuaaccuuacugcagccccucuguagcaaccauccuugucucccuuuuuccugaggaaguugaggcccagagagauuauguuacuagcucaggggucucaagcuuggagacacagccauaacucagguuugucagacuccagagugaccucuuaacggucaugcuugcuacucuggcucuugaaccugaaacaaauggugaauaacuguugaaaauggccaugugaacuaguuaccucauacaagucucuuuggauguaacauuucguacagcuggcuuaggcucauugugauuugaauucacccaugguuggggcucuucauuuccgcucugaaggcuuccucuucaucacagugcaagagggcaagccuuugcauagcuccuuucuuggcaucugggcucugaaagcugacagugcucuaacugcgccacagggaggaggagggacagagagagccaaaggcagcaaaggggcaagcauccugggacuuaccauaaagaaaugaaacagauuuucuucguggcugacagaugaguucucaagaugacuuuugaaggauaacacuccuuuuaauuugaaaaaaaugugauaacuguguguggaaaaaucaguuuuguaacuuuuaaaucucauccuacauucugucuauagcugauaagggcaaaguccaaugugugaacucuugcuguagucuacucuuauuguguaauauuaauacuugugauugaauugagaggacuugcuuuaggaaucuaguaauacagucagcacuguauguauuugaguuugucucccguauguuccggaauucuggaguuuugacauugugaagcaacaauuuaauuuuauugauucaauuuuacacugugccaggcauuguggcauuccacacaaauggugagaagcuaaaagugagaaauuuggcacaggugaagaaggcuggguaacacauuugaaagacugcuaaacaggucuugcaugacuggccuaagugcaaagugaagcagcccaucacgcuccagcucuccaaaucggagccggcauuucacccaugugauacagguauuuuucauagucccugcagugaguuccaagugcacacuaaugcuucugccuaacacaggcagcuuauggcaugcaaaaggaggcugcaaaguaaccacuguugguguguccaggguuagaaaaauuuccacagggauuucugugaaauccaauuaaggcagcccuuucuuuuuaauagaugauuauggagaaaagagacugacgaaacaaaaucagcaaggggaaguuaaaaaauuuccugaauuguucaguuucuuguggaaacucuaguuccugaaucugagucuuuugcugagauaguguacagaaaguuuguuuugcugcucuucccacuucccucagaauacauuauuucugagggaagaacucaccacuuuugucucuagccagcuuucaguuaggcaccuggcccuaaacuuagucuuaaagaugcagucaaggccuggcaaaguuccuuugucugaaaugggcagucaagccacuuggaggacucuacacuggguaggccacuuuucaccccaaagcuggcuucuccaagaaagucauugcuuucaggacuguuaggaaguuauuugauauauugccuaacaugccuccuauuaauguuuuuuacccccuugugucuguuccaaacaaauuuaguucuucuaguugacaggucuccacauacuugagaaugguaaucauguccuccuggagacgucucuuaucuaggcuaaacagccuuccuuccuggagaaguguuucaugguuuugaggccucucucccuuuucuaaguguccucuucuaaaguguguuacucagaaauaaguuuugaauuuagucuaauaaacauggaacaggcuaauccugugacaaacacuauacuuuugguaaauguagucaaauaguguguaaguuauuuuuucccacagacccagcacacugcgaauucauagagaauuuacuuucgguuaaaaauuuccacccuuuaaaaaggaauuauucucuuccuugcccucccuaauuaaagugaaaaaacuuacauuuuguuuuguaaaauugaacagcuauguagagauuguuuugggaucuguuucugucacagccccauguuaccuccagcuuuaauguuugucuuguguguuuucauacagguaauuaggaaaaacagggaugugccucucaaaacuuuacaaacuggccuuagucugucauccuuugaguauuuuguaaaaaauaaucuuauuauucaguuuaauugugcuucucuuuagcuaauauucacuuuuuccacagugauaacauauagucuugccacaagucuucugucaucccuuugugucuacagcauuaccuugacuugccaguuuaguaaaacaauccaaaaggaaauaacugguaucacaaggcuuagugaaccuauucugagcucuaguaaucacugcugucauuuucucaguguuuaaaaaucaugucauuguucuugcaguagcuuuugucaaguuuuacguuauggcuuuacugacacucauguguuacagucucauuuuaucauuauaugcuguucuucccauuuguguuuccuuucgcuccuaaacccaagcuucuuagagaacucuguauuuacccacaccaauuucugugucuccuuuauaugagaaucaugaaaucauuuugucacauauaaucuguuacauauaaugcacauucuuuuauauauuauauauuacauauauucucucuauauaaaacauguaucucuauaucuguuauauucuuuuuuguuguuguuuugagacagaguuucacccucuuacccaggguggagugcaggugcaaucacggcucacugcagcugcgaacuccugggcucaggugaucuucccaucucagccugccaaguagcugggacuacagaugcacaccaccacauguggcuaauuuuuauauuuuguagagacggggucuggcuauuuugcccaggcuggucccgaacuccuggaaucaagugauccacccaccuuggccucccaaaguacuagaauuacaggugugagccaccgugcccggcccuauguuauauuuuugagaacuuccuagcugugaagucauucuuaaguucuuccuaaauaaaaaaaaaaguucuaccuaaaagggggaaauuaaaaauuccgucuucuaaacaaaguguucuaaacuugauuguuugcagcuuauuuugaaaguaaucaaagauccuucuguaccuuuuagucuucaucucuaaaucuacaaagaggaacacaugccucauaugacuauauguguguuauaaauagaaaaugauauucuaauguucuuuuaacuuuucaggacacuguaugcucuuugauucaggacaauuaguguauuuuuccagaaauagcuauucacauguaaagugucacuaaaguagauuauagaguuuuauggcaggaacagugguagagggaagggaggagacaauauuuauuaagaguaucuuaugugcuagguuugguguuggaaaguaaucuaaguaguuaguaaugggaguuggcuggaaugaucauuugagggaugauucaaaggugguuuuugguuguaauuauggugcuauuuauauauauuuuuuucuuuuaaaggagcagugaggagaaugaauaccuuccaagaccagaguggcagcuccaguaauagagaaccccuuuugagguguagugaugcacggagggacuuggagcuugcuauugguggaguucuccgggcugaacagcaaauuaaagauaacuugcgagaggugugacaugugcuuuucucuucuguugucuggacucuugacacagggcugauuugagcauggccaaggacuuggucucuccgugccagcaaaaaauuucaccccaugccuugcguggucuacuugguccccgucaguugccugauauacuggugccuuucaucccaaggggaaauaaggcagaugcuagaagagucuggaaaacccugugccauucuagaaaauucuauucagcuuacuuagauuacuaacuacuuagauuuuugauuacuccucugugugauuccucaggcacugugaccaguaaaaauaugaaaugagugagcaguauccucucagcugcauccucuugauugcaugaaggaugcacuugagcauccuccccaucaucuuuuagcugguuaauggcauuguucuguaaaugacuaucuguuagggcaagccagagugaaaucuguuguugguuccaguaguauuuuguuguuguguguguuagaccaaguauuacaugacuuugaaacacaacuuuauuaaacagaaaaaaauguguuuuaaaauacaguuucuuauguauauugucacggauaauuuauggccuguuuugacuuuuucccuugggauuuuuauauuuagcccuguuugaaucacuguuuaugcuuccagaaauauuaguuuauaauuuuacuuaaauugucuacccuaauggucuuuuagcuguugacaugugguggcacaucucuuuacuaaauuggccuccuguaaauggaccgcucauucuguggggugagaaaagagauaaggggcuagcuauuaaguuaauacucugucuuuauucugcugauaaacuuguaaaaccguagguuuuuaaauuauguggaaaacugagggggucaguauuuccugguacauucuuguauuuucucuugauuaggacacccaaauuaaaccuaauccucuuagaaggcuggguauugaagaaggauuuuagaguuuagguaugccuuuauggcuaggauucuuaaauugggguccauagggcuuuaguggguccuugggugggcuuuggaacacuaaacccugaaauuauagguaaaaucuugaaaauauacauuuuuucuggggagauacuucauagaugucauuggauaauuaaaaggauuugugguccccccaaccccacccccccaaaaaaaguuuuagaaacucacuauucuuugggaaacaucauucuuugggauuaacacuaggaagcuaacauguauguguuuccuaggucaaagcucagauucacaguugcauaagccgucaccuggaaugucuuagaagccgugagguauggcuguaugaacagguggaccuuauuuaucagcuuaaagaggagacacuucaacagcaggcucagcagcucuacucgguaaggugacugcauggcuagaauugguuugagcauggcuucugguugccagagaguaucuuccuuguaaugcaguguuaauauagaucagauagaaguuuaaucucaagugcuguuugguaacuugaguauaucuggugcuuuuggugucauuguggcuaguugguuucauuuuucuuuuaguuauugggccaguucaauugucuuacucaucaacuggaguguacccaaaacaaagaucuagccaaucaagucucugugugccuggagagguaaugacccuuuuugcguauuuuaacuuuugacucuugaacuuugguauacuaaaagaaagucgauuuuguaacucauugcuuguguuauauuuaacuucuguguugcuaggauaagaucauucugcuucauguauuuaauauuauacuugcugauacaugaauaagccaucuaucuuugguugaguuucuuagagaaguguaaucauuuaaaauuacucacaauuuggcuuuuguuuuagaugaaguugaugaaacagauauuccuuaaaaauagccaauuuuguuuuuuuuuccccagacugggcaguuugacccuuaagccugaagauucaacuguccugcucuuugaagcugacacaauuacucugcgccagaccaucaccacauuugggucucucaaaaccauugugaguaaucucauaugcuucacugggcacuucucauaucuguggccucacagcuggucuuaaaaaaaauugcuaugaauagugacuuucuugagaauuugauuagcuucaaaaauuucauguucucagcugggcgugguggcucacgccuguaauccuagcacuuugggaggccgaggagggcggaucacuugaggucagaaguucaagaccagccuggccaacauggugaaaacccaucucuauuaaaaauacaaaaaaauuagcugggcgccuauaaucccagcuacuuggaaggcugaggcaggaggaucgcuucaagcugggaggcggagguugcagugaccugagaucgugccacugcauuccaaccugggcgacaaacagugagacuccgccuaaaaaaaaaaaaauucauauucugauuaaguugccuagguugguaguucuuggaauguaguacagacucagugauacucuuuggaaugccucauguaucucucuaaauacuuuugaaauauuuuuuguaaaauuuauggcuugaauaguuuuuaauaaagaacgaaacguuugggucuuguuaaaagugguaauacaaccaauucugguaaagauuuuuuauauaauaguuaugugguagaguauucucaaauuugauaacuacuuuguaagucauggaauuuagugugaacaguauuucuaaugaaaugguaaugcuuuaacauuuuugaaauuuggaauuauaauuucacuuuuuuggcagcauagcauaaauaacaugauuaaauuaucucuauuuuguagcaaauuccugagcacuugauggcucaugcuaguucagcaaauauugggcccuuccuggagaagagaggcuguaucuccaugccagagcagguaaaauaucauuuuguuuuugguaauugagucauuacuuggcuuauacuuccuuuggguuuuauauagcauuaaaaaaaugcuacuauuuguaaaaaggcaccaguggcaaugaguuaguuuaugaaauugaaugcuucccuugagaccuaaugccaaauagaaauuuagaugucuugucggggcugauuaacagaaaaaguaauuaucaaucaguucacaggaaauuaucauuagcugucuuacugauacugguucucugugagcgauccucuuuauaauuuguagagaugauuuauuucuaaaggaauggcaaugugaauaaagguuucuauauguuuuaguugagaagagcccuagagaucagcugugugucucuuguuuuauaauugugaaaauugaggcucuuggaaggcacaugauuugcccagggucaguggcaagccaagauuagagaguggcucuucucuuuuucuggugaacuuucuacugcauuugacauuccuuguuuugugauuaacagaagucagcauccgguauuguagcugucccuuucagcgaauggcuccuuggaagcaaaccugccagugguuaucaagcuccuuacauacccagcaccgacccccaggacuggcuuacccaaaagcagaccuuggagaacagucaggucuguugcugcuuuuauuguuucuacaguagacacagcaguagguggaguuaguuacuaaucaguaguacuaugugucauuguuaacuuuuugguugcagucuggaaacauauuuauuaauagucucuucaucauagaaaguuuagaaaauaaggaacucuuuaucauagaaaauuuuaaaaauaaagaauuuuauauuaaaaaagcccacaaacccauaaucucaacacaaagagaaaaacacuguaacaauaaaagugaaguauuuauauacuucaguuuucuauacauacauauuuuaaaagaaccauucuguaaguccuguuucgguagguagauuuuuuuuuucaccaggauaacauuaacauauuucucugucauuuaauuucuucuguaaaguauuuaguaguauauaauugauuggcuguaauuuaaauucaaguuuuucuggauauaaaaaaggauucccuaaacauccaggagccaauuauuugugugcauucuugauuaguuccuuaggaguacauuuauagaaauugcauuccuagauuauaauucugcuuacgcuuuaagacuuuggauacauauugccaauuuggcuucccaggaaguugccaacaguuuauagucucaccagcagaauauucaggguaccugcuucccugaaaccuaagaguaauagucauuuagguuuuuugcucugaauuugacacaaaauagcaauuuugcuuuuguuuuuucuuccauuaguaaggagguugaguauuuucuuuuuucguuuuuuuuuuuuuuuuuuuuuuuuuuuuuuuuucuuucuuuuugagaccgagucuugcucugucucccaggcuggaguguaguagugggaucucggcucacugcaagcuccguccugcggguucaugccauucuccugccucagccuccugaguagcugggauuacaggcgcuugccaccacacccugcuaauuuuuugcauauuuuuuauuuuuuaguagauacgggguuucacccguguuagccaggauggucucuaucugaccuugugaucugccugccucggccucccaaagugcugggauuacaggcgugaaccaccguacccggccaaguauuuucauguuuauuaggcuucuuugaugacuugccugaucauauccuuugcuuauuuuuugugcuuuauuuguaaaggcauauuacacccuuuucuaucagauaagaguaucuaaauagagaaaucccuugccuuuuggcuuuguguacuuaaauuucaaaacacugggcaagacaguaaauaugcagacagggccgggcgugguggcucacgccuguaaucccaguacuuugggaggcugaggugggcggaucacgaggucaggagaucgagaccauccuggcuaacacggugaaaccccgucucuacuaaaaauacaaaaaaaaaaaaaauuagcugggcgugguggugggcgccuauagucccagcuacucggaaggcugaggcaggagaauggcgugaagcugggaggcagagcuugcagugagcugagauugugccaccgcacuccagccugggcgacagagugagacugucucaaaaaaagaaaaagugcagacagaaucuccaaagcagucauaauuguucuggcaaacuaauacuguguacuuuuuguguagacuucuuccagagccugcaauuucuucaauaaugucgggggaaaccuaaagggcuuagaaaacuggcuccucaagagugaaaaaucaaguuaucaaaaguguaacagccauuccacuacuaguucuuucuccauugaaauggaaaagguuggagaucaagagcuuccugaucaagaugagauggaccuaucagauuggcuagugacuccccaggaaucccauaagcugcggaagccugagaauggcagucgugaaaccagugagaaguuuaagcucuuauuccaguccuauaaugugaaugauuggcuugucaagacugacuccuguaccaacugucagggaaaccagcccaaagguguggagauugaaaaccugggcaaucugaagugccugaaugaccacuuggaggccaagaaaccauuguccacccccagcaugguuacagaggauuggcuuguccagaaccaucaggacccauguaagguagaggaggugugcagagccaaugagcccugcacaagcuuugcagagugugugugugaugagaauugugagaaggaggcucuguauaaguggcuucugaagaaagaaggaaaggauaaaaaugggaugccuguggaacccaaaccugagccugagaagcauaaagauucccugaauauguggcucuguccuagaaaagaaguaauagaacaaacuaaagcaccaaaggcaaugacuccuucuagaauugcugauuccuuccaagucauaaagaacagccccuugucggaguggcuuaucaggcccccauacaaagaaggaagucccaaggaagugccugguacugaagacagagcuggcaaacagaaguuuaaaagccccaugaauacuuccugguguuccuuuaacacagcugacuggguccugccaggaaagaagaugggcaaccucagccaguuaucuucuggagaagacaaguggcugcuucgaaagaaggcccaggugagcauaaacaucaaaauagcacugguuugaguuuuauuuauuuauucauuuauuuugagauggggucucugucacucaggcuggagugcaguggugcgaucucagcucauugcaaccuccccuuccgaggcuccagccaucccccugcccgcacuacagccuccugaguagcugggaccauaggugugcaccaccaugccuggcuaauuuuuuguauuuuugguagagaugggguuuuggccugggcuggucucugaacuccugagcuuaagcgaucugcccgucuuggucuccuaaacugcugggauuacaggcgugauccaccacacccagccuagaguuucauauuucauaaucccaaaccuugcaaaccggccagccagauccuuaaauauguuaaauacuaaauuuggaauggaggauuuaugauuuuuuugugcauuuuccaggccuaagccccauccuucaggaaagaaaagaaucuagccuguuuuauugcuauuuauggaaaauauuugggguagaaauaacaauugucaccuuuguuuuugguuguuacagagaauggccaacauuuaaauuauucucuguagacccuauuuggaagauaaguuggucucaugccuccuuguuuucaugaagcaaccuacucuuuucuuuuauugcaggaaguauuacuuaauucaccucuacaggaggaacauaacuuccccccagaccauuauggccucccugcaguuugugaucucuuugccuguaugcagcuuaaaguugauaaagagaagugguuauaucgaacuccucuacagguggguacaugccaccagcaugaaaauuagauuauagcuauuuauaaaauaaauguuuugucuuacauaugaagucauacuuggcucacugaaccauaucccuuuuaauaguauguauauuaggcaagugagggugggacgggggagcucauaaaaaguugauguauuuuaauugaauuugcuuuauuaacuaacuaggcauacuucaaaaugaacuuucaagauguaaccguugggaauuuucagaucccauguggauucuaguaguuuauauaccuaccucgaagguggguuugguuccaggccacugcaauaaagcaaauaucccaauaaagagagcuacacaaauacuuugguuucccauugcauauaaaaguuguauauaauacacuauaguuaagucugcaauaacauuaugucuuaagaagaaaccaauguacauaccucaauuaaaaaguauuuuauuacuacaaaaugcugauggucaucugagccauuaacacauaaucguuuugcuguuggagguucuugccuugauguugauuacugcugacugauuaggaugguagcugcuugaagguugggauggcucugucaguuucuuuaaauaagauaaugaaguuugcugcaucgauugacuuuuccuuucacgaaauauuucuaacaugugaugcugugugauagcauuuuauccacaguagaacuuucaaaauuggagucaaaccauguugcugcuuuauccacuaaguuuauuuaauauucuaaauccuuuguugucacuucaacaauacacagcaucuucuccaggaguagauucuaucucaagaaaucacuuucuuugcucauccguaagaagcaacugcucauccguuuaaguuugaucaugagauugcagcaauucagucacauauucaggcuccacuucuaauucuacuucucuugcuguuuccaccacaucugcaguuacuuccuccacugaaguccugaguuccuccaagccauccaugagggugggaauccguuucuuccaaacuccuguuaauguugauauuuugacuuccucucaugaaucaugaaugaucuuaguggcacccagaauggugaauccuuuccagguuuucaguuuacuuugcccagaucuaucagaggaaccuagguagcuagggccuuaaaaaauguauuucuuaaauaauacuugaaaguugaaauuacucuuugauccauaggcugcagaauggauguuuuauuagcaaacaugaaaacauuaaucuccuucugcaucuccaucagagcuuuugggugaccaagugcacugucaauggguguaguauuuugaaaggaauguuuuuuucugagcaguaguucucaacagagggcuuaaaauauucaguaaaccaugcugugaacaggugcgcugucauccaagcuuuguuguuccauuucuagagcacaggcagaguagauuuagcauaauucucaagggcucuaggauugaagcacuggcuucaacuuagccaccaguggccaggugcaguggcucaggccugcaauuccagcacuuugggaggcagagguaggaagauugcuugagccaaggaguuuaacaccagccugggcaacauacagagacccugucuguacaaaaauuaacaaauuagcuggguaugguggagcgugcuauagucccagcuacucaggaggcugaggugggagaaucuugugucugggaggucaaggcugcagugugcuauaauagcucugcugcggucuugccugguugacagagggagacccugucucaaaaaaaaaaaaaaaaaaaaaaaaaaaaagagucacuggcuguguuagucccuaacaagagaguccaucuguccuuugaagccaggcauucacuuaucucucuagcuaucaguucuagaugacuacuucuuccaauaggaaguuguuuugucugcacugaaaauguugaguguagccaacuucauuuacgaucuuggcuagauauucuggauaacuugcuacuucaccuugcauuuuugcuauggagauggcuucuuuccuuaaaccucaugaaccaaccacugcuagcuucaaacaugacuucugguuccugaccucucucagccuucauaaaauugaagagaauuagggccuuacucugggguuacgcuuuggccuaagggaauguuguggcuaguuugaucuccuauagagaccacuaaaacuuucuccauaucagaaauaaggcuguuugcuuuuuaaauuauucaucuguucacuggaguagcaccucuaguuuuuuucaagaacuuuucagccagagaaugagaagcugaaaaacaacaaaaaacuuugcuuuugugcucacagcuuggcugguccaaaaggccugcccagcuuucagccucucguggccuucaacaugacuuucucgcuaaguuuaaucauuucuggcuuuugauuuaaagaagagugagagauggggacuauuccuuuuaguugaacacuuagaugcaauuguaggguuaauaauuggccuaauuucaaucuuguuuugucucagggaacagggaggccugaggagagagaagagaaauagggaaaggcuguuuggugggcauucaggacauuuauugaugaaaaguuuaccaucuuuaaugggcauaguucaugacacaaaugcuuaauuuguaaaaaauacaauguaacaaggguauaccuguauugggaaaugagucggagcuuuaaggcagggaaaauuugcuuuuauucuucauugaaguaacuuaucaucugugggugucucuuuacagaugugaaggaauggacaagaguugagcagccuuucugcugauuaucacacaucaugagcugagugacugcagcuugccaaaucuuuguguuucugggucugaccaauuagcuuaguucuucuccugccuaauuuugaacuaguaaagcaaagugagucaucagauuaugaguuacuguuuaaaagaaaaaugcuguuuauucaugcugaggugauucaguucccuccuucuuacagaaguauuuuaauucaccccacacuagaaaugcagcaucuuuguggacgucuuuuucacaagccuccaaggcuccuuagauugggucguuacuaaaaguacauuaaaacacucuuguuuaucgaaguauauugauguauucuaaagcuaguaaacuucccuaacguuuaauugcccuacagaugcuucucuugcuguggguuuucuuuuguuaguggucugaaauaauuauuuuccuguucuauuaauacauaguguauuuugcacaaaaaaauuaaccuggucaauagugauuaccaaaauauauauuaauaaucuuggcaauuuuugacauuaauuaugaaacauuuuagcccacguuaguucuacauuauucuucacuuaaacucagcuacugcaaauuuugucuuucuguaaauguuauuaaaauauccagugagcucuuuagaaggacucaguauuauuucaagacuauuuuugagguaauucuagccuuuuaaaauauucuacagaccuacggggcuuaaaagaaccccaguaccgacuaagcaaauaggcaaaagacauguuggaaauguaguauaguacuugaaacagucacuaucauagggauaauuggugcauccuguguaaauggaagcugagcuugacaccuggugcuuuuaaguagggauaaagucauccucucacugcaagcacagcauaccuguaccuccaaaagugacguuuuagugaacaggccguuuucaacacuugugccuugggguguucauugaagcuuugugaaaacuacugauguuuucucagucuccuuaaaguuacguccaugcuuuaaaaugucuguguaggagagaagugggguuuauaauguuuucucuaagauaucuuugcugcuuuccagacuuugaaacuauuaagcuucuuaacugccucuuaccggaaauacuucuggggaaacuucauggucccaaaaugucauugccauacagcuucacuagaguucuuugaaccacagcugaaaagagcuuuguauuauuuuuuaauucccuccccagauaucauuuaggaguauuauauaaagguggugggcaaaaacaauguaaggagccuuuccaguuaucuugaguugcagcucuguaguuucuugaggccaaacacacuguauuuuacaagucaaaauauaauuuacauuaaucacuauguuaaugaguauguaaaacauucuuuugcauugaugaauuuuguaucugcuuccauuaaaagcauaacagccauaguuguugcguguuauuuuuaaaacuauuugucacaaaguguggugugguaccacauaacgugguaacuuuugguuaguaauccagcugagaaacagcuugaacauaaaaauaacaucaguguauuuuaugaaaaauuagcaaacaauagguauauuaaccuccauuuucagucuuuuauaaaaacuauucacaucuauuaaaaaaaaaccuaugggacuucagccaagauucagugccuuucuacuggauuccucuuacuagaugcauccgaagaggcccuaguuuacuuucuccaaucauauagccaccagguauuuaauacaguaauauuuauguguauaaccuguagugcaauuauacaugauuaacuucauaugguggaugagaaaacaaacucagaaauuaaacaauuuggccucauguccuuuaguuuucccaaggcuuccuugaaaaacaucuagcucuuggccaggcacggucgcucacgccuguaaucccagcacucugggaggcuaaggcagguggaucaccugaggucaggaguucgagaccacccugaccaacauaguaaaccccgccucuacuaaaaauacaaaaauuagcugggcaugguggcaagugccuguaaucccagcuacuugggagacugaggcagaauuacuugaacccgggagguguucaaguaaucucagcagugcgcugagauuguaccaccgcacuccagccuggggaacagagacccugucucaaaaaaaaaaaaaaaaaaaaccuagcucuuaauuauuccuaguaaggugugaguuaauauguauggaaugaagcaggauuguuggaaagauuguucuagcauacuagucuaacggcugaccugaaauaccuugaggugguuuaguaccagcucuauuggugaaugccaccaguagcucauuucuuuuuuugaaauggagucucacucugucaccugggcuggagugcaguggcaugaucugggcucacugcaaccuccgccuccuggguucaagcgauucuccagccucaaccuccugaguagcugggguuacaggugcacacccaccacacccagcugauuuuuguauuuuuaguagagacaagguuucaccauauuggccaggcugauuuucaaacuccugaccucaggugauccaccugccuuggccucccaaaguacagggauuacaggcgugagccaccacacccggccaccaaguagcucauuuuaacacaaacacgaagauguuguuuugcccacugggacaaaaaaugccaaggguaccuuucacuuuauacccagguagauacuuuuaaauugagacaaccacuauguuuguguguuggaguuauaacuuugguucuguuuuuacccuuuauuuggaauacagugcaacauuacaguuuuggaucauuaaaugaauggacuuggugauauaguacuaacaagcacgaccugaauucugggaguaagugguuuucuaguucaugggggaggaaaacagauacgugcaagaucuccagaggagaacagaaccaugguacucagugagucaccaaagggcuuuggcuucaacucacuaauggcuggaacaagugccagucuuggucagccauccaggauuuucaucacagcaaaucaaaaucuccaauuuuucaaacuaauuguagguagaagagagagaauaacuccaaacugucuuauaaaaggaucuagaugacuacugaaguguccuccauucaugaguuggcaaaaucuucagagugacuguuggagcaaggagccuuucaugugcucccaguuauuauauagugcauagaggcugguaaguguuaguccugucagaccaccucgugcuaucccucgaagaccaccu

SEQ ID NO: 17500 - RNA, 3523 nt, Homo sapiens
ugucacuuaaguuaucaggacauaacauuuguauuguaacuuucugagcuuaaauuggacaugaugguuaauugggguaagaaguaauguauaauuugauaccuugagauggcaguaaaacaugccauugguuacaauaccucugucaccuugcuaugaaguagucauuuguuucucucuucuuaaucagaauacucagacaggaccuuguuuccccuuuaucuggugaccuugcccagaagcaugccugaaacggguaauauauagcaaguuuugguguguuuaguguagaucauaaauaugagaugauuacucaggugcugaugaugguuuuacaguuauuuagggagaagaguccuugcguuuucgaccuucuaauauuuauuuauuuauuuauuuaugaaauggagucucacucugucacccaggcuggagugcagcggcacaaucucagcucacugcaauuucugccucgcggguucaagcgauucucuugccucagccuuccaaguagcugggauuacaggugcccgccacguugcccggcuaauuuuuauauuuuuaguagagaugggguuuugccauguuggccaggcuggucccaaauuccugaccuuaagugauccacccaacucggccucccaaagugcugggauuacaggugugagccaccgcccucaaccagaccuucugauuuguauuuacuuuguaaacauauggaggguuggagaaguccccacaacuacacuaaguauuuauuucuuguuguauucuuuuuaagucuuugcccauauauaugaugucuuauagcuagacauaaauguauguuuaaaauuuaugcuguauuauaaaaucuucuguguuauauaauuuuauaauguuuagccuuaaugguugcaauaauauuccaucaaauugauaaauugucugcucauccauuccuguguuuguuggagauuugaggaaauuuguguaaagcuuaucuagagauuugaaggggguucucccugugauuguuugcuauucugucauuaucaguguacuuaacaaaauaccuuggauguuuaauacacuuguuuauuuuucuauccaucaaaucuccagauauuauucuagaacuuuagcaagucaugacccacagggacaacauugcccacgcuugcagugguuagugagaaguaagugucagacauaccuauauaggugggauugguggaagaaaagauuuuuagcgcaagggaaacaauuguuugcuuugguuuuaaguugaaaauauauuugguuugcauuuucagugucuuauguucuguacuaggaaugcuuguuuauaaaggguucuuuuauuuuuuuauuuaaagccaggcuauagugcaguggugcugucacagcucacugcagccucaaaccuccggggcuguauacuuccucccacuuuagccucccguuuagcugggacuacaggcaugugcuaccacaccuggcuaguuuuuuguauuuuuuuguagagauaggguuucaccauuguuacccaagcuggucuugaacucuugggcucaagcaaucuucgcuccucagccucccaaagugcugggauuauaggcaugagccacugugccuggccuauaaagcguucuuuauuuucgagauggauuccagcucugucaccagacuggaaugcagugauguaaucucggcucacugcaaccuccaccuccuggguucaagccauuugccugccucagcuucccgaguagcuaggacuacagacgugcgccaccacacccagcuaauuuuuguauuuuuauuagagacuggguuucaccauguuggccaugauggucucgaucucuugaccucgugaucugcccgccucggccucccaaagugcugggauuacaggcaugagccaccgcgcucggccuuaaacuaaggguucuuaaacauuguuuauuagcaggguuucgcaauauuuucaauuuuuauuuucuaauuuuuuguuguuuugagacaguaucucacucuauugcccaggcuggagugcaauggcaugaucucggcucauuguaaccuccaccucccagguucaagcaauucuugugccucagccuccugaguagcugggacuacaggcaugcaccaccacaccuggcuaauuuuuggauuuuugguagagacaggguuucacuauauuggccaggcuggucucgaacuccugaccucaagugaucugcacaccucggccuccaaaaguguugggauuacaggugugagcggcugcucccagccagaauuuggaaauucuuuacuuaaaugucacauugaacucugaguggcuuguuuuauuaaggaaaagaauuaaauuugacaucguauuaagauuaauauuuugcaguuacguuuauuuugaagcuguugauauuuaucuccuuaaaaccuuccuuugauuaauucuguaaguaaaggauuuuguaacccaaacuaccuuacaacgagaggaguucaugucaacagucauugugaauccaugguacuguaauuaccuacauucuggucucuagcacaagagguaaggugcccagaagcccacccuggugugugagcaccucuacuggaauggaaguaaggaguauuaccuaagcuuuuauuaguuuuucagaaaccagcaaagaucacagagaccaaucuguuaauuuguuauuuauaauuauauauuuaggugcuacugagucgaaauggcuguuauuuaguguuuucugcaacuucagggcuaauauuggucuuccucacugcuagcugcuggaagugcuacaaacacacaaucuguguuuuauggcccuccugugugguguuucacaaaauuaaauucaaacacuucuguaauuuauauucuaaaugaaucaauauacuuacuccuggcauuuuucacuggaaaguugaacaaaauguucuauauguuauaaaaguccucuaucaaugcaucuuggaggaauuuuuaaauacuucucuuuuuuuuuuuuuuuugagacacagucuuucucugucacucaggcuggaguggaguggcacgaucuuggcccacugcaaccucugccucccagguucaagugauucucccgccucagccuccugaguagcuggaauuacaggcacccaccaccacgccaggcuaauuuuuguauuuuuaguagagacaggguuucaccaucuuggucaggcuggucucgaacuccugaccucaggugauccacccaccuuggccucccaaagugcugggauuacagguaugagccacugugcccagccaaauacuccucuuuuacaacaccuguggcacuguuucauuucacuuauaguguguuaacuugugaaauuuacauuaaagcuguaguaacugaagggcaugggggacguauuuuuaaggggguuucuucuguuucugcaauguuggcuucuauuucuggacuuggauauuuguuuuauauuuauucauuagacuauacauauauauuuuuauguacuuuuu

SEQ ID NO: 17501 - RNA, 27701 nt, Homo sapiens
ugacccagguaauuggcacggcgcgcgcgcaccccuuccgcgcagcccccugaccugcagccuccggaccucgcugcagcgcggacccggcccgcccgcccggugagcgcggcggcccgcccccucccggucccugcgccgcugcuucuccugccguccuggggaccggccccacagcuccucucuccuggguccuggggcgccgcugcccgcagcccugagucuggccccgccggggggagggggaggaggaacagacugugaccuuggcucugaccuuggcuggccguggccucccccgggacccccagcccaucgcgcgcguaccacccggcuaguccaggguccugcgcagaggagcgggugcucgcgguggguuucuccagcccgaggacuucagacugccccgcgccuuccguggccaggggagggcccggagcugcgagggcugugcgggggauggggagggucagcgcugugcaccuggcgggacccauaggcagcuucggacuaccaaggagccuaauagacgguuuuaaccgcggucuccgauuacagaugagaaaacugaggccugagagagggcggcauggccugaggucgcugcuugcaugggaugcgcuucuuccgccccccgggagaugugggagggggacgggguaaucccgaggccacagcaggcugcaguacgcauucgccgaaccggagagacccuuugacgccccucggccaccuggcucaagcaggcccuagcagccccuccccagugucuuggaacaggccccaacuaaauagaauugcgguuuguugcugagcaaaagcucaucugcuucucagaaaguggggucagaguagaccugcugcugagagaauccaggcucugcugcugcccagcuuggagggcccucuggggagaacccuucccggccucuguuuacugaucucugcaaugggugcauuagggaguaguccucacuagggcaccccagacaggguugugugugugggagucuuaguggccauggugucggcaguuuucugggguuggguugagguucugagguuggguuggggaugcuaugugaccuuguccucagagaagagacccccaagagauacccagggcaacucugcuggagucuggacugggcaggggguugcacagggcaccugacucucacuccuuguugcuguccuugacuguaugggcaggaacuaguagggcuggcuugggcucuggcucuagauacugagcccucaugcccugcugggaugcagguggggguggguggcaggcugcccuccugccaggcugggucaaggucacaacagugcccaguggccaacccagacuguuuaguguuuauaaaacaguguuccugcaccgggccauucuggacacagccagacuuugucccuaucuggcccaaacugccccauuccccugugggggugggaguggcgcuggcagagggagcagcucuggcucagcugaugggaacugcaucgcuaagagaaaucuggcuuacauauugacugcagugaucagggcacagucgcuggaaccccacacagcccugucacucaccagauuagccagcuuagccucuugcaccucaguuucucuguuuauaaaguggaacugauaugagugcccaccccaugggauguugggaggauuaaaugagcacaguaucuguccuagaaucagugcuccugacggugccuauuauguuuauucccaugacgauggucuugauaucuaguuuccuuugccauagacuggggaugauaaagcguccuggguuguggauucuuuuugaugcucuagaagauucucccugaugcuucaggagcuccugggccuaguggccagcugggcuggcacgaccuucucuuugcccaggccucuaggauagucagagguggaacaggaguugggacccuggcugccugaccccagagcucaugccuggcacuuggagaggugcugcucccagaggagccggccccaagugccccgcgcucuagggcuuggcaucacuggcucgugggcugggccacaugacccgaagccucaggggcugagcauuggggagggaaacuugggggcacucagaggcucccaagcucaccucccuccucccugcaguggaaucuuuuuuguuuugaaaauuuucucuguucaggcuugcugcugguugccccaggagccuguccucccuccauugaggugacaucaccccuuuccucuggcucaugugaguuagaaggagggcugugcccugcccucugguggggccugaccuuuuguggaaaguccagccagugaguuucuggugacaugguugagcugauggcaggggugaggcagaagggugcaacagguguuggcugagcacaccugaccaggagcguuggcucagggccuggccugggcaguacuuggaagccaguuauaccccagaaugcacauuuucuggggccugagcuguccagggguaggggacuccucccgccugggcgaccccuuguggggugguccuugcacccagcuuacaagcugggcggucugggcaggagggcauuagcugguauucauggggagcugcucuauggcaguggcugugcuggagcagaggaagggguucugcucacaguuguaggguggggaacagaggucccacuuuacacaucauguguaggaugagguggcagggguauggggugaucugggaccucaguaggcccuaucaaccccuaaccugccuggauagggauaucugggggguucuccaggauuggcagagggcucuuagaacucuuaccgucugcggaauagagaaagcccccaucacugaaagcccaagauuuagauauuuucccugggaaggcacaggugacagagugaggugagaugagcugcagggccugguuccccguggucugggugggcuuccagucuguaccugccuggacuguuagcugucuugaguggcgcugggcugggccuggggcugccuuccauucuacucuuccugccccuccagaccuuagcccuuccugcaaugaaguggggcuauuguugggccuagugucaccagccuucuggcugggccugggagagagggcacucuggcccaggauugcagucacagggagucacuggucacuuuuggucgcaaugacuagagccacagcccuccugagauagugugccucuaucacccccgacaccugugcucacuggaugcuuuugccccugcuuuucccugaccaugcacaacacaccugaccccuggaggacugccugcccugguucuaggguggugggccugagacccacuccuucuuggugguacucccugcaccugcccuguggcucuccgagugggcuccaggaccuaggugggugcucccugaggcagggccuggggaguucaugucucugcacaggcuuuggggacuauccgggaaggaguguggucugggaugaguguggcacagcagggcuggggcucagggcuguuugauaucuauugauagaguuuacugagcugggagcuuccaccagacaguaagcccagggggcugggagagugucacauucccagucucaucacugccuagcccagcaccaucugcccagugggaaugacaagugcugaugagcggacaguggcuugguagagccucuuccugucuugguccugccauuuaugccucuccuucauugccuguguccagaaugagucagcugaggcugcugccgucccgucuugggguacaggcugcgaggcuccuggcugcacaugacgucccgguguuuggcuggcgcagcagguccuccgggccaccggccaccuucccaagcagcaaagguggaggcggcuccaguuacauggaggagauguacuucgccugguuggaaaacccccagaguguccacaaggucagcauccccacccuacccugggccaccgcaagggagggaagcccucgggggccgggcuguggcagggcaguggggagaagcagcuugccugcugugugauccugggcagguuucuuugccucucagguccucagucaucaaagccuguugcuuucccuuugcugaaucagccaguggguggugguuuugauugagaggcccuggccauguccugcucagccacaccugagcccugccgugcccccuuugucgugcuaugcugccuccauaugcuccuuuguauguaauuagggacauacguguuuguguauguauugaucugauaaaauaaauacuugcugauaguaaagaaaaaaauuaaauuagaugggagggugaaaagugaaguuguucucugaccccuucaccugcaguggaaagcagugcagucacaugauccaaagccagaagguauaagaaguuacacagucagaaagcucccuccuaaucuauccucaucugcucaguucccacugucccccaacuuaguguccucuauauccuuuccaagacuugcauuagguaaacuuacugcaaauguaacucuggauuugucucccuuuacgcaaaaguaaccuguaacacauacuguuuugcucccugcuguuuucgcuuggugauguaucuccaagaucuuuccauaucaguacaugaagagccucacuauucacucuguccagcuguguaguauuccauugcauguaugugccaccccuauuccugcugauggacaucugguucauuucuagucucugacuguggcgaacagugcugcagugcaucaucuuacaccuucaucaucuugcaccugcagagccaucuguaggguaaauuccccaaaguggaauaguuggguccaggaguggcuguguauaauuuugauggguauugccaaguugcuuuccauggggauuguaccaacugagucucccaccagugccguaugggagugcacggaggaaagcgcuuuuacauuguucuuauggaaaacacaugcaaaugccuguguguguucacaucugcuuuuugcuucuacacagagaguagcagccauacauccucuucugcuucauucacuuuaaaacguaucuuggcaauauuccauguccacaauacugaaagcaccuuuuuaaaagacuguguaaucuuccagauucuaaauguaaaaucguuauuuagccaguuuucuauggauagccauguagguuguuuucacauugucaauuuuuguaaacaguucugcagggaacaucguuguauguacaucuaggcacccugggaaggcccugagagcugugguccucaaggaagaccugacacuccuuggggccccagccugggccaccccugacucuucccaggcccugaccuggcugcguucuuguuucugcccugccuaguccugggacagcuucuucagggaagccagcgaggaagccuuuucuggcucugcucagccacggcccccuucuguuguccaugagagcaggucugcagucucaagucggaccaagaccagcaaauugguggaggaccaccuggcugugcagucccugauccgggccuaccaggugaggggcagcugaggcacagccugggaggcugcacuggcuccugggguguggccaggcacugaagggaaggggucucagcuccaacaucaucuccccagagagcccuucuccuuguccucuacugagcggcaccuacuccucuagccagucuuugccacaucaccauucagagcacuuaccaccugcuugaauuuuuuuuugugcauacugacuuguguccuuguggucuguuccuugcacacaccaugccccgaguacguggaggagcacuuaguaagggaucaauuccaaagccuguugaaugaggggugaguagauuaacccuuguuaauucuguuuucuccucuagaaugggcauccugggagaacagggacugauacagcaggugccuaauucauguuuauggaaugaaugguucaguaaacaauucucccccaccaguugcuccuccuggagacuuaggcucucccaugcugggccccugcucugucagagucccagugaugguguguguuuuuggucuugaccagacaggacuaauuggaggacugcugcgguguucaggccauaacaagcguaaucauuuggaauaucucugggaacugcuggcaggagguauuccgucagggaaaugugaggcagcagcaagccacagcaaggcuaggguacaggggggcauuagcaaauggaaaugaugcuuugccucugaaugagcugcccaaucugugggauggaacagaguucccuguacaccacccaccuggggauggaagagggaaggugagcaggguuggguucccuucuggccugaggacccaucaauugugggccaccuaggagcaaacagcagcuauuguguauugugucuuuccuggcuggcugaaagaagcagacagugaucuaacccuugacuucaaaaaugaagaacaaggauguaaaacuguauauuaaauacagggaaacguucagggugcugcccgagggccuuaucuucuaagcacagaucucagcccuucaguagcucuuuguucuuugauuaaccaagacgaggcauuagagaguuuuccuggcaggguggcuucuggauucagguguguuacucuguugugccugguguggaugagcucccaccaggagggcugcagccccuuacaggcgaguagcaggcacagcugugguuagaaucaccugcacacugugcugaaaaaaaaacacuguauuauuauaagcauuuucaaacauauaaaaggcagaaggauagugcagugagcccaccacccaucaaucauggccagccuuguuucaucaauuucccccuuagcccccgcucacugcugauuaucuugaggcagaucccagauauagcauuucauucauugaacauuucuuuguguaugucuagagaaaagggcuucuuaaaaaaugugccaugauaccauuaucgcaucuaaacauaauaaugccuaauaucaaauaugcaguugacauuuguguuugccuuuuguccugugcuuucuuuuuuucuuuuuagauggaguuuuacucugucacccagacuggagugcagugaugcagucucgacucacuguaaccucugccccacguggucaagugauucuccuggcucagccuccugaguagcugggauuacaggugcuugccaccacgccuggcugauuuuuguguuuucaguggagacgggguuucaccauguuggccaggcuggucuugaauuccugaccucaagugaucugcccgccuuggccucccaaagugcugggauuacagcgugagccauugcacccagccugugcuuucuuuuuacugcuucuuugaagcaggauccagcuaaauccacagguugcaauaggcuaaaguggcucuuacgucucuuguacuuugcagguucccucuguuucuuuuuaugauguggaaaaaccaggugguuuguccuguaggguuuucccaagucuggauuuugcugauggcuuccucaugaugucauuucaucugucccauugucccauguaauuucuguacuuugacaauuagaucuagaggcucgaucccauagacauuugauuuuuuuuuuuuucaaaaucagcuuccugguggugauggugauggcacuugagcaguuagcagcuguggauagugauuuccuagauccauuaacucacuagggguugcaaaaauggugauaugccaauucuguuuugccuucuuuauuaacugaagucccacuaucaggagaaacuuccguuuguuaacucuguuuauccugaggugcagauuguguaggaaagacaggaucacugcuuuauuuuuuucuuuuauucagugauuuucaaaauuaugaggugauucccuagcacacuccaaaagugacuaaugaaaguuuaucuucuuuuuuuuggauucauaugaaugcaugaauauaaacauauuugaugaguuucaaucugcuguagguauacuguccuuauaguugcucaaaacuuguccuuauucccagcacucgugguguuugaacacugccuugauguugguauaacaagaugcuucaagcucagcuuguacauuucugccuauuccagaacuguccaggucucuggcuguuuccugcuauugguuugaucauuacuucugggcccuuucaggaaucagagccaggaaaggguuuauacugaugcuucuaacgugcuacaaaugugggauuugggguuuguccuugacccugucaaucuuauggcaacauugccuuuagagaugucaaaaauagagguucucaaagaugccaguacaauggcuuguuugauuucccagagcucacaugcaacaaucuuagaauaacaguucuuuuuuuuuuuuuuuuuuuuuuuuagauggaguuucuccuuguagcccaggcuagagcgcaguggugcgaccucagcucacugcagccuccacuucccagauucaagcgauucuccugccucauccucccaaguagcugggauuacaggcaugugccgccacgcccagcuaauuuuguauuuuuaguagagaugggguuucaccauguuggucaggcuggucuugaacucuugaccucaggugauccacccaucuuagccucccaaagugcuaggauuacaggugugagccacugugcccagccagcauaacaauucuaacacuauuacgacugacugguaauaaaaaagacuugaugaauuuuuuucuguuugucuuuagggaauguuccauuagucaauuggaaugguuucucucuguauuuaugccacuaaguggacauauuuauucauuugauucauuucacuuucaauuuuuaagacuuaauuuuguuuuauaagaauguaaaauauuuacaagguuugaaagucaaaucuucaaaguaagauaacuucuuaaaaaucuggcuccuagcccugccucucuauccuauuuuguccccuccccuagaggauaauuuuucuuauguugugguuuuuuuaaauuuuaugauuuucccuucuaaugcauauauuuauuugugucuccuuuuuauuagauaauguguaguucaccauacauacuuugcuagaauuugcuuuuuugcuuaacaauauuuuuuagagacuaccuuguaguaucagauggggauuuuucuucuuccuuuuaauggcucuggagugcuccgcuguguggaucgcccauauccaugcgccagucuccugcugauagacaguggggaaguuucuagaauuucacuauuacuaguagcaccgcagugaacaccuuugugcauaggucuuuuuccuguuuuugcccgugcauguuguacuuccaaaccagguugagcuccugccaccuuacuggcuguggcuggggucucgcaggcagcagugaaguagccgcggggcagagacauggggaagcuuaacauucgggaaugggaagagaggggcuggggcccagagccuuacccuggaggaggucuguccagcugggucccagccccacccugcucuuuucccuccucccagauccggggucaccauguggcccagcuggacccccugggcauucuggaugcagaccuggacuccuuugugcccucagacuugaucacaaccauugauaaacuggguaagacccuuccucaggacggccauggcagugcuguguggguggcccaguaaggggcccacgggcacuagggacagccugauccuugggaauccauggagcucggggagcagcccacagggccuccuuucuaccuugccuguguacugccuguuguuccugagaaggaugccugccacuuucccuagcuugugccccauguguucaagccugagaggcuuguccacccugccucccugggcucacucucacuucugcuccccagguuggacccagagggagggcacuggggagacugggaggucuggugagacugcggggcuccaccugggccugaccucccucccuccacuuugcugcccggggcucggccacgccuccuucuccagccuucuaugaccuucaggaggcugaccuugauaaggaguuccagcugccgacaaccaccuucauugggggcucugaaaacacccucucucugcgggagaucauucggcgccuggaggugagcacaggcggguguguggggugcagcugaagcagcucuuuggagcuugccagaggacgggaaggcacugucuuuuuuguucuagacagcagggaugucagccgucccucuuccccgcuccucauggggucccaaugugucuccccagaacaccuacugccagcacauuggccuggaguucauguucaucaacgauguggagcagugccaguggauccggcagaaguuugagaccccuggugugaugcaguucuccagcgaggagaagcggacccugcuggcccggcuagugcgcuccaugagguuggcaccaccuggagggccaaguggcuggagguccugcuccagggcucuaugagacgucccacacccugccuaagagagcaggaggguaccacaggaaggcaggacuggaucggccucaccacuggcugcagggaggagaguugggaccagguguuuaggcaguuuggccaagagcuggcccaaggcagagcaggucaggugggcagggaugaggcucuaggagaacaagagagcggggacacugagcaaggccagaaguggcgggaaguggcugugggaacauuugggcagaaaauuaucccugguguggagugacuguggccacaccaccugucuguucacuggacuuuucugaagcugggucccccagggcugcaggggcugggggagcaccugacucagcugcuggaugcaaaguggauuccugagcagcgaggugugggcuggaguuuggaucuggcuggguggagaucuuugggacuuggcgaagagagcccuugaguguggcaggaggguagugggcuaggagugggugggcaguggccuguuggaggagcuuggcuaugaggaagagagagggcggcagcugggaagggguguaggcagaggcguuugguucagcugggaagaugccuagccuccccuaacccuguguuccuuugcugggugggacagguguauccauggugggcccuggaccauguagguggaaggaggauuugugacuuccucuguccucagcauucagcucugagcacucaugaacagccccugugagccccaguccccucccucuccaucccuuucccuuuccucuucccauccucuccccaagcagguuugaagacuuccuggcccggaaaugguccucagagaagcgguuuggccuggagggcugugaagugaugauuccugcccucaagaccaucaucgacaaauccagcgagauggggauugagaaugucaucuuggggaugccacacaggugggucccccucccugcugugccuugcgcauucuccuccagcccaggggacagaggugggagagaugagauggaaaucagagcggagguguuggugggaccuggggguagagguggguuuccuggaaaguucugaguccugggccuggccugcucgucacagaaauugccggguacuuggccagagucaccuggggccgggugcuaaccagguuaucaggcacccucucucccuggccauguugccucugucccuagcaagggugagauuucagaaagcgguacacuauacuucuugagguuccuguggacaaggagagguggagggauuucuuccagggaagggagggcagggccugggcaguuguucccggguuguguccccaacagggaggucuguggaggugagccgagggucucugaccuggcugcaagcugacugcguguucccuugaccuugaugaagaucuaggaggcuugcucagcaguggggcguuaccucugagcuggagccuguggggaagcaggagggggaaugcacccugggggacagagacgucuguggccagggguccugcugagugggcaugugcagaugugcagaguggccugugggaagggcccugggcuuuucccgugaccagagagcugcuugugguuggacuagcccagggcuacaucagcaugagggcauccaaaugcauggugcagggguccccauucguggcuggccugccaggacuuugggguuugucugucauggggggccugggaaugcccagugucuggucagagaguuaggcagagcuggcccaguggccugaggcagcaagaaagcauggggcuuuaagccucgggccauuacagcagcaggagaggauggugccuggugauuggguggccugaggagggcucugggcacgaaggggcuguauuaggccaggccaggccuccacagugggggagggaacccugaggccugcgggcuuugccaggugagagcccggccccucuggcuccaggggaaggcugaacgugcuggccaacgugauccgcaaggaccuggagcagaucuucugccaguuugaccccaagcuggaggcggcggacgaggugggugccaugcccaggucccggcacccuuggagagcuggguguuugggagguggacuguggaggggcugagccgggagcuuccgggcugagauaaaccuuaagauggaugcauuggagaagccugcaggagagaggcuggguguuugccugaggacccuaaggcuuuuuggagcaagggcugcagucucugguagcugggagggcccucagauaaucugggucaaccucccuguuuugagcuagggaaacugaagcccaaagaugcaaaggcuugcuggaaguugcucaguucugcucauguggcugugccuccauguccaaaguccuguccaccagccaggaaugacucccuugcucauuuguuugcccagcagagccuugggaggugaggaugguuuuccguacccaucgaccugcugaggaaauguuguuccugcucccacccccucccugggaggccugggccaggccuucagcccauacugccuagccucuuucuuuccuuuucuuuuugagaugggguuuugcucuuguugcccaggcuggagugcaauggcaugaucuuggcucacugcaaccucugccuccuggguucaagcgauucuccugccucaaccuuccaagcagcugggauuacaggcaugcgccaccacgcccggcuaauuuuuguauuuuuaguagagaugggguuuugccauguuggucaggcuggucuugaacuccuggccucaggugaucugccugccucggccucccaaagugcugggauuacaggcauggagccaccgcuuccggccacugccuagccucuuucaaaguccugcccaucuucccuuucgguggcucucuggguccccugggcagugagccugucacucccuccucugugucccuuugcccucaggacuaucucuccugcugucuccagccugcugccguguguguguguguguguguguguguguguguguguguguguggacccauaccuacuggcuccuaucccaggucuuucugacauccuguuccuuuuguucuagcaccuucagccuucuaagccucacuuugcucuuccauaaaacagggauaaaagcgcaugcccgagaaugguugcaaugagucaaagaugaccuguguguauaguggaaaacuuggccaaaggauguuuaaaaugaaauuacuauuuuuuuucaacugaaaaagaaauuugaucauugugaaaacaacaaaacagaacaaagcuuauacaaugagaauauguuccucagugagacuccauucuuguggccaauuuuguuugugugcuucuguuguguuuagguguguacuucuagaaacauuucaugcugauacaaacaaaccucuuuuuccagugcaaccuuauuucuaagaggccaugggcauagccgugacaccggguggcaccuugcuguuuucacuuaacaaguugucauuguuuccugccugcacacaugggcuaccccaggcuucuuacagcuaaagcaucccuugugcuggacauuggguuguucucaugaggguccuugcacaugugugagcgaguuuaucuguuagaugguguccgagcagugcagcggcuggagcuacgggggugggacugaacgacccucccaggagcuggcagaugucagcgagcccauccacagugugugauggugccagagcccccaccccacuuccuccuacacgcucucgaauccuuucaucuuugccgauauaauagguucaaaagaggauuuuguuguaaugcauuucuuuguuaugaauucaguugcuuaucuuuucacaugcuuuugagccauucauauuuuucuguaaauuccugcuuguggcuuuugcucauuuuccuauggaguuuuugggcuuuaucuuccugauuuguaaaagcguuuuguacauugagggaauuugcccuuugccugcauuuguuuaugaauauuuuucucagcuugauuuguuuccccuaucgcugggcguggguuugcucccccauggcaaauuugcuagaauuuaggugucuuuuguguuuucugguguuaggauauuguguagaaugcuguaagucuuccuugcuucagggucauaaaauguuguguguuccucauugcuaccauuggugugaggagucaggggauucagcuucaguguuugcugguggccuggccgagggucucugcgcugaugccuaggcacugcccuucucucccugccuuccccaccgcuggauggccuuccccacucuugugcucuccugcuccauggucaguguacagagaggcucugagccaaggccuggggucccugccuuccucccucaggccagugaggaggggcagugugaugaggagagaggggucagagacagcuuggcccucugaggcagugggaucgggggaaugugccagccugacugugggcugcagugccugccuguguaucugccugucugaugugggaggggaggauccaucauguucccaucuccaccuucagggcuccggggaugucaaguaccaccugggcauguaccaugagaggaucaaccgcgucaccaaccggaacaucacucugucgcugguugccaaccccucccaccuggaggcaguggacccuguggugcaggggaagacaaaggcagagcaguucuaccguggagaugcccagggcaagaaggugagcucaccugggggaacccagaggaccugggcccuucagggugggcccagagggcugggcuggacccugggucuccacaguacaggugccggcugggcuacaugggcuggggcacgcagccccuccuggcucacaccugcccugcaggucauguccauccugguucauggggacgccgccuuugcuggccagggcgugguauaugagaccuuccaccugagcgaccugcccuccuacacgaccaaugguaccgugcacgucgucgucaacaaccaggugagcauguaggcuccacgcugggccucacagcgucagcaucccuggaaauccaggcaguagcuugcggggaaagugagaugcuccuggcucugagcccacugcugugcugcuuaccaggcaggacccugcucuuuccagccuugguguccuggucugugaaauuggaagacacaauagggagggauaaguagggcuggaaggaccaaaggagcaccuguguagcgagugccucauggaggcuggccgugugcagccccacaugggcaaucuuagacacagggaccuuggugcccuuucucuaaggcagcugagcuucuaacagcucauauggagucuagaaagcccuguguucacugccuuguuugcauuaagucacgucaucguccuugaacauccugugaggugggaauuuaagugaccccuuuuuauagaugaggaaacaggcuguggguauguaagcaccuugccccagguugcaguuagccguuguuaggacuggauuuuccaggccuauguuccucacuaccagugugucaaagugacuggcgaaaaagagcaggcuccacccggcuggugcugcugccguccccgugggagcuguugccgugucuaauuguggggcugcucaccaucacccuguugugucccacauuccuccugggcaccucaguggaccuugagcaucccccugcucagucuccaaggcuggcaccuucuaucucacucuaaguaaauugagaggcgcagcagguuucuccugccucugcagauuggauucaccacagacccccgaauggcccgcuccucaccauacccgaccgacguggcccggguggucaaugcgccuaucuuccaugugaaugccgaugacccagaggcugugauauaugugugcaguguggcagccgaauggagaaacacuuucaacaaagauguugucguggaccuggugggucuggggacugaggccaaggcauggguggguggcccaucccugcugugcugagccagccaugucaucagcaucuucagcacucagggcugggagugcuucuuggaugagagauuuaugccaccaagagcaaucugugcaaaggccugggacgggacauucauucggugauaggugauaguggagcucaaagggcucccagugggugugcccuacccagauauuccccaauuuugcagcagcuacauugaccacacagcguagggaagggccugagccccucuggcugcuccugcaggucuguuaccgccggcguggccacaaugagauggacgagcccauguucacccagccgcucauguacaagcagauccacagacaggugccugugcugaagaaguacgcagacaagcugauugccgagggcacagucacccugcaggaguuugaggugggcaggcaggcugcaggggcgcccaagacaaacuuuggguggggacccuggagagggguuguagauguuaccagcccagugcugggcacuaaggauuuaaagaaguagccacuaugguccuuguccccaagaggccccaguuaccaaaggggaccaagaacuaaggaugcaguuacagccaagugggacacaguggguacugcaaugugggggaaguccagccuugagcaggagugcgggaaggcuuccuguaggaggcagcccugagcugggguuguccccauaauuaucuauggaguguucguccuuccaccuucauggagcucugagggcaaggacuacaaguuuccagagccuucuccaagccccuugcugagcgcacugcaggccugcccagccucgggguaccuguacaggauccccugaacucugagacuuuggcuucuagccaugaggucccuauaggccagagacagagaguucuagaagaacuuggugauggggaccaggacuuacgaguccaaguggacugggcgucuggcugcgcagggcuuuggugcucuguccacaucuucauccugauuccaggaagaaauugccaaauacgaccggaucugugaggaggcuuauggcagguccaaggauaaaaagauucugcauauaaagcacugguuggacucccccuggccuggugagcgagcaguguguggcucagagggacuccccugggccuugaggucuugcacugggaucaggacuggaauggcccugggugacagcugucauugccuagucuagaggcugcaggcucuaucacugaguccccaaagcugcguggggccgauuccugcaagucaaggauagcauugcccucugagcauggauggccaggugcucacugaaaagggagggcauagccaggugggagaggaagcccugggcacuggaugcuuggggccagggugcucagagggccucccuggggggcaggguuagaagagcuguuacccuggggcccagagguggguguugggccugugggggaguugcagcuguggcuguccagcugucccaggucccaagggugggcucagggugaguccgagugccgguggaguuugggaagccaugggccacucaguccuggggaggcaggcuggccagggggaucagaacccaccacugacacaguguggacagagccucucucccucucaggcuucuucaacguagauggggagcccaagagcaugacaugcccagccacggggaucccugaggacaugcucacccacaucggcaguguggccagcucugugccccuggaggacuuuaagauccacacuggugagguugcuggacaggcugcagcccaggcugcuggccccaccccaacacugugccucgaagggagauugguugggaugcaagagagauggugugucgcauuccugcucagucuguaguggguccacguagcucucggcaccaugucugugcccgugacaguagcucuuuucagggugggcguggcgagcugggcagcuccagaugccacacucccagcuggguaccagugacuagucuuagguuggggaccuuggauuuuccaaaugccuuugccggggcgucccugggucaggcagaagagcaggaaagcaagggcucccauacaggggcuggaacgcagccuggaacgugggcagaauucugcagcugaaaggacgguggcuugccggggccuggaccaaugaccgagggcagcccccccacuccggggugagacuagaauguggguggucaccgacugcaucccuuggcuggggccacugugaccuuugccugggaaguccggaggguccccuguggcuguauuggggugccuacacacccucugacccaccugggggaguucugaggggguucccuuacagugugcaccgagaccgaauguccuggggcagcugcugacagcguuuggggcaugugcccgcucuguuuguguguuagccucuguguguggggcugacaggagcacagcauaagccuggggacuuggagucaaauccguguaccuugacagcugugugaucugaguaaaugacucugagccugacggugucugcaacguggccaaugcuugccaagugguaccugcuccaccccuccacaggcucgggguagccccuugucucagcuggaggaggggugccuggcccugggcccuccugcagcaucccugcccuccaaccaaaucaacagauggcugcccugcuuugugcggggugugugcugagcaccuaccuacccgccccagggcuggcugucccuuggcccucaggccagcacuccuuucccacaggccucucucgcauucugcggggccgugcggacaugaccaagaaccggacgguggacugggcguuggcagaguacauggccuuuggcucccugcugaaggaaggcauccacgugcggcucagcgggcaggauguggagaggggcacauucaggugagcgcaguggggcucagcauccgcacaggagaccuggagcagaagcugggccuggcuuggggaucccgagggggccuuuguuggggugggaucuucacagcaucccuagccccugcccucagguggcaucaucagauggccaccucgcugaccccccagggcaagugugcagagcucacugcugggcccaagcuguccacuaaggucaagcugguggccaucugugguccucaggaucaugugugugugggggguguguggugagugugggcgaguuguguguggugugugugugugguguguuugguguguauguggugugugguauguggugaguggggggaguguauaggggguguguguggugcgugugugugguguguuuguuguaugugugguguguauguguguaugguguguguggugugugugggggugugguguguauuugugggugugugguguguuguguggugcauguguggugugugucgugugugguguuugugguggguguggugcauuuguggugugugugguguguguuguguguugaguguguaugggguaugugugguguauguguggugugugcgugugugguuugugggggugugcguaugugugugggguguguauaguguguguggggcguguauggugugugugauguguguguauguuugguguguguguaggguguguauguguguaaugugugugaggguguuugugugguauguguggggugugugguguguaguguggugugcgugugauaugugugguaugugucauguuuggugcauguguggugugguauuuguggggugugugugguuguguguguguaguguauguaguguguguggugugugugauuguguuugugguguguagucugugugguguguguguugugugguauguguggugugugugguaugugugguguguguagugugugugguguuuggugugugugcauggaugugugugguguauaugugugugguguguuuugcauguaugugugguaugugugauguguguguaugugguguuuggugugugugguguguguauguaugugugugguguguguguauguauguguuugguguguggggauguguaugugugugugguauguguggcauguguauguaugugugugguguguguguguacugcuguuaagucagccccuaucuugcuuguuugcaguugucuuugugaauccaaauggggacuugacacuugucaguuguccacaccacauuuccucugguucggguuccuaaaauguucuagauccugccucaguccgcuccugguuagcaagccagggugguguggcuuccaggacuugaccagcuggcuuucucauuccugguugcuuaucucggcuggucuugcuccagccagggcccagguggcccucugaugcacccagagcuaccugucaguccuugccagggacugggguucagccaggcgccccucacuuacugugcccaccucggcuacugcacggugguuucugccucuugugaguugggacagggcuggugagaugguaaagaagccagcaagacggggcaggggaaguggccuccuagggucucuggcucuagcuggcaccugggaagugucuuaucagguccccuuuaugggugaaaagcugacauucagagaggugccacaacucacagcuccuucccccagaccccccagugcguggugugugggcgcugcuagcaggcagggggcaggcuggggaggccuggugggggacaggcugcaggagggaccacauggcucugguuuuccacagccuucuuggaugccauguugugggacccugcagguuuccugggacagugacggaggcuugccugccuccugcugcccagcuccccugcuccaggugaacaggugccagcccaccugcccucugucccugccccggucugugucucugcagucaccggcaccauguucuccaugaccaggagguugaccgcaggacgugugugccuaugaaucaucucuggccugaccaggccccguacaccgugugcaacagcucccucucggaguacggaguccuggguggguccacgcucuccugcaggccaggcaggccccagacaccuggggacaagagaugggcugggaagggaccggggccagggccugggaggggcgagagaugcucagaggcccuuaggggauggcccugggggauggugauugggcugcccucaccuaaggccaugugggaggugaaaucgugucccaucugggccccuuggggaucccaguuggggggaccuccuugccuugagggguuuuguggguaucagggccccagugggcgcagacagagagcccaacacagucugcuguggguuccagcugcugagcaguccagucuuggcccagcccucucacauuccuuugagccccaucuugccuccucugcccugcacccuaggaacacugcacugagaucccuucucugggcucugggcuucccugccuguguccccugugcaugcucucccucagaugcaucauuagcuggcucaccucguccucacugccugccccuagaggccaggcagccccccgcccccaggcagaugccucuagggcuguuucugccccuucuccuuagcagcucugcauguuuuuaaggaguucuugacagauggucccuguugccuccccaggauaccuaaauaagguugaaccugaccacacaugauagcagggcugaggguagcaucucugagcauguugucagcccccaggaugguacauuguacccuuugaaucccagggaaucccuggguucguccuggcuugugagaaggaugggugggggcauggaggauauacugagaaaggcuaaauuugacuggagccacugccacuuggugacugugugcagcaagcucuaucuugucuucuguuuaggcuuugagcugggcuaugccauggccagccccaaugcccugguccucugggaggcccaguuuggggacuuccacaacacggcccagugcaucaucgaccaguucaucagcaccggccaggccaagugggugcggcauaauggcauugugcugcugcugccccauggcauggaaggcauggugagggcugcggugguggcugguggcuugguggguucuggcgggccuugaaggggcgggauggacccugggccccuugucggguuggacgguauaugccuuccaggccccuggagcacgugggucugugcaggguggggucugcacaugugcaugcugcagcugcugagacgaugaugcuaccccuggcagcagaaggcgcuaccacguaugagugcuugcugugcgccaggcacuguucaaugcuucugaauguuaacucuuccaauccauacaacuuaaugaaguaggcuguguuccugcuuuucagaugaggaaacagaggcacagagcuggggaguagguugcccaagguuucacagcuaguagcugggguuugaagcuauccugugcaguacugccuguucucugguccccuccuguaugaccugccucugcagccacacauggggcagagggaagacaugcaggcugggugcauccuccggaggcuccugggcuagcaggaagggaggaaggagcagggugucaugugauaccaucuggugggcagguggccugaccaggcagaagggagacaggcagggggcucauugccaccauuaucccugaguggcauguuaugagcacuuuacaggcugcauacucggcauccucacaacaccggguaucagugaggagggaggugaggcucccugcuuggggcugccugccgugaaggcagcuucuugggaggccagaucugggccaggcuggguguggggggcuggguccuuggccguccccaccaagagagggcaaguggcagcugugcagugggucauccccguccugcaggagcuggcuuggagaugccccugggcuugucuugcugcuuucauggagcagagcgguccgugugggugagggugggcgaggcccaggccgaguuggguuggccccugccuggcuguguggucaugggugguuucuuacccucuccuugccucuucaucugugcaguggggaagagugucugcaucauggggcuacuuuggggguuagcgauaaggcgugugggauuccuagaacucugccuccuguacagcaggugcucagucaguggcagccacuguuccaggacauuccagagaaagcacgucucagugcgggcuuuuugcuuuuucuucugucccugcaaguucacauacugugcuagcucugggcagaccccacucugaggauucccauucugcucuuguuccacauucuugguucuuuucuaugguucaggcuccagggugagggcaccucugcugagaagcccuccagacuuuccccugagccuggggucccugcagggccagaugucuuucccauggugggguccagccuuggcugucuggcguuugcuuucagggcccagagcacucgucagcgaggcccgaaagguuccugcagaugagcaaugaugacucggaugccuacccugugaguguugcugcuguccccaggacagggacgcgcccuauugugcccacagggcuagggguccagggugugggugcagcagacagccacccuggccauaugcaucucguccccacaggcauucaccaaggacuucgaggugagccagcucuaugacugcaacuggaucguggucaacugcuccacaccggccaacuacuuccacgugcugcgccggcagauccugcugcccuuccgcaagccggugagucuccgucccagggcaggggucacaggcagggggccuggccaggcagggccagcuggcagcugggcguguauuucccuuccagcugauuaucuucacaccuaaaucucugcugaggcacccagaggccaaguccagcuuugaccaaaugguauccgguacgugccuggccugggugugugggguagcccacaauggggcgguggcccauuguguggcuucugcuucuggggcuucuccaaccuccccucugccuguggcucugcugaccugcagcagcuccuggcauggucccacuagcaguaggguugggagguuggcacaauggcugaccugggccagcucaggucauguggguugcguccaugguagaguccacuggggcccccuuagacccuagcagggcuggucgaggccuggcagaggccugcugaguucgcaagauauugaguaucauucauucauuuguccauuuuaaaaauucaugagccaaacagacauuacaggcccugggguccugguguccccuccaggagucuuuggccuuauuucccugggagucagaucagauaaaacacuauaguugcaacugagaggugacuauguccagggaaggacaggugugaggcugguggagcagagcugucuuggaaaaugguccugggcaguagagggagggcugggaagggccucagcauggacagggguuggauuuucucccauguguguuuggauguccccucugugcaggugggcagcuguuagagcucugaugucgggacuggacuaccugggcuaccugcccugugcuggcuucucucuugagggccugggauccauuuguccucucuaccccagagucuucaccugagaugcagggaugugaggacacuacaguagcuuccugagagguuuugcagugugcgugaccuggggucaggaucaugggcucaggaaggaagaaugguuggggcuuggaggugaagcucagcugccaggcugaaagaggaggagcaugcagcagccuccugggacaucugcuuaguggugggggacugcagugcucugcaggaggugggcgcagcugggcagaagcaagguuggggcaaaggaugaugccaucauguugccuucucugucuccuucagggcgcuucuuauuguacccccaccuccggucaccuuaaacgugaugcuuccagggcucaacccuugggugucuccaccccucucccuaugacagcucagggugucaucugcccccugcuccaucuuuuaguucaagagguguccacugcagccacaaguccaaaccugcaguuagugucaguggcuaaggagagccuggggaugcaggccugguccugagcugccccagccccucuggguaccaacgccucugccauguccuguuggucccucagggaccagcuuccagcgggugauuccugaagauggggccgcagcacgggccccugagcaggugcagcggcucaucuucugcacgggaaagguguacuaugaccuggugaaggagcggagcagccaggaccuggaggagaaaguggccaucacgcgccuggagcaggugugccugaaccccuuguacagucaagugaugggcaagcucacgucgcuggccccggcucuggccaaugugccaggcaggccagaugaaggccggugaggcccugugccuccuguccgggggugcuggggacauaccgccccuccucuggcuaugcuccuuuguuucugccuccccagaucucuccauuccccuucgaccugaucaagcaggaggcagagaaguacccaggugcggagcuggccuggugucaggaggagcacaagaacaugggcuacuaugacuacaucagcccacgcuucaugaccauccugaggcgcgcacggcccauaugguacaugguggggccgcugauugccccucaccucggcccugaggcucuguccuggcuccaucugucccauaggccaugcuacccagaacuggcccugcccuucucuggugaugagcaaugauggggcaucaucaguacuggcuuuguguuuguucugcagccagaacuguauuaaggaaccugcuacaugucucaaaacuccugccuuagaucuuaggccgguuauguaguccuuggagccuuagucccugcaucucuacaaagggcggugauaagauuagaucugauguauguauuagcucuggcacauggugcguucccaauacuggcaucauguguuccugggaagaugggagaggguccugagaaacuccaagaagccaaaaguauguuuguccccaaagucuuugaguuguugccucauuuguuguccucaugggcaagugcagugacauggagggacaguuucuccccacucuucuguggcuaggugacugaguuugauccgggcuuugcagcucauuggaaguggugccagggccaaaaggcagggucuauggcuucgaggucagcgguucucagaugcgugcccccugcagucccggagugagggcagcgguuggggggcggcuaggccccgccuuccccuuagcuugucucuccuccuccagguauguuggccgggacccagcggcugcaccagccacaggaaacaggaacacucaccuggugucacugaagaaguuucuggauacugccuucaaucuccaggccuuugagggcaagacauuuuagagcugggcaaaaccuguguaggucucgcuguggguuugcuggggaccaagggggugaugaaaaggggaggggcggagcuccugcccaggagaggggcuguggggccccaggauaaaacagacacagugacagggccaagagccagcacugcuggccuuggugucaugccagaaucuaccaggacugagggagccagaggaguccuauaggcaggcuacugugcuggagcaucccccagcugcucccaucuugcuggaauuucuugggcggcuucuccaccuguaucucaagacagacacccgggggccugugucuguggccgcucccaucccggcagcccuggcugcugcucgccccacccucgcuuaucuguagauucaaagcgauguucucuucugugcucuuagaaguagggaguucagcaguaacagccaggugaagcgaaccugcugggugauuuguuugcgcucuguuuuauggggcauuccugcgagaugugucagcuucugugugaaaugcagccacagcucauguguaccaaaguagaaaaccaaaucacagagaaauaaaaacaugcuucagagagau

SEQ ID NO: 17502 - RNA, 16140 nt, Homo sapiens
augcuuaaauaguuccauagaguucuaagugauucacaaucccugaaucaacucugacaagugaagcuugggcugggguuuuaaaaauuauauccccuacuuuguccugugugagaaggaacuugugcaagcaguuucaugguccccaguggucuuugaaguucuggggugcaggaggguuugaggcugccuggggcgaugguuaggacugcucucagagcaggugaagccgcaggucucugagcgauccugaaagcccugcuccuucagcacaggugccccggguccagaguuuucuguuagggaaucugguuuucuccccguaggugugaggccuucuuaccaugaccucccauuugacgucauuagaucaauaucugcauuucccccucucuguuacucuauaguuaagaauauauacuacacauuggugcguaagaguggaaaguaaaaauaucauuucgacaugacugauuuucacacugaacauagugaaaacccucuuuaacucuauggggcuguguucuacuccagagggaccagggaaccaucucacauucugcugaggacucuuuugcgcccuccucagacgauauuaaugcaaaagaaggcaggucauuuucuuguuuuagaugagagaaauugaagauuugauuuuggcuaauuuuauaauagcaauuuaaaauauuuauucccucaggagucagaaauaaaucuguaggaauagcaagguuuccaaauauuaacauuugcuuuugguucagacuuucaaaagccuuuauucccacucuucccccaaccucucuuuaauuucaccuguucugagcacuuugaguacuaaacaauggaaucucagaugcuucuggcaacuauguguuauuagucaggaauggcaccuuguuauuugauugcauuuuauuguuuccuucagcucaauguguaccugauauuggagggcucucccuauggguugagauugagacauguuauaaaugaugugguuuuuauuauuucugugggcuccugugcagccaggugacaauccugaggcugcguaagcuggaggucaggcccgaguugcccuguucugacuagcagagcccaguguccacaccguggcacagccacuucugccugcaucauagaauggcuggggcagcugcuguugugccgacuugagaugccuguuccaugaggagaucaguaggcauucagcacggcuauccuggccuuuucacacagugggucuaguuuaccaucgccuccuagggaaacagauauaauugucuuuugguuagcuuuauauacaauuuguuaucauaucagacauaccuauggcuuccacccagagugcauuuucaaaggccaugggcugguaaaauguuaacuaguuuuuaauagaguguuaguggauugcaaagcuuuaacuucugagcacagagaggcacgcacagugccagccugccaggccagaagcucucauuugaauguugcugauagugucaugcacugcuggcauaucaacucagugucuuagcaagucuagauagaauaaacaaguggaaaaaaagcagcuucgaaagcaaauaauaacagaauacauauuauuaaaguacaaaaaccuauuaucccuuaauuccaucacaucccucgaaguccagggcuucacuucauuuuccuuccuguuuccaauguuuggggaaacucguagcaucacacacuuuacugugugguuuuggauacucuccugugugugccacugaaagcacagggcuuucaguacaaguuucaaacucagaaagaaacccaauuugaauccaggcaugauacacugaucauuucaacuagaaauugagggacuccucagaggaggcaaauugcuggcuggaagcaucgccaaagggcuuaccgaacuccaaguccuuaauguugcaguggaagaugacuucuucauucaccaugaguuccaccacauuccagucuucuaucuucucuaggaugaccucauguccaucuauggccaacacagcugggaaggaaagaaaaggaggugagugacauggggucagacuucaaacuaaccugacugguagcaguccucaugaugacaguagcuugucugccaucuaguugcucauggguaucacucaacugcccugguaggcacuuucuggguguuggccccaggugcccucaccuuugcugggaagcacagccagaggccugaguaauucagguuucaguugcgguuuguccuacaccaaggugaucuguuaaacaaugagcuuccucuaguaaagggcuauugggcuuuccagaggcucaaucuuauagagaccacacucagugcuggagaagacuugggggaauaggcaacuucuuacucugcugaugaaaguacaaauugaacaccuucuggagggcaauuuggcaguacguaccaaaagccucaaaaaaugauucuaaucuuuaguccaggaaauuacacuuaaaagaaagcuuccuaaggaaaaaaaauacaggcagauuuuugcaacaagaugucuuuucuccauuauuaugacagcaaaauaccgugaauaacuuacauauccaauaaugagaggacggccaaauaaacgguggaauguccaugugaugagauuuuauuuggacauuuauaaaaauguucaugaacuuuuuuaauggcaagaaaaauacaugcaauauaagcaaaaacuuaggauacaaauauauauaauacauguuuaaaauauauagucaauaugaauucaaauauguauguaaggaugaagaaaauaccuauugauuaucugucuguggugagauuaugggaaacuuuuuucucuuuauucuuucagcauuuuccagauugcguauaauaaucugaaaaaaaguuuuuuagaaaagcuaaugaacuaacuuuuuauucucaucuuuggaaucugcauuuugauuaucacuuacauucaauggcuccuuccccagagaacaguuauggaauaauugucagauuuaaucuuuuuauuguggaaaugcaaagguguguggauuagaagaaaugauguacauuggacagccuagagcucuauuuuuuccaauguauuucuccccacuuuccuggauauauuuaacccauaacaucaauauuagagugggugugccgaucauuaccuuuguuggucuucauauguuggugagaauuuuguuuaggauggaaagagaaaacagacgggggcauauucuuuaaagucuugccauuucaaucaguuuuacacggaguaaagcaaacaguuaugucaguuaauugcauuuaauuacagagacaauugcuguuucaaaauguugguguguccacuucuucaucuuucaaucaguucaagaacauccagccccaacugugaacauuuuaauugcgcgauuuuaauuucacuucuggaaaggaacuucagaaagagacucagcaaggaucuccauuaacaagacagcacucccuggguacccauaggcggcccuaauugacccaugucagcuaaugcgucucuaaaaaaaugccugcaucuuuuucauuggcauauuuaugauauugcauccuguuuaagugucucguucuuaaacgucuuugaagaaggcacucaguuuggacccacgacuuguuuaaaugaagcaguccagcucguuuggaaaggcagcugaucaucuagggagacauaaaggcaguccaugggcagagauuucugggaucccacacucccucagcagcaaccccucaggacggcggagcugcauuugucugaagacacuccuggaggauggacuucaauuugauaggaagaaaucaggagcaaaacaacuucuccauucccaccuuacacccgcaccccccaaccuccaccugugaggcaaggugcugccacucggcaguuaacacccagugccaacucucuaaggccuggaggagugagggugcauggacugugggcaaggagcagcccuacggguggaggccccaggaggcgagcacacuguagccugccccuggcccuccugcagggccugcugacugagccucacguggcaucugagcuuggaguuuagaggacaguggcacuuauacggcaugguguagcucagaaacaggaauugauccaccgaaucacuuacccuauugaguugaggggugccgaauaauggggguccaccucaucuucgagcaaaugaagcccaacaggaagaaacccucuuaagagacacaccacucuucacucugcccucuacaggguugcaaagcacaggcucucgugcucuuaaagggcaugugucuuccucacugaccagaauuaucuccaagugccugguuuuaauagaggcucacugaagaagcaaacacagaauggcccugggcacugcccacgacacuuuuggacccacagagugaccuaagucugauucuugcuaaagcaacaagcuaccucagagucuacauugaauauucagccccaggacauucccuucccaucacucugggagguguugagcuggcuuggcucuaagguggccagugcaggcuuaagggaucaaacacuagacaccccggaauuccugcagcucauccaaaugccacuucucuacacggagcacccauuuccucccaugagcugcugugggguugucuagucaaagaaaggucagauaaauauacucccugaaacaaagccugugcgaaggcaguggguaaacuccagcauaaaucaaccagaagcuauaaggccaccugcaguccgccugccucuuugaaguggcaccucauucuucaagggggaucuaaauaaacgaaagggauauggaaaaggcucccuccuugccggugcugguggaacugcacagcaucugcgaaugauuuaaaugccgcuggucaggaagcagagguaaacagaccucucucccuccucuacucagcacagaggcauacacacacccccgcgcaagggccgcugaugcauagcuagcacaggagaaugccacacagagugucucagcuacgugggguggauucuauuuuauggauugguuucaauuccuuccaagcccuuugagugggucauuuggcaaacuuaaguagagcaugcaaggggcaaguguggccagggaaauuacuuagaacuuuuuguuaagcauuaguuuagcuucaccagcauugaggccauaguggaaacauuuugcugaguuauuauaauucauggauaauaaagaaagaacaaaaauuuucagauugcuaaaggcaugguaaguucagaaaagaucaggccuauuucuaaagccagcagggcuucgggaaaugauaaagagcuguaauuuuaaaagaaacacagagaauucagaugcagauuuuacagaggagggccugcaaagguaccacucucugccugcugugcggugagugcuggaucuaaaguugugggggggugcagaugcucccugcuuugcugcggugaacacccuggcccuuguuggcugccgguauuacaugacuuaucauucaucgaaacacagaacugacuuuacaaaucaaccaccuacugauaccuugcaacccucaagucuccuucagccauaaaaaugcuccucuugcucuuucuccaaauacucuucccuuccccuauugugggaagagccaccugcgccugcugccuucgcuuuuugcuguguuuccacccgcucaccuccugcagggaagccuucagcucaccaaguccagagccugccgucucagaggucaggaaaccaucgcacauucaauggcuucccagcgcuccccaucccucucggacccaccuccuuucuuguuucuuuaaaauacuuuugaugguaaaaacaaauauguuuuuugaucucuaaauuuuaaaaaucaaguuaucaauguaaugaagauucauaauacuuuuuuaaaaaaacuuuaaaauuauagaaaaggacaacauuuuaaaaaugaccccuaauucuucucucccucugucuuuuucaguggcaguaagaccauggcauucaggacaaugcuuuguucccuucgcagugcaucaugugccccagcccugucacacacauagaguggcugcauucuucuucagcgcuguguaggauuuuacaugauguacgcacuacaauuuauuuacccauuccuuuuucugauuguuuccaauuuuucgcuaucgcugagaauguuguagaaaacauucacagcaugcauccuagugcgugugugagguuuguuuuuucuuuuauaaggaagauauugagaaauggaacagcuggauucuacaguauaugaucacauuuuaacagacacugccaaguuguccucuaaaggugacaguucaauuuacucucccgccgaggguaaauuaggaaaauacuuuuuuucucagucuuucaucagccaugaauucuucucuccuagaaaucaccucuacucaauaguuuggagcccacugguaauuuucuuccugaaaugccaucgcuugcccccuuaugccuccaguucucuccucccucugccccugcuccuccacaggcugcuccucuuaacacacccugcccucggggggcugucucaucauccugccaucuccaguccugucuuuccuugcuuccuccgcagucuugccuccugugguucuagcauucggcuuuacgcagguugauuuucuuaacuaauguuuauucuuacaauaugccaggcacagcucugggcugggacccagcagagaacagaaccagaaaagaacuccugccccuucccuccucaaagcaugccuccaagugggggagaaggguaacaagguauacaggugagugcgugcugagguagguaauuacgagcaagaagaagaaauaaggagggaagggagaucaggaagagggaggcagagggaaguguugacauuuuuguugggaugcccaaggaaggccugcccaugaaggugacuuuugaggaauaucuugagacugagagaaugaagcugaagaccacguaggaaagagcguuccaggcggagcggcugugaagcccugaggugggagcuggcuaggaucauugaaggacugcaggagguggcuguggcugcagcagcgggccagggagaggauaggcagaagcaggagggggugagaugagggggugagaucaggggggccauaaggagccuagagggccaugugagccuuuggcuucuccccugagugagcugggggccccuggaauguucucagggguaaaggucaugcuguuucaugugauucagguuuaccgguaucagcuggcuguguuacugagaacaaacugcaagcagaugaggguugcagggaagucaggaggccagggcaguaauccaggcaggagaugauggcggguggacaaaaaaugcagaggggguagucaggaggccuaagagggauuaauucugggcguacuuugagggcagagcugacaaauuguguugacagacuaaacagggaguguaagggaaagaggagugagaggugccugcagggugucuggccugagaaacugcaagauggagcugcugugagcaguggagagggaaagugggcagagcugcuggugggggugagugcuaggggucuagcuggaaauuuggggcauacuaagucugagaugccuacucaacauggcaguggcuacgagagguccugauuaaagacauaaauuuggaaguucaucgcauauaaaugucauuuaaagucauagcuacuccugacucaaaucuccugccuucaucuuucuuccaaacuccagaacguaauuuccagccacuggcuuaauauuucuuaauaguucauuccaccccacacccugccauuucuccuucuuaaauuucuucuuccaaaauuggacucuuaagguacaucccagaucucaucauccuuuagcucaagaaccuucacuggcuuccuguugccaaggaugagacaggcuggacucuccuguugcacauccuccuccaaccagacccaauagccugcugcuccccagaagugcccagguugccugcaccuccccuucgcaaugagccuuccucaggaacaauaagaacuaacgcuugcagagcccugacuguguguacgcauggaguuaauuacuuuacaugcacuugcucaucagaaucucacauuggugaggcagggauucacauuccucuguuaccaacaaggaaacugaggcucauaaagguaaaaccacuugauuuucaccuugacugcaaagcuacuaaaugguggagcccaauucaaaccauauguguugacuucagagcccuugugcuuauccucugcucaugccaucucccugccagaagugccaaaaauguaggcaggagauaagugaccagggagaggugacaacuaaagcugacaugauuuguggacaaacuagauggggaguuucccccccaauacugauaaguuguguauuauaacaaaauguucauuuaugcauccugcuuuaauaaaauuuuugguauguaaaugaucuaauggaacuccuacaaucaugcugguuguggcaggagcaaggaacuuaugucagcaaaacagcagagcagacagcuccaaacucccauuccucugcagauacauaaaaaacaaaacaaaacccagaaacagucagaaccaacauugucaaaacucuggaaaacagucaaaggucuacagcaaccaagugaauacugaaucaaagaaaaggcaacuuuaaaaugguaggaaagcuuuguggcauguuugccugcccuugccucaccuuuucucugaccugguggcagucuugaagauagcagccuguguucccaguaugggacucugguucuugauuccagagggagguguaccaacagggaguaggucacaaggaccacaugcuucaaagggcaauaaagaucacagggcaaggcaaaauuaggauuacugaugagagucuaugucccgcugugcacucauugucuugauaagcaucuuaacaggaaacaggguucgagagcagacaaccggucugacuagaauuuaccaggcuggaauuucucaauccuaguaagccugaggguacugcaagagaccagggcguauuucaguccuuaucucaaccgcauaagacagauacuccuagagcagccaucuauagaccuacccccuggaaugcauuccuuucccagguucucaauuauuaauauuccuugcugggaaaagaauucagcgauauuucuccuacucacacgucugucuacaggcuuucugcaagaagaaaaauacggcuguauucugcccgaccccgcaggcagaccuccuguuuaucuucccucauucccugaaaaucacuguuauucuguucuuuuucagggugcacugauuucauauuguucaaacacacauauuuuacaaucaauuuguaaaauagugguccugaggugacguacauucucaguuuaugaagauaacaggauuaagagauuaaaguaaagacaggcauaagaaauuauaagaguauugauuggggaagugauaaauguccaugaaaucuucacaauuuauuuucagagacugcaguaaagacagguguaagaaauuauaaaaguauuaauuuugggaacugauaaauguccaugacaucuucacaauuuauguucuucugccucagcuccagcuggucccucuguucagggucucugacuuccugcaacaacccagucugaggaguagaaaggaaaaagaaugaagaaaaaugaacagcccuggagaccugugggaugcccucaaguauaacaacauauaccuagugaaagucccaggagaaaaggaaauagagaaagggacagaaagaauaucugaagaaauaauggcugaaaacuccccaaauuugaugaaagacaugaaaauaccuauccaagaagcucaaccaacuccaagcaggauaaacucaaaaaguauuauacuaagacacauuauaaacaaauugucaaaagacaaagagagaaucuugaaagcagugagaaagaaaugacucaucacacacagauucucaauaagauuaucagcuuucucaucagaauccauggaggccagaaggcagugggauacauauuuaaagugcagaaaggaaaaaaacaagaaccuguuguauuggucacaauucuccagagaaagagaaccaauaaaauauauguguguguaaguguguguguguguacauauacauacacaaauauauauacauuauacacauguacagauguuccucaacucacagugaacuuaagucuugaugaacccauuguaaguugaaaauauuuuaaguuaaaaaugcauuuagggcaccuaacauacugaacaucauagcuuagccuagucuacuuuaaaaaugcugagaacacuuacauuagccuacagcugggcaaaauuaucuaauacaaagccuauuuuacaauaaaguguugaauauuuuacauaacuuauugaauacuauacugaaagugaaaaacagaaugggguuguauggguacucaccauuaauguacacagcugaaagcaucagcauauagucaaaaaucaaaagucaaacaauuguaagucagggaccaucugugugugugcguguguguguguauguguguguuugagagagagagagaaagagagcagagagguuuuaaggaauugguucacaggcuaggcuacagacagagguagaguuucuauguugcagucuuggggagaaucccuuguucuuugaaaaacaucaauguuuguucucuuaaggccuucaacugauugaaggaggcccacugaacguuuuccccuuaagaucaagaacaaggcaaggaugcccaccuuugcacuucuauuuaacauaguauuaggaguaccagccagauaaauuaggcaagaaaaagaaauaaaagucaucuaaauuggaaaggaagaagacuaccucuauuugcagauugcauaaucuuauaccccaaaacugcuaguguucuuaaaaaaauguuguuaaugcuaauaaaugaaauuggcaaaguugaaggaauuaacaaaauuaacacacaaaaagcaguuguauuucuacacacuagcaaugauugaucugaaaaggagauaaagaaaacaauuccauuuauaguaguaucuaaaagaacaaaacaggaauauaugcaaacaauuaggugcaagucuuauacacugaaaacuauaaaaguugcuaaaauaaauuaagaaagaucuaaauaaaugaaaaugcauccugugugcauggacuaaacggcuuaauauuguuaaaauaacaauacuacccaaaggauuauacagauucaaugcaauaccuaucacauucccaaugguguuuuuugcagaaguggaaaaaccuaucuuaaaauucauagggaacugcaagggaccuaaaauagauaaaacaaucuugagaaaaaacuaaguuggaagacucacauuuccugauuucaaaacuuacuagaaagcuacaguaaucaaacucaugugauacugacauaaggauagacauauaaagcaauggaauagaauugagagccuagaaauaaauguucacagugacugaugugaaugaacagucaguugauucuugacaugggugcgaagaccauucaauucguaaagaacagucacuuuaacaaaaggucuugggauaauuggauauccauaugaauaucuuuuuaaugaauuuggacccuuacauuacaccauauacaaaaauuaacucaaaauggaucaaagaucuaaauuuaggaauuauaaaacucuuagaagaaaacaugggggcaaaucugcauaaucuuggauuugacaaugguuucuuucuuuuuuuuagacagagucuuuugcucugucacccagucuggaaugcaguggcacaaucuugauucacugcaaccucggccuccagggcucaagcgauccuuccaccucagccuccugaguagcugggacuacaggugcgugccaucacacccaccuaauuuuuguguuuucuauagagauggcugguuucuacaaaaagggcugguuuugaacuucaaaccaggcuggucuugaacuccuggguucaagugauccaccugccucagccucccaaagugcaggcauuacagguaugagccaccaugcccagcagacaaugguuucuuaaacagcauaucacaggcaaaauaagaaaaaaacagauaaauuggacuucauuaaaauuaaaaauuuugugcaucaaaggacacuaccaagaaagugaaaagauaauuuacagagugggagaaaauauuugcaaaucauuuaucuauuaagggucucauauucagaauaucuaaagaaauuuuccaacucaguaacaaaaaaaagugcaacccaauuuaaaaaaugggcaaaggacuugaacagacauuucuccauagacauacaaauggccaauaagcacaugaaaagauguucaacaucaccaaucauuagggaaauuuaagugaaaaccacaagcuaccauuucacaccuacugcgauggcuguaauuaaaaccaaagaaaauugaaauccuugugcauugcuagugggaauguaaaauggugcagcugcuuuggaaaacaguuuggucauuccucaaaaaguuaaauauagaauuaccauaugacucagcaauuucagucccuuaaaacaaagggauucaaacagauauuuguuuaccaguguucauaacagcacuauucacaguagcggaaagguggaaacaacccaagugucuaucaacagauaaacagauaaacaaaauauggcauaucugccacaaaaaggaauaaaguaguauaauacaugcuguagcauggauaaaccuugaaauauuaugcuaagugaaauaagcuacaaaguagauugcagguuaccaggggcuggggguggaggugagaggugaagccagcugggcuucugggucggguggggacuuggagaacuuuucugucuagcuaguggauuguaaaugcaccaaucagcacucugugucuagcuagaggauuguaaaugcaccaaucagcacucuguaaaaugagccaaucagcacucuguaaaauggaccaaucagcaggacaugggcgggaccaacuaagggaauaaaagcuggccaccugcgccagcagcagcaacuggcuccugucccccugcgccagcagcagcaacuggcuccugucccccuccacgcuuugggagauuuguucuuucacucuucauaauaaaucuugcugcugcucacuuugggucugcaccaccuuuaagagcuguaacacucacugcaagggucugcaacuucauuccugaagucagcgagaccacgagcccaccaggaggaacaaacaacucuggaugcaccaccuuuaagagcuguaacacucaccgcgaggucccuggcuucauucuugaagucagcgagaccaugaacccaccagaaggaauaaauucuggacacagagggauaggguguuguugcuuaaggaauacaguuucugucugggguguugaaaaauuuuaaaaagagagaauagugaugguuccacaacauuguaaagauaauuaaugucacugaauuguaugcuuaacaugguuaaaauggcaacauuuuaaauauauguuuuacccacguuauuuuuagagacagugaacauaaacuaaagguagauuaugaggugaggguggguagguguggcucaucagagggggaggaagagaaaagucacuuauuuaggcugucuucuuagccaaaacuacaaaacauuuuaaacaucaccaugcaacacugcuaggaauugaauuguugccccccuucccccaacuucauauauggaagcccuaacucccaaugugacuacaggugcuuaaagagguaauuaagguuaaaugagguuauaaggaugaggacccaaucugauaggauuagugucuuucuucuuauaagaagagacaccagugagcuugcuccccgcucuccccauauaaucccaccaggugaggacaaaagagaagguggcugucagcaagccaggaagagcgcccagagcccucaccagaagcugaccuugccagaccuugaucagggacuuuuagccuuuagacugaaaaaauauauuucuauuguuuaagucccauagucuaugguauuuuguuuuggcaaucccaauagacaaauacaaacauggagguauuugcaacagaaauuucucuaucaacuguucucucacagaaaguaacuuccucugcugauugaaauccuacccauccuucaaacucaaacucaaaugccaucucuuccaggaggcuuucccugauugcucagcuaaaacuaauuuuuguguccuuaggcuucaggguauuuugccuggaagacucuuaguuugggucauaggaugggaguucaucaauggucauuccugggcucucaucucauucuauauguucucuccaagucaaugacucacaucuuucuaucuccauuucagacuuuuucucugaacuccagaacaacagagcugauucagcaccucugucuagguagccgaaagcacaugaagcuuaauucagaugcuccuugacuuaugauggggcuaggucccaaugagcccacuguaaguggaaagugggcuuaauaccuggauaagcccaucauaaaguggaaaaaucguuaaguggaaccauuguagguucagaugugccucaacuuaggauaggguuaccucccaauaaacccaugcuaaagucaagaagucuaaguuggggacuaucuguaugaccaaaauagacuguuccuuuggaacgauuccacauauuccuccaaauuuugguccaucuuuggugucuuugauuuuaguggacaguacauccauccaucagcacuguuucaagucagacacugauuagauccggauaacauucuuuuuacccuuaccucccaccuccauccucucaggaaguaccauugcuuucacuuugauccauggucuccuuuaugguccaagcuacucucaucucagcccuggaccaccccaacagacuugucuuccuuguuuccacucuugcccccucuaaucuguucuccucagagcagcaacagcuucauccccugccuaaaacuuaucugcggcacugcaggaucuggccugauuaccucuccagccucaucccccaucaguuuaacaaauauuaauacaucauuuauugaaugccuccagccauugccuauauuauuagucccucugccuggaaggcauuccucucuuuaccugguuaguuucuacucauucuuuaaaggucuacuuaaaugugggcucauuuaaggcuccacuuaaaugagccuuuccagaccucucccucuccccucccauuauggcuagucacaggucccacugugguuagcucccauggcaccaccuagccucagucagagcuuaggcacagcugucauuuagcaguuaacaaggagauuacuucaaggacauucaucacuguuuaacaguguguccucagucccuggaaggguguccaacacacacugcgugcuuaauaaaagucugcugcaugaacgauuaagagauggaauaccagcaacgcuacuucccagccauuugaguugugaaagucacuuaauauucuugauccucaguuucccaauucuuaaagcaggguuauguaauuuuuucuauggagguaauuucuguaauuugcugggcacugggugggcccacagcucacucuuggauagaagagccuucccacucuuuuagcccagcccuggaagccauagguugcaacaucauccuggggaagacuuccuggagagguggcgcuucgugggggucugaggaaggccuaggcacagggcaccaccugcacggaugcucagaggcuggggcccucaggggcgcacgcggcgaggaggcccaccuugcaggcccugcaggcggaagguguggugcuccaccgguaggccugccgcgcuguagggcccauagcgcaggaugaccacugcguucuugggcaucgccaggccuccgccgccgcagaggcaagggagaa

SEQ ID NO: 17503 - RNA, 861 nt, Homo sapiens
caggcucagggaggcucccagggggccaggucuugcuguaagcagagccugcaggcagcccugccggcaucucugggcccaggaguucaggacuccaggccaguggcaccugggcaggggaccccacagccaccucaacgccuuuccucuccagcccugccuuuuccugacaagagcugcagcaacacaguggggagggaaguugggggcccuggacagccuucuguaccauaugagacagggucaggggaugcaagucacucggagggaagacaugcaagggaggaggaaggcuaaggugugugcaaggggcaaaccccuuggcucuucccuuguccuuuucacacagcccagcuggagggcaagcaccucaggguuaugagcaccagaacugcacacgcaggaucccacacaguucucagaacuccauggggugagggcuuacuaugcucauugcaccagggagggaccuggagcucagagcaggugagcaacuugcuccaagaggcagggcagguguggccuugcagauucugcacacagagcucucugaggcucacacccagcucuguucccccuacaggaccaccagggggacggcaggugcuuacuuccggaguugaaacuuucgaucuguugaauugccugcaagaaaaugaagaaauauugagccuggacagugagaugcucccacugaugcucuaagauuuuguagguuaggguuaggguuaggguuaggguuaggagaucaaggggucuauaccuuucuaaauccugccugcaugaaugugugaccgucaggcacaauuuucugaaguuggucaagaccguuuuuuauucuauuccugaaaaaaauuuaaa

SEQ ID NO: 17504 - RNA, 1281 nt, Homo sapiens
uggaacaauucccccagcuucucacucccagggccuccccuccaugaucaccgucucccucuccucccugaggccggaggccuggccaugcccauagggacaacgucuccccagcuuggccuuggugcucugggaccuccccaacugcacaacaggcucccaagccgggaaugcuuuugucucagcuccccucuagaccuggggagcccuccauggaaaaccacagucgaaaaauggauuuaguaucugcauuguucagggucauggcaagaaauggcauugaaugcuucaaaugaugagacuuuaauggcaguaguccuuacagaaguguggccaggugaagaggaugaacagggauguugagaagcacgaaaacaaacaacucuaggaugcuguuacucauggggcuagacagagaggaauaguguugccacagccaguaagagcuagagauguggagaagggguuuccagcaggagcugaugucuuggagagacacagccuuggggaggggcaguggggacgggguggggggauacacugaccacucucucucuuccuauacuuuugccuuccagcuagagucucccacuggcuaauuccaaccucugcccagucaguaagaaagccugagaggcagcuuaaagaagucagguucccagggucaagcaggacacauggcuguggggguggggaaggagagugggcaaacacccugaaacuaaaaggagaguagcagugcagaauccagggccacugaaaacaguucccagaguccaacuccgucguuuugcaaauggagaagccaaggcuggaaaagguuagugauuuucccaagucacacaaaguucguggccaggcugagcccagaccccagauccccauccccccugcugccugugacacaacaaaggccuugacaccaacacucccuucuguggagucccuuguaguguuuaugcacuaaaaaucauuuuuaaaacauuuuaauaggguauauugcuuugaaucccuuccccaacaggaaauaugcuggcuggcuggcagaaggcucagcagcugaccuugaacucccuugaccuccccacauccaggcugagauuuuccauccaacgguauugccagagcccaagcugaauggaggaggcuggaauuaaacaguaauagccccuuccaguuaucguucuguagccagcagcuagauaaauauucggaaaacaucggaggagaaaucuaauugaauucaaacauaauaaauugaagccaacucacuggauuuau

SEQ ID NO: 17505 - RNA, 1281 nt, Homo sapiens
auaaauccagugaguuggcuucaauuuauuauguuugaauucaauuagauuucuccuccgauguuuuccgaauauuuaucuagcugcuggcuacagaacgauaacuggaaggggcuauuacuguuuaauuccagccuccuccauucagcuugggcucuggcaauaccguuggauggaaaaucucagccuggauguggggaggucaagggaguucaaggucagcugcugagccuucugccagccagccagcauauuuccuguuggggaagggauucaaagcaauauacccuauuaaaauguuuuaaaaaugauuuuuagugcauaaacacuacaagggacuccacagaagggaguguuggugucaaggccuuuguugugucacaggcagcaggggggauggggaucuggggucugggcucagccuggccacgaacuuugugugacuugggaaaaucacuaaccuuuuccagccuuggcuucuccauuugcaaaacgacggaguuggacucugggaacuguuuucaguggcccuggauucugcacugcuacucuccuuuuaguuucaggguguuugcccacucuccuuccccacccccacagccauguguccugcuugacccugggaaccugacuucuuuaagcugccucucaggcuuucuuacugacugggcagagguuggaauuagccagugggagacucuagcuggaaggcaaaaguauaggaagagagagaguggucaguguauccccccaccccguccccacugccccuccccaaggcugugucucuccaagacaucagcuccugcuggaaaccccuucuccacaucucuagcucuuacuggcuguggcaacacuauuccucucugucuagccccaugaguaacagcauccuagaguuguuuguuuucgugcuucucaacaucccuguucauccucuucaccuggccacacuucuguaaggacuacugccauuaaagucucaucauuugaagcauucaaugccauuucuugccaugacccugaacaaugcagauacuaaauccauuuuucgacugugguuuuccauggagggcuccccaggucuagaggggagcugagacaaaagcauucccggcuugggagccuguugugcaguuggggaggucccagagcaccaaggccaagcuggggagacguugucccuaugggcauggccaggccuccggccucagggaggagagggagacggugaucauggaggggaggcccugggagugagaagcugggggaauuguucca

SEQ ID NO: 17506 - RNA, 548 nt, Homo sapiens
ccuuuucacaacauggcgccgaaagcgaagaaggaagcuccugccccuccuaaagcugaagccaaagcgaaggcuuuaaaggccaagaaggcaguguugaaagguguccacagccacaaaaagaagaagauccgcacgucacccaccuuccggcggccgaagacacugcgacuccggagacagcccaaauauccucggaagagcgcucccaggagaaacaagcuugaccacuaugcuaucaucaaguuuccgcugaccacugagucugccaugaagaagauagaagacaacaacacacuuguguucauuguggauguuaaagccaacaagcaccagauuaaacaggcugugaagaagcucuaugacauugauguggccaaggucaacauccugauucggccugauggagagaagaaggcauauguucgacuggcuccugauuacgaugcuuuggauguugccaacaaaauugggaucaucuaaacugaguccagcugccuaauucugaauauauauauauauauaucuuuucaccauaaaaaaaaaaa

SEQ ID NO: 17507 - RNA, 548 nt, Homo sapiens
uuuuuuuuuuuauggugaaaagauauauauauauauauauucagaauuaggcagcuggacucaguuuagaugaucccaauuuuguuggcaacauccaaagcaucguaaucaggagccagucgaacauaugccuucuucucuccaucaggccgaaucaggauguugaccuuggccacaucaaugucauagagcuucuucacagccuguuuaaucuggugcuuguuggcuuuaacauccacaaugaacacaaguguguuguugucuucuaucuucuucauggcagacucaguggucagcggaaacuugaugauagcauaguggucaagcuuguuucuccugggagcgcucuuccgaggauauuugggcugucuccggagucgcagugucuucggccgccggaaggugggugacgugcggaucuucuucuuuuuguggcuguggacaccuuucaacacugccuucuuggccuuuaaagccuucgcuuuggcuucagcuuuaggaggggcaggagcuuccuucuucgcuuucggcgccauguugugaaaagg

SEQ ID NO: 17508 - RNA, 4484 nt, Homo sapiens
ccagaggcagcuauaaaagcauguugggccaguccucagcauccuaguucaccacugucugcugccacacgaugcugggaggccuggggaagcuggcugccgaaggccuggcccaccgcaccgagaaggccaccgagggagccagugaggaccuggggcuccuuucuaccugggcuggggggaucuggggcagacugggucugugggaggcggaucuaaguaggcaggugaggaccugggaggaggccuuggccccucaggaacccugguccccugcucuaccaagucagcacggaguugaggggugcagaccuggggaggucuccugggggcagggcaugaguccuggugcugggugaacacuggcagcuuggacccuucccucuggaaaucuggggagccuuucuugucaaaacagccuauucugaauaaccuaugcaggaaaaggaagauggauuuuuauuuuuaccauaacuuuaaagcuucaaagauuucuaaacaagucaccaagucuguucaaagucaaaaagggcauuuucaauuucauccaaguccccugaagcauguuuauuuuuauuuuuauuuguauuugaaauggagucuugcucuggcacccaggcuggaguguaguggugcgaucucggcucacuguaaccucugccuccuggguucaaagugauucucaugccuuagccuccugagugucugggauuacaggcacccaccaccaugcccaacuaauuuuuauauuuuuagcagagacaggguuucgccauguuggccaggcuggucucaaacuccugaccucaagugauccauuccucuuggccucccaaagugcugggauugcaggcgugaaccaccgcaccuggucccgaaguguauguuguauucagaggucagcagcuauguguggggaggcccagccaggagccacucaugggucaucgugugaaaaacagucuugccugaguuuguguccucuuucuaaauggcagcagacgcguauuuuguuuuugacucugcagcugguguggaccaccugcuuuaaccuuucacuagccucugaguuuuguaugauuccuguugggagaaaagcugaguguugggagagaagcugaggcagggcuugcuagauuggcuggcuccuugcuucuagcacucccauuuucucaaguagccguauguuucucauucacuugauacaccguuuccuuucaaccgccacauccucaccaccuguuucuuuguuagaucaccaauaaauagcauggguucccagaacuccgggccuucgcagccuccacacucgcgauggcgccccgcucccauuuucucucucaaacugucucuuucucauuccuuugacuccucuggacuugccgcccccgcgaccugguguugggucucaucaccccaacagauucccauucuaaagaugagggaaccaagagguggaagguagaguuagaauaagaaccauuucuucugacucugaaauccuucaguucuagcaugcuaccaccuacacuuuaaaaaacucugaaguaggcagagaauucccuuuuguuggaggaauugcuuugagagaccugguuuuacuggaugaggcuuuggaaaccaaccugaggcaggcgcuagcacauccugagaggggugugaccuggcacagaggcccagccugggcuucaugucucagcuggcaagauggccugcucauugccauuccaggccgggcagggccaaggggcuucagggacccaugcccucauggggcucacugagcucgucucccggcagccaaggcccuggcgucuccgaaggaagccagcugugggggaagguccuucucaugagccagucuguccuggcuggggguggcaucccagagccccaucuaggauguccagggauguauagguccauugugaggauaagccagcacugagcccucacccuggacugggagggcagugggccugcucugagcccucacccuggacugggagggcagcggcucugcucugagcccucacccuggacuugucuccucuguucaguucaugccguggaagaaguggugaaggagguggugggacacgccaaggagacuggagagaaagguacagcuggcugaggucgggcagggaaggagggagggagcaagggaagcuaggugcugggccaaccuguucuuugacuaaccaggucaaacucugcccccaauguugcagccuuucagagccucuuggcuggggcaguuaucuaugcucaucagaggccacagacuguacugcguuagggcacugucuagaugguucugucuguggaauaagaagacaaagucacacaagacuaugugacagcacacugggacaaaacauuuaacauggcagggcgcgguggcucacgccuguaaucccagcccuuugggaggcugaggaggguggaucacgaggucaggagauugagaccauccuggcuaacacggugaaaucccaucucuacuaaaaauacauaaaaauuagccgggcaugguggugggugccuauagucccagcuacuugggaggcugaggcaggagaaugguguguaccugggaggcagagcuugcagugagccuagaucaugccacugcacuccagccugggcuacagagugagacucggucucaaaaaaaaaaaaagaaaaaaaaaauugcugggugugguggcucacgccugugaucccagcacuuugggagccugaggugggcggaucacgaggucaggagauccagaccacggugaaaccccaucucuacuaaaaauacaaaaaauuagcugggcacgguggcgggugccuguaguccuagcuacucgggaggcugaggcaggagaauggcgugaacccggaaggcggagcuugcagugagccgagaucgugccacugcacuccagccugggcgacagugugauacuccgucucaaaaaaaaaaaaaaauuuaacauguaaaauucuauguuaaauguuaaauugaugugugugagcuaugaguagaacuauguacaaagcauauguauaucucauuccuuuucaacaaaauagauuccagguagaugaaggacuuaaauuuacauaaaugaauuuauuaacuuacuaggagauaaccaucuuagcucaggcugcuauuauaaaauaccauaggccaggugcaguggcucacgccuguaauccuagcccuucgggaggccaaggugggugggccaccugaggucaggaguucaagaccagccugaccaauauggugaaaccccguugcuacuaaaaauacgaaaaccagcugggcgugguggcacaugccuguaaucccagcuacuuaggagucugaggcaggauacucccuugaaccugggaggcggagguugcagugagcugagauugcaccacugcaccccagccuuggugacagagcaagacucugucucaaaaacaaaaacaaaccauaaacugggcgacuuagaaacaacagaaauuucucacacuccuggaggaugggaaguccaagaucaaggaaggcacuggcagauuuggcaucuggugagggagucuuucugguucguggaugggcccagcucuguccucacaugguggaaggagcuagcucucuguggucucuuuuaugugggugcuaauuucaaccucccaaaggccccaccucuuaauaucauuacauuaagacugaggauuucaacguaugaguuuugagggggaagacaucauaaacauuuagacauaguaauaacauaaaagacuuuggccuaaucuuggagaggggagaaucuuuagaaccaugacaaaaaaaucagcgccauaaaggaaauauuaaguaaauuugacaauccaaaacugaaauuuucuauagccaaaaaaaaaaaaacuauaaaccaagccaaaagaaaaauuacacacugaugaaaaauauuugucauaaaaaugauaauccaauauaacaacccaauauaaaaauggucaaaagacauaagcaggcauuuuccagaaaaaaggauaagcaggcaauguacccaugaguagaugcucagucucacucacaguugaagaaaugcaaguuguuggggaaauuaaaaccaaauucaaauucauucugcaguaauccugcugcccuuggucccaucgggccacuccagagacuaauccauuaagauggccacaucccacaggccacucaaggggacacaaguucagcggguggaucacuaggacauucuuccucuuucuuuccaacagccauugcugaagccauaaagaaagcccaagagucaggggacaaaaagaugaaggaaaucacugagacagugaccaacacagucacaaaugccaucacccaugcagcagagagucuggacaaacuuggacagugagugcaccugcuaccacggcccuuccccagucucaauaaaaagccaugacauguguacauugag

SEQ ID NO: 17509 - RNA, 4815 nt, Homo sapiens
gcaggagugggcucaaguuuuauuuggaaucauuuaaaaaaaaaauucacagcagcauaaguggggucagaaggaccagaggguggguggggccgagggagggcagugagguuggugcagcagcacagguggacaggccaaggguggccagggagacgagggcaggagcgugggcagccgcaugucacucaaggcgggcacuccuugugcuaggaggggaugguguccaaggcagaggagcgcucuucaggucauccacgcuggccuguagcccucuagucucccccacucugggccugggagagagaaugaccugcacacccagcuccaggccccagccuuaaugggccacccugagugggcugagaaaaguugucuucugugccccaugccugaggggucauccguggggggaccucccacucagguucaggguuagcccuguacacagucccuguaggggcuguggaaggucaggaggccccucugggcccugggagcccaggagggaagcagugcgucugugggggauggggucccuaccaaggaaccccccauggugcaccccaggagcccagcuccuaccuccucugccacuuccucuuucucuuuggaugccucacccuccuguuggggggcagauggccucaaguccuccuguaggggacaaaagggggcaugagaccauguggagaaugcagagaccccuagcugcccugcaaccagggccuugucuacccuggccucaaggaggagcagaggccccucguggccuuguuguacuuggaggggcuggagguauugggggcgugcaauucagacaauacccggggcucugaugaugccgaggccuuccaggggcaccaaguacccuggagcccagcuucaccccucaagcugguccccagucucugggaagccccuaguugggcuucacugaugaggaaccugggugggguaggguggaguggggguuagagugggcagaggccccugaagccccaggucugaccccacccucaguagcccuacaaggaagacugauugggguucacauagggacucugaggccagggaggcuuggcaugcagcucagggccuucgagcucaaaguggugggguguguuggcaucagaucaggcuugcuucaggcccacuucaguccacaggagcauggcucccucucuuugccuccuggacaggcucugggcucaggcuggucagggccagcagagguuacacaguccucucucacuucccaucuucuaucuccugcacuccaugccggccagacacuugcgugagauaucaugacagcuggguguguaggaccacacuggugauugcccugcacucuggccucagcaccugccucuggcgggggacgggggggaggcggggauacugucaccucuguguugccccagggccauccugccccuuggcggaguggggcauaaaagggcagugcugugcuggcgggagucggccaggcuauccaggggcagggcagguggccaccugcugaguccugcugcccuaaggcugaugaugaggccagggguaugaguggucagauagucccugcugaggccuuucacaguucacugggagaugagucgugacugguuuuggggugucaccaggaaaugagucucccucgagguggcuccaagggcucacuagcccugcuccgggauucacaaggaaugcccgggcacccucaccccagggccucuuuugcugggggugaggagggaggagcccccuggggcucuauguguucugccugggacacaugaugaugaugaugaugauggucaccuuccucugcugggugcucacauagaccaggagaauugcuucauggaggucauggcccugccucaucacacagcccagggaggccgacacucucacccccaucuugcagaugagaacacggaggcccagagagguuccuuugcuucucaaggucauacgacgagaaaggggaacuaggagagggagcggcugccagcuccaaggacauggagacccugugcuggcccuggaagcagacaccugggcaucgccccagagccaagaggaguagggcagcccccacccuuccacccacccacuccuaacgcagggauucucagugcucagagccucagacuccaccaccuaggaggccuggagcagguaggagagcuggacacugcucccccgccccacccccagguaggaauccuagcccaggccaccacuuacacugccacagggucucucagaguacaggcugcucaggggaauuccaagcucacaugaacuagccaugggaccuugggcacauuaaucucucugggccuuaguuuccacaccgucucauggauuuugugucuauuaaaugaacuaauaagcguacaaugcguaaagcagagcuugcugugucacaggugcugggacagcucacccagccaacacccgucccuggggugcgccccacugcuccugugcugucugcuauugggccgcacacgcauguguacauucacacgcauguacacccacacauucucacaaaugcacccacaugcucacucaacacacgugcacacacacacaaaggcagcugcagaggguagggucagaagcagcacugcuuucuuaccacuaggggacgcuacuucccugaggcucccagcaggaggcagcugccccgcccagcccagggagggaggcuaggcccugggggcggggcuggugcuacucagcccccggccuggugaccacugcccgggaggcugccugucaccgugugggauccuguuuucacuuauaaaauggggugucuccuaagugcugagagccguccggaagaugugguuuugagccucacuuuccuugucuaugagaugggcucccaagucccccgaaggggugguuguggugauuccagacccgaaugcaggucgaacagcaagcauggaccccaccccaugccggcgcucaguggguacugaaacugaagccagccgcagccccccguguuguuuccugggguguggaguggagugaugccgccuccgcccagcagccuuucugggcccaggagaggacugggcaggucugagggccggggcucaccuugcgcaccaccccggaggugaccgcgauguucuccgccuccuccacggucuugguggccacaguguugacgcugcucaccacagccucgcucacggcguuggccugcuccuuggucuucucggccacuaugggaggacacuggcuggccuccaccccagccccagccccaaggcaggccugcuggagucaggcucgcagccccuucccaggagcucagagcccuggcccugcugggacccuccccugcucccucugacuccagggcaccucugaugcugguggggguaaggagacgcccacccuaguuuagccucauggucugcaggggucuguagggcuugggaccccaguuggggguaaggcaggacucuagguuugagccccagcacuaggaugcaggagccccagggguccuaucccccauguguccccuggcccuggggcuucucaccugaggucacgcucuguacaacauucuccuuggucuuggcuccuggggaggaaauggagcugucagcccagaccucccucgagguguugggggcggucaggacaaacacaacagaacagcuggacaaacuguggggucgguggggggguaaggauggugucugggggccggcggccccuucagagggccucuuccugcugugucuggaagaaguggauggaugggaaggggacaggacagaaugugggggacaagagagagcaggccugagguagggacacuggcuagacccaggguccagccccugcccggguguggccgggccucagaagcagcaacaggacaggaugggccagagcugagucauuggcuugaccuccccuuccuccucuggagagugccaggagaggaugcgggggagggaacacugagccuagguuucaucccccagccugccccuucucucuggggagggaggggauccgugaccuggcuguagccgcucccguguggagagggugggggccaccugagcacaggcugcucauggcuucaggggcuccaggcucaggggaggcugguaugcuugggaaugugugugugcgugcacagacagguagccagcccugucugcggucucugacacccagaggccccgaggaggccaaagacaaacacacauaggugugcacagggcauugugggugcuccagggucuggagaccccaccuugauagccagggccucgcccccucccaaaaugccucccuggggcuggggaguaaggucuggcgaagguaacugggcacucacccuuuggccaccacacugucccacccugccaugccccacuuacccacauacaugacccccuccuuggucuucucagcugcuuccgucacccccugcuuggucuuuuccaccgcacccaccacgcccuccuuggcgauggagaagcccuucuugaagacauccauggugggugugcaggguugugcugcugcaggcaggacggagcuggaucucccugcgagcugcgggcuugagcuggcucgagugcugccgcagcggcuguccccgaugccuccuauugacgccgaugaaauauugaugcggaggccagcuggagcccagccagcccugcgugcagugggggcggggagggagggagggagggaaggagguucagccucaccuuccuccaggauaggaaggcagagaccaggcuc

SEQ ID NO: 17510 - RNA, 4815 nt, Homo sapiens
gagccuggucucugccuuccuauccuggaggaaggugaggcugaaccuccuucccucccucccucccuccccgcccccacugcacgcagggcuggcugggcuccagcuggccuccgcaucaauauuucaucggcgucaauaggaggcaucggggacagccgcugcggcagcacucgagccagcucaagcccgcagcucgcagggagauccagcuccguccugccugcagcagcacaacccugcacacccaccauggaugucuucaagaagggcuucuccaucgccaaggagggcguggugggugcgguggaaaagaccaagcagggggugacggaagcagcugagaagaccaaggagggggucauguauguggguaaguggggcauggcagggugggacagugugguggccaaagggugagugcccaguuaccuucgccagaccuuacuccccagccccagggaggcauuuugggagggggcgaggcccuggcuaucaagguggggucuccagacccuggagcacccacaaugcccugugcacaccuauguguguuugucuuuggccuccucggggccucugggugucagagaccgcagacagggcuggcuaccugucugugcacgcacacacacauucccaagcauaccagccuccccugagccuggagccccugaagccaugagcagccugugcucagguggcccccacccucuccacacgggagcggcuacagccaggucacggauccccucccuccccagagagaaggggcaggcugggggaugaaaccuaggcucaguguucccucccccgcauccucuccuggcacucuccagaggaggaaggggaggucaagccaaugacucagcucuggcccauccuguccuguugcugcuucugaggcccggccacacccgggcaggggcuggacccugggucuagccagugucccuaccucaggccugcucucucuugucccccacauucuguccuguccccuucccauccauccacuucuuccagacacagcaggaagaggcccucugaaggggccgccggcccccagacaccauccuuacccccccaccgaccccacaguuuguccagcuguucuguuguguuuguccugaccgcccccaacaccucgagggaggucugggcugacagcuccauuuccuccccaggagccaagaccaaggagaauguuguacagagcgugaccucaggugagaagccccagggccaggggacacaugggggauaggaccccuggggcuccugcauccuagugcuggggcucaaaccuagaguccugccuuacccccaacuggggucccaagcccuacagaccccugcagaccaugaggcuaaacuagggugggcgucuccuuacccccaccagcaucagaggugcccuggagucagagggagcaggggagggucccagcagggccagggcucugagcuccugggaaggggcugcgagccugacuccagcaggccugccuuggggcuggggcugggguggaggccagccaguguccucccauaguggccgagaagaccaaggagcaggccaacgccgugagcgaggcuguggugagcagcgucaacacuguggccaccaagaccguggaggaggcggagaacaucgcggucaccuccgggguggugcgcaaggugagccccggcccucagaccugcccaguccucuccugggcccagaaaggcugcugggcggaggcggcaucacuccacuccacaccccaggaaacaacacggggggcugcggcuggcuucaguuucaguacccacugagcgccggcauggggugggguccaugcuugcuguucgaccugcauucgggucuggaaucaccacaaccaccccuucgggggacuugggagcccaucucauagacaaggaaagugaggcucaaaaccacaucuuccggacggcucucagcacuuaggagacaccccauuuuauaagugaaaacaggaucccacacggugacaggcagccucccgggcaguggucaccaggccgggggcugaguagcaccagccccgcccccagggccuagccucccucccugggcugggcggggcagcugccuccugcugggagccucagggaaguagcguccccuagugguaagaaagcagugcugcuucugacccuacccucugcagcugccuuugugugugugugcacguguguugagugagcaugugggugcauuugugagaauguguggguguacaugcgugugaauguacacaugcgugugcggcccaauagcagacagcacaggagcaguggggcgcaccccagggacggguguuggcugggugagcugucccagcaccugugacacagcaagcucugcuuuacgcauuguacgcuuauuaguucauuuaauagacacaaaauccaugagacgguguggaaacuaaggcccagagagauuaaugugcccaaggucccauggcuaguucaugugagcuuggaauuccccugagcagccuguacucugagagacccuguggcaguguaagugguggccugggcuaggauuccuaccuggggguggggcgggggagcaguguccagcucuccuaccugcuccaggccuccuaggugguggagucugaggcucugagcacugagaaucccugcguuaggaguggguggguggaagggugggggcugcccuacuccucuuggcucuggggcgaugcccaggugucugcuuccagggccagcacagggucuccauguccuuggagcuggcagccgcucccucuccuaguuccccuuucucgucguaugaccuugagaagcaaaggaaccucucugggccuccguguucucaucugcaagaugggggugagagugucggccucccugggcugugugaugaggcagggccaugaccuccaugaagcaauucuccuggucuaugugagcacccagcagaggaaggugaccaucaucaucaucaucaucaugugucccaggcagaacacauagagccccagggggcuccucccuccucacccccagcaaaagaggcccuggggugagggugcccgggcauuccuugugaaucccggagcagggcuagugagcccuuggagccaccucgagggagacucauuuccuggugacaccccaaaaccagucacgacucaucucccagugaacugugaaaggccucagcagggacuaucugaccacucauaccccuggccucaucaucagccuuagggcagcaggacucagcagguggccaccugcccugccccuggauagccuggccgacucccgccagcacagcacugcccuuuuaugccccacuccgccaaggggcaggauggcccuggggcaacacagaggugacaguauccccgccucccccccgucccccgccagaggcaggugcugaggccagagugcagggcaaucaccagugugguccuacacacccagcugucaugauaucucacgcaagugucuggccggcauggagugcaggagauagaagaugggaagugagagaggacuguguaaccucugcuggcccugaccagccugagcccagagccuguccaggaggcaaagagagggagccaugcuccuguggacugaagugggccugaagcaagccugaucugaugccaacacaccccaccacuuugagcucgaaggcccugagcugcaugccaagccucccuggccucagagucccuaugugaaccccaaucagucuuccuuguagggcuacugaggguggggucagaccuggggcuucaggggccucugcccacucuaacccccacuccacccuaccccacccagguuccucaucagugaagcccaacuaggggcuucccagagacuggggaccagcuugaggggugaagcugggcuccaggguacuuggugccccuggaaggccucggcaucaucagagccccggguauugucugaauugcacgcccccaauaccuccagccccuccaaguacaacaaggccacgaggggccucugcuccuccuugaggccaggguagacaaggcccugguugcagggcagcuaggggucucugcauucuccacauggucucaugcccccuuuuguccccuacaggaggacuugaggccaucugccccccaacaggagggugaggcauccaaagagaaagaggaaguggcagaggagguaggagcugggcuccuggggugcaccaugggggguuccuugguagggaccccaucccccacagacgcacugcuucccuccugggcucccagggcccagaggggccuccugaccuuccacagccccuacagggacuguguacagggcuaacccugaaccugagugggagguccccccacggaugaccccucaggcauggggcacagaagacaacuuuucucagcccacucaggguggcccauuaaggcuggggccuggagcugggugugcaggucauucucucucccaggcccagagugggggagacuagagggcuacaggccagcguggaugaccugaagagcgcuccucugccuuggacaccauccccuccuagcacaaggagugcccgccuugagugacaugcggcugcccacgcuccugcccucgucucccuggccacccuuggccuguccaccugugcugcugcaccaaccucacugcccucccucggccccacccacccucugguccuucugaccccacuuaugcugcugugaauuuuuuuuuuaaaugauuccaaauaaaacuugagcccacuccugc

SEQ ID NO: 17511 - RNA, 889 nt, Homo sapiens
ccgcgcgcggcgaagaucgcacggcccgaucgaggggcgaccgggucggggccgcugcacgccaagggcgaaggccgauucgggccccacuucgccccggcggcucgccgcgcccacccgcuccgcgccgagggcuggaggaugcguucccugggguccgggugaguugggagugcgcgugcggaccggaggggcuggccgcagcggggaggccagaggggcucgggcgaggcugcagaggcagcugggcgcgcgguggccggagccaggggcugcccggcccggccccggcagcuccgcaggccucggcgcgcgcugggccgggaccgcccagccagagacccacggcaccccgcgccgcgucccccgccggccccucuuuugucucccacucgcggguugcaggccgaguuuggggaugcggagugggcgaaagucgcuccggggacgcuucuggaauccuuaaaugggaaaggcgcucaccuccccgccccggagcggcgaggcugauauuugugauuuggcuccggacgcuguggggaggaacaggggagaacaaaaugaguuucgggcgggggucgagugagaggagcagccggcccgcccccgaguccccgcgggaaggggcccuggcccccgagcucccggagcugcuucaccuguuguccugcgcggccuccgcuccguggccuggugauuccguacuucaguuuuggaaaacuuucugcuggauugccuggacccuuuuuucucuuuccagacuccuaguggaaagauuuggcaaggaaaaaaaaaugagcuugcgucagggaagaaaaauaauaugcuguguguuagggucuggcguuugagcgugguacucuuucaugcucucagauguuuuaauuug

SEQ ID NO: 17512 - RNA, 1358 nt, Homo sapiens
ugacugugcaaacacaggggcacaggggagggagcucaauauguccuggaacaggaugucucucugugacccugggagcagccagagggacccuggggauuggcagugggggacauaggagaagggaagaggaggcggaggugguaggagcagugggaaggccccaucagggacuggcuuaggugucuccagaccugaccuggggacaggaagcccugggaggggguugguuagcuuugcagggugaagaccaaagaaggaagugcugcagggcaggaaagggaugacccauuuaaggacagcaggagcgggggugaugccagagucuccacauguggaagagaggagcggauuggauggugggggugaggauggguucaguugugaccccgggagucaagagcccggggagcaucccaggagaugcucuguaggcagcguuaggcguuaccagcucuuacucugggauguggacucugggaaggcccaucccugacccaggacacaaccuggcccuuccaugcaaccucccccacugcucggugacccaguguguggagggucaucgggagacugcccccagugaacugcuccucagcuaaacagaugugugcuguuuguuugcagaccaaggggcugauccccagccaggaccccaggauguaggacgcccacuggcucucccuuucuucugagacacauccagcccccccacgucucccucauauacacagacccaggauuaugcugugagccugcaggcuuuggaaguggcccugucacccgugcugcacgggauucacagccccagccccauggccccucuccacaccucaaaacuccugccccauaacguccuccgcauccacuuuccagcucagcagccgcacccgaggcucagccugagggguaugugcccaggcccucccacuucccgaguugucugccucuccucaaaugcugugugcugcaauuguccaggcgaugacaauggugauggcuccagagaacacaccagcuauuuaugagccucugcccccaggcugggccugucacuggcauaggaaggccagccccgcaucucccacugccaacagcugaagccgagcacagaccucccuuugcacgcuggaacaguuacucaccuguggcuucuucccccaguguaccguuccacuguggcccacauucuugugcacgcgggcauuugcaggcacgcucucgcguaguuaccuaucugaaugcacaccaagcacaugcgugcacacucugcgucugugauucauuucauguaguggucuaagcuccucccagggcuguguggaucugacaggguauaggaaaauaaaaagcggaga

SEQ ID NO: 17513 - RNA, 1183 nt, Homo sapiens
ccagguccgcgaggucgcgggccgaggaccaggcgcgggagcgggagcgggcgacuggccgggcccucccggucucggcagccacuucuagcucccggcccagccgggagacgcaggugccacggagaugggcagccgggcggguggcgcagugcaggcagcuguaucaaucgcuuccccuccagggacccgccggugccuggggaccgcgggcugugcagcugugccgggccugcggaggccgccgcccgggagcugggaggcagggggcgcguggucaagagccgcccucgaccuggccuggucgguccuggcccggcguaggugacgauggcggggaccgcgaggcgccggacacccgaggccacgagcagcgucgccccucgcuuuuucgcgccccuccagcccugcaguccuuccucuaaguccgucugccccucaccgauugaaaguggccccgagaauauuggaugguauugagcaauuaucauuaacuuuguugggugugguaacgguaaugugguuaugguuuuuuguuuuuuuuuuuuuaagaccuacugauguguugacagagugaucuggugucaggacuguaaaauacgccuaugaaaacugggggagaggaauaaaacaagcuggcagaacguuuuucaucguugaagcugcgugaugcgagcauaugugcucaucauacagucucuuuacuuguguaucugaaauuuuccauaauaaaaaguuuaaagaagugaaccagcgauugccucuagggaggacagugagguggcggaugacgggaggaaggagucuuaauuuuucgcuguacgccuuuuugugcuaucuuagguuuuucccauucaauguguuaccuaauucagaaaauugguaaguuuuuuuuaaggcuaccaugggaaaacagcguucuaaagaguagcgcaaccaguucccccuaagagaggugcaugauucgucggacuccgacagccuugguguuuguuaggcgguuaauggagacccaccugggaaauuagaaaacuacuaauugcuuucagugagaagcccgcccuucucccacaaauggauaauuugcuuuuaaugcacccagaaguuauccagcucccuccgguauaaucggggaaacuccaaauaaaggaaaaauaguucagagacccugcagcucuuccca

SEQ ID NO: 17514 - RNA, 635 nt, Homo sapiens
uuccuuuuaauuacauuuauuuuaaugcugaauuuacucccgugccauaaguuuuuguuucuucaguuucuucugggauaucuuuuucuucugggcaaccuccucuucugguuuaggaacaaucuguuccuuuuccguaaggaucaucucaauguggcagggagagcucauguauggguuaauccgaccaugagcucuguagguccggcggugcaucuuaggugcuuuguucacuuggauaugcucaaugaccagagaaucuacaucuaaacccuuaaguucagcauuacucucugcguuuuuaagcaugugcagcaagaauucagcacucuuuuugggccaccgaccuuguguccagccccacugcuuggccugcgcacaccugccaacuccaccguuguaaugucggaaugguacacacuguuucuguaaagugacaucuuucagauacuucguggcuuuucguauaugcauacccuugauggccugagcaguuucacgaguguucuuaaagugaacacgaagauuggaaccucuugauuugccugauuucgugggguucuccgggucaagugaauagcgaaccauuuucacagauuaccucaggcugcuuaggaaaagagcucucucccuuu

SEQ ID NO: 17515 - RNA, 635 nt, Homo sapiens
aaagggagagagcucuuuuccuaagcagccugagguaaucugugaaaaugguucgcuauucacuugacccggagaaccccacgaaaucaggcaaaucaagagguuccaaucuucguguucacuuuaagaacacucgugaaacugcucaggccaucaaggguaugcauauacgaaaagccacgaaguaucugaaagaugucacuuuacagaaacaguguguaccauuccgacauuacaacgguggaguuggcaggugugcgcaggccaagcaguggggcuggacacaaggucgguggcccaaaaagagugcugaauucuugcugcacaugcuuaaaaacgcagagaguaaugcugaacuuaaggguuuagauguagauucucuggucauugagcauauccaagugaacaaagcaccuaagaugcaccgccggaccuacagagcucauggucggauuaacccauacaugagcucucccugccacauugagaugauccuuacggaaaaggaacagauuguuccuaaaccagaagaggagguugcccagaagaaaaagauaucccagaagaaacugaagaaacaaaaacuuauggcacgggaguaaauucagcauuaaaauaaauguaauuaaaaggaa

SEQ ID NO: 17516 - RNA, 15293 nt, Homo sapiens
cuauuuacguccuuucgauguugcgucaugcagugcgccggaggaacugugcucuuugaggccgacgcuaggggcccggaagggaaacugcgaggcgaaggugaccggggaccgagguacugcuccggcuggccggcgggcgcccgggauccccggugguccugacagccgcccucacgggaccgcugggugcggggggaagggcuggaagcagcggugcugcuggcugcgucagggccggccugcgcguuggggucgcaguccugugggugaccugguggagagggcggcggcacaaggcccuggucaggcgggcaagggcucaguguagcugugcuucuguccucgggcaacaaggugcugagucauccuugcggcgaggccguacagccgcugcgcugguagcggcaccuggggcaggggcagagguguuguggguugacagggaaguuugcugccggguucucaucugaaucuagcgggcugggugaacuuucucggggaccaggcacccaaacucaucaaugcucacggaggcauaagcccuuggauuagggucgguaguauuuuccccauuuuauagcaacgacaucugagucuuagagauccacacuccucacaaggucacuucuaaccugucagaagcgggauucccacucugggcuguuacgccacauggaggucacucugagcuggaccucuucggccccaaccaguggacugaguacugaggaagauacaggacagccauagguugagaugauguaauggcacgaaaguuccaaaagcgcuggguguuuucccaaaggccgggugccgaauuuuaagacccuuaauaguucaguugcagagcucggaggacgcucggguaucuuaaagcaauaguucuuagcuuuuggaguguucguuaaaacacacguucuuggucuuauuccuagggguagaaucauuaggagcaaagaaagacccaggagccuacauuuuaagaugcauccggggcacuuucaagcagguagucuaagggucaacgcuguagucugaacacggaauccuuauguuacagauggggaaaugggcccagaaguauaucacuugccuagaauucacuacaaaucauuggcagagaugggcugguagccccaguugguuuacacucgucauuucauucugaccuauuguagucaccucaccuuagcauuacagaaacacugucugcugacuucugguugaccacccaucuaguauaaugugcccuggagcuaagauaauccaguuuuuagcaugcuuuucuuuugaagacaccaucgagggagucuaauguaagggaaaccugguugguaacugaguuuacuuguuuacuuugaaagacuaaauguccuuuacgcauuauaguaggacauauagaauagguuaacuuagaauauuuuuauaucucauguugaaggaaaguaauauuugguaugauuagcugaaauucauauaguuggcuucuuuuaauaccuuuuagcuuuguaaugcaguauaaccuugaagagcuauucaugucuucuuuggaugacacuauuccuuugcccaaaaguuauguagauucuuuuaaauuuucccacuggaugcugguauaaaucuuaagccaaaacuacauuuguaaaaaccaucacagacucuguaaucacguccaguuauuaacagccguucuguguuacacauaauuuuugcagucaucuauuuugauuggucaaacugggacuuaaaccuaguuuguuccuccaucuucagcuguguucucugggauggguuucuugcauuacaguggaugguugggcaaagaauucaucgcugaaaauuaaaaaggucgcuuuauuuccuguucuacuaaaaaauaguuuguuccuugacucugacucucauauguccuucucuuaauugguuaguagguuguuuuacuuauguuuuuuugguugguuuugccuuuuuuuuaaacuagcauuucagaucugcucgguagaccuggugcaccaccaccauguuggcugcaaggcuggugugucuccggacacuaccuucuaggguuuuccacccagcuuucaccaaggccuccccuguugugaagaauuccaucacgaagaaucaauggcuguuaacaccuagcaggguaaagauaaucugaauguuuuuauauugcuucuuuuuccauuugugcccuuucuuuuuggcagaguauggcugcucugccuuuaguguguuauacgucaguuagcccugauaauauccccaaucagcucuuucuccccauuaguuuguaucauucuggucccuccuuaucccauaugaaauagaaaaugaguuucuguaacucugucuucgcuuacagcuucuggaguuucucauuuagaaaauuuagaguacauugugagggauugagaguuacauaguguaacggagauccuggagcacauagucagaaguuuaagaacccagggauauuaccaguuggccaauagcuuauuaauaaauuacuaaauauauuaucucuuauuuagagguugauaauaucugucagguuagaaagaaacccauuuuuauaauagauuuaucuucuggcauucagauuauaagguuugaagugugagguaaugaggacaauauaaagaagcuaggagacauuuucucuuuuaaauuaacuguuccacuguugaaaaagagccacaauggaaguaguagucuucccucuucuuggcuucauguuaaggaaagaugcuguucuugaguccauaucccagaugacaaaauauagcuaauaaugcuuguagaaugcauaucuuaaaaaugcuaacagauucucacccugguauuugguuaggauuuaaaauauaacaauucuagguauguaaaucuauaguuugugaaagaaacaauuuuucugaaauugaaacuaagaauaauauaaugaauuacuaacuuccaaagguggagcacagggaaggucuacauuuauuuauuuauuuuuacauuuaguuuuuuaaguuggcuaauaaauuuccauagugaaguuagguauauagaaaguaccaaguuucuuuaacuagaguuuucuaguguaaagggaucuugcauuuuauuuuauuaacguucuguuuucaugugggugguacgugucuuuguuugcaugugugucaggaauaugccaccaaaacaagaauugggauccggcgugggagaacuggccaagaacucaaagaggcagcauuggaaccaucgauggaaaaaauauuuaaaaguagguggcuaucuuuaguuuuuaaccuagaaucuauggauauguuuuaagagguccaugaacaacuuccuaaaaauauauguguauuugugcauuuucugggaagaccacauuauuauucugagaucugacgacccagaaaagauugguacuuugcacuggauucagugguuaucaaucauauuucuuccaguggaaauuuuacuuuccuuuuuuuuaaagaaaaggauuauuaauaugccaugguccaaaagguauacucuguugagaaaguucauuuuaaguguguagaauccucauucaagcauauaauauuuguguauguuucagauuaagaauaaaucaccaacacauagauguuaauaaaagccuagcuguccaagaagaauccuuuaacucacugcucacauagggccucaggagggcaguacuuuaauauauugccaguuugguucaguuuggauaucaacuuugcaaguucagaaacuagauuguuaaucauccuaaagcuauucaaagaauaccacugcuccuuaauaaucuugcaaaaugucuuuacagugggagagagcccuaaucaguauccuucaggucauuucuuucugauuugacccuagagaccaaaucaugcaaauuauguagugacagccuaguaauauucuuaguaaacgaauuagacuaaaagaauaagaugcccuuuaugaauaccucuauugaguuagaguugauuaguugccucucaguacccuaaaacgggagccuccucucacuugauucugcugcauaaacacugauuauauuuucucuuuuuucuugauuuccacguaaagcaucauuuguguuaauaccaugcaguaugguaugacuguuaacauuuccuucucauuuuuuacuuuccaugaaugucaugugaauauacuucaaccucuuauuaguaaaauaauagguaucacagaaguagcuccacgucuacagguauacugcucccucaaauauuguuggagggagguugaagauucaccaagccugauccuuucuuuuuuguacugauuuuuacaccuuuguuucaggaguguuuuuuucuacugguuaccuaacauugaggcaauuucuguaccccauaugcacugauuauggcuucuauuaaauaugguacaugauuugauucccuugauaaauauuuuaaaggcuuuguccagaugugccaguacuaaccugcauuuccuucuguguucugcaguugaucagaugggaagaugguuuguugcuggaggggcugcuguuggucuuggagcauugugcuacuauggcuugggacugucuaaugagauuggagcuauugaaaaggcuguguaaguaaauuguuuuaaguaaacuguuccuaaacaacuccagccuuaaaacaaaaauucaaauuuucuucucauuccuaucuuuagucacuuuggaauguuuugugucuagucuuuguguauacacacaaauagagaaucucuuuuugcuucuuugacauuuauuuauucaaaucuaaauaaaaaucuuuuagcaagguuauauguguuuaagcaaagagaaaauaugaaauauguuuuuuguuuguuuguuuguuuguuuuuuuggagagagagucuugcucuaucucccaggcuggggugcaguggcgcgaucuuggcucacugcaaccuccgccuccuggguucaggcaauucuccugccucaggcuccuguaggugggauuacaggcacaugccaccaugcccggcuauuuuuuguauuuuuaguagagacgggguuucaccauuuuggccaggcuggucucgaucuccugaccucaggugauccacccaccucagccucccaaagugcugggauuacaggcaugagccaccgcacccagccaaaaauauguuguuuuuuauaugugcuuguauguuuuaucucauuuaguccuuacaguaacucccaaguaugcauaauuaucauaauuauuuccaugauaaaugaagugaauaagauuuaaaguguaaaaugauuuaucccgaggucgcccagcuagugugugacucaaccagaaaucaaaucuguaauuucauagauuaaucaugucauguuucuuacagaauuuggccucaguaugucaaggauagaauucauuccaccuauauguacuuagcagggaguauugguuuaacagcuuugucugccauagcaaucagcagaacgccuguucucaugaacuucaugaugagaggcucuugggugguaagucagcuguuuuuguuuuccuuuuucaucuaaagaucaaaagauuagauaaaauauauuggagggaaggguuauuaaauggaaagaauacuguauugaacaaguuuuuguucaaauaauguaugaauuacagguugagcaucccuaauuuaaaauccagaaaugcuccaaaauccaaaacauuuguagugucaacaugaugcucaaagaaaauuguagcauuucacauguuggguuuuugaauuagggauccugaacccuaacaacaaugaaguguaaugauaaauaguccgaaaucugaagucugaaacacuucuggucccagacauuucugaugagaguuacucaaccuguauuagugcagcugagauaaaaguaggaaguucauucuagguaggucagcuauuauucuuuauuaaacauguauucgaauaauaccagaggaguuagaaaucaaacuuacagagacaacauuuuugucuagcagcagauaucagacagccucuaauuuguagcaguuuacuaaaaaaauaaagcaaaugcaaaaucaucuuagaagucagagggaaaugccuaugcaguuaagagcagaauagugcugcuacuauuauuccuaagauucuugaccuuauagaagauuuuauauuuaaucgguuucucuggagcccuuguuauuuugcuagauaagagaauuugaauauguguccccuauucuccugcuauuugguagaagagaugaacuggaauaaguggcacagauacgcaauaagaaagugcaaagucaguugagaguuucugucuuggacuguuaggcaaguuccgugaaggagacauuuauuucaucaggguuguugaaggcuaacaugucucauuuauuuuagaaguagacaagagggccaggugcaguggcucacaccuguaaucucagcguuuuaggaggcugaggcaggaagauugcuugagcccaggaauuugagaccaaccugagcaacauagugagacacugucuguaauuuuuaaagaaauagaaaauuuuaaaaauuaaaaaaaaauuuuuuuaaguagacaagggcgguccaauuuuaccaaacaguuuaagggaagaggagguaggaaaaccuaauuucagaggugacuuacaaucccauuagagggaaauucaaguguuugaggucuggaggguaaagaagacgugguuagaaaggauacaguugucaagcugaggagagaaccuaagcagucggaggccauuggagauacuggaacaacaaaagcgugauuuauauuugaguuuuuagaaccaauguggaagagacauggagcagguguaccagcugugccuuuguaagaucugaaaugagggaugauaagaaccugaacuagagcagagugugauacuggaggggaaggagaguucauguaacacugauuccccacauagggacgaaaaccauauuauuuucacuguguuguacuuuacuaaaggauaaccauuuacaguagcagccauuuggauauuuauauauucuuaggaucaugcuuuuucacauagacgucaugaaucucccagcccagagguucacaaaggcacagaauguuucacuggggaugucaguuuuaaucagaagcaaauaauuuaaaacaauacuuuuguaauaaacaugacaauauuuaccuaaaauuuuaggcccuaaaaugaggcuucaaagaaguuuuguguuugggccauauccucagucccuucugggcaaaagauuacccucuuccacuguuaguaauacagaaaauaggaaagccaaagacaaguguuacagagaugaagauguaaccuuuugggugugacagacauauauauacaaacacacacauagacacacagauaaugucaaaguuugucccaagugcaucugaggagagguaucugaucuugcucuugggcagccaggguaccuacuagaaaaagcuuuugagaugagacaguaccagaguaagucgaccagauauggaaggagauauucuuaggcaugauggauugaauuaaggaggccugaaauuuuggggcauguuggcagcugugccaguuccguaugguuggaaugcagaguuuggagugagacuggaucauagaagaucuuaaaaaaauuuaauugcugcuguccacagaggaugugugaaauaguuuguaguaauuauuucucguuagaaaaugguggaguggagcucgauaugcuuuucuuuucuuuuuaauguuuuuuaaaaauagagacuagaucucuauguuugccuaggcuuggcuuaaauucccaggcucaagugguccuuucaccucagccacccaaguaacugacauuacagguccauaccacuacacccagcucaguaugcuuuuucauguuaagguuuucccauucuuggcaaaaccagcuauuugguuuaccuguacuuuauauuagagguugaauauuuugauguucauaggugagacagauaauacagaugagugaggaggccuagugugucacacaggagauuguugacaucuagagguuacugacaucuagaguuaaccuuuucaacuaaaaccauucaccauguucuuuuuuuuuguuuguuuuuuuaaacauaguuugccaaacaaaacaucuguggccugauuccaagggcuacaaguuugcaaucucugauuuaaauuucuuggagauuagcaccaucuuauuuccauuacauguuaauacauucuucuugucauacacaagcaauauuuaauuauaacacuggaaaucuaagauaggcaaagaaaaggaaugaggaccaaauuagccauaaaccuggaaggguagaaguguagaaucuuauuucucauuuuucuuuuccaugugcugugauaaucuacuuucuauuuuucaagucuucauuuagcaaauauggaguucaaagugaugugcuauauauauuuuuuuuaaaaauuacuaauuuguaagcaucacugauuuuaaagaaaaugcuauuugugcuauacaaaaauauauuuuuuaauuaagaguuaauuaucuugggaucccuaaaggguuuuuguuucaccucuguccaacaagaguaaaauuguuaaaagauguguugccaguucaagcuuaagacaugcauuugaagcugucugcaaaaccucauauauggcaguagggggcacucgugcuaacuuagccaaaacucugaaauaaacccagagcuuuuaaugugccagaaaaauuaaaguuuuuauuuuuuauuuuuuauuuuuuauuuuuuuauuuugagauggagucucgcucugucacccaggcuagagugcaguggcacgaucuugccucauugcaaccuccaccucccggguucaagugauuuucccaccucacucagccucccaaguagcugggacuacaggcgcgcaccacugcgccuggcuaauuuuuguauuuguaguagagacaggguuucaccaguuagccaggcuggucucaaacuucugaccucaggugauccaccugccccagccucccaaagugcugggauugcaggcgugagccaccacgccuggccuuaagcuuugauuuauuaucuuuaauauuuuuacaacuaguuuauuagaaguaacuaauuguacuucaaaccuguggguuucugcuuuguuuucauauaaagaucaguuuuucuuaauaguacuugucuuucagacaauuggugugaccuuugcagccaugguuggagcuggaaugcugguacgaucaauaccauaugaccagagcccaggcccaaagcaucuugcuugguugcuacauucugguauguucuguuuuaaauuguuacgagacaaccuugacuaccaccuuuuuuggguggcucuucacaguuguaaaugaccuacauggaauuuaagccucauguuuagaaaacaccauuuucuucagucauuacuggcugcauuauugccagaccuuugcuuugaaaaguugauuuugcuaagaccauggacaucuucaauacgaaacuuguaucuucugacagucuaguauaugcagagauuuacuuuuguguauuuuguucgauaccaggaggguuuuauaucuaguacgcaucauuugagaguuguuuuugucugguauguuuagaaaaauuaaaaacugaggauagagaaaguugugcuaaaaauguugcugcgaaauaacaaaaaacugagaggaguccuaauagaaguguucuguguagaaauuucacccacuguuuugccuagagcaaaaaguauuuuuaaauuauucaucaucaugagauaguauaccuuauuaaccauauaacuugaucuagaaauguuauucuuuaagcuaguauugaaaauucaguauaaagauagcuuugugccuagucuaugagguaaacgacauuuaagaaaaagguaacuuauucuucuuagcacugaaauaaugcauuaucuaaguuuuuuuucaauuaaggaguuccauuuaccuuuguugaauuacugguaaauuuuuuacgaaauuguuuauaaauaucugacaacuaaaauuacuuauuuauaagcuguuagcaguccuuauuacauaaagaaacagcagugucugucuuagaaguucccacauuuuaaguuuaucaucauaugcuuucccuuuugacagcaguagguuugaccuugaguuauuuguuuuaagcuuguuuaucucaauuauuauaugaauguuguagaaacuagugguaagcucagauucaaauagcuacauggaauuugaugguuacuaaauaaguagauuaguguuugcuugugagugugauugauuaggaauaguguuaauguugugauauagaauuugaguagucaccaauuugggcuguagaauuugguggggguaguauuaucuaaaggcagaacuuuuugaaucauagugcuuaaacaguaagguauaauauaaaguggcauguuagaagugauauuuuccuuuugcuuguuauuuaguaaauacuuaaugagcacuuccucuuucuccaggugugaugggugcagugguggcuccucugacaauauuaggggguccucuucucaucagagcugcaugguacacagcuggcauugugggaggccucuccacuguggccaugugugcgcccagugaaaaguuucugaacaugggugcaccccugggagugggccugggucucgucuuuguguccucauuggguaagcugcuguguuuuaacacuuaauucuuggugcauaguuuccuguaaccugaaauacuccaauauccuaauugauugagucauuuauuuuaaaaguuuuuuuaaagauuuaugcuaauuugacuggauuuuacuaccugacaucauauaaaaaucauggcaacauggucaaccauuauuacuggcuuuaccaaacacaucuaaaaugggaaaguuggucuggagaacaugaauauugcucugaugcaagaaccuuccugugaaaugggcaaguggcucauuggaggaaugaguaucauggauuuugaacuaaugcaaauaagauuagacaguacauguacccagaugucgucuuaccuacacaguauaccaaggagauuuuuuuuuaaguaauauaaaucauaaacucaguuaucggaaauccuuuuuuaaaaaaaaucuuguuuucgcauuuugauuucaggaucuauguuucuuccaccuaccaccguggcuggugccacucuuuacucaguggcaauguacgguggauuaguucuuuucagcauguuccuucuguaugauacccagaaaguaaucaagcgugcagaaguaucaccaauguauggaguucaaaaauaugaucccauuaacucguaaguaaugcuuuuuauuuaacacuguuacucugucacauaaggaugcuuguguguauuugaccuguuuugguuuauggcuguauuaguuuucuagggauacuguuaacaaaguaucgcagacuggguggcuuaaaacaaaacuugauucucuuguaguucuggaggccagaaaucuaaaaucaagguguuagcagaguuguacuucugagggcccugagggaaaaucuguucccugccucucagcuucuuguuacugcuggcaguccuugacauuccuuggcuuguagauggaucauuccagucucugucuccaucuucacauggugcucuuccuguguaccagggauuaggauuucauuauauuuuguuggggggcagaggagggucacagcucaaaccacaccaauggcuuugucagauuuccuguuuuacuucuguugcaguuuugucuguucucucuuuaguaaacuauccaaaaaaaccucuugauuuuauugcaacuuaguguaauacuuagguauucauuccauuaucagaauauuuugucuauuuuugugagccagugucagggugcaauaaauaaugugcucuuacugcucaguuaauuuuuuugguaguguauuuugcagacuuuaaaacugaagaaauguauuaaucaaguauuauuuauuggaaaauguauauaauugacauggaauuuuuaauagaaaagccuauuuuauacuucuagaaauuagaaacucuucaguauaaagagucuaguuucagagauaugcaacuuuaguugguauuaauuguuauuauguuuuuuucuuuuuucuuggagucgaccaaaguggguuauuuuauuuaaacaauuuucuugaguuucauugugucugucacauuuuuuuaaaguaauuugauuuuaucuaaaaauaaaacuuaauguaaugguuuagggggaagaaaaaguugcuguacuguaaagcuuacagauuuguagaaguuuucuuuagaggggugaagugggucuuuuauauuaaaaaaugcuagacuugugucuaacagguuuuuauaaagguguuucuuuggucuuguuuugauuauuucauugucugccaccuaguuuucuuugcaaguugauauaugcagagugucagagaauaaaauaaugauuuuuuuaaacugcucuuuaacauuuaaaagaugagucugccaaaaggaagaccuuaacuauuuucuagucuaguacuucauuaguuggcaguuaaacaucuuauuuuuaauuuccauuuuauaucacuaagacaaauaguauuuuucuucuuuucuauauuaagaauucaacaucacuauuagaauugcaucauauauaaugggcauaauuuucuuuucuaggaugcugaguaucuacauggauacauuaaauauauuuaugcgaguugcaacuaugcuggcaacuggaggcaacagaaagaaaugaagugacucagcuucuggcuucucugcuacaucaaauaucuuguuuaauggggcagauaugcauuaaauaguuuguacaagcagcuuucguugaaguuuagaagauaagaaacaugucaucauauuuaaauguuccgguaaugugaugccucaggucugccuuuuuuucuggagaauaaaugcaguaauccucucccaaauaagcacacacauuuucaauucucauguuugagugauuuuaaaauguuuuggugaaugugaaaacuaaaguuugugucaugagaauguaagucuuuuuucuacuuuaaaauuuaguagguucacugaguaacuaaaauuuagcaaaccuguguuugcauauuuuuuuggagugcagaauauuguaauuaaugucauaagugauuuggagcuuugguaaagggaccagagagaaggagucaccugcagucuuuuguuuuuuuaaauacuuagaacuuagcacuuguguuauugauuagugaggagccaguaagaaacaucuggguauuuggaaacaaguggucauuguuacauucaucugcugaacuuaacaaaacuguucauccugaaacaggcacaggugaugcauucuccugcuguugcuucucagugcucucuuuccaauauagauguggucauguuugacuuguacagaauguuaaucauacagagaauccuugauggaauuauauauguguguuuuacuuuugaauguuacaaaaggaaauaacuuuaaaacuauucucaagagaaaauauucaaagcaugaaauauguugcuuuuuccagaauacaaacaguauacucaugauugcuaaguguuuuuuuauuuuugcauauuuauugaacugucuaauugaauacagcuugcucuugucaccucuucaagcuuucaagccuuuauagaaaagcuucuuuguggcuuacacuggaaauuaugaaagcaguuuuucuccuaagacuuuugguuucucgcauugccucucagacuaagcacuaaaaagcaaagcaaaacagaacuaguucugucuuaaugaaauauaucaacccaaaaguguaaugaggaaaaugcuucauuaguuuccccuagcagacuuuuacuucucuuacacugcuacaccauuacuuucuugagacauuuguaaguucuuugauacagaagaguuauauuuagaagucuuuaaugaagggaaagaagucuguaugaugacugaggugauugcucuuuuugacaaauguuuauuacaguaaugcagaaauacuguuaaucaucucaaaguacauaggaggcuuauuucugaaacaaagguuucagccagauguugauuagucuaauuuuuccaagugaaucauaugcaugccauuugaauagggauuucuucaagaaagcaacuuaguuucuugccaguauaguauagugcagugugauaaguacaugauacuuguagcuagacuaccucuauuugaaucucaacucuuauuucuuaugugaccuugggcaaauuacuuaaccucugugugcccaguuuccucuccuguaaaaugaauauauuggaaccugucuuauagguuuaugguuaaacgugcaggcacuuaguaagcauuacauaagucuuagcuauugaugcuuuuuuuuauuaguaaaaauguaaaugccaauuuucuauuuuucuucuccccauccugauacccauaucagugugaucuuaaagugccuguuuuccuuagucaccuuuuagaacccaaaguuuaugucuuuuuuaaauuaauaucacacacaaaaugauaucauuucagugaugguaucaggcaguuuaucuagaaaaccaaggauuuuuuuacuguuuuacuuuuuuuuuaaauagagggguucaguuuggucuuaaauuggauucaaacaauccacucaccuuggccuuccuaagugucggcauuacuagcuugagccacugcccccauccuggguuguuuuguuguuguuguugucguuguuguuaauuuaaugacauuauguuauuggacuucuucugacuuugcuaagacaaugaaggcuaugcaaaauaauauauaaaauguggccgggugcgguggcucacgccuguaaucccagcacuuugggaggccgaggcaggcagaucaugaggucaagagauggagaccauccuggccaacauggugaaacccugucucuacuaaaaauacaaaaauuagcugggcaugguggugugcaucuguagucccagguacuugagaggcugaggcgggagaaucgcuugagacaaggaggcggagguugcugugagccaagaucgcgccacugcacuccagccuggcaacagagcaagacuccgucucaaaaagauaaauaaauaaauaacauauaaaagguaagcugauauauaaaau

SEQ ID NO: 17517 - RNA, 2535 nt, Homo sapiens
ugccccagucacugagccgccgccgaggauucagcagccucccccuugagcccccucgcuucccgacguuccguuccccccugcccgccuucucccgccaccgccgccgccgccuuccgcaggccguuuccaccgaggaaaaggaaucguaucguauguccgcuauccagaaccuccacucuuucgguaagcuaugggaaaggucgcgggcccggguggggcagcggggccuuccgggcccggagacguguuccgggaaguugccaagcgcuccgggccuucguaagcucgggcaggggaaacuugaccagggucgcagggcagcgggaucaaggccugggccccggggucggacccugagcgcgaccggaaggagcaggcgguaggucagcccuugggcgggcccggcgucucaguggcgcauuuacuaauggcuccugggccuccucgggccacacccgccccucccgucaccauugcgucacguccguuacgucaccacccguugucacggauccggagggaaaggcggugccagcccuaaguggcaagcgggugcaccaaugggggugggaggcuuagccccgccucgggagcucggguuccggcggguugcaucagcuggguggggcaccgccuggcagcccggacucccccgacaugugaucggcuucccagggagggcgggaggcccgggcguuccccgagccuggggaagcuggccgucccggacugaccugcucggggagagccagcaaaggacacauucggccuggcccaagcccugacgauuucaguguuguuuucugcacgcgcaaaacaccuggggaccgaggggauggcaguggcauccuaucuuugacagcucugaacgagcuuaaccuuuuuuuucagaccccuuugcugaugcaaguaagggugaugaccugcuuccugcuggcacugaggauuauauccauauaagaauucaacagagaaacggcaggaagacccuuacuacuguccaagggaucgcugaugauuacgauaaaaagaaacuagugaaggcguuuaagaaaguaggucuucagugagauuuugggaaagucauaauggauuuguccacaagggggugccagcuguguuguauguauuguuagcggaaggggugauaaaugcguucaugcucuugcuaggccuaauucguuuuccuuugugcuugcagaaguuugccugcaaugguacuguaauugagcauccggaauauggagaaguaauucagcuacagggugaccaacgcaagaacauaugccaguuccucguagaggugaguucagucacuacuugauuugugccucucugcuggcaaaucucagauccugucuguuagcuucugcuggggacauaaaaguuggcuuuguaaggcugagcaaaaccucaguuggguuuuaaaguacauagacuuauuucuguuuuauaggaaaaagcagaagggacuugucuaccuuugguuuacuguuucuguggaucuacuucacagaugcaaauuugaauagcauauagaugcauuguaaaauaagccaaaugcuggguuguuccuguauuuguaaggacaugaguuuuuaaaaaugaauuuccugaguauuaauacuaaaauacuguuacaugaucagcucuugauauaauugaagagauuucagauaccugaugagucucauucucacacuaauucagaaccuuggaaggcacugaguguucaaaaaagguagcucuuaacugaggacccucuguugaaccauugugcgcaccccuggcucuugggcaguguaguagcaggaagacaggguuguugccauuagaaauggaggcuuuaacucucccugucccccauuuaaaacuuugcccuuuugucuuuucagauuggacuggcuaaggacgaucagcugaagguucauggguuuuaagugcuuguggcucacugaagcuuaagugaggauuuccuugcaaugaguagaauuucccuucucucccuugucacagguuuaaaaaccucacagcuuguauaauguaaccauuugggguccgcuuuuaacuuggacuaguguaacuccuucaugcaauaaacugaaaagagccaugcugucuagucuugaagucccucauuuaaacagaggucaagcaauaggcgccuggcagugucaagccugaaaccaagcaauaccgucauguuucagccaagcccagagcccuaagauuacaaacaacuauggccggaaccuccucagcucucccucugcagaguucccuacccuaagagaauguuaccaccugaacaguccucggugaaucugagaggagaggaugggguaaggcagaagcaccagcuguacuacuagaagggagcuuuuggugguagauccccuggugucuccaaccugacuagguggacagagcucaaagaggcccucuuaccgcuagcgaggugauaggacaucuggcuugccacaaaggucuguucgaccagacauauccuagcuaagggauguccaaacauca

SEQ ID NO: 17518 - RNA, 1238 nt, Homo sapiens
gggagcccagcuuggagaaggaggacgugaguauuccuuacaaggcuccgaaacaauucuuucuucacuuaguuuucuuucugugcucugcaucuuauauuccagcagggucuuccaaugcaugguuuaauaacuacuagaacuggccaggugcaguggcucacgccuguaaucccagaacuuugggaggcuaagacaggcagaucacuugaggccaggaguucgagaccagccuggacaacauggugauacccaguuucuacuaaaaauacaaaaauuagucgggcauggugaugugcaccuguagucccagcugcucgggaggcugaggcaggagaaucgcuugaacccgggagacagagguugcaacgagccaagaucgagccacugcgcuccggccugggugacaggagacuccaucucaaaaaauaaaauuaaaaaaaaacuacuacaauaaauuaucaccuuggacuguauaaaacaacuuuuaaacuagucuuuuuaaaaaguacacuuaaauaaaaaucuaaacauaagagaauguaaagugaaaagugaaaguaugucuucuguuacgcagagguaacuacuauuaggaauccuuccugaaaauguccaugcaucuacucaggucaucacacccauggaaucauuuuacauacuauuuuaugaguguuacuuaauauacugauccacagugcguuuucacggucacgccaucaguuguaggagugugccaagaacagaugggccuugccuuuguaccagaggaguccauuuacaguugcagguaauagaaaacccaauucagacuggccuaaacaaugaggggagguuuuggcucuugaaacuggaaagucccaagguggggugaguuucagguuuggguugauccaaguggcucagugacgucaacaggaucuuguuuccauuucucugccuuccacagccuccccuucaucuaugguggagggaaggagucuaccacagacaaaccccgagccucccccugauggguggugugguggugaagccagcaagggaagggauccccggacacaccccuccucaugcuuuaucccacugaaaccaugcggcugugaaaugcagcauccuccaggagggggaugaaggccggggaugcugucagcuauugccauugcacuucuguggauggguguuacaguuuuuugcaggguuuugcacuuacaaggacauauauauauauauauaaacua

SEQ ID NO: 17519 - RNA, 65966 nt, Homo sapiens
cuccgcgccccgcccccgccgcucggacggcccgagucgcgcccucccgccccgcgccgcggaacuugcucuaacuuccucggccgagccgggccgcgccgccgcugccgccgccgcgcgcgggugaguagagcgcggagaccuggcuggggcgucgggcccugccccuuucuuugucugaggccgacuuccccgagcguucuccgggggcgagggcugcuccuuaggucccuguuuggccccucagccucccuccccgccugcccaggagcggccccgcgggcggcgcuggcuuugucugccaggauugcucgcuagagguuggaggccuccgccgggaccccgcugagccgaacuccggcgccgcgcggacgagagccgcggcgggcccggggccggcacuccugguucgguagcccucgccccaucagcgcgccccggcgagugcgcgcccgugccgggcggggugagggcgacgggagccuggacggccgcugcugcucggggcucugcuucucguccccagcagcgagcucggggaugggccacccuuucggcucagucacccacccucggcucccaggagaucggguccggggugggggugggcguaggccggggcgggccgccccuuccuccugccccgccgugguugugcucagucucccacgccgccgugggucccacucugcccggcuuggguuugggacggccggaguuugaguaggcggugacccagcuucuccgcguuagucgugugggguuguguuugggagcaaagccugaccccugaccuagccggaguucugguagagugagguuuguggcugcggacugugcuugucccgggccgcugcugcuucuccuccacccccagggguggggugcggguggguaggaagugccugugugaggguguguggagggacuuuggcccugggaccgcaggagcacuugucuuggggacuuaaaguugaucuccggcgagaaacaguccgugcuagggggagucgggggaagucgugggcccggguacuggccuggggcugggcgcagagcgguggugagugcggcggugucacacacucguuggcugugcuggcgcugcuauccgggaggucaggcggugcugggcggcugugcagagcauuguauuggagccucugcaggugugcucuuggcaguggucugcucuccaggggaucuuccucccuuccgagagggaguugcucuugggcuagugagagaguggccugccaaauccucaaaaguagccuuccccuugccccuugaccuugaaguccagaagcaguuagugccugcugagugcuccggccacccuucucuauuugugaagggaaaccuggggacaggccaucggagcaccccuauguccuugccacauuucagcuagccgagugguuggugggggcggccgucuuuccagggaucuuccugggcccuggcacccccagaaugaagcccagacuccaccauaauggcccuguaugcccuucuauccccuuagcugcuggugugaucauagccucaaauugcugggcucaagugauccucccaccucagccucccaaagcacagggauuacaggugugagccaccacgcgcagucugaucccacuccgaucccuaacguuauagugacaggcccuggaaacccagggccaccagauguauuuucccuuuccuucucauuguguugcaccccaacuucaguuggagacucuggauauauccauccccacaucucugaacuccacugcuugggccaccuaaugucauccucaguuuaguuaacaaagcaugguugagauuucuguggggugcgaggcauuguugcaggcacuauuccaagucuggaaagucccucaccagcuaugaacuugguguggucuuagaacccaggcuggacauggcauaggugcucaguaguguuuauugaucugagcuugaucucagcguagcaggaucauuuagggagacgggguuguggggggggucugagcccaugggugcuucugaagguuuguggcugccccaggaagaaagggcauggagcugcagaaugguuggcugcccagggaauuguccccuucaccagcugggcagcugugcuagucucugaggacuggugaagguccuucucauguaggaaguggcaguaugaagugggagaggagauggcucugcccugaagguuguggcggcagugaagugaaguucccauggaggccggggagcaggaaagcccuggguucuggaacuauuuccugaggccucacucuaugccaccaugugcucaggaauuugacccauuuaacuucaacugagguagaauuccuuuuagcagugccugcaaaguggcauugugccaggccugggaaaccuuugcuggcuuaaaauuuagugaaggacaagauuauuucauagugauacuaaugugaguuuauugagacuuacacccuagaaguuugacuuguaauaacucauuuaauccuugaaaacagcugugauggcugggcgugauggcucaugccuguaaucccagcacuuugggaggccgagguggguggaucaccugaggucaggaguucaagaccagccugaccaacacggugaaacccugucucuacgaaaaauacaaaauuagcugggcgugguggcacaugccuauaaucccagcuacuugggaggcugaggcaggagaauugcuucaaucugggagguggagguugcagugagcugagaucgcgccguugcacuccagccugggcaacaagaaugagacuccaucucaaaaaacaaaaaacaaaaagcaaaacaaccgugaugucaacagcuccauuuuacagaugaggaaacuguggucccgagaggucacagaguaacuugcuugaagucucaauaugagcuggguuuucucauuucuuuuuuuuugauacugagucucacucuauugcccaggcuggagugcaguggcgugaucucggcucacugcaaccuccgccuccuggguucaagugauucuucuccugccucagccucccaaguagcuuggacuacaggugugcaccaccacacccagcuaauuuuuguauuuuuaguagagaugggguuucaccauguuggccaggcuggucuugaacuccugaccucaagugauccgcccgccucggccucccaaagugcugggauuacaggcgugagccacugugccggaccagguuuucucauuucuaauuuagacaauauguuccucucagaggugauuaaaauggauucauauaccaaacaagccuggcccacaguggaacuaaugaauguuuucagugaaggugcccuuguaucccugccucugaacacaucucaucuguccagcacagccugggcacauagcagguaccccggaacccccgcugauuggugauggagcuucugucucccuaaggccagggaaugggaagaccagcacuaccacaugcagaagauuggggagucacugcuugugucugucuggacagaucacgguuugcugugguaacagcaauccccaggucucagaggcuuaaagcaacagagguuuauuucuuguucacacugcauguucaucacuuaucugcuuuauguuguccucacuggggggacccauagugauuagugggaacaccccugguggcuuggacagagggacagagaacaugaugaucccuguguccugccacugaguccugguggccuuuaagaugccuaugggaaggggauuagguuccugcugccugucucugcccugccgugucaguccuuggauaucuugcauguuccauccgcuaccuggauguggccuguaggggcagccaccuuuccuagaagcaggagcagguagcgauacccaggcaggccugguccuccccacuuuugugggacucggggauugagcuugcaggcauagggguguagaaagcagugguagcgaggugacugaagguggacucccacuggggaugggauugaguguggggcuagaucccuggucuguagaagggaguaggaacccuguuaguuaaauuuucccccucaggccacguuaguaggauuuugaagagucagccacacuguggcucuugauuuugugccuggucaccugcuuggucucuggugauuucccucggggccagcagacacuguuggagguggugaggccucagguucuucugcuucaugguuaacucacucugcuuaggcauauuuccaccuuuuccagggccuccguuuuucugccaguggauugagagguggugguggucuccagcaguggucucacucuuggcaggcuaucagaguacccagggagcugcguagaaugaaguuuugagagucuuuggucuaggugaaugccagcguuucaguuugcuuaucuuccauuauaguaguguccucuguaacugugaaucagggagguuauucauaauaucuccacauccauuuucucccuuaauugcguaugcuuuugauuuagacagggcaaguagccauuuugguggagcgcaggcccuggcaggggggcaguguccagugccgcucucaauuaaacgugaagaugugaagaugaauaacacuguccagcuugcagaguggacgguggugaggcaagcuuucaaguugcaccuacuuucuaguugagugaccuacacaagucuuugauuuuuuuuuuuuuucuuccuggaaaaaaaaaguugucuacuuuucucaucuguaaagugagaagaaucaagucugccuuuucugucucacgggguugcagugaagcauuaguacccugagaagcaagauccaaagccccugaguuaggccugacacuggugugagacagcugccaucucuggcggcacucagcaaguguucaccagcagcugauucugggaaccucacuuccuccgcccuugggcuuggugggguuggguaggguuggguggggcugugguuuucuuuuaggaggcagcaggccaggccuggagaccagagcuuaagugggccugggcaggcugggguugaaacucuucaccccuugcggucuguacugccucccaacugagcagccagggagaaggccuagagccugugccuuucagcuagauagcuggaggaacuggcuccucccuccuuaggcugugcuggccugagcugggagccugagagcuggggcaguugucucuaaaguggcuucugggauucugguaagaggugagcuccuggugcugccucagagucuuuguguuuccuggcauuugggagagcuggaguugggcuguccugcauggguaagguuuggggagggacuggaacaaggggcuagugaaccuucucuggguuuuuccugccugacuaugcguugacagucccagcuguugggccugugcuccuguacacugcacggccuugagaggaguucggagcccuaacauccaggagagaggccccacagcaguggaaggaaaugggccucucccgaaucucuuguuuguaccccgaggucugaguggugauccuggggaugcuaugggacucucagcaguaggagugugucuguccccagucugggugcccaccagcugugcugaggguccucuccugugucccugggccaggcagacagggucuuuuucuggggcuuguuaggggaggucagccacagccccagaccaaguaauuuacacacccugagugaggggugggagcaguggguccaggaagacuuagggagcuggugaaagaaaaacuuaauucugacacuuguuaaacugguaagguagacuguaucaggacuauuacgauagauguaggaauuaucgcaauggauuuugcaguagaggggagagagugggccaacuccaaauacaacaaagaaaagugggaacuuauagccaaggagcggagugugggggcuccugaaaauuucuaagaggguagggaaauuuuuacuaaacuuagcuaacugaauucuugcugcaggcaggccagggugaucagguuuuaccugggagauaguacaggaugagaaauacguucagauauccagggugauuagauauugagguugggggauucugguuaacaggaguuuugcuaaaacuaggcucuuagagagaauggaguuaggaacccuaggucaggaccagaugaguagagggcucagaggaauaaaguuuggugagggacagaaucucugucaguaucccgugguuggcaguguccuguccauucuucuugcacuggccugucccucaggagacaggugugagugguccugagcuugggccaguguaagaguaggggacagguuucucuccuuguaggugucccuucuuguaagugucacucucuuuuuuuccagaaaccuugguccuuuucagcaucugcuggccccuugucccuuggcucccuugcucuuggccugcuggauuuccccucugcacccaggaaaucgcauggaccuggguccuuguuucccuacagcccaccaauuuugcugcuuuuuucugcccccugaagcugagcuccugcugcaauuuguguucccugcucucccuguccugggcaaaccagucugacaacuuugugguucucgcucccgccuccaucagccuggggauugacugucccauuugucugagcugggcagagggaggugcugugggggaucucuuccucuugccuggacugcacacuccugcugccuucuagccggagcuccugggcauuuugccuaugggagcuucaccagcuuccuucugucugaggccuacaagucccugccuccagccuaccuuguuccuccuccaugagugaggcuccuccuuuucucucuggcccuccugucuacuugaucagacucugccucucuugagggccggcucccuccagccuacccugcacaggugacccuguuuggccugccuccuuuucuugaggcugaucuugucucaacagucagcuuuucaggaaccaggcccuugcuguuguaaggaaaaccugucggcuguggauggggccuucccuccuuccuaaaggcucuguagccagcuuccacccuugcaguggaacagugguggugccagaacccugcucucugcagccauccugccuaccacagucauuguguuuuguaacucuaguagcuucuugugaaauacaagugaugguauaaacguggauagguuuuugaggggggcaugccaaaaucagaguuggugguaguggugggggauucauucccaagggcucuggggugcuaagugugugagcaaagaggaacaaguggcaugugcccaggaugggguggggcgggcagguuuaguugagggcuccucugguguaggguagcccugacgcuccccuccauggcaugacugaugagguggcaaaggcaggugccaggauuugguguguugaagauuagugccuggguugggcucugcucacuccugcagaaagacgguuggagaggggcuggucuugguuucacagaggauugugggauuacaggcaagaccugcugagggcuugcacugagccaccgagaggagcagaaagagauacgagggcuucaggugccaguaugguucucacuguugugagaucucauuugugccuuuuuuuuuuuuccuucagacagggucucacucuguugcccaggcuggagugcaguggcccuaucacagcucacugaggccuccaccuuccuggcucaagugauccucccgccucagccuccugaguagcagggaccacaggcaugcagcaccacacccagcuaauuuaaagaauuuuuuguagagauuggaucuugcuauguugccuaggcuggugucaaacuccugggcacuugauuugugcuucuuaauucaggggcuacuuauugaacauauuuagcagucuucagaaagcaucuuauucuguaaggggaaccaaauauacccauucccccucucuggccuucuuucccuguggucugggcggucuuugagcuugaggucauuaggagguguuuauuucuguccgcccugguggccuagggcguaggaauggggugggaugggaugggaugggguggggugggguggaggaguuauucuacauagauagaguucuguuuaugcagcacucccugccauacacaucucucacucaaauggucuggccaguccugguucuaauggucauugugucauuccccucagcagcaggaaaggcuggaaugguuuuuguauuguuccuuagggggaaaaaucacuuggaggaaguauaucagugcuucugagugcagaguauuuauugacacgucaguuaaaggaagcuuuuaaacaacauauauguaucucuuuagugaggaauaaaucuacaagugcaucucacagcuccauuuugcagcuuccauuuccuggaagguacauggaguuuagugguuagggaaugggguuuugagcugggauuuuggagaaacuguuuuuagccuguccuuggaauugggccaggccuagaaaucuguugaaauagcuuucuuuaguugcugaaacugggauguguucauagcacuaggaccucgagcuccacugaugacugaguggggagggcucagagaagggucccuguggaugcccgggaugccuggguuucagucccgucuccugcaucgccuacauugccugaaucuuagggucuuacagauuuaucaugaagugggcuuggcagcagauggucugguuucuuuugugccuuugucagaaucuguucuugcucuucuuaggaaaacuuucuauuucaggacuugggguggagucgaaagcagggagcccugugaguuggugagucuguaucccugaggcugccacugccugacccccuccuuccccuuguuucguuuccccuccccauuacucugccuuguucuagggaaacaccagaagcugccugcagacagcuacggguaaaauuguguguccagccacaaacuuuaggcauuuuaaauauuaauuuagguuuaacauuuuuauuuacaaaaauguauacaugaugaaaaacacauaacaaagauacacggugaaaacuccuauuucuaucccugaccccuucaguucugcuccccugaggccgcugucaccagauguucagugccuagucaagcaugacuguauuccucucuuguuuauuaccccagugguauacuaauuaugcuguuuugcacuuccugauuuuuacucugagaauuuaucccaggauuguuccauuuuagcacacauaguuuaguccauucuuuuuaacagcagugcaugauucugcugcacagugaaugaugacucacuuuaccagcucucuauugauggauuuugagguugcuuucaguguuuuguuucuauaggcuaagcugcaggagugucuuaugcaugcugcaggucuguaguggaaaugacuagauguggaguuacugcauuagguguguaaaaggaaaagaaacaugcggcuuugauuccgaaagggggaaugaaaguuuacaaaguuuucuuuuggagggaucuuggccuucuacagagacaagagcuggagaaacuacugggaaggcaugagaggugccagcguguugguucccacccaaguccaucuuugguucaguucaggccagccugucuccgugaccuccauauuuacagcccuuggcuggcccucuggcucaugcagccugugccccuaaaagugugaggagucagccagagcgaguugggguguagggaggcggggagcaggcuucucauaguggguuccagcaaccucacgacuuugcaggaccuauguggggugugaagggggagcguugguugcagcaagcuggagcuggcgucagcuuuuagaggagcagauuuucccgcagugucagggguuggugugaggaucggccuccuucucuggccucccuuggccuuucgcugcucugcacaccucccuguucaggccgccuugggccugguugccacccugugauuuuaaaagccuguguaaaaggcaccuggugaaaauaauagauggguuuuguguuuugagcgggagcuuccuuucagaacagaaaugggguacgguucuuccugggauggguggggaaggagggacagucgugagagcauguuggaggugcccacucuguguugggagcucucugguuguuucccuguguggcuuucacugccccaugccagggcagggugggaagcagggagacuuuagggcuggcuggcagauagaccuccuaaauagacccugaccugguggguuugaggcuugugucccugccauggcucucccacccuucuacucagagaacuucucaccauugcgguuacaugcaguccccgugagaaggccagagcuucccaugugcagcucauugucugggccuggguccuugguagcacagagguuucuauuguggccugguggcagugagggcugaccuguggagcugaggaggcgggaccuggggccucacaguggagcuauucaggggcucugcccugguuuccugcugcuucccauuguagauuuuuuugggggaagggugggagggaacuagagaaggaggagagugggagagggaguggucagugcaacuauuguugcugguagcaggagcccuuuaugcuuaauagagguccauuugcagacagccuugagccacuccaaggcccaucauguguucucagauucuaguuucugccucugucaagaucccccuucgcccuucucaagucccugugcuugccuggaacaccucuggguaagaguucugagcagcugggcaaggagcaggaguggccggugccaggcuugucggccaccugcccacugcuuuggggagugaguucugccgagucuucccggcccagcugugcccuugggugggggccaggcacgugccuggguugcuauuagucucccaggccccccacuugcuuugugccucagugcucagcccagugcucccguuccucacgcgagcacucagcugcugaaaagccugugugcuggcagcucagccugcagccacccccgcugcaggagccacagccauuuuccuuuguucugccaucuccgggcucuugaaucucaggcuggcagugggcagcaggcagccagcacacagcgcuggugggguggaaacccuugugacaugaaucugcccacugagccaaaggcauggcagcccccuggcugcaccccuaauuccucuggcuguaccccuaucucccagccaugcugagagaagcacagaguauccccucuuacuggaucagaaagauagugacaccuacagugggaacagagagaggucucaccuguuuugggccacugaggugcacacuaaagagagagagaguuagccuccgggucuuuggcagaaaaagccacucucaggcacaaaggaugcucguucuuaaucuccuggucuuuguugaaaacagaggcaggauugguuaagaauauuuuuuauuuugguccuuaugguugugaggaccuuucucuaacugaggggaacuguacccugcuucuucacaucugaaucucucccuucucucccccaccacuuuuuggugggcaaaaugagcauucucuuuugggguacaauuucagcuaugugugggguugcaggcggggugaaggccacucucacccgcugucugacuucucuaucugaggugugcccgccccaacccauacugucuccuuucuaaaccacagacagaaucuguaaggcaccugccuuugaaauagaguuguuuuguauagaacucauaacucccacuaguuuucauguguuuagcauuauagcuuacccuuucaaaacccauccuggcugucuuauuugauucucuuaucagccaagucuuacaaaucaagaagcaagccucagccccagauaggguugcaccuuggaguguccucauuuuauuuuauuuuuugacauggaaucuugcucuguugcccaggcuggaguguaguggcaugaauaugguuuaguguagcccccaccucccaggcucaagugauccuccugccucagcuuucccaguagcugaaaccacaggcacgcaucaccaugcgcgacuaauuuuuaaaaauuuuucauagagacgaacucuugcaauguugccuuggcuggucucgaacucaucuucuggguucaagcuguccgucugccucggacucccaaagugcuaggauuacaggugugagccacagcacccagcccucauuuuaacaaauguuguagcaccuacaagacucaaaguaaaaagagcuggugcucaucgugaaaggcauugaaacacccccacuuugguggggggugggguauguuaacagaaaaaccaaagucucuaaaauauuuuaaagagguuuauuccaauccagugagugucugcguccugggaaaagcacggucucaagagguguggggaaagggugcuugaggccguuggauuacgguuuuguuuuauacauuuuaaggaggcaaaaguuacaggcaaaggcauaagucaguacauggaagauaugcauuguuuaagcccagaagggugggauaucaugaaacgggcuuacaggucauagguggguucggagauucuuuaauuuguaauucguuaaaggaguaaagcuuuguccaaaaauuuagagucagcagaaaggacugguaagauaaggaaguccguuaaccaauacacuggguuagagcuguggggugagugacuuaacccuugucuggcauggccuucaguccucuuuauauuucgguaucuuauugucacaaagagucuuguuucuuagucuuauaaucucuauuuuaauauuaaugauggucaguuuuugugucuaaaucccaaaagggaggagguauguaaugaggccuuuccaaccuccuccuuguuguggccaagagcuguuuuucagguuucucugggguccucguggccaagagggucuguuuaguugguuauggggcuuagaauuuuauuuuuaguuuacagguuguuggacccaaacaagacugggaaagucaccaucgaggcagcucaguauucuuucugggaaaaacacaauggauguagaggcugggauuugaauucgggcuuacugggugaccuuggugggucacuuccugggguguagauucuuacuagaaaauggaaguguugcucagaggaacuuugggaacauuuuagcuguaacccuuggaguucuauuaaucuaacuccaaaaugguucuauuaaucuaacuccacuaccuggaaucucucuugccaacucaggauccuuuggaagaaaaugucaucagauggaauuaacaaagagccccucuuuuccugggcauuucuuccucagguucuugagggguggugaugaucaccucaaaagaugccuguaguuuucaaguggaaaccgagccacccugagcccaaacacacacucccaguguucaggcgcugaguguggccccuggaguucacugaugaguagucuuaccuuggaccucgccuuggcuuuucuuggaaauggcacauuacuuuuguuuauuaguguagccccucuguugugaaguggaauccagggagagggaaguaaagcuuuuaauuuuaccucuugccaaagugaggccaagcucuuaaauguaaaaacaaacuuguuaaaaguaaaaaugaaaacaauauccccauuccucuucuuuggggguggagacuguguuuaaauuuugccucuauuuugucaacagguucuaggagacaaaauguucuuuuccuggugaccuuucaggcuggguuucugcccuuuaugugccuuuccuggcccagccuccauccucugggcccgcccacccaaaccagcacugccuaccaggccccccugugccuguugcccgucugacuuccucccauugucuucggggccagccugugucacugcucuaggcuguguuucugccggcacgaacacaggagggcgguggucuuggaagaggcaggucucuaucauuugguuagaguagcuuuuacagcugagaaaugggaauaaaaauaaucugugaggauccauugggaugcaacaaaaucccaaacaaaucccaaaauuaaagcauuccuccagggaagcugauugcauccuuguaaaucaggaacaauaaagauggguggcuuucuucccaugacuugcuuuaaugguuguuuuccuucugugugucagcguuacauccuuacuauucaaagugccauccacagaccugcugaugggcagcaugagcaucaccugggagcuugcugcgcuguagaaucuugaggggucuccauccagaucagcugaaucagaguuugcauuguuaacaagguaacccaagugauuugaaugcuuuuuuaaauuuuuuuuuuuuuuuuuuugugagauagggucugacugugcgcucagugguacaauuaaggcucacuacacccuuuaucuccuggguucaagcgaucugccaaagugcugggauuacaggcccaagccaccaugcccggccugaaugcacuuucauguuugagaagcacagccucagccagccacacugucaugcuugccccuucgcuuuguuagccuguuucaugguuuugcagucuuuacccacuugcuuuccuguuuaaaguugucgacuuuaaacagguuuggcagccccagcucucaguccuuccccucugggugugcagugcacagcaguuauuccucggugccggggaugucuuggaaauggagcuaguucgagaaagcccccuuagcccagagcccugcuggugagguuaucuuuggggcauggggguggggguagggauggggggguaacuggagcccuccugggugaaagggcagcccuaagccucccuggccaucuggugccacuugcccugcccuguuccagcuggagaacagguucagaaucagguuguaaauauuguuugcuuuuggaagaaacacaaagcauuuucuauaaagauguuuugguguauguugaagauaaauaaauaguccagaagagggacuguaaauuuguauuuuguaguaguuuugcagcagaaaacaguuugaggugcucuccugauuucacuuuacgccugcacauccccugcauucuggcgaagguuggggcuuuguggggaagagcuugcuucccugggaaugagacccugacucuccugcucagcuacccaagggcuccccugcauuucuggcucuguuuuaggggaugaucugcuuucuccugacucuugauuuccucucagccuuuuccagcaguuucucaccauugauuugcaguuuaaaaaauucugccgccucuuccuccucucuuuugacauucacaaggacacacuuaguuuuauuuuuccccacugggcuucacuuuucauggcuucuuuggaaaggauuuuuguuuguuuuguuuuagcucuguaaaucuuuuucccccaggcugggggagccaggcccuggggugggcuggaaagugucccacccuagacucagaaguuuuccagauugccguccuuugagguggguuuuuuuugucuuaaaacacaguacaguugucccuugguguccugucuccaagggagauugguuuuagccccagcacuuaguaguguuugcauauaaccuauguacuuccucccauauacuuuaaaucaucucuagauuacuuauaauaacuaauacaauguaaaugcuauguaaguauuauauaauuuaaagcauuuguaauuuuuuuuucuuuuugagacagagucuugcucuguugcccaggcuggagagcaauggugcguucucagcucacugaaaucuccgccucccagauucaagcaauucuccugucucagccuccugaguagcugagacuacaggugugcgccaccaggccugcuaauuuuucuauuuuuguuagagacuggguuucaccauauuggucaggcuggucuugaacuucugaccucaggugauccaccugccucccaaaguguugggauuacaggugugaaccgcugcgcccagccuuuccugaauacuuuugauccugguugcuugaaucugaggauguggaaccuguggauauauggaagacugacaguauauucuagcugacugugcaauuuuguauaaaaagauuuuuaagcaucuuacagccauaaucuuuaugccuuucaggcguggaaacauagagaaugaggaguaaauauaauucuaaacucucuuauguaguuucuuugugaccuguacaaagagaacacuucaaaucuacauuaggcauguaggucaaaucccugcagccuacuggagcagcuccuguaacagccagcuuuuaaagacccaguuauuggagcaaaguuuguuucuccccaagaaugggccacucaucacuuggaacaucuaugguguucaggaguggcucccaccccaauggugucagcccugcaaggaugaccaugcugguuuugucuugguaucaucugcagggcccagccuggagcuggggaugcacugaaggcucuguuaauaaucuucauuggagggucagucucggggugaaacaguugccugcugccaggucggguugcagugugucccucccuaucuuuaggcacagcucucgaucccaaacuggggagcuucuagaugugcugcccucaucuaguacaaauuuaaacuagcugcuuuagggagcauuuccugaccagcuugccaccaccaccaccuccuucucucugcccuccagcaccuacuugacugcacuuagugaagggagucauguucugaguucccugagucaggcacaggucccacucugaguugguguuugucuccacggccucauucucggugucuuacaugcagcagugcccugaacauguagaaacaagucuuuagguguuugucucccacagcaaaagucuuuucaccccaugggcuuggcaggcgagccugugcacugauggauugcugggugguuugcuucaaccuugcugaucuagggaggccacagggcccagcccaguccuccugaggucuggaggcacagcaccuuggacucccuggguucuuguucacauugggaauacuaguguagacugggcccagacucuccacguuuguuugcaacuagcugaggaagaggcucugaugugcucuuaccaggggcauauaaaaggauucuguguauagacauuucauguagacuuagauuuucagaaacaggccugucaugaugaucaggguauggguauaggacacgugcacuaugccugcuuuggccuagcauccucccuugagugggcagcuucaccuucaauggcagagggaaguagguugggacaucaacuuggaagucaaggugccaggccuccuuuugccuagccauuugagaagugggggugggguggguagcagguguggggugaguggcaggugugggugaccaggcccugccucaccuaggugggcagguguugcccugaggcugcuggugcaguugaaugagcugccugaugaaucauucugaaaaucucucaugggugcugggcgugguggcucaugccugugauccuagcacuuugggagcccgaggcaguaggauggcuuaagcaggaguuugagaccagccugggcaacauagggagaccccaucucccuauguagcugggacugcaggugugcacugagguaggaggaucacuugagcccaggaggucaaggcugcagugagcugugacggugccacugcacuccagccugggucacagagugaggcccugucucaaaaacguaaaagugaaaaucuccaauggggcccaaggccugaauguuuuguuugcuuuuuuuuuguuccuccaagaaggaccacaaacucuauguuucaguuacuugaagccaguuauuuuguaguaucucccuuaauuuaaguuuguuuguuguuuccucaugguuagcugcaaguuuugcaguuuuguaaggaauacugcggaaauggugaguucuaggugcauccccuugggaggcacaugaugugggucugagucauuaccggugauauugacaaugaucgcuugcuuauggugaugucugcuggguuucuccccucuaaguuacuauuuuguucuuuguaaguguccuguggggagauacuuugagauuaugcaaauacaguaugcuauuucacaucaaacucaugacugguuuuaggacccauugcagauucuuggcacagucgguuguuucugucauggguguugaaugcgaugauuuaauuccauaauuccuucuacauuuaucauuuaacuauacagaacugcuguagcuauguaucauugugcuacacauaacuuuuccuucuuuccuguuuauuuaucucuguguguguauuagaaugggcucaugaauucuuauuuuauucaaugaguuaaaauccguuguuauuauuguuuauuuugccgcucagauuguuccagauuuggccagugggggcuuuuucaagcugcugugaaugacagcucuucaaaacaugcauuuccaagucuaucacaguucuguugaacuaguugccauaugauucuggaggcagcuccugagccguucugcuguccuguggagcauggcgucagucacaguaggcccaugguuuuuagugugcaccuugugaagccuuccuuucccccagccaccugaagauaaaaguguccugcucugccugcuuccauguuggguuucugggucagaguuucuuugaacaaagccuccuguagcuuaaaaaauaauaaaaauaguaagcuuggaagucacuggacuaggugaccuccauuccaggcccagugcuucucccacugaggacuccccugacucaaauccacccacucugcugcuuuccugaugacagcacugagguagacagaggccuccucucaccagguuaaugaggaggccccucgguguccugaaacuuggcagguuuuggguugugaguuuuuggugguggaaauucacaguguuucagucacuaagaucaggguuuuuacaggaugccaggcacugagacccucagacccuuuggagagccugguggagcucagagcuggggcccagccucuccugcaccugcauguggaggccauccagggcuggcggucaggggcuugauggccuuggaagcugggggcccaccuuccccacacugugccagggcaguguuugucacccugugauaaaggaggggauccagccccccugacguugugcagcuguguagugacuucccacaguaaagagucaaacuucuucacuccagugagcgguugcugccaccaugauggguuuuuuuuuuuuuuuuaaauuaaaguuuuuuuuuuucuuuuuuguuggaaaccacagguucacaugccacggugucugauuuugcaguguuucugguggccccuggauuuggcguuuggguuaaugagggaaugggucagggaugugcauggacaguucuggcucuaaggggugagucagagagagccgagccccuccuuccauccucagagggugagauugcugugggcagcugagcagccugcccuggccugccuuagugauucucucuccuacuggggcccauucccuuucauauucgccugcccccuccuaggcuucucucccugggccugccuguuccuuuggccugugaauguuccucagcaccuagugggcucuagagacccccuucucagaugguaggaaugucuaggccccaggugcuacuagaggugcagcagaaacuccgccuuccuugggggauguggcugcccuuccuugggaugggccugugaucaggucagaggccaguucugggagccucaaaggccaggugguguugaaggauuggcuucggagaaugagagggaaggagagauaguaaggauaauuugggggcaugggguguauguagcucaggauaugggugguggguguugucauugucacuuggguccuuaggaaaaagaggggccagaggaggggugggguugaagguagagagccagguaagagaccuucagaccuucccugagaggucaugaggaacugaccugugcccucaggacgggaggggaggggagugaggggaggggagguauuggagcgugaggaguuuaggaaagcuccugagugucugggugggugaaggcugagggauucuggguggggccccuugguccaugcuuugucugguauuugugccuggugcuuguguggaaagaugcaaaucucuggaaccaucagcagaguaguguuggaggguugugaggcaugugauuaucccauaggaggggcaaacacuccagggacaucacucucaggaagccuggggagcucgcagugccuuugugcagggucaggccacaugguuugagccuggccuucccaaaucucaguucacuuuucuccacugucaugucauccggcuuccuucccuuggguuuucucuccccucuuccucccucaugaccccuuauuaguauauaaaaaaugagacucuugucucagagcuucccaaauuuucaucuuauucaggaucuuagugaaaugcagauugaagggaauugagauuccacauuuccagcaagcuccugaaaugggcaucguccaaacagggccaggcagaaucgggggaugcuaaagaacuggagguagaggacacccaguuggaggggugcaggcggccauccucccccucugaaggucccugugggaggagccaagggccugacuucuuuggguguggggcugccaagcacuggcuggaguuuaaucuggauccaaggcucacaaacagcugguucuuaagggagugucaguguugcagugauguuugauagagcuaaucuggcaauaggacagauaaugagcuuuucuguaaaucuaaaaguuuugggcugagcaugauggcuuaugccuauaaucccagcacuuugggagacugcagagggaggaucucuugagccagggguuugagauuagccugggcaacauagugaaacccuauuucuacaaaaaauuaaaaaauuaacuucguguggugguacacaccuguggucccagcuacuugggaggcugagguaggaggaccaugugaagcugggaguuuaagauccugucucuaaaaagagaaaaaaaguuuuaaguuaaagguccacucuguucugaguugauguucuuuuucugcccccuuuccccauccuuuuuuuuguuguugagacagagucucgcucuguugcccaggcuggagugcaguggcgcgaucuuggcucacugcaacuuccgccuccuggguucaagcaguucucugccucagccucccaaguagcuaggauuauaggcgccugccaccacacccagcuaauuuuuguauuuuuaguagaggcaggguuucaccaucuuggccaggccagucuuggacuccugacuuugugauccaccugccucggccucccagagugcugggauuacaggcaugagccguggugcccggccuccccauccuuuuuauacagucaucccuccacuguccaaggggguuugguuccaggacauacccccuccauuaugccaaaauccauagaugcucaagucccuaauauaaaaugguguaguauuugcauauaaccuucacacauuuuucccuaaacuuugaaccaucuccagauuacauaaaaauaucuaauacaauguaaaggcuggcugggugcgggggcucacgcuuauaauacaagcauguugggaggcugaggcaggcgaauugcuugagcccaggaguucgaguccagccugggcaacauagugagacccugucucuuaaaaaaaauuuaaaaaucaguugggcuugguaacacacuccuguagucccagcuacuugagaggcugaggcaggauugcuugagccugggaggucaaggcugcagugagcccaguuugcgccauugcacuugagccuaggcgacagagcaagacccugucucaaaaacaaaaguaaaugcugugaaaauaguuguuuuacuguuuuuuuuuuuuuuuuuuuuuuuugagacggagucuugcucugucacccaggcuggaaugcaguggcgagaucucugcucacugcaagcuccgccucccggguucacgccauucuccugucucagccucccgaguagcugggaauacaggcacccgcuaccacacccggcuaauuuuuuguauuuuuaguagagaugggguuuuaccauguuagccaagauggucucgauauccugaccucgugaucugcccgccucggccucccaaagugcugggauuacaggaguuuuacuguauuuuuuacuuguaucauuuuuuguuuuguuuuguuuuuuuuuauauuuuucaaauauuuuucauucccaguuggcugaauccauggauacagaacugugguugcagaaggcugacuguauuaaaucucacaauuucuguaggucagagguccaggcccagcauagcucaacuuauucccuccuuagggucucacaaagcccaaaucaaauuguuggcagggcugugcuucucucuggaggcucugggaagaauccacuucuaggcucauucagguuuucagcagagugcaguuucuugcuacauguagaacugaguccuugcuuacugucagccagggcuacucuuagcccuuagagucccucacugguccucgcauguggccccuguacucagauccagcaacagugcaucaaauccugcugcugcuucucugccuuccucuucugcccucaacugggaggaagcucugcuuuuaagggcucauguaauuacauuggauagcucagaugaucccccuauguuaagaucaguugauuaguaaccuuaauuacaugugccaagucacuuuugcccuuucuuuuauguaauaauggacuauacuuccugauuuuuucacuuugcuaaauaaaaagguggcaauuaaaaauacuuugaaauguuccuagaggucuucuggguaaaaaauagugguuugaguagacacauguaauuuugcuuucuccuaaacccccacauaagauaaagggaguuguaaaaaagaaaucaaugcaugaggacagggagaaugagaaagaaaacaacagcaagaaaaauuuugcaagcaaagaguacaugaaugauucaauuuaaaauguaggaguggauggcaugagauuuuuuuguggggggaggggaacgugggcaucagagguugcugaguacaagaauaguuugaaagcagcuaaugcaguuacauccuuccaucccuuccuuuccuuccaccgugaugcugggugauggccuccgacuuuagcugcauguugcacauuucugcagaaggaaaaaccaagggcccaggagccuccagguauucuugggaguuaauauagagaccaccuccauucucuagucuucuaaccccuuuuagcuucuagaacauugacagccaggcccuuauagaugaaaaggggccucacuguggagucuaaccagccuaagaugggaaaaaaauacaaaugaugcugacaacagggauuucccagcaaauggcccaaccagaucauccuagacagaaacuuagccgcccaaggacucagagcuuccagcugguuccugagucauucacucuuagucaugcggacugccagggauuacuagauggcuaaagaaagugccuaauaugaaggaaagcaaaacaaaugaaaaaaagcaauuugaaaggaagucuauuuagagaaaagaacauuuugaaaaaaauucuuguauccaugaaauaagaacaggauacaauaaaaaggaacaguuagaaaacaaaguuaucagaaaauuuuucaaaaauaagagcagagcaaagauaucaguaguaguauuagaaaauaaaguucagggagucuuucagaaaauagagcaaacagaugaggagaugaauaauaaauaaggcagaaaagguaagaaaauuaaagcaucagccaggcuucccacaucaauugauaggagcuaaccgaaagggaaaacagagaagaaggcaagugucaaaaucauugaggaaaauauugccugaaauagguuauuagcuucucuauggaggggccuguggaauauugagccaaguaguugaaggcagacccagacuaguacccucagaugucaauaugcuuggaagaaggggaugaugcuacaaguuacacagagaaagaaacaggucaaauacagagaucagaaaucugagugguuucgggcuucucaauacaucugaauauaggaggugggggagugaugccuucaucaugcucaaugaaauggauccccagcuuagaacucugcacacagccaaacucauucaagagugaagguauccuguaaucccagcacuuugggaggccgaggcaggcggaucacuugagaccaggaggucgagaccagccuggccaacauggcaaaacccugucuccauuaagaauauaaaaauuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuccauguguuuuuuggcuacauaaaugucuucuuuugagaagugucuguucauguccuuggcccacuuuuugaugggguuguuuguuuuuuucuuguaaauuuguuugaguucauugcagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacguuuaagucuuuaacccaucuugaacuaauuuuuguauaaagugcaaggaagggauccaguuucagcuuucuacauauggcuagccaguuuucccagcaccauuuauuaaauagggaauccuuuccccauugcuuguuuuucucagguuugucaaagaucagauaguuguagauauguggcguuauuucugaggccucuguucuguuccauuggucuauaucucuguuuuggugccaguaccaugcuguuuugguuacuguagccuuguaguauaguuugaagucagguagcgugaugccuccagcuuuguucuuuuggcuuaggauugacuuggcgaugcgggcucuuuuuugguuccauauggacuuuaaagugguuuuuuccaauucugugaagaaagucauugguagcuugauggggauggcauugaaucuauaaauuaccuugggcaguauggccauuuucaugauauugauucuuccuacccaugagcauggaauguucuuccauuuguuuguauccucuuuuauuucauugagcagugguuuguaguucuccuugaagagguccuucacaucccuuguaaguuggauuccuagguauuuucuucucuuugaagcaauugugaaugggaguucacucaugauuuggcucucuguuugucuguuauuggcgucuaagaaugcuugugauuuuuguacauugauuuuguauccugagacuuugcugaaguugcuuaucagcuuaaggagcuuuugggcugagacaaugggguuuucuagauauacaaucaugucaucugcaaacagggacaauuugacuuccucuuuuccuaauugaauacccuuuauuuccuucuccugccuaauugcccuggccagaacuuccaacacuauguugaacaggaguggugagagagggcaucccagucaguguggcgauuccucagagaucuagaacuagaaauaccauuugacucagccaucccauuacuggguauauacccaaaggucuauaaaucaugcugcuauaaagacacaugcacacguauguuuauuacggcacuauucacaauagcaaagacucggaaccaacccaaauguccaacagugauagacuggauuaagaaaauguggcacauauacaccauggaauacuaugcagccauaaaaaaugaugaguucauguccuuuguagggacauggaugaaauuggaaaucaucauucucaguaaacugucgcaagaacaaaaaaccaaacaccguauauucucacucauaggugggauuugaacaaggagaacacauggacacaggaaggggaacgucacacucuggggacuguugugcgguggggggaggagggagggauaacuuuaggagauacaccuaaugcuaaaugacgaguuaaugggugcagcacaccagcauggcacauguauacauacguaacuaaccugcacauugugcacauguacccuaaaacuuaaaguauaauaauaauaaaauaaaagaauauaaaaauuagcugggcgugguggugcaugccuguauccuagcuacuccagaggcugaggcaggagaaucucuggaacccggaaggcagaguuugcagugagcugagguugcgccagggcucuccagccagggugaaggagugagacucuguuucaaaaaaaaagagugaagguagaaaaaaaauguuucagacauacuggaugugaaaaacuugccuuucacauugaagaaacucgugaaggugaacaaagacuggaucuucuuuaggguguaucccaaaagauguaaagggaauucugugcacugguccagauggaaggaucuccgaaggccccaggaggauuucuuuuugaagaagaaauagaaauaaaacaucagaugugaaaaaacucaggguagauuuagacaacugacaucaaauuuucgguuaaauauugauaaauucauagaaaauuaagcaaacaaaacaagaaguuguacgggaaaagaaaugaaaucauguguuauguugcucacucugauagcucacauggucauaauaaggucaacuaugaaaauuacuccagccagcacugcaguuuaauuaguggagagauuggaaaggacaagcaugagggguggcuugcagggagagggauuuauggggaguaaaggguuaaguccuccucuuccaagguagaaagcagaugcauaaugcguaaaacugaaaagcuggggaauuguaauacaaaauggcgcgaucucggcucaccguaaccuccgccuccuggguucaagcgauucuccugccucugccucccaauuaacugggauuacaggcaugggccacugcgccuggcuaauuuuuuuuuugagacugagucucgcucugucgcucacugcaagcucugccuccuggguucaugccauucuccugccucagccucccgaguagcugggacuacaggcaccugccaccaugcccggcuaauuguuuguauuuuuaguagagaugggguuuuaccauguuagccaggauggucucgaucuccugaccucgugauccucccaccucggccuugcaaagugcugggauuacaggcgugagccacugcgcucagccuacaugcagacaguucuaagagauauuuggguguaaacaucaagagucagcuagaaguuggaagugucaccuagaaagggaaaaccugacuuaagggcugggaucugcuguuuucucaacaugguuuuuacaguaguugauucuuagauuaugugcaguuaugauuuugaaaaaugaauagaaaaaagcaaaucuacaaugcacggcaugugauaaggggacauauuucacaaaacugauuuuuauuuuuuugagauggagucucgcucuguggcucaggcuggagugcacuggcgcaaucucagcucacugcaaccucugcuucccagguucaagcaauucuccugccucaaccucccgaguagcugggauuacaggcgcccgccaccacgccuggcuaauuuuuuguauuuuuaguagagacgggguuucgccauguugaccaggcuggucucaaacuccugaccucaagugauccaccugccucagccucccagagugcugugauuauaggcaugaaccacugugcccggccuccacaaaacucauuuuaguugugcaugugagugugcgugugcacuggauugacuuuuguuaaauguauuucuuacuauggguugugauaagauuugaaaacccuuguuuagugguuucucauugucaguucacuuuucuuuuccuuuuuuuuuuuuuuuuuuuugagacggaguuucgcucuuguugcccaggcuggagugcaauggcacgaucucggcucacugcaacccccgccucucugguucaagugauucuccugccucagcuucccgaguagcugguauuacaggcgugagccaccacgccuggcuaauuuuguauuuuuaguagagaugggguuucaccauguuggucaggcuggucucaaacuccugaccucaggugauccaccugucucagccucccaaagugcugggauuauaggcgugagccacuuugcccagccagccaguucacuuuucacacuuaugaauuguugagauauuuuacaguugagaaugugcuacuuuuuuaauuuaaaaaagggcaggagggaggaauauuaaaggugaguacaacacugaagccaaggagcccuguuuaugaugacugccagccuuauauauuguagcaagcauucuccuucccagcaggggcaccuccaaccagcagcggccccauuuucauuuauaauacaaaggugguaaugguaagugugaugcuggaaaccuuuuuggaaaaucacuuguaaguccaccaccaccccaugcagccauuuucaugcucuuaacauuccacuuuggccuuuaagcacaugcuuacaaauugucucauaauugcaaaccaugagguucauguuucacuuaauguguauucuuuuucuggaggcaaauucuuagucauuaguuuauugauuaagggugugaccuuuuuuugggugguaaauguaaccauauugcuaccaaaugguaguaaccguuucaucugcugccaacaaggaauaaauguguuugccacaauagugguggcaauuuuguuaaauuaaaaaguguaaaguaggccggguaugguggcuuaugccuauaaucccagcacuuugggaggcugagaugggcagaucacccaaggucaguaguucgagaucagccuggccaacauggugaaacuccugucucuacuaaaaauacaaaaauuaguuggacauggugucggucgccuguaaucucagcuacucaguaggcugaggcaggauaaucacuugaacccgggaggcggagguugcagugagccaagauugcaccauugcacuccagccugggcaacaagagcaaaacucuugucucaaaaaaaaaaaaaaaaaaaaaaaaaaaaaaaaaaaaaaaaguguaaaauaggccaggcacggugacucacgccuguaaucucagcacuuuggaaggccaaggugggcggauugcuuugagcucaggaguucaaaaccagccugggcaacaugaugaaaccccguuuguacaaaaaauacaaaaauuagccaggccugguggcaugcaccuguggucccagcuacuccagaggcugaggcuagagaaucacuugaaccagggaggcggagguugcagugagcugagugcgccacugcacuccagcuugggcaacagagcaggacuuguuuaaaaaaaaaaaaaguguaaaauaguauaucuggguugucuuuaaguuuuauuucuagugacauugaaaauuuuuccuuuuuuuuaaauuuuuuuauuuuuuaaagaccgggucuugcucugucacccagacuggagugcaguggugucaucacuguucaucacagccuggaccucccaggcucaagcgauuaucccgccucagccucccacguagcugggacuucagucaccacacccagcuaauuuuuguacuuuuuguagagaugguguuuggccuuguugcacaggcuuauuuuuccauuuguuacguuauucuucccuuuguuauucuuuccuuuguguauaauguucauauccuuuguucauuuguguacaacgggggucuuuuugaaguaugggucucuauagguugcagauauuuacugugucauaauuuuuucagcugcagauaacauuuguguuuccuuuuuuauuuuaauguuacuuuuauucauggggauuuuuuagauuuguuaucuguucaggcuugguagucuugugcuuugaauuguuuuuuccuguugccucaaaaguugaagguggguaaaauggacuugaaaacccuguucucuggguguggugugugcauguaugugcauaugcccuuuaaaucuguaaguuguuauuugcuuauuauuuaacuccccucaaguugcuaaccaguuaucucacuacuguuaaacaauucucccuuugcccuguuuugagaaguugguauuuugauaaacaugugccuccuuccugccacacugaugcuuuauuuucuaucacauucuuagaguugagacaguuugagauccuaauuuuuuuucuaggcacacaaaauagcuuuuggagauucuucucugcuggaaugguaccuaacauuugugaaaaguuuacccaucucuacuuuuaggaagguucuuagucaugcgugcguguguguguguaagauaaagaguguugguguucuuuguggaugcaucugcucauagagggcuaacuucugccuuccuucaguaugaugugguuuagcaaaugaggugagaugcuagggaccauggucauuuugggaaucauuuugggucagaucuggguucuaguuucagcacuacugccuuuaucagccuuccugcauuuuuguguaaaugcccuaguagcuccguugguggcucaggagcgcucaguccuuuuuuccucccuugggguucugaagccuccgagccauaccuguugugcagcuccaucauuaccccuccacagucagaaggccaccuuacacuguguaggaggauguggcuuaggcuggaguccuaaugagucucccauuuaccuucuucagcuuaaacuauguggagaccaggaucugccagccccacagagggucaggaccugcuuuccaacccgcuggccaacacagcagagagggacagauugagaggugccuucccucccugucccgagguuagguggguggcaggggugggaaagcggggagcggagaaggaaaacugaaauguuucuuuucaacaguuuauugcaauaguuuccucuucuguggguugaggaugggggaaaaagugucacugggacagccccaccccuagaccucaugggguuauccuggguuguacaaaaauggccaaaaauggcauaauacuggcggugcaugugcucuggguuguaaguggcacgugcaucaggauacguugucuggguguggcacaccucuucuuggaugagagaggguuucuuccuaguuauuccgcaguguggccccuaguguaguuucgaguguugauguuaccaggggggaagugagggcuuggaguuuaggacguggcugugagagucucugacggguguagguguggaccccagcaucugaaggcagaauuguucccugguuggucaugcguguuggguggaaggugaagcagcagauggugagggaagccaggcgcccuguggagaauccuugcuccagagcgcuggccuuccugccaacugcauccccaugaaguguucccuguagccuuuccauguucuguacacuuuaugggugugagcugcaggagaccagggaccgucagguugagauucccuguguugccacaggacagucauuuugcaaaggccccgggcaggggagcagaggugagccaccaacacuguggaaagcacacagacacguuugcuaaugagcugguuucuuuguggagcuuucaucaaggaggaagggggaaguuuggcuuuucuuacugcuuccggagaguucuuuacaggguuggguuaaaugaggucaaaggagcacucuguaggaucccaaggcauuggauuccauggcucgcaccagcccuccuuaguuccugaggcccagcucccuggagggcacagccuucuacuuuccaggcuccucugggaaccacgaggaagagaggaggcgggauugucuuguccauaaaaaaagaauagaguuucuaccgcuuagaacauuuuucugccucauaaggcauuuccagcugaauugacaguucucugugauaaauguacuugaguuuuagguuaaaaauuuuuuuucauccuauaugcauuaauccagacauggauuuaugguuggguagcccaacccuccccugaagggaaaaaaaagaacaauuuaaaaagucaaaccauuggcugggugugguggcucaugcagguaaucucagcaauuugggaggcccuggcaggaggauugcuuaaggccaggaguuugagacuagccugggcaacauaacauagugagacuccuaucucuaccuacacaaaaaauuaacaaaccaacccagugcuuugggacccuguaauuugaaacaagcuggugaaugcuaguuauagcuaccguuagguuaguugccuacacggagccccucucugcgaauccgugugcugcaccacagcucaacaggcccgucuaccuuguaagauccccaaggggacugcugcagcccucagugccuaagcugauaccugaucugcugggcaugggucugcuggcaugucaguaucaccgugggggcgggggugggggacuugucggaaaugcagauucaaggcuccaacgcagaccuucuuaccagaaccuuguguugggggcugggaucuguauuuaaaauaagugauucugaugcugccagccaggacccucaugccagugacauuggagcaggucacuaaaagccccacuuuaguugaggaugcugagguccugagagagcagggacuugcaugggcugaggucauguugcugaaggaaggcgccugugucucuuccuugagagcugcuuuucucccugcagccgcucuggcccauacaguguucaggccuuguguguguccuuguguccuguagaguccuugggcaacaggugguuguguucacacucauucuuggaggcaaguuuuauggaugugcucuugugaugguggggcggugguaggggggagguggggauagggcagcuggguagccgucugccugucauucuccccagcugguuucugaggucagacagaaggagggucuggugggugagugguggugucuaggcugugcccgucaauuccacaccgugggagagguggagcggucacagguuccguuuccagaggagugugguuucaugucccuucuuggcacuucuuucucagaacauugcagaccagcagccagccugccguggcugccucacaggaagggguuuugcaaguagccacuccguggaagcugguuucucacuggcggaugugggugggucgccuccucaccucuaggguggccuugucuccuuucgccuugggcuguguuacucuccucaccugggaaguggggggugagcagggggcuggcaugggaccacugcccuacgggccucugauccugucccuaccugugcacuugaggcacucccuccuuccccacuguucagccacugcauugggggcaggggaccguggaggacuucgggguccaccuggauugccacugggguucaaaaaggaaagcagcaaagguaggccaggcccucagaaaagucccucggaaauagcacccuccugcaguaggaucucugagguugcuuugaggguuagacacagauaaaaaacaguggccccacccuucacucuguaguucacagggucuucccacauaggcuguguaauccaagcuucauuacagcccuggaggacaaagcuauggcuauagucuggguugagguggaguggggggcgagugacaggggagggagggagcagggggauggcugcuggcugcaguggccuuccucaccucugagggcugagcuucagagguuuucagaaaauguugcaugaaugaguauggaguccucaucuuggcuuuucuucacugggcacaguuggaucauguccagaccugccugcacguucaucucccaaacauggcucuuuguggucaagcccguuucuucuguuggcucugguggguggaaagaacguggacugugaaguccccuguccuugguuccaauccugggcugucauugcucucuuguccuugggcaagucaugugaccuuucugaaugguuuccucaaccaugaaguggaaaaaaaucaauucccaaucgagaggugaugagaucaauauuugggaaggcuccaagccgaauuucugguacuuagaagacacuuaaaaagcaucuuucuuccuuucaaaaaucucccuuauccuuucguuugucuuuuggagagcugauuuaaccugaguuuugcauuaccuauaccuggccuugguaucaggccucugcuuggaccaguaaagggucaugagggaaaugaucgggagcuuucuagaauccgcauaugagcugguuugggggaaagguuuuaacgcugagccugccaucucacuagucacacaucucuccgcagauucugcuucucagaagaugcacuauuauagauacucuaacgccaaggucagcugcugguacaaguaccuccuuuucagcuacaacaucaucuucuggguaaguggaugagagcugccacauucccuuguuuaguccuucauucaguaaauuaugguuuuccacacacucuugauuugccagacacuauguaaggcucugggauaagguggugggcagggucagugaccccuacccucacagaaccaguugcagcuguggggaugggggaaggccaaaggccgaggugauugaaagccagaguaaggccaacccagccuuggggguucaggaagccuuggggcucuggcccagaugccugucugucuccccuaccugcccccuguuccgauccugggagugccccaaugagacaucagcagcaagguacuuugugugcaucugacuaugggccaggcccuguuuuagguucugggaggugauaacagacaagggcaauaaagucuuauccuuguagugcuuauguguaaccaagagccauguuagccuccugagcaacaggacagugagggagaagcuccuuggauagggugaccagggacaggcauucuguggaggugacuugugggcugaaaacuugaguacuaaugaagaggcagccaagcaggagucuggggaagaaugcuccagauagacagaauggcagcugcaaagggccugaggcaggaaugagcuuugugugugcaaaggacaaacagaaggccauguggcuggagcugaguaagugggagaagggacacagguggggacagaggcaugcaggauucaggucacaaaggaucauacaggucucaauaaauaguuggaauuacuuucuacugcuuuaaauaauuauuggaaggcuuguaaguuggguggugugaucugauuuuguagugacugcagagugaggggauggauggugguaccagguucugagaugggauuugggguagaagggguacauuuaaguuaucucauagccagccucagggagauacuauuuccuuugucguugacuguccuggagauggaagucuuggccaaccaccaucagaggaagggcuggaccagaugagagcauggaagauggguguguugacugagaagaggagaggucugaauauugagcccuaggaugcuagagguugggucgaggaagaaaacccacucccaaguuggcugagagcgaguggccugugguaaagggaagaccaggagauuguguauuguagaagccuuuaaaguagaaaggcacagucaaccauggugcagggaggugaagaaggaugaggacaggacauugguaauggcuuagacaaaguggagguuguugauguugacgggaccacugugagcucuggguaggggaucugggcggguggauagaaacccagcuggagucggcugaggagccaaugagaaguaaagaagugaaggggaugacucuugacaguucuuccaaggaugcuugccuuaaagaggagaagaaaaauuuggacacuggcuggagauggucaagggauuaagggagauauagcauguguuuauugccagugggauugguccagggagaggcagacauugauucugugcaggagggccuggggacaugaucaugcacagagucuuugaaaaccauuaaacauaguuuaugaauaucuguguggggguagguggagaaagaaggacagaaugaguggccaugaugucacauuuugcuucuacugcagauuuggcaucuccuauggggacuggaacucuugaaaacaaggcagacuuacuaagccuucucagccuugcaagcuugauuuuacagcuucaucuccuggugauuuaucuuaguauguuuggggauuuucuguccuagagaaauaaggugggauucaauggcuuggucuuuuagcccacaucuuuuccugugguccgauaacuuugcaccaacaucugcaucauugucccuggaauagggcauugcuggauauuugauguggugccucugggucccucuuaaugcgggaguccaugcuccauccucaugauguauggcuucucagagcagcauuguucccugucuggagagcccucuggccuuaccugguguuccccuccaccaucccgcacccccaggcaaguauaugguggagguucgcugggcuaggcaggcagucugucacuugugcacuuggacacccaguugcuccucucugugggugugcugcuuggcuuugugccucaaccuccaacucucaucuugauuucugcagcuagagcagcacucucccacuacugcuguggcugagggcccugguaucuucauuucuucagaggguuucaggagagaguuuuugacaucagggagcucuacuaacuugcccaguaacacguuugcagcacuauauuccaguaguggagugcaugaauccagcaugguagcaagucugcuuggugguugaagggugcugcaguguuuuugggcuuuugcagauuuggcaauguguguugaaaguuaaucauuuuucaguuagugugccuuggggcagaacaggaaggaacaaacaggaacagucaggaagaccaaacaugagagagcuugguugggaaauaagagugggaggccaagugccuugccuagggggaagcugcuggacccuccccacuggguuccugguagugaugugcagucuucauuugcaauggagcuggcaaauggggugaggccugagaugggcgcacagaccucugggaagcucacgguguagcaggagggugccgggcuggcucugggcacccagggccucccugagcugagugaccuggcuaagccucaguguuuuccuugugauguagcacucucagcugccuagugucugccucagguugcugaaaauguauaaaguggaaugcccaagcccuuaccucuucagauaaguuuucuuuuuuuuuaaauggagaaaauaugaaaguaggauaauaaaaugaacuccauguucccaccaucuagcuuauuugauuuguaucccccugcccaacccuuuggauuauuuugaagcaaagcccagguagaugauuuugcaguguuuuuauuuguauuuuguuuaaugaauuaacagugagcaguggugcagaaggauugcacguguugaugguggacacugggcucagcaggcaaguuugaaugugcagaaggcaacuuguugcuucugugaccaauccuagguguugggacaaauaugagguuuuauuuaguaguuugcccucacuuagaauuauuuucacaggccuggcgcgguggcucacaucuguaaucccagcacuuugggaggccgaggcaggcggaucacgaggucaggagaucaagaccauccuggcuaacacggugaaacuccgucucuacuaaaaauacaaaaaauuagccgggcgugguggugggcaccuguagccccagcuacucaggaggcugaggcaggagaauggcgugaacccgggaggcggagcuugcagugagccaagaucgcgccacugcacuccagccugggcgacagagcgagacucagucucaaaaaaaaaaaagacuuauuuucacaauagcauucuuuauagauaaauaccguuugguaccuaauagauuuuuuuaagcucucuuucugacuuuggggccaagguuuucccgggauuguuaaaaccugcuugggauaagaaauguggaugccacugauguuugcaugucuguucugaaccucuugguuuacagaaugagaauggaaugggcuucaugagguucuuaucacaaggauguuagggaaaauaugcuuccaugcaacauggcuuuuugagagcgcuaguguuuuuuacuuacugaaaaaaucauucuuugguugugcuagaccuguuuuuagugcaaaaaucucacuuugacuuaggaaaugcaaaucaaaaccacaaugagauaccacuucacacccauugggauggcuauuauuuuaaaaaauggaaaauaaccgauguugaugaggauguggagaaauugaaaccuuugugcacuguuagugaaaauguaaaauggugcaauugcuaugguaaacaguaugguaguuccacaaaaguuaaaaauagaauuaccguaugauccaacaauuccacuucuggguauaaccaauagagcugaaagcaggaucucgaagagauauuuguacaccuaugugcacauucauagcagcauuauuuacaguugccaaaagguagaaacaaccaaaguguccauagaugauugaguggauaaccaaaugugauauacagaugugaaagagcuuaaaaaggaaggcaguucugucacaugcuacagcauggguaaaccuugaguacauagugcugagugagauaagcuagaugcaaaaagacaaacacuguauaauuccacuuauaugaggugcccacaguagucagaaucauagagacaggaaguagaauguugguugcuaggagcccgggaagggaagauuggggaguuguugguuaguggguacagaagaucucacuuugaugugcagaggaagggaagcugggagaggcguacacuggaggaguggcaucuggcucuuugucuuuguucauuuauaccccccacugguuccacaaagcacuuggacuuuucuaaguuugccgagugaauccucuagagggaugauuccgauaaugucugcaacuccaggguugguuuccaacacaagcauuggcuuuaaucugcaugcagagguuggaugaaguccuugccuggaucugcuucagagauggauuaaaagugaagaacugagacccuuucuaaauagacuguaggccuguguuacacaggaaaguccuuugcuugccuuuaguuuaaaaaaauuuuuuuuaaaugacauucugccauuggcuuucucagugacuugggucuguuugagccuacccuuguaaaaugugugaauucaccucugcgcagccuguuucugagugagaugagagccauggacaucugugcucugugaccagcauggcuuaaggccuauuccuucaaagucacagaugccuccugugaguagggcgaacauguaaucugugguucaacuuuugacaguaagagaauuuugagagagucuugcgaauuuugccagaacaacagguguaccccaggccucuccugugcaaaccugggcauguggccacccugcacaagaaagggaagacaagcccaagguggaaagaucaacucucuucccuuaccucuguguagggcaucuuugcagguggggucuuauucucuuccucugacuuuuauuaugcuccucuuuauagaggacuugccaccucccaggauagucugcuguuccugggcucuucugacugauggaaaauugcccuuauuugagcugaacucugcuccuuugauaucagaccccaaggccugaucccuagaucuucagacaaaugauuucuucauuuccaucucaguaaugcagucaaaagggaaaagucuaguguuuuaauaauguauauaguguauuuuuguuuucacugcugggaagaugucccuuuuucucuucagguaguauuuaaucaacuuuuguaauuucguggaaauucauaaaggcuaaacaaggcaucccagguuuacugcauuuccucuuccaugccccagcguccugucugcaggcacacaguuucauauccugugaguaguauccuugcagucuuaagauacgcauuuucacaucagcaucugcuaauauagaacaucuacuaauauagaacauuccagguugcaacauuaucuuuccaauuguauuuuuagaaauucccauauuggacauuuagguuguuuccaauuuuuuugcuauccuagauaaggaugcagugauuaguuuauguaauacgcauucuucccuuuagggaagggagggaaauuauuugcugagauagauucccaggagagauuaauugggucacaagguguguacauuguuuugaccugccugaacauacagucaaaaucacauccccagaacgacugccccaauucauaggaaguugacugucuuuuggcacuguguguguguguguguguguguguguguguguguguguguguauguacauguguguauuucaucauuuaggcuugccaaggcagagggcagggauugcuuaaucagaaacuccacuagaacuuaaggaguggccuguggugcugaugccugcauggccucagccccugauuuccccaacuuaggcaagugugaggcugggaccaccaguugggauuacugaggaagggauguucaaggugcucugagauuauugccuggcacacaggacuguuaaaugcuugcacguacuuucaagucuuaaguaguuuggugugcuuguauaacucugccuccuuggcugguaaauaaucagcauggcauagucuacaggagugauuuuucuuguuuguacuuuuuuucuuuaauggaaauccuuuuuauaaugaucacuucuguugaugucugauuuagauagaauaacauuuauucauuucaacuguacaguucagugacagcuguacaugccacauaaucaccaucaucacaaugaagauauaaaacauucccaucaccccagaaacuuuccuugugccccuacagucaugccugccccacccuaccccuucccugggugaugguuguucugccuccuguugcuauaaauuaaacucuuugguaucugacuuuuuuuuaguuaggugguagugucucuguuguuuuucuguuuuuaauuacuuuuuaaaaaucuuuugaaauaauuucuuauuuuuuaauuguacaauauacguaacagaacauuuguuauuaaaaccauuuaaguguauaguucauuggcguuaaguacauucacauucaccuugauugguguucuuauuuuuauuauuuuuuccuuucuacuugggauuauuuugcuuuuucuuagcuacuuaaacuggaagauuagaucacugauuuuuagauuuuuuuccuaauauaaauauuugaagcuguacauuuucugcaucccacacauuuugauauguuuucacuugauuugguaaaaauaguucgcauaugcauacucuaugaacugugucuccucccaccuccaggcugacuucaagaguuucuccuuuuauucuggauuauagcaauuuuauacaugcugguauaguugucuuuguguuuauucuguuugggguucauugggccuuugagauuuguggguuuauaguuuucaucagauuuggaauauuuuagccauuauguuuucaaacgcacacccuuuuucuccccuucccugucccauuucccuaggacauuguuuaucuagggcacagaggcucgguuuaguuuuuuauuuuguugaguguuuuaccauucuccuuuaguuuccauagcuuugucuucagcuuuacugaucuuuucuuccauacugucucauuggcuguuaaacccaucuagugaagucuucaauucuaauauuguaguuucuauuucuagucguuacauuuagguauuuuuuaugucuccaauuucuuuccuuaucuuauuuauauuuuccuuuaaauuccugaacauauuugcaauacuuguuuugaaguuguugggauuucaucuucuuugucauucuugugucuucuauuuacugaauuuuuucucuuauagcucacuucuuuccuuuucuugccuaucuaguaacuuuugauuggauauuaguuauaguuuuucuacuaaguauucuucccuaacaguauuaagucuuuugugucugacaucuuucauuuaauaucauaugugagauucauucaugcaguuauacguaguuguagaucauuuauucuuguuguguaauauucuauuguggggauauauaauuuguguuauuuacaguuuuaggcuauuaagaccuguuacagugauauaaaaacauaccaguguuggagaccugaguauaggguaucccaggcuuuguguggcugagcaggaugacaucccaucuuuccucuccagguccagaugguuuuagugugauaguuuacagcugagcuuuucagacuauggcuugcaggccaaaccuggccuuccgccuguuuuuacacauacaauuuuauuggaacacagccacacccauucauuuauguauuaucuauggcugcuuucccauuauaacagcagaguugaguaauugcuacggggaucauccagcacacaaagcugaaaauauuuacuauuuggcccuuuacagaaaugcugaccacugccuuaguaucuugauuuucuacccacuguuaaucacugugaacugugccaaaguuagguugggggguucccucucuccuggggguacugccuaucaccucccuugaauggcugugcucccuccgccugccuucauuuccagggccuugacucagguuccugggcggggcucagugggggucaacucuguuaucuggcaacacagagacagcuguggaagcugccccuggagcccucugcacaguccuuccccacauuggggcccucacauggguuugcuggcucugcugggagggcacauguguugccuuuucucagaaccacccuuccggcaggaggaaaagcuggggugugauagcuaugugaccccaugcaaggcaccuccugcucugggcucuguuucccucugucauaaggaagccgagcccuagcaucccuucuggcucccagaccuuccgaacucccacugacaaguggcuugguucaggcuuucaacacaggacagauaacugcagcuccucccuuggcccacugggcucucaggccagguugggucuggggucugcacccucugguccuuuuuggcuucaaauucuauucaaucgucagcauuucaaguggccacaagcaucucuguuguuuccugaaugccccaggccuggauucaggauuucuuauucuggagaguaccaggacccugggguuuccgucugguguaauuuauaauggcaaaacucagccagugggaggugcauggguccuugcugcuuauuuugcugauugacagacugaggcccaggagagggauggcuuccucgagacccugacucugugaguuagggacaaagcugagacucaguccuggcuuccuccacucucugcuguuuucuuuccaucauccuuuccuaccucacuugaaaagccuccagaaggccguauuucccuaagcucugcuucacuguugucuccagaagcccaguaaaacaggugccucuggaaagcacuuggucuuaggacagaagcuggugcuggaaguaauugggggugggguacagaacaccagugucaagagaaggagacucugucuucaggacagcagaugcuuguggcauauccuugaacgccccucacaucucugcucugucugccgugcgggagggcauggccaccuugagacuggcucugugccuggaguaagcaugucacguaggaucuuccuucaaucuuuacaaccuuccugugaccuaggaaagauaaucccuguuuuguagagaacauaggcucagagaaggucuuggacucgcaugaggcccugucacuagguagcuacaaagcagagacuggacccagggccggcuuuguucaggggaagaggcucugugaaugucaggcugagucagcguguggauugugcaagacccggaggccagcagggcagagccugagagcaucgccugcugcuggugauucgccuugaucuugcugaggaaaggccucuggggccugcaggaguugccaaguacuuuuauacacgcuuaaaugaaaucuugcaaggagccaaggccauuaaaucaugggugagaggcugccuuugaccugcuuggagcugcaucuuucuccuccaguucagcagggccuggccgggugucacuuccuuuugugacuugauugugcuuggguaaaguaccacaagcuugcucgugugguaaguggauuucuugugucuggacucuggcuggaccagcccagagugccccaagaggaccuccugccuuucgcaaggucauuugccuaaggugaaaggucaauauuuaaucuucacagugacccacaaagaggcccugcugccuuguccaccugcccugguugggacacagcguggucucacugccugacagugugggucauuuggcuguagagcugcacaaccccaaagccccccuguggaauuccuacauccccgggcucuugugugagugcccguguguggaaggcagcugcucugugggugguaagauacuguguugccagggucagaggcauccagguuugguucuuaagucugccaccagcuagccgugugaccuugggcaaaggaccaaauugcucuacauuugagcuuucccaugugaaaaaugaggguaauugagccagaguuaugggauauggagggauagccuuagguccauuaaguauuuaaugcagcgcacagcucccaggaaagggcagcuauucacagugaccauagcaguuuaggugcucgcugguccagcagaggaggcuggccucuccucaagcugggccggagcugggccccguucuucaguagguaauucaauuaggucaugggagggagacaaagaaggucacuugaggcuggagggcacucagcugaacccucacucccagaagauuggcagccagggcucacagcagccagggcuuaccuggccuggccccauggaccaucugcugcagaguuccagggaaggguuccguggggugaagcgggccaaugacccaguucauucaugggaccguuaugugagcucucaggcagaucacuuccccugucuaguccucccucaaucuccuggucucugaaaccagguuuguugguacucagaguuccugcccugggccacuguucauugaacccaugaucugacaugugauccccaaguuccugucuuuccggugugaguuaacuuuaguucuuccuuuaaaacagaaugaaaacaacacaaggccuuauucuuuuuuuuuuuuuuuuuuuuuuuuuuuuuuuugagacgaaguuuugcucuugcugcccaggcuggagugcaauggcgugaucuuggcucaccgcaaccuccaccucccagguucaagugauucucuugccucagccuccugaguagcugggauuauaggcaugugccaccacgcucggcuaauuuuuuauuuuuaguagagaugggguuucuccauguuggugaggccggucucaaacucuugaccucaggugauccgccucccaaagugcugggccucccagcacucggccucccaaagugccgagauuucaggcaugagcuaccacgccuggccaaguccuuauucuuagagcugagagaaagagaacugcacgcagugguggggagcuggcuuccccaguaaacacagagucagccagggcuuucccugggggccuugagaagaacagcaagcgagggaggguguggucugugggccauaugcagagcgguaagcggcccuacagcggcccugcauguggggaaggggcgauuggaacagaggugagcaggagcaggccuaccuuugcaugggcacugugccccugaggguggggauaugaacugcucuugaggucgagggucuuuuuugagaacuugugcagaccaaaauuccuuuugugaaaccagucaccucuuccuauuguaucuauuuagucacuauuuagucaccuaggagaacaaaacaacuaaaacagcaccucagcgugaauucacagaaaccuauuaauauagauggaacugacgcuguuuuuuuuuuuuuucuuuuuuuuugggagaccuggucuuacucuguuaccacccaggcuggagugcaguggugcaaucucacccuugaccucccaaguucaagcaguccucccaccucggccucccugguagcugggaauacaggcauuuuuuuuuuuacagcuaauuuuuuuagaaaaccuuuuuuuuuuuuuuuuuuuuaagagaugggggucuugcuauguugcccaggcuggucuugaacgccugggcucaagcaauccuccugccucagccucccaaauugcugugagccacuguucucagccugaggcugguauuaaugugggaaacaauacccuuagaagucagacuuaguagucaaggugagagaaggggugagcugugaagugcaguguggaggagagaggggagcuccagcagugguuuuguugaguguccuuaagguagacuuuucucaccugucccauguggccccacaggaugagcggacugucauggaaagcuguuaggcaggggcuggaaugucuguugggaaugcuggauggggcaucggccucugggcuuguucugcucugaccauaggcaaaugccccuguauagagcuugacccaugcaccugggccaggcugagcuuuucuuggcccacauuugcucugaaugccuuuggauugaaucacacccagaagugugccuggggguagcuagaaggacccaggcaagcacuguccuggucuugaauccuggggagucacucaugccugcucugugccuacugagggccaagcccuccucguuguugggcugcaacucugaacaaaacagguaacaucucuggccucagaagggcuuagcuggggagacacaauagagagacagccccuguggucugggaucagugccgcgaagaaaaucaacagaggaggucacacauggaggauggggagcaguuccacucagggugguaaaaggaggccuugaacgcagugagggaggagccaggaauggauauggaggaagagcauugccggcugagggaacaguguccaggcucugaggcaggggugauuuugaugacuucaagaaacaagaaugucaggguggcccagggaguggcguuggagcagggaggugggaaggagaugccgugggagaugugugugaagccuggcugcagaggcccuugggggccaugggagagaccgugcauuuucuucuaggucugcgugggaagucacugcagaguuucgaggaggggaguucccagcucuguauuuuugaagggucagucuuguugcuuggaccagugaggagccccgugggauccagacucgaguggguggagccggggcaggugggagcagagacacuggaggaaagcuggucgaaugcacuguguauuuggaggcagaaccagcagaggguccucuggguugaguguagggcaaaagagaaagaaggcaccaagccuggggucuggguuuucucucuuacacuugcuggguggacgguggugccacugaaugagacggagaagaguuggggggagcucgguugggguugggggaccaaggcugcguaguggggcacaguaagaguaaaauaucguuagcugucuuaggaggacaaguaaaguagacauuaggguauuugaccgggggcauggccaggacuggacaucugagugugucacucagcaauguuuagaugguauuuaagccuugugaauuaugagaucaucgagagggcucagggcagggugaaggagcuaggacugugagugaggcccaccagcaucuagaggggucugaaggaggaggaggaggaagagcagggaggaaggcagucaggggcauaugcuugggguccccgaagcagggugugucaguggaaugguuggaggaggagagaaugaccagcugugaccaaugaggucagauaccaugaggaaaagucuuggccuccagcuuuggcaagagggaggcaggucccugggggccuugaauaagauggguggggauggagccugcaggauucggcagguggugaccagucaccuucagguugcucagcaugccaguguaagacaccuggggagggaaaggaagcggucaugcauucuaucaggaaaacccuucccagcuagucaguucagggggaggacugagaagcgggaaaaggguguggugugauaugguagaaagggcucuacccccuuggcuuggugcuguauccaguacuugagacgguaucuggcacucgggauguacuccgugaauauuuguugaaugaaugagugaggagugaaugaaugaacugagacuugugauucagcccuucuccccacugccugacauuuuggucuuggcccucccugggccccagugcucugcuuuuguaaaauggagggauugguucuugguggggguucuuuacuuaguguucacagaccauugugggagccagcagugggaagcugugaccccucuaaaauuucaugcaaaauacugggcaugugugcauuuucugaaagugaucugugauccagaagagguuggaucacagaucacuuucagguuggaugagacuuccuggggcuuuccuugagcccuuucuuuccauucuagccccuggggcuaguuacugaguaaaauagguagaaguggcucaaggcuugagaucaccgguagucauagagaagcgugguccuguuauuuaucgugagauggugauaaauggcagugaaaugccagugugguguaaaguagucacagaaaaacaggaggcagcuuuauuaacagagcccacguuguguuuuguuguauauggaaaagcccucccugguucaggaaccugugugauguauuugggugggcgccuuucuguuguggugcacaugggguauggguuccugcaggugggaaguugggguuggggguggugcuccucuggggcgagcucauugcuuagagcaagccuauuuucauucucuagcuaaaagcccagccuuuccugagcauagaugcgcccccugcucauuguaguuaacaguagggaggaggcucagcccuggccagugaauggccugggccacuggauagcugcuuaucugugccuggagucuaucuccagggcuggagagcugggguguguggcagagaugcugggcuguuucccccuguccucacccugugguggugccugguccuaugcagucucauccuguguugggaaccucugaggggaccugggucagcccucccaaggggugaugucuucguauacaccagauagugcacugaaaugaguucaggguugcagaaaggggaagaagcagcacagccugaugucugugacccauagucucuccaggguggaguccgcucugagaucuuuuccucuuccuucccuggggcauagggucaucugagguugaaggaguuuguccagauauucaggaagguagguucagguuaucugucaucugcggggccugaggggccaugugggaugugagcuaggagcaugcccuaccuggcaguguggacuuugcucugugaagcauguucacagugcugguuuccaaccuaacuuccuucucucuuuccucugccccgcuuaguuggcuggaguugucuuccuuggagucgggcugugggcauggagcgaaaagguagguguaacugucgcaggacacugagcuucaggcagccaaaaccagauucguuggacuucauuuucccuccuccaaucuguucccugacaacaagcauuucuugugcagugucaagguguauaauugucaaucuuuacagacacagcucuugcguacucugcccacaugauaguauuggcugcuggagguaugggcugggcugguuggguuuugagcccuguggauguggagagcucagcucuuguaugcagcugugcccagagcaggcuugggcaauccagcuuccugacccugucugugccucugggagcaagcgggcaggucccugaauacaggcaugcuuauuguggaagcccuuauccuccaggaugagaaagagcaggcagcagggagcggggcugggugacaugcccccagggugcccuguggggcaggggugggccuuuaagcaccucugggccuccuugcccagccucaggaggagaggggaggaguggagaccuggcuccuacugucgggaaggacauggugcaguugcggcuccaggaaggggaugagacuggauaugggcaggguggggcugugcugcugcuuguugcccuguggcaggggugcuggggaggcagugagggcugaaaaaggccagggagggaagaggggaggggagggaagcaguaagguggagcaggccuggccagaaagagccaggaauaaagcuuccucuagugucuugagccuaggccuucuuccuucaguggaaccucccuuugcuuccagcaggaggaggcaggagaaccuaggucuacaggcuuuccugccauggucuuagggacuggauaaggcccaccuucagguuugggcaccuuccaaguggccugugaaccccuaaagggcaagagcugggguacgaugucccuuugccccagugacccagaagcagguucaaucugugccucacagcaccaccguguggcuuccccugggacugcagccgccuaacuggguguggcccugaguguggagcuggcuacuacaauuccuuugaaucugucgaucuaaaauaagugaaaaggccagaaccuaguuuagagagaguuuauucaagcacacauguugaggacaggccuacccaggaagcacaaauuccaaagaauggaagucagccuuccuguucgaaauguaggagcuugggaucauuuauccagccaaagccagacagagacucuguugcccaggccggagcgcaguggcuggaucuuggcucacugcaaccuccgccucccugguucaagagauucuugugccucacccucccaaauagcugggauuacaggcaugugccaccaugccuggcuaauuuuuguauuuuuagguagagaugggguuuugccauguuggccaggcaggucuugagcuccuggccucaagugaucugcccuccucggccucccaaagugcugggauuacagacgugagccgccaugcccagacaccuauguaugucuugaugcuuagucacaauguucugauuaguugaggcggucuuuuucuuucaggaaagguauguuuaacauuccacacugaagauguaauugucccugggucuuagaugauaucugaucugaguuaguaaagaacaaugaaggaagcaguuaaacuauaacagagaucagugacuggaaggggggcuguggucucuccggucccuuaguucaaccauaaucuaagaaacagaauugcaaacaugcuacaugacucagucuccagggcuuagcuucccccuuggcguuuuacaaacccuauggaacugcucugcccauugugugacuguguuuauauuuaaauugaaauugaauauaaauuaaaauucaguccuucugucucauuagccacauuucaagugcuccacgauaccuguggccagacaguggggguauagucuaaaacaccuccauugguguagaaacuucuauggacagcauugcuuuggccugcccuugggcguguuuucuacuagaguguucauauugaggcuguuuucaucucagaagaguaguguucuucauuaauuaggugccaaauugggggacuaacaaggucagccaccugggugaccaguuugaccacaggccacagggccccguuucccuccaggccuggaauaggcaccccacaggcugcagaagaagccugguggcugccuaggaggaacuuguagcguagguggaggccaggaacacuuucugggaccugaggugggcagggaucgccuggucggaggggccccuaagggcauggauggggccggacucuggccuggcugucaacaagagggcugagccuggggaagcaagucccuguuuucaguaccaccugcaucccccagggcagcauccuugacuccccuucugggccagugcugcccugcuuucucugucucuuucagggugugcuguccgaccucaccaaagugacccggaugcauggaaucgacccuguggugcugguccugauggugggcguggugauguucacccugggguucgccggcugcgugggggcucugcgggagaauaucugcuugcucaacuuugugaguggccacagagacaagagugggauaggaugcaaugggguacaggcucugcugggcaggauuauauguuaccuggucagagcagguggcagcucuuaggagccuccccuaggccccugccugggagcaggaggcagccauuugcacucuacugucuagagaagcugguuccucccagcaggagaauuagguacccucugguuuuuagcccugggugggaggagccagcugccuauaggccagcucuacuccccgcuccuuugccuuuuaucuuccuucagaaauucuaaaagaauuguuugucugcuacuguccuuugcccuuccuggcuaagaucaaaagauguugcaaguaaccuuaaaucauuucccuccuccaaggaugugugagucuguuggauguacaagucagaaucccaaauuuccuggcagaacugcagauuacuaagaguuuaguuuuauauuuagauacaaauucauguuuagauuuauucaguuaaauaacaccugguggggaaaacacauuaucauauuuugcaguauauuguuuguugacuucauuagaucaagcuuucuuuuucuuggacauaauuuuaaaagcaaaacuaugggcuuuuuguccuaauuuuuucucuggaaaaaaaaaagaaaagcuauguuuagcaucuugcuuuuauaugaacagagauuacguuuuggcaggccuugugugcauauguguguuuccuuuuucuuuucuuuucuuuuuuuuuuuuuugauaccgagucucgcucuguugcccaggcuggagugcaguggcgugaucucggcuaacugcaagcuccgccucccggguucacaccauucuccugccucagccucccgaguagcugggacuacaggcgcccgcuaccaugccuggcuaauuuuuuuuuguauuuuuaguagagacgggguuucaccguguuagccaggauggucuccaucuccugaccuugugauccucucgccucggccucccaaagugcugggauuacaggcgugaaccaccgcgcccggccguguguaugcuuuuucuuacuuugaaagauuacuccaaauuggccgguuguggcaagcugcuuagugucuuauauggccagugauaaugucugugagagcgcagacugcaggcugggagucugcccugaugggauguggaccuguggcugcacuggccccuugcagaaugccaccacugcuuguggccuggggcagcugagcuucuggaggggucuuuaugcugacgaucauauacuuucaugcagaguugguacagauaacauuggcacuuccagaauuguaaagagcccugcagggaacucacauguccugcaugaacuaugugaccucaggcaagcuauguaccucgugacauagccauaguuuccucaucccuaaagugagguaacagauacguaggcacucgaugguuuuguguguguaguggggagucaucagauaaugucuugggcacagugucuguccuaaaggagccgacaccccaggaugccacccuggaggguccagguggaacugcugggguaggacagccauucauuccugugauaggggucuccuccuuguccagggaggagggcugcuucauagcaagugauugacacauuggcuuggagcuuucucacacuuuuucacgcauuugaguguuaucagcaaugcagugacauggguagggauaaauagccccuuuuuacagaugaagcgaaguugugcagagucacccagcuaacucuaagugugggguucuggggccccgaugugggacucucaggugcagagcccacgcucugcugaggauggugguucugggucaggugggguuaugugugugggggugcaggcuggugggguggugacuucugcucccguccccuuccccugcaguucuguggcaccaucgugcucaucuucuuccuggagcuggcuguggccgugcuggccuuccuguuccaggacugggugagggaccgguuccgggaguucuucgagagcaacaucaaguccuaccgggacgauaucgaucugcaaaaccucaucgacucccuucagaaagcuguaagcaccuccccagcgggcccccgauagagcaugcaccucccugugcugccuggagcugagucuagcaggggcaucaggccuucucuguggguugucugccugcagcuuggcagacagcagggaggccguggaacaagccacuccaccucuggucuguuccacuuugccggcuugugguugccuggugggccagcccuuucccauugggauugggcaggcaaguccagcuguacccgaggccacccaccccccacgugcccggcccuccucuuucggccccagaucuuuccaauccugcccaauagccauaccagcugcaauccuccuuaggcgcugcauaccguaaggcacagcuucuuccccccggcucaugacucaccaucugacgcuauuccuauccccuuccuccccgggaccuuuuccccuuccucccugggaccuuuuccccuuccuguuuaagaagccagggcugccuggaggaagcuuugucagaucuaguggaaugugaccucccuggaauaugugcccagggguuugucuaagcaguuccaggcuauggccuuuacuccaucugguccccaucccucuuaucucucucauguguggcugcaccuggacgcuuggaccauagcugucacagcccccuggggaggaacccacuccuuggccaugucagccugugcaaugcaaggcucuuguuugaucugugugcugacagaaagcccagcuuccuuaagaacuuuucauguggaacacuuugguuuugagaagaaaauaaaucagaaaccauuaaaaaucuaugauucacucucauuauuaaccaaaacuuguucaccuuuauuucauguauuaugggauccagcaaaacccauuuaugggaccaaagacccugccuguauuguuauuacuaauguguauuagucugugaaagucaccaaauccccgccauguuuugaugccucuccuuucuuuucuguucagugccaccguccuuuuuucauuuucacguagccuuggcuugccuggucucagcaugcuagguugcgguucaucccugcauugccuuaaaaacauaguuuucugcauugacuucuuuuucuuuuaaaaauaaaacuucuggccgggcgcggugacucacgccuguaaucccagcacuuugggaggcugaggcggguggaucacaaggucaggagaucgagaccauccuggcuaacauggugaaaccccaucucuacuaaaaauacaaaaaauuagugggguguggcggugggcaccuguagucccagcuacucgggaggcugaggcaggagaauggugugaacccgggaggcggaacuggcagugagccgagaucacgccacugcaguccagccuggucaacagagcaagacuccgucucaaaaaaaagauaaaauaaauaaauuaaaacaaaacaaaacaaaacuucccaggggagggauucaguaaauuacagagcuuccuuggagugaaauuucagguaaucacuaaagcaaguggaaccguggaggugugggggagacaauuuuaccugagaaguaagcaaaacaaaauaaccaaccagaaaucacuguugucauuuguugugauuauugccauaaccaugucagcuguaagggcaaaugcaaagaaguuuuuuaggggaaaagacacugucaacuucacaaugaugcuuucaguguuuggauuuuacacacuuuuuagucaaauaaggauuuucuuuguagccacaccagaugcgaggaaggggagggcagaggccccagguguggggcagagcuuugauuguguuaccuuucaccuucaucggaccucuuuuccucaggagcagacacuuagcagcuguuuuuuguaaaggggugaaaaggggaauucacuugcaaguuucucagggaggaagaacacugcacacuaggaaguguucucuuguggcaaguagaggaccacaccaaggugccgagggggccacaaaggagaggacgccacucuccugucugaggaggcuggaaggaggcgucuccuuugaggaggcugggaagaagagcaagcucccugcuaaggagggccagggcuggguauguugugccuggcaguggggccagagggcuccacugagccagccauguggguuggacagaggaggcaccguggcccggagauaccuucacugccauuuccuuuuuguuauuauuuucuuuaacacaucaaaagggcagguccucucucucucucucucucucucucucucucucucucucucucucucucucucucucucuccccuuuuuucuuucucuccuuuucucuuucucucucucuuuccuuucuuucuuucugauugggggugggggucuugcuguguugcccagacuuguuuccaacuccugggcucaaaccaucuucccaccucaaccucccgagucacugagguuacaggccugagcuacuacgccuagcuguuuucuucuuaaagggcugccuggguugccagcuuagcaucucugcacaugggagguagggggcgggccuugauuucucugcaugguagaugccggcagacuuagccuggcaucacuaugaaugaugcccuaugcugggcagccauggcccugucuuggagccccuaacaguucuggcuuuugugguugcagaaccagugcuguggcgcauauggcccugaagacugggaccucaacgucuacuucaauugcagcggugccagcuacagccgagagaagugcgggguccccuucuccugcugcgugccagauccugcggugaguuggcuugugcuggggcacagggagcccgcccuuccugaagcccagaagcuuuccugacuccuccagugcucuaggauacuucucugucauggaggucugaggagcaggugugcuuucuccacacccuccucaaggcugccucagcucugaaauccgauauguguacauucuaggaacacugcuugcaugacccacccuggccuugguguucugggugaggcaggagaaaaacaguauuauuucuaccuggagggcugucacuugcagcuggccaagagcuaugagugaaauaaggcccgcuuaucccucuucccuguccuuuuucuggagcagauuccuagaacucaacagugcacgggggcuguggguacacaucauuaacuggggaacaguaguggagaauuauuuucuuucuuuuucucuuucuuuuauuuuugagacagggucuugcugugucgcccaggcuggaguguaguggcaugaucuuggcucacuggaaccucugucuccuggguucaagcgauucuccugccucagccuccugaguagcugggauuacaggugcacgccaccacacccggcuaauuauuuucuguuuguuguuguuguuguuguuguuguuguuugguuuuauuuuagagacagugucucacucugucacucaggcuggagugcaguggugcgaucucagcucacuguacaaccauugcuuccccgggcucaagcaauucuccagccucaaccucccaaguagcugggaccacaggcuugagcaccacaccuggcuaauuuuuguauuuuuuguagagaugggguuucaccauguugccccggcuggucuuaaacuccugggcucaaagcgaucugcccaucuuagccucccaaagugcugggauuacaggugugggccgcugugccuguccuguccuuucuuuaccuauuggcauucccaauccaaggccaacguccuuggguuccagaagcuggguucuuggggugaacugugaaggagcucugaauuuugccugaacugagccugaguagaacugggccaguugccagcucucggugcaguuaugcaaagccugguccuggguuacaggcuuugagaaggcagagcaucaccacuauuauaugggcaaguucugcagcccaggagaggcucagauuugcugaagcugcacagcucuucugaggucuccacugcgacugugaaauguaccagucuuguaaguguugcuuuuagcacauauaguucuuaccuccaaguauaggucuuaccuccuagcaaacuguggcccccaggccaaaucuggcuugcuauuuuuccaugaccugugaguuaagaaugcauucagauguuuuuaaaugguuggaaauaaaucaaaagaagaauaauauuuugugguacgugaaaauuauaugaaauucaaauuucaguguccauaaaguuuucuugaaauacagccauuccuguuuguuuacagauugucagugccggcucucaugcaacaaaagcggaauugagucugugucugaaguacucacucucuagcccuucacagagaaaguuugccacccuguccuggucugaaggauuaguugguggcaugauugaaggacaugagcuguaauggaauuugcacaaauguuugcuaguguuugguugugacuuuacuagagccucuuagcaccagcuucuugagacgccagaagcaacuaauuuuucugcuuuucuugcagcaaaaaguugugaacacacaguguggauaugaugucaggauucaggugagaacucccauguauacaacuugaagaguucuuuagguuuuauucccugugguucaacauucugauuuagcacgagugcaaauugaagugggaaaacucagggcagugaagcucuugaugccaccuaagcugagcauaggcacagggucacauacacugcuuccugagcuggcggcaggacuccugggagcaguaauggugauucuaagccuugugagcugcagucccaacaucuaggaguugcugcauuuaaagaggugggauggaaguuuugagggacaaagacugcauuuuuaggaggcuccuuggcaucccagaagacgucucucguuaaggggacagcugcaggaguguaggugccuuguucuggccuccguguggaggcaguagugacaaagagggaggcaggccuggggcaggggcgaggcucuguccuccaggacuuccuuuaggcuguagggagugugcucuuagaugcaaagagaaggaagaccccaccccacuccaguccuuguucuaguggucuuuggugauaugaaugacugcuguucuaaaagggaggagucucgaggaaucuucagagaccccaccuguuagccguggauaugagggaugugucccuacagcuuggggaacuguccuccuuuagggaccugcauuucacagggagaaagugcuguaaacugaaugugugugucucuccaaaauucacauguuggaacuuaaacuccaaugugaugguauuuaagagguggggucuuggggaggggauugggucaugagggcagaguccuuaugagugggaugaguguccuuauguaagaggcccagagagcuuauuugucacuccacugugugaagacacagugagagggugccauccaugaaccagaaagugggcccucauccgacacugaauuugccaguguccugaucuugaacuucccggccuccaggacugugagaaauaaauuucuguuguuuauaagccaccuaaucuauaguauuuuauucuaguugccugaauggacuaagauaagaaccuauaucaacaucagcuucccuaauuaugauuuuuuuugccacuuauauuaauuugcuaaggcugcugucacaacauaccacagacagaaauuuaagccacagcaggcauuuauuuucucacaguuuggaggcuagaaguccaagaucaaggugcuggcgaggugaggugggugccuucagagggcugugauggaagggucuguuccaggccucucuccuggcugcagguggcuguccucucccuguguccucacgugggcuccccucugugcaugucuguguccugaucuccuccucuuagcaggaugcucuucauauuggauuagggggcacccugauggccucauuuuagcauaauuaccucuguaaagagccugucuacaaauacagucaccuucugaaguccuggggguuaggacuucaguguauggauuuugaggacacaauuuagcuccuaacaccucuaaaauuaggggcuaauacuccaucauguugccauggaggaggcugauaggugugagggggcuggggccgauugcccuguguggggugggcagggcuggggugugugcugggaugguuacugacaccccaccgggguuagcaguggagggagcugguuggcuggcgacuguugccugcuggcucugucuccuggagcugagcuuacuggugggaugcccgcuccgagaagcacccuucuucucuucuuaggagacucuggacccccuucuccagguuucucucccuuuagaggcacauuuuccuccaagccuucaagccccuucucuuucuccagauguggaugguggggaaggguaucuugagaaaguugggcuuuaaaucucuggagaccugaaaggaaacagccagggagccuuuggucagacagguggugcgauggcacagugcccagcgaggggcagaggcugagaggagcugacgagcaucuccuggagaguccuccuugccugccuccuggaucccucguucccacccugcuuugcccugcuccuuaccagagcucacuaggggaucagguggggacaucgugugugccaaaggcucagaccccugugguguuuuccugcagcugaagagcaagugggaugaguccaucuucacgaaaggcugcauccaggcgcuggaaagcuggcucccgcggaacauuuacauuguggcuggcgucuucaucgccaucucgcuguugcaggugugucccaggagccuauaggauuggcagguggccuuuuuucauuugagauugggcccuuaacauagagugcauggguccaguuuggguaugguauuaaggaagcuugcagaagaaaaaaagggauucaacuggauguccaaggcugagagaguguaugcguguaaguguauuggggaggagaaugguggcuuccauaaacgcuaccuauaggggggcccucugggcgggggcaggcugggaggggcuuguggcccugcacagguccugguggcagcccucuccagagggcccaaugggcugcagaagggucacugccuaucuggagguaggucaggagugugcucggggugggccaucaagugcugcagauggggaggugaaacccuuggucaccuggggccugaggguggccugaggcucacgugugugcacuugccccaggaccucuccuccugucucuggccccugggcuggaguugucagguaucuucccuguccaugagacauccucugaggccugcugccguuuguggcauccuuuccucucccaggcugugcuuguucauuugaaccagguugcacaugugggaggauguugguggcugagcaggcagugaggccuggggugacugggcugguuggugacugcuaggagaagaacuggcagagaaagucaagaauucagugaucagagaaaccaggagucuuuccagugcuguucagggcuuccaagaagccgcagcuucuggguccacugaugcauuucuuguguggaaaauaacaccauuuagaaaguguuugacucuguuuuugccuugaagagggugacugagguagacccagggccaccagccacccacacaugccuuccuccuucaaggaagacuaagaaauaggaggaagcaacuggaaaaggaaagaaaaaaguuauuugcaaaauaggcaagggaagaaucagacuucagaaggacugacuagucaaauuagaaccacacaagaauuuaaagggaaaaaaagccauuuccagaggucaccaaguucguguucaucuguucacguuagaagaacaucagucuccucucaugauuucccugcucaccaagguugggauggaucuucagacauuauuagcacagccaaaauuggggauggccuugguuuuauuauggaaucgacguuuacaggaaacauucaagauuuauuauuuugggaaugagaaccagucagcgugacccuguuauuuuugguuuaacccagggacaggcguguccugccccauggcuugugacauacuuaaucauguuggaggcaggacagagugucuguuuugcuuguggugccugugguuugccucuucuaggcuuugggaauguaacagacuagaccccaggaccccuuuuuugcgggagggguggcugugcugugccacucgcucugcggugcugucucuacgucuucagucgcagcuggggggugaggagaggcgugcagugggagcucccaaccccacccuccgcucccugcccucugccuuugggccccagcaauggccgcugacucugcugguguugguuucagauauuuggcaucuuccuggcaaggacgcugaucucagacaucgaggcagugaaggccggccaucacuucugaggagcagaguugagggagccgagcugagccacgcugggaggccagagccuuucucugccaucagcccuacguccagagggagaggagccgacacccccagagccagugccccaucuuaagcaucagcgugacgugaccucucuguuucugcuugcuggugcugaagaccaagggucccccuuguuaccugcccaaacuugugacugcaucccucuggagucuacccagagacagagaaugugucuuuaugugggaguggugacucugaaagacagagagggcuccuguggcugccaggagggcuugacucagacccccugcagcucaagcaugucugcaggacacccugguccccucuccacuggcauccagacaucugcuuugggucauccacaucugugggugggccguggguagagggacccacaggcguggacagggcaucucucuccaucaagcaaagcagcaugggggccugcccguaacgggaggcggacguggccccgcugggccucugagugccagcgcagucugcugggacaugcacauaucagggguuguuugcaggauccucagccauguucaagugaaguaagccugagccagugcguggacuggugccacgggagugccuuguccacugucccccuguguccaccagcuauucuccuggcgccggaacugccucuggucuugauagcauuaagcccugauggcgccgguggcgcggugggcaugguucuucacugagagccggcucuccuuuucuuaaaguguguaaauaguuuauuuauagggguaagaauguucucacaccauuucacuuccucuuccucuccuccagcauucuccucugagcagccuuagauaguguccauggcuggagccgacccuuugaguccccuugagugucuuaagaaccagcccacaacagccucucuuucuccuccacauacugcagccucccuccaugcaucccacauacaagcacucccccacuccccagcguggccucacugucuucuggucuuggugcuacugaaauugucacccagaauuugaauccugacccuccccacugcaagcccagggagccccagcccaagauggccagccugaaacuguuggccagggcuccucuuguggccauguacccagggcuggcuggccugccauuugccucuccccggagacagccguucuucugcaaccacaccccgugccuagccacaaccccaggcugcagcugcucagaagcuccaggcauuuuguuucuggugaccgccccuaaugggauaucggugaucacugguccacccuuccugucagggcuuuucuggggcugcucuuggaaaugaagucuuaaguacugaauaacuccccuggggauagcuggggcauuugucuagcugggcuacuuucuaacacuuugccauagcucagaccacuucucaucguucagggauggacugcaaccuuaauuuacuugccggaguguacauucuagugugguguauacugguggcuguugaugaugauuuuuuuuuuuuuacacaauucucuguagacuaggagaagaaugcuuguguuuuucggaagugugaugcuucucuuugacugccaaacucuuuuauggaauauaucuuuauauuaaugcuguuuuggucauuuuuguuuggggucacuauugagauauugcuaagcaucucagugguaaacgcggcugccagaggaaccaagggauaggguauguagaccuuacagaaggauggaugguaaaggcaguccaucaucagcacaaucugacuuacauuucauugaguaauuuuuuuuuuuuuuaagauucuguauggcagcacuuucaguugcccuugugugccggccacagccgcacaaguuggcuugugguuuaucccccgcuauaagugagagcuggagaaacuucaacuccauaggucuagaggaaacauuguuuuagguuauuucuguccaccccugugcgauacuauuuauugauccaagcagaagagcuuggggacacugagucgaaguggggacaugggauugaagccugggcacugcugcugcaugagcuguguguccugggugugccggccuuucugugaaggggguugguggcagugcccaccucacuagaugccucugacccagccuccccugggggaguggguggccacagacccucccugccagagcuccuggaaggcuccugcaggc

SEQ ID NO: 17520 - RNA, 24469 nt, Homo sapiens
ugauuucugaugcauaauuuuauuaaagccagagauggacauuuuuucuagagaaacagaucucugagguuagaauggaagauaaugaaacaagagauuucacuuuauaauuuaccuuugucaaacuaucccagagcaugucaauucuauuaugaaaguauuacuuugacaucauauaaccaauuauuaauagaaaacacacaugccaaaaaaccuuaaauuuuguaaucuucaagucaaucaucaacuuuucuugaauuuuugaagacccgaaaagaaaaauaauuucaaacaacagcacucaaacaucauaugcauuuguaaugaggcacagcaaucaauuuuuuuuuuuuuuuuuuuuuaguuagagucucagucacccaggcuggaauacaguggugugaucucagcucaccgcaaccuccaccucccagguucaagugauucuccugccucagccucccggguagcugggacuacaggugccugccaccacacccgggugauuuuuguauuuuuaguagagacgggguuucgccauguugcucaggcuggucucgaacucccgaccucaagugacuugcucaccuuggccucccaaagugcugggauuacaggugugagccacugcacccagccuggcagucaauuuuaagccuccuauuucccagguuuuagcuuaauaauccucauuaguuuuucagauuuuugucagucuuguuuuggggcuauuuugccuuagugggccuaaacagaauauuaaaauacauuaauaauccauacugagaguagaguauaaauggguuucucacuccuuagggacacgaguggaaacaauacaucccaugaacacaggugaaugucccugguuaucccugagcugggcaguuucacacaaucauuuuuucucugaggccaaagucugugguuugaucaucuuagcagcuuccagaacagaaaguagguuuacuuugucuccaaauucuuuuucucggugcucaagaagaaugcccuaaaaggaaacaagagauaaugucaguccucauccuaaaucguucguucaugagacaggcaucgaggaccagcugucugucaagccuuuugcuugaauagcaaaggacacagauccaaauauggccuggcuccugcccucaaggaguucagucuuugagggaagauagaccggagaaggccacauccaucuggccuguaccagcagcucuagaagcaggaagucagaagugauaaagcaugacaagggcaaucagggaaggccucacagaggcacggaggguaaccaggaugucuacaaguagagaugcagguaaaagaacauaccaggugaagagaaaaaaaugaagcuaacacagaaaggcccaaagguguggaaguggagcucagagguuagacuuuggaaggcacugaaugaccaucuaaaagagagacccucauuuuucuuuagucuucuaagaaacuggaagccacuuucuucucauacagugaaaaaaaaugcacuaagacacaagauaccccaaaguuaucuaaaguuggagguaguaaaaaaaagacaaaauaacauguuugagaucagcaucaaggaauccuuguuagaguucuuugauucauuacaucuggaaacucaucuuaaaaagaaaaucuguaaauacacugugucauuauuuauaaagacuuaaaaaaaaaaaaaaggcccaccacacugcagagauuaugggcaagcagaucagaaaauuauauuuacuugcucaguaaaccauaauacagacauuaaaaauacuaauaggcugcgugcuguggcucacaccuguacucccagcacuuuaggaggcugaggugggcggaucacuugaggucaggaguucaagaccagccuggccaacacggugaaacucggucucuacuaaaaauacaaaaauuagccagguacgguagcucaagccuuuagucccagcuauucaggaggcugaaacaggauaaucccuugaaccugggaggcugggaggcggagguugcagugagccgagaucgcgccacugcacuccagccugggcgacagagcaagacuccaucuaaacaaacaaacaaacaaaaacacgaacaaaaaacuaacaauauauagugacauaggaaaauguucacaauauacuguuaaaugaaaaaagaacaucuaguacaauuuucuagagcaaagcaaaacaaaaggaaaggccauucagcuuuguuccaguggauuuuccacgguggcugagcucauaggaugguuuuccccaccuucuauguucugcuguuuuuaaauuuucuguagugcaaacacacuuuuuauuuauuuauuuacagacagggucuugcucuguuucccaggcuguaguucaguggugcgaucauagcuuacugcagccuugaacuccugugcucaagaaauccuccugcuucagccucccaaguagccaggacuacaggugcaugucaccacgccggcuaaacuuuuuuauucuuuauagagaugggguuuugcuauguugcccagcugcuucuucuuuaagaaugcuuucaagauuauuauuaaaaagaaaauucaggcagggugcggcggcucacgccuguaaucccagcacuuugggagaccaauguggauagaucacuugaggucaggaguuugagaccagucuggccaacauggugacacccugccucuacuaaaaauacaaaaauuagcugggcauggcagcggguaccuguaaucccagcuacucgggaggcugaggcaggagaaucgcuugaacccggggggguggagguugcagugagcugagaucgugccauugcacuccagccugggcaacaagagugaaccucugucuccagaaaaaaaaaaaaaaaaaaaaaaaaaggaaauccccaccaccccaauuuuagacuacaaaaacucuacacccaacaagaacugaaguaaguccugaaguucagcuagccaguuaaccuuccgccuaggagaaugaaggccaggggcuccagggaauacgaacaaaagucaaacacaccuagcaacaucagaaacaugccaguagggcccaugagcaccagaugagucaucgccaggcaagaaaaggcuggcaggcaugccaagcccugcccuagaggccaugagaaggcagaggcggguaggggaaggaaccccacguugucagagugggaagaggaugggcaauccacuggggaaguggccugcccaagcauaaggacaucaggaaguggucgcugggaaacaccuccaaggagaggcuaggggcagggcagggcaggagaggcuaggggcagggaagggcaggagaggcuaggggcagggcagggcaggagaggcuaggggcagggcagggcagggcagggcaggagaggcuaggggcagggcagggcaggagaggcuaggggcggggcggggcagggcagggccgggccgggaagggucucuggaguuugacagauuugaguuccuaaguuucauuuccauuguaccacuuagcugugucuuuggcugaguuauuuuaaaucucuaggccaacugcuguauauguggaugggaauaaaaaugccuaacauccuagacugguugugaggaagacaugagaccauguacuugagcacguagaacaagacaggcacucauuggaaaccauuauuacuaagacacuuugacagauuuaccagaaaauuagcaaauagguuuauguuaaaucagacaccauuuuaugcuaaauucuaauauagucaagcgaaucaguuaccaagcuguaaaaggaagacauaagaaauaaagcucaggccaggcgugagcuuguaaucccagcacuuugggaggcugaggcgggcagaucaugaguagaaacccugucucuacugaaaauacaaaaaaauuagcugggugugguggugggugccuguagucucagcuacucaggaggcugaggcaggagaauggcgugaacccaggagguggagcuugcagugagccgagaucgcaccacugcacuccagccugggcaacacagugagauuccaucugaaaaaaaagaaauaaagcuuaaacuugaaggauuucuauucccuuuuauuccucccaaauugggaagaguauguaauuaucaacauuaauagugagauccaacaaugcagauaaaccccaucuuucuacagaaagaaaacacuuucuacacguuaaugucauguccaaaauugacagagacaggccuagaagucaggccaccaguuuccagguccuucucccauacccuucccucauccacuugcuuuuuugagauggaaucuugcccuguccccuaggcuggaguucaguggcacaaucucagcucacugcagccucugccuccuggguucaagcaaaucuccugccucagccucccaaguagcugggacuaugggugcgcaccacuacacccggcuaauuuuuuaagcuuuucuuuaguagagaugggauuuugccauguuggccagucuggucuggucuggaacuccuggccucaagugauccgcccgccuuggccucccaaagugcuggcguuacaggugugagccaccgcgcccagcccccucauccacuuugcuccaucccugcuacacauccuccuggccucugcugacacugcccuccagggcaggggaaccaccauggcucaaggcugccuagacucugacacaaacaacugccuaccuggcucuugggccuauagagaccccauuccuccuuuccacaccuuccccuagggcuccaugcugcuuguggagccucacagccaggaccuauaauaauagccuguuugcagaggagucagauaccuuuccuaggccagcccugacaccaagauccccacagaaaaaagcaucgucuccccgcaaccuccuugccacuuccccuaauuacgccugguucuauuccuuauuuucuccucuuauuuuuuuuucuaucauccauccaugguggccuggaacacugcaagagaguaaauucaaaaacagaauaaaacuacgcuuuuguucaagcacagaaaacaaaacuuaaagucagcaaaccuggguucaggccccagcagugccacccaugagcugugcuccuugaacuuaaagucagcaaaccugaguucaggccuagcagagccaccgaugagcugugcuccuugugcagcugcucaucccuuuucaguucuaaguuccuugucugcaaaaugaucaaacugucucaugaugucacugugaugagugaguagauucaaguaugagguacuagcagagaaugaugugugauaaacaacaacugccuucccuucccuucuucauguucccuggcuugcuagaaggaaggcuaggagacccaaaacagggaaagucaacccccacuccagcuucugguuggagucucacacucacagacacagacaccuacagaccacaaguaaacaccaagaacucaccugcuuuccugaucccaccacgaaaacucccccaaggaugaagccuucuccuuccagguuuccagagaagccuccguuccaggcucggaagaaguuguaccacacucccagacggauaaaucccauaaacaucaucuuccgccuuuguggaccauagaacuuuuucuauggagugagaaagacagaucccauaugaguacucuacaugccugccuuccucaaggaggaaacgcuccugacggggcauugguucucaggcaaagacucaaaaggcugcugguuccagucuucucucccacccaacacacacacacugcccacauucagguccacucuuuuuuuuuuuuuuuuuuugagauggagucuugcucugucagucaggcuagaguacaacggcgcgaucucagcugacuacaaucuccaccuccuagguucaagcaauucucuggccucagccucccaaguagcuaggauuacaagugccugccaccaugccuggcuaauuuuugaauuuuuaguagagacagguuucaccacguuggccaagcuggucuugaacuccugaccacaaaugaucugcccaccucggccucccaaagugcugagauuacaggcaugagccaccaugcccagccaauccagguccacucucaacugccaagaaaacagaacccugcuggguccaguuucagaccucaagguaggccugaccuagggugacauccguagcuuucaauucugacucuaccuucucacuagucuuccaccugacaggaugguaacagugcuaccuucugcagaggugggagcagaagagaaagaaauaaaugaauuaagggacaggguguggggcuuuguacuaggcccccaacaguggaggaaccuguuggaguuucagcuauuuccuacucucccaguucacauggcaggaaagacuuaaguaauacagaugcuccucaacuuacaaugggauuaugucccuacaaacccaucauaaguugaaauaucuuauauugaaaugcauuuaauacaccuaaccucauagcuuagccuacacuaccuuaaacaugcucagaacacucuuauuaaccuacaguugaauaaaaucauguaacacaauccuauuuuaaaauaaaguguugaauaacuuauguagucuauugaauauugaaugugaaaaacagaauggcuguauggguucuugaagaaauguagaaacuaaaugcuuaucacuucugcaccaucacaaagcugaaagaucguuaagucaaaccaccagauggucagggacugucuguaacugagaggacagcuuuaaaaugucugaucaugcucugcucagggggcugaaaaaggccuugcaaguucaggacagcugaagggaaggccagccuccagcuccaggccagacauaccugggccaccugacuaucacacagcugagcacaauccccagcagucugugucuaaaagccucccaucacacacaccuuuucauccaggaagauuucuccuuugaaauaaggcuggaaauccuucacuucaguccugaugugcuccuuuaccacugcauagagggggacgcccagcugguccaacaugcuuuucagggaggacagauccgcagcuuccuguagaagacacaaggguucagggacaucugucccagcuggcugugggccuccacauagggugucagguucccucugcagcccaggcuccuugucuucuccaguggaaagcagaggcaaggcuccuguuauggcuguccuaaccacagcuugggagcagccauacccaaacacauccucuccuccugcccacaaugcuucucuccuacaucaucucccagccccuucccugcacuagaccaaacuaacacaagggcccagcagacacacgcuccucuagccauaaccuuccuucucucuucagcucaacccuacccucuggaaagguauccccguucuaaaaagaucucccuggcuaguccacccugaaguaaagcccugcuucucugugcauauccuaucuucccuguuuggugacauuuucuguacugagucugcauguuaccacuaaguugaguguugucucuuacauucccaaauguuucuaauaguuagaaacuaugucuuccauuucuuggaacccucagugccuagaacauggcuggguauaaaacaggugcuaaauaccagguggaaagauuugaagggggacaauggggagaaugcagcugagcugagaugcagauacccuugacucucaggaacugugugcuagaugaaugagggaaacugcaugagucaugguaaagcuucaacauuaagaacucaauccuuuuuucacauuuggugucagaauuaaagaaugagcaaaaauccuuuuaaaugcagucuacucaucuccaauacaaauaugcuguuguaugguugcaacuacauuuaauuuuucauuuauuuucuagaguaagaaaaaaaacaacuaaugaggcagaauugauuacaauacauuuaucaagaguuuuacugacuggcaaauuuugcccuagagcagaggacuacaguguuugauauaaucaaaaaccaccuuuuugugauaugaaaggucuuuuauuuuugagauggagucuugcucugucgcccacgcuacucgcccaugcuggaguguaguggcacaaucucagcucaaugcaaccuacaccuccuggguucaagugauucucacgccucagccuccuaaguaacugggauuacaggggcgcaccaccacaccuggcuaauuuuuuguauuuuuagcagagaugggccauguuggccaggcuggucuugaacuccugaccucaagugauccaccugccucggccucccaaagugcugggaguacaggugugagccacugcaccuggccuuuuuuuuuuuugagucuugcccuguugcccaacuacaguggcacaaucauagcucauuguagcccugaacuccugggcucaagcaaucuuccucccucggccuccugaaaagcugggacuacaagugcacaccaacaugccuggcuaauuuuuuuuuuuuuuuuuuuuuuuuuuuuuguagagacagggucucgcuauguugccuaggguggucucaaauuccugggcucaagugaucuucucaccucagccucccaaagugcugggauuauaggcaugagccacugcaccuggcugagaugaaaggucuuacucacuuuuccuggcucuuuacuccugguguggcacuauacaaagccaugacguggaaacugagucacauaccuccuaguugggccacucaaaauaacucagauugccauccacccaucuuuuuggaaacguaaguuuccacuaaauguucuaugugggcacagaccaguacagagggaaacagguuauaauuagggagagcuguugcucuuggaaccuucuggauuuuaauggccccgagaaaucaagucaaaacaggcuuccaugcuguugcugacuugccagccauugcugaccuaaaaauagaggaaggggccauaaaccaauauacauagguggccucuaacagcuggaaaaggcaaaagaaauggauucuccccuauagucuucagaaggaaugcaaccagauuccgcuuuggaauucugaccucuagaacuacaagauaaaucugugcugguuaaagccauugaguuugagguaauuuguuacagcaacagaaaauuaauacaucuccccgauccggguggcuuuguuacaaccucuguaacuguuuccuccucuguaaugagaauaauaaaaugagaguaaaacaagcuguauuuccaagggcuauggugaggacccacugagauagcaggcacacagugcccuggggguaggguacugcaggcaucacaugcauccagcagugcaaguggauucuucaccagcccagccacacaagcauggagagaucagcaaggcugaaagguggugucucagggucagggaggggaaccaggagaaugaggaugacaauuuggacagggccacagccacugcuugagaugcaaaguugucucaagagcaggaauacugucauucccaguuuucucccaggcagggcaguaauuucagaaucugggucuucugccacugacuggcugugugaccacaaacagaccacuaaccacucugguccucaguuugccuaccuauaaagggacaaggcuagauccaaguaguggcaauguuccuucucacacuagcauuuuguguuucaacaaucacaguuccuuccuuccacugauaagcuccaucaccuacaaauagaugaugucuucccuucgaggggccaaccuggagaccacccagucagugagcuccaacuuucaacaaacucucaugccaaaugcacuacuggcaugacugaaaucccacugagcuacagauucaaugcugagagcacacagcaaggaggcagagcuaacaugugagaauguggcucucagcuguccacgauggacucuaagagcuccccaaggaaagagagacaggcaggucugcucuaauagguaaccuugaaguguuuccuccgacacugcagcuucaucacagggagggacugaccacacccgaaucagaagcaauccaggcacaucauauaucugugcugagcaucagaagcauggaauuggaccuggucacugccccugauuaaauuggaauaugguccaggacucagaagguacagcacagggugaaaggccugggaguacuaagggaaacugagauguguugcuaaccccaguaggagagggugaguuguuuaaaaaaaaaaaaaaaagagcacaaaucaaagaaauaccuagagcaaauaacagaacagaacauguggguaaaaggcuaaagcuggcuuaccgacccuugguucuggccggaaaacaauggccccuacuugccaggaucccuuucucugaauagauccucaucugcacucaccucucgacagaggaaacagccuggccuccgcacggccauaaucacagcuccauuuuuuucccauagcuccuuugcuuugaaaguccuugguucuaagagaggaaaaaaagaaauucgauaucuccucccagcccagccccaaucacuaagcagcucaugaaccacacuaaguccagccaaggucagagacccggccuaguagaggaccuggacaggcauuucacacgugggaaaagacacacaggaaacacagacagacagaauacacaccuuccugaagaaaguuaaccaagcuuaagaauccuguuauauacccgguaggucccucccaccaugaaaaucuuuuuucuaaccugaacauucagaagugggacauuucuggaaaaauggccauuuugucuauugcugaugucaucagauauuguauaauaauccuucagaacagaaacauggcccaaacugaaaaagucucaaauuuuuaaccuaaauauguuaccugcaauauuauuaacgaaggagaggauagaagaugccuaggaauaaaaugcuuugggguaguacaguacuguaguucaacaagcccagcucuaagguccaacugaaucugaaucuagcuguguaacucugggcaaguuauuuuugcucuuugaaccucagcuuccucauuuguaaaaugcaaauaucuaguagcuccacuuugggccacagggcauauugaaagaugaauauaaaagugcucaccacaaugucugguaauauagaguuggugagggcucaauaaauaugagcccuuaauuauuuuaguauuucccagagggauccauguucccguagauguuauguggaaaaaaaaaaaauggggucaggugggugagaggguggggagaagagucuguaaucaaauaagauugggaaacccuggguugaacaaagcuuaacaggucucucucucuccuaguaucuuacuaaggugaccuacuauaaaccugcacaaucuccugccuuccuuucgcaagcuuccuuacuuacuaaacagaugacgaugacuuccaccuggggggcuaacauggugaccacgccaucaaugagaccuucaccacuccaacucucuugccacaccacuggcaugacugaaaucccaccaagcuacagcucuaacacugagagcacacagcaaggaggcagagcuaacacauuuggguguguggcucuaagcuguccacaauggauucuagcagucccccagaagagggagauaggcaggucugcucuaacgggugaccuugaagugauuccucagacaccacagcuucuucacagggaggggcuggccaugccugaaucagcagcaauccagacaccucauucuaauaagcauaugucugugcugagcaucaggagcauggaauuggauaaaaggugucucccauacuuguucacucaggaacuccuuuuaguuugacgaucccacaagccuggaauuccucagaauacacucuggaagcacugguuuaguaaaagauuguaauuauuacuaaauauuauggagcaauuuaucauuauaauuacagagacaacaacagagaaugagaaaugcuuuugauaagaaaagcuaaaauguaaaacagcaccuaagccaagcacaacuacguaauauguacacauggaaaggaauaugccaaaaucaaaauuacuguguuaggguaacagaauuauuccuaguuuaaaaauuguuauuaaauuuuuccuaauguuguuauauuaucuuuucaauuaaaaaaaggagagaguuuagaaagaaagcaguaagccuguaucccagcuccuuggaaaaguacugagaccugaagggucaccacuuacccuucuccaguguuuucaggucuauauccuccagguacuccagggccgcuuucuggggcuuggacagaaacacgucuguguuggcaagcagcaaugccaaggcagcagcccccagggcuccugcaccaauggaccacauccccauggugaagaaacuuggguccuggaggaaagacauuucuggagauugagaagaaggaagaaggcguuacugcucccacaggguagcuggaauuucaucuuccaggcaaggcucuggcaggacagccaaccaggaggucaggacaggggaagggagcagcagugucacaggcgagacuggacaagggcugcuaagcaccugcugccaccagaacuuggggaugcagcacacacauggagguuccugcaccguggagcucaccagggcaucaggagugaugacagagaaaggacagccuucucaaaugguucucuugcugcucucucuucucaugccccaaguugcagccccuagcucuguggagcugugccgagcuauguccccuguaggcagacuacuuccucauuccccuccucaucaaugccugauucucccucacaauccagguggcucaggaucaugucccuggguaggggcagcuuucucuucugugaucagaggauacuuagaacaccaaccgcacuguuuuguuccccuaucuucuuuccucuuuaguuugacgacccuccaaaaacagggaccauauccuacucaucaagcccccagccagugcccagcagggccucauucauuauaggcaggcaguaauuucucccaauugagaagagcuuuauuucucccuuauauaaaaacaaaauaugcuuauaguaaaaaacaaaacagagaauacaugaaaccauagucgauaagaaagcaaauacucucugaagcuaccaccuacugauggccacuguuaaacacugguguuuaguaaucugacuuuuuucuccugugaacagaacuacacagaugucugccaaacaaaugcagguguuauaucagaaagaggagguccuggcagggcgcgguggcucaugccuguaaucccagcacuuugggaggccgaggugggcggaucaccugaggucgggaguucgagaccagccugacuaacaugaagaaaccucaucucuacuaaaaauacaaaauuagccgggcgugguggugcgugccuguaaucccagcuucucgggggugcugaggcaggagaaucgcuugaaccugggaggcggagguugcggugagccgagaucgugccauugcacuucagccugggcaacaagagugaaacuccgucucaaaaaaaaaaaagaaaaaaaaaaaaagaaagaggaaguccuggcagggcacggugggucaugccuguaaucccagcacuuugggaggccgaggcaggugaaucacgaggucaagagauggagaccauccuggccaacacagugaaacccugucucuacuaaaaauacaaaaauuagcugggcaugguggcgcaugccuauaaucccagcuauuugggaggcugagggaggagaaucgccugaacccgggaggcggagguugcagugagcugagauugugccacugcauuccagucuggucauagagcaagacucagucucaaaaaaaaagaaagaaaagaaaagaaagaggagguccuauggcaucugcagaggaggcugggcaaaagacagcugcauaagauaaaggucucugcaacugaaauggagcuccaggcggguucugucagaauucagccuuguuccuggcuucuucugccagcuaggaagacuugugccugugggugggagcuccuggaagcagcccacaaaguacccccaccuccagccuuccuucucccaacaaccacuuacaauaucuaucuuuccauuugguccucacgccauccuaagcucuggcauacacuggugccuucuucccuaaguaccagccugcuucugugugcuuagaucaccgggaauaggccugggagugggugugguaauuguguggcccaccucaccccagcccaucgaaccucugacucaagucucccuugcaggacuuggccgggagaggaugucucuaaaggaucaggaaaggcccuggaaauccaaaugucacugccaagggugggggcugugaggggugcacugcaugaggugggggugggagugaguugguggugacuuugggaaggaaaggguaggccagacuagcauugaagccacauggaaauucagauuuaagaaacaaaagaggcagccauaaaaaaagaacgaaaucauguccuuugcagcaacauggagcuggagaccaucauccuaagugaacuaacccagaaacagaaaaucaaauaccacguguucucauuugcaagugggagcuaaucaauaguauacauggacaugaagacagaaauaacagacacuggggacagcugaagaggggaggguggggugaaaauuaccuaucagguauaagggucacuauuggauaacggguacacuaaaagcccagucuccaucacuacacaauauacccauguaacaaauaugcauauguaccccaugaaucuaaaauaauuaaaaaaaaaaaaaaggaauaagagagaaccuugguugagugcgguggcuccugccuguaauccuagcauuuugggaggcugaggcaagaggguugcuugagcccaggaguuugaaacaagccuggacaacaugggaggacccugucuauaaaaaauuagcugggcaugguggcacacgccuguggucucagcuauuugggaggcugaggugguaggaucacuauagcccagaacuccagccuaggugacagagcaagaccuugucuuuaaaaaaaaaaaaacaaaaaaaaaaagaugaagaagaagaaaagaaguuccagguaacggggguaaccaaacaaaaaacaacaucuaagaaagaggaauuuggcaucuauauacuugggaagcggaaaaagaaggggaaaaucagugccuguguguguuggggaagggggugcugcuaugguugucuugaaaugccuaaccuuguuuuuacucuaacucgcuacuuugaauuuuauccugcuugucucuuuaaucaccuagccuugcuucuccuguaaauaagacucuuucuagcugggaaagccagacaaacuccaauugaccccuuaauuuacaagacacuaagggcuccuuacccaacccccuuccgcaaggaguugaccuguguaagcagauccucagcguuucaaaggagcccaauuaacugauaagguacuagcaccaacaauguaugaaguucccaggauuuuucuuaaagagauaacaacauaaagccuugaguucggguccgacauacucccuauaucuaauuauaaugaaagauuuagagccuugcaccugguaccguugcucuuuuuguaaccauuugucuuuuaaauuguuuaucucucuguaaccauuuugcuucuuuugauucuugcauguuuuuacuucuguagaauuauugcaucugagucccccuccccuuccuaaaccagguauaaaaguuaaucaagcccuuuccucggggccgagagaauuuugagcguuagccgucucuuuggccacccgcuuaauaaaggacucuuaauucgucucaaaguguggcguucucacuaacucgcuuggguacaacagucugacaugagggaccugugcugagaaagaagaguuucuuacuacccacuauucaaaauguaaccaauaaauggcaccaucuagaaacgaagaaucucaacccccaccuuagaacuaaggaaucuuauacugccuuuuagucagacuggcaggcaauucauaagcacguuaaaguuugagaagcauuguguuagagcaaagaauucaggacuucgugcuugguuggccaucagccaccagaauaaaguaaagucacgagggcggucugggcuuggagagcugggccccccgccaagacccugagaacagaacauuacagacgugcacacaucucuaccccucugccuggaauauccuauuucauucugugcuucacaacucagaggccucuuuaagaaggcuucccugauguucugccagcccccuacuuccagccucccacuucuacccccaagagguguugauucacccccuccucaguucugugcccaaacaucacccacauuucuucugaugugcuugacacacugguuuggaccugucagauuucucuccuuuggugacauucugcaguuuaucucugaaucucucauaccuagcacagcgcaccucugguacaaagcaggcucaccacaagugcaugcugaaaugaauucaacagaauugaauuacagagacaauggcuuauggacaacuaaaguucuugggacaaacaggaaagaaccugccacaggccugcuuccaauucuuuaauuugacaaaguuacacauuacuggaugacaguucacagaacaauuaggaggaaaaccacagcucuuaucugcuugcuguaaacaagagauuucccagagccuggaacaacuucuguaccuuuaugcacuuccaaaauguuccuggauuucugacuuguguuaugacucaggagcacauagaauggucucugaucacagauuugaugggcauuucugcgucaguauacaaagaccaguuuacaucuaucccacaaauggacucugacuccuaggacacaucagugcauucacaaaguccagggccccucacagucagcuccacauucuuccaacacaccccugccacacucaaacagccuccaccuucccacuguccagugaugggcguuuggcauguuugcuccuaggcacaagagaauucaacucaacuagacucaacauuuauuuccaaacauuuauucaguacugaccuguucaauaaauggcgauuugggaggacauaaaaugauacacaauccucaagaaaauauggaccugguacacaaauaacaaaaaaauaucaagugggaaggugaggcagcuugggcaauguaugggcaugaggcuaugguggugcaggaauaacagccagucuggguagccacagaagcacccagaaggaaguggcuuuggagccgguguaggacacaggaggcagcauggacaggcuaggcugggauggggccagcuaagcugggagacagcaggcugacuggggcaggugucagugcugaaggaacccugagaacucaaaccucuauguuccaaagacccccaucuccauaccucaaguucaagggcuggguacaagauccagaccucaaaacccccauaagugcugucuucugaccucccacugugauccugaaagugugagcagagauucagcccucuggggcaguggaccccauccucaggcacugcagcaccaugcugagaguguuaucaggaccaguggugagcaucaggccucuccauggacagaccgcacccagugggccucuagcagcccacucuugugccagagagaagcacagaaaauucacuuccaggaauaccuggagagcacacaggccuagccucuuauccaaguccccugggcuacaaagcaacucccauccuggcaugucuugaagcacguacuacugugacuugcugcacagugagcagacccugaauucugaaaucacaauuuuuccuacacacaaaaaaggacaaucaaaggaauuuuaauuucuaaacagaaaugaugcauuuucacaugggucucuaagauugcagagguauggaggccagcaauccuucguaccucugcagccagucgucuuagaagcugucaguaauggccuaauuucauucacucaacagucuugugaugcaaagauuauccuguuuagcagcuaacacugagguucagaguucaguaacuucccugugucacagagccagcaggcagcaguacuacaaccuggacccaagucaacaggaauaggacuccaaagccugaaagacuaccuuuccucgccacacauucagaaguggguuuacaucugcuguaauuguugauuaacaaagaaaagaagaaagaagucgguccuggagauccaggaguaugauucccucugucuuaaagagaauguguuuuuaaucaccuuguuuuuucagucaucguguacagucaaaccauguuuacucuaaaggaaauuuaccauacaccagauguuccuucucuuuccucccccuuucuauccccccuuccauuaaggaaagggucaguuucucugaaacagaauaguaggguuguuuacagaagagccagcccccaccugacacagcuauagcauucaguuccccacugcugggcuuaucugauccacccucucccacagaaggugaaguaggauaaagccacaaacaaacaacagcuguggcagcucagaguggcagcucuggucugaacaugggugcaagaggacgagacccagucgggcucccuaggcuaagcugaaucaauuccuccccaggccccauuuuucucaacuccaugaggaaguuccuaaugauccccagugacauccuaugagucuaacaaaaacaggucacuuuggagucagaacauucuaggcuccucaacacugcccccaccgccccaaauucaguuuccagcuucgagacccugucucuuuccuauacaaggcaacucccuuccucaaacggucucuuacccccaaccucagacgcuucaaacuugggaacaaggcacucaccauacacagcguccacaccucugcuucucuugacaaagaaguauauccaggggugagcagacgggccugggcaggcggcaaggggagggcuggaggcgggacuaggucccuaggcucagucacuccauaggcaggaccaggccacccagaaacccuggggcuccuucagcugccaacagucagucuccagaaaacaucuaaauggaaagcugccaaggcccccuagcccuucaaaaaguugagcaaagcuuugagucauuugcagucaugcagauuauaacauuucccaagugccaccagacuccucugcuauccggugcagacuaaagaagcaaagcucguaacacagcccacaugucauacuagcgcaaauaaaagaagauguccuuuucucuguggcuccucgugcagccugcucccuugccccauuccucaccccaggccuggaaagucagcuggcaccucugaggccccucaucugcugucuauucuuuaccuccuuuugcuuucccuuccuuuucugccacaucgguggcuucccucaacccacacucccuuccugggugacuuccagcacuucucccaccacuuuguuauugacuuccaaguuccuauugcuguucugacccaaaguuuccacuuggggguuuuguaggugucuugguuguaccacauccaaaacuaaagucgauuucucugcuggaguuccauggcucaguagaugggggggcagggaggggggacagugggggacagggguucacauuuuacuguucauuugccuucacugccuacaucgacucaggaaguucuguccaucuucuaaaauguaucugcuacccauccucuucucgaccucacugcugcugcccaaacccaggauccuauaacucugucccuagccuauuucaagaaccacagaaugaaucuggcuugguucuagucugguccucuauaguuuauuuuccaagccguagucagagcgaucccagcacacccccaccugauuacaccuuucccuuguguucagacucucacuaacaauaaacuccucagcaagccagcugauggggcccuccacagcuuggcuucagcaaguguugcucauguuguuuccuuugcccgggaugccccccucugacccaggccaaccacguaaaugccuacuuauucauaaggcccagcacacauaacacuuccucuccaaagccuuuccugaaagcccugacaacugacugcucacugaccucuucuauagcgugcaugugugugcgcacacacccauaacccugcacaaugcacaaaugaauuguguaaauuuuaguuauuuacaugucugucuccacaauauguuggcacaauguguugucgucuucauuccugcauccccagcacucaacacagauccugguaauuaucaggcauuaaauguuaauuaaauuaucugaauuuuacucuuagaauuccacagugaggcagacuuggaacuuauaacuacucaauuccaauuucaguucaguaugaaaggcaauuuuggacagggcuggcuugauauuaaagaaaacacucuagcuugggacuuagguaaccuuaggcuggguccucgcucuacugcucacuagcagggcaaucugacuuaagguaugaagacacucggggccuggaucucaucaucuauacagaggaaggaacucaaaauucuaugagguugucuuagcucugacauccaaagacucuaaaguaccaugugacugcaacuacagggaucugaugucuagaaagccaugggaaccccugccaccacuguucuucugcugggugugcacauucacccugccuccuuugcugggccuaacuccugacuguuccaggagcugccucugggcaggaacugauaaagucuuaaugaaacaaaguaucagcacuggcugaguuaaaucaugucugaaacaaguagagacagcaucauauucuaaacaucaaggguacaccugcccagcccagccccacccagggaaucgucccucuucagaaugagcuggccugaggcagagauaggggagaagcaagaaaaggugcugagggagacaaaaaacuaagagugcacaugggccuccuugccucaggcccucagugaacaagucuugaaaggaugcuucaucuuccuucucuggucuccucuguuucccucuccuucccucaaagcgcugguucagcucauuuuacugagcaaaugaagaaacuaaagcucagagaaggagcuggcuaguccaaggucacaugggcagggcagguugucaguggcugcacugggacucagguuugggucucccaacuuccaguccaugacuguuuauccugcaucagacacgcuagguccugggcagccagccaagggccaguggccucuaaggcuggaauagcauggcagucugggcucaggaaguggggcccugcaggucuugaagccuguucacuggccucaggcaagcuaagagcaagacugcccguaaacagggccugggaaaucugcugccuggagagaacaucaucagccucucccaagcccaauccuugguaagcagcuuauaaucugaagccaaaugucuuaagggucucauugccuagucuccgcugagaagccauucugcaccucucuuccccacaauaacaagacucuguccauccuugucuagcauacugaugaugcaggcacacagagccuuaugagcaacagaugcccuuccacccacccuugucuucauauaccacaaaaucagucacuugcaaugagcucucaccuaccugccucagucuccaacucucagcccugcuccuugggguguguaucugccugguucuggcccaguccuacucucaaaugccagauucagaaaccucugaauagaugcugaaagcagcaccagcccccacauuccucacucuugggcguaucucaggguuucccaguagcugauuauguccucuuguuuccucaagcuguagggccccccaccccucaaagagcaagccauucuaaucucacuugcacagccuccugucugggcucagaacuccggcuucaucaaguuauauggguguggauaggaaggcaaggcaauaccacagaagacacugggcuaaaagccaauaauccuggguuuucucucuuugacucugagaguuauuuuaucccucugaaccucagugucuucuuaaaaacaagggcacuuuaaagaguugucauaaagauuauauaagaagagcaauuuuuaaugcgguaacgcacuagaaaacggcaaagcagcauuaucuuucucucuuuugcagggcucagauucacucgugccccuauaaagacaggauaucugaagcaggacaggcacaaaauagugaacuucugcagcugugucacugcaggccugcuuucuggugaacguucuaggucuggugggaacacuggcuugucucagccccucuggccugcaggcccgcuccaugcuauuccuguagcagcuaacacugccuccugcacuagcagugccagagaaggcaaaggacacugcccagcuguaauuucccugugccagaggccacugagcucaaaggugaggcuggcucucugcacagaaccucaggaugguucuugccacacaagccacagcagagagacuuggagcuucugcucaacauuucacaaagaagcaagaacccaacuggcaggacagcugcccuauugcuuagauagggacagagccuggggcuugagcccuagaguuccaguccuauccaaacuuucugagcaccauuuaaaugacacgagaugagaaaaucaucagaaaugucuuuuguaccccuucagaaguaaugcagaaggucucaacuaaaugacaugcucuuauaaaagacggggauauaggaaaggcccacaccaagaauaauaucuaacuuuaauucuugcaagcuguauaaaccuggacaaggaacuguuuugcaucaguaaaaugggaaugcuuccuuaauuaccuucuacagaguugcaagaaucaaaggauuaaauguauaggaggugccuugugagguaccuuacaaaaagugcaauaaauacgauguauaauucuucauuucuagagcaaugauuacccucaaaacguuauuuguacacaaaaugaagaguuuucugaugaaugaguaugguaacgagucggggucugcaguggaaaucccaauccucauucuccaaagcugggcccgagcaggagcauucaagacuauucaagcugacuuuuucacaaugcuuuucaaaacaaaucuugauuauuuucuuuuugaaaaaccaccugccagguucaaaggaaaauacauuaaaauaaaacaaacaaaaaagcugaguucuggguugcugggcugugcagacagcaugauguggcaaggaaaagaggcgcaggagcagcugggaaccccgguccggcaguggacucccgggugugccuccuucccacagcccuggaccggcugggccuugacuucccuuccuuugccucuaaccaucuccaccugcgccuucaccucccgcuccagcaacaacccugggggcagauuguucaucuuuucauuccuagaccucagcagggcuguuaaguuuacaacugggcucuacccaauuuaaagucaggcguuugugacucuugggaaagagggggaacaggugccuccgaaacgcugaacaacgcuagaaaccgugcccucuuaaaagacacgacccuaagcgggcacagagacgaggacgaggacugccagguccgcaccuggggcugguccagcagggcggcccccgggcccaugcuccagggcagggcccucuccucuguucuuugucccaacaauucgcgaagguuggcgccaccggcgucacucaaggcuugcgggcguggacagagggggcccuagcccgccgcagcagcgccggguccccgucuccguucuccgacgucugggcgcaggguuuuuccaucggccgccacgcaggguggcggaagggucgucguccucggagggagcgccagcgcugcggcggcuccuaagaaaguuggcgcgggcccgaggggcgcgccucaccagcccagcacccacccuaccggcccugcacugccucaguuuccccaccuacgccgcggcaggccccgccuacggacaucacgugccucgcggagccccggcgcgcagcaccuaccucaagugccucccuucugccggccuuuuaccgccccgacgcccgggcgcuaaggggccaaaccgcccggcccggagggucccaggggcgggccccgcgcuugcgcagccucuag

SEQ ID NO: 17521 - RNA, 24469 nt, Homo sapiens
cuagaggcugcgcaagcgcggggcccgccccugggacccuccgggccgggcgguuuggccccuuagcgcccgggcgucggggcgguaaaaggccggcagaagggaggcacuugagguaggugcugcgcgccggggcuccgcgaggcacgugauguccguaggcggggccugccgcggcguagguggggaaacugaggcagugcagggccgguagggugggugcugggcuggugaggcgcgccccucgggcccgcgccaacuuucuuaggagccgccgcagcgcuggcgcucccuccgaggacgacgacccuuccgccacccugcguggcggccgauggaaaaacccugcgcccagacgucggagaacggagacggggacccggcgcugcugcggcgggcuagggcccccucuguccacgcccgcaagccuugagugacgccgguggcgccaaccuucgcgaauuguugggacaaagaacagaggagagggcccugcccuggagcaugggcccgggggccgcccugcuggaccagccccaggugcggaccuggcaguccucguccucgucucugugcccgcuuagggucgugucuuuuaagagggcacgguuucuagcguuguucagcguuucggaggcaccuguucccccucuuucccaagagucacaaacgccugacuuuaaauuggguagagcccaguuguaaacuuaacagcccugcugaggucuaggaaugaaaagaugaacaaucugcccccaggguuguugcuggagcgggaggugaaggcgcagguggagaugguuagaggcaaaggaagggaagucaaggcccagccgguccagggcugugggaaggaggcacacccgggaguccacugccggaccgggguucccagcugcuccugcgccucuuuuccuugccacaucaugcugucugcacagcccagcaacccagaacucagcuuuuuuguuuguuuuauuuuaauguauuuuccuuugaaccuggcaggugguuuuucaaaaagaaaauaaucaagauuuguuuugaaaagcauugugaaaaagucagcuugaauagucuugaaugcuccugcucgggcccagcuuuggagaaugaggauugggauuuccacugcagaccccgacucguuaccauacucauucaucagaaaacucuucauuuuguguacaaauaacguuuugaggguaaucauugcucuagaaaugaagaauuauacaucguauuuauugcacuuuuuguaagguaccucacaaggcaccuccuauacauuuaauccuuugauucuugcaacucuguagaagguaauuaaggaagcauucccauuuuacugaugcaaaacaguuccuuguccagguuuauacagcuugcaagaauuaaaguuagauauuauucuuggugugggccuuuccuauauccccgucuuuuauaagagcaugucauuuaguugagaccuucugcauuacuucugaagggguacaaaagacauuucugaugauuuucucaucucgugucauuuaaauggugcucagaaaguuuggauaggacuggaacucuagggcucaagccccaggcucugucccuaucuaagcaauagggcagcuguccugccaguuggguucuugcuucuuugugaaauguugagcagaagcuccaagucucucugcuguggcuuguguggcaagaaccauccugagguucugugcagagagccagccucaccuuugagcucaguggccucuggcacagggaaauuacagcugggcaguguccuuugccuucucuggcacugcuagugcaggaggcaguguuagcugcuacaggaauagcauggagcgggccugcaggccagaggggcugagacaagccaguguucccaccagaccuagaacguucaccagaaagcaggccugcagugacacagcugcagaaguucacuauuuugugccuguccugcuucagauauccugucuuuauaggggcacgagugaaucugagcccugcaaaagagagaaagauaaugcugcuuugccguuuucuagugcguuaccgcauuaaaaauugcucuucuuauauaaucuuuaugacaacucuuuaaagugcccuuguuuuuaagaagacacugagguucagagggauaaaauaacucucagagucaaagagagaaaacccaggauuauuggcuuuuagcccagugucuucugugguauugccuugccuuccuauccacacccauauaacuugaugaagccggaguucugagcccagacaggaggcugugcaagugagauuagaauggcuugcucuuugagggguggggggcccuacagcuugaggaaacaagaggacauaaucagcuacugggaaacccugagauacgcccaagagugaggaaugugggggcuggugcugcuuucagcaucuauucagagguuucugaaucuggcauuugagaguaggacugggccagaaccaggcagauacacaccccaaggagcagggcugagaguuggagacugaggcagguaggugagagcucauugcaagugacugauuuugugguauaugaagacaaggguggguggaagggcaucuguugcucauaaggcucugugugccugcaucaucaguaugcuagacaaggauggacagagucuuguuauuguggggaagagaggugcagaauggcuucucagcggagacuaggcaaugagacccuuaagacauuuggcuucagauuauaagcugcuuaccaaggauugggcuugggagaggcugaugauguucucuccaggcagcagauuucccaggcccuguuuacgggcagucuugcucuuagcuugccugaggccagugaacaggcuucaagaccugcagggccccacuuccugagcccagacugccaugcuauuccagccuuagaggccacuggcccuuggcuggcugcccaggaccuagcgugucugaugcaggauaaacagucauggacuggaaguugggagacccaaaccugagucccagugcagccacugacaaccugcccugcccaugugaccuuggacuagccagcuccuucucugagcuuuaguuucuucauuugcucaguaaaaugagcugaaccagcgcuuugagggaaggagagggaaacagaggagaccagagaaggaagaugaagcauccuuucaagacuuguucacugagggccugaggcaaggaggcccaugugcacucuuaguuuuuugucucccucagcaccuuuucuugcuucuccccuaucucugccucaggccagcucauucugaagagggacgauucccuggguggggcugggcugggcagguguacccuugauguuuagaauaugaugcugucucuacuuguuucagacaugauuuaacucagccagugcugauacuuuguuucauuaagacuuuaucaguuccugcccagaggcagcuccuggaacagucaggaguuaggcccagcaaaggaggcagggugaaugugcacacccagcagaagaacagugguggcagggguucccauggcuuucuagacaucagaucccuguaguugcagucacaugguacuuuagagucuuuggaugucagagcuaagacaaccucauagaauuuugaguuccuuccucuguauagaugaugagauccaggccccgagugucuucauaccuuaagucagauugcccugcuagugagcaguagagcgaggacccagccuaagguuaccuaagucccaagcuagaguguuuucuuuaauaucaagccagcccuguccaaaauugccuuucauacugaacugaaauuggaauugaguaguuauaaguuccaagucugccucacuguggaauucuaagaguaaaauucagauaauuuaauuaacauuuaaugccugauaauuaccaggaucuguguugagugcuggggaugcaggaaugaagacgacaacacauugugccaacauauuguggagacagacauguaaauaacuaaaauuuacacaauucauuugugcauugugcaggguuaugggugugugcgcacacacaugcacgcuauagaagaggucagugagcagucaguugucagggcuuucaggaaaggcuuuggagaggaaguguuaugugugcugggccuuaugaauaaguaggcauuuacgugguuggccugggucagaggggggcaucccgggcaaaggaaacaacaugagcaacacuugcugaagccaagcuguggagggccccaucagcuggcuugcugaggaguuuauuguuagugagagucugaacacaagggaaagguguaaucaggugggggugugcugggaucgcucugacuacggcuuggaaaauaaacuauagaggaccagacuagaaccaagccagauucauucugugguucuugaaauaggcuagggacagaguuauaggauccuggguuugggcagcagcagugaggucgagaagaggauggguagcagauacauuuuagaagauggacagaacuuccugagucgauguaggcagugaaggcaaaugaacaguaaaaugugaaccccugucccccacuguccccccucccugcccccccaucuacugagccauggaacuccagcagagaaaucgacuuuaguuuuggaugugguacaaccaagacaccuacaaaacccccaaguggaaacuuugggucagaacagcaauaggaacuuggaagucaauaacaaaguggugggagaagugcuggaagucacccaggaagggaguguggguugagggaagccaccgauguggcagaaaaggaagggaaagcaaaaggagguaaagaauagacagcagaugaggggccucagaggugccagcugacuuuccaggccuggggugaggaauggggcaagggagcaggcugcacgaggagccacagagaaaaggacaucuucuuuuauuugcgcuaguaugacaugugggcuguguuacgagcuuugcuucuuuagucugcaccggauagcagaggagucugguggcacuugggaaauguuauaaucugcaugacugcaaaugacucaaagcuuugcucaacuuuuugaagggcuagggggccuuggcagcuuuccauuuagauguuuucuggagacugacuguuggcagcugaaggagccccaggguuucuggguggccugguccugccuauggagugacugagccuagggaccuagucccgccuccagcccuccccuugccgccugcccaggcccgucugcucaccccuggauauacuucuuugucaagagaagcagagguguggacgcuguguauggugagugccuuguucccaaguuugaagcgucugagguuggggguaagagaccguuugaggaagggaguugccuuguauaggaaagagacagggucucgaagcuggaaacugaauuuggggcggugggggcaguguugaggagccuagaauguucugacuccaaagugaccuguuuuuguuagacucauaggaugucacuggggaucauuaggaacuuccucauggaguugagaaaaauggggccuggggaggaauugauucagcuuagccuagggagcccgacugggucucguccucuugcacccauguucagaccagagcugccacucugagcugccacagcuguuguuuguuuguggcuuuauccuacuucaccuucugugggagaggguggaucagauaagcccagcaguggggaacugaaugcuauagcugugucaggugggggcuggcucuucuguaaacaacccuacuauucuguuucagagaaacugacccuuuccuuaauggaaggggggauagaaagggggaggaaagagaaggaacaucugguguaugguaaauuuccuuuagaguaaacaugguuugacuguacacgaugacugaaaaaacaaggugauuaaaaacacauucucuuuaagacagagggaaucauacuccuggaucuccaggaccgacuucuuucuucuuuucuuuguuaaucaacaauuacagcagauguaaacccacuucugaauguguggcgaggaaagguagucuuucaggcuuuggaguccuauuccuguugacuuggguccagguuguaguacugcugccugcuggcucugugacacagggaaguuacugaacucugaaccucaguguuagcugcuaaacaggauaaucuuugcaucacaagacuguugagugaaugaaauuaggccauuacugacagcuucuaagacgacuggcugcagagguacgaaggauugcuggccuccauaccucugcaaucuuagagacccaugugaaaaugcaucauuucuguuuagaaauuaaaauuccuuugauuguccuuuuuuguguguaggaaaaauugugauuucagaauucagggucugcucacugugcagcaagucacaguaguacgugcuucaagacaugccaggaugggaguugcuuuguagcccaggggacuuggauaagaggcuaggccugugugcucuccagguauuccuggaagugaauuuucugugcuucucucuggcacaagagugggcugcuagaggcccacugggugcggucuguccauggagaggccugaugcucaccacugguccugauaacacucucagcauggugcugcagugccugaggaugggguccacugccccagagggcugaaucucugcucacacuuucaggaucacagugggaggucagaagacagcacuuauggggguuuugaggucuggaucuuguacccagcccuugaacuugagguauggagaugggggucuuuggaacauagagguuugaguucucaggguuccuucagcacugacaccugccccagucagccugcugucucccagcuuagcuggccccaucccagccuagccuguccaugcugccuccuguguccuacaccggcuccaaagccacuuccuucugggugcuucuguggcuacccagacuggcuguuauuccugcaccaccauagccucaugcccauacauugcccaagcugccucaccuucccacuugauauuuuuuuguuauuuguguaccagguccauauuuucuugaggauuguguaucauuuuauguccucccaaaucgccauuuauugaacaggucaguacugaauaaauguuuggaaauaaauguugagucuaguugaguugaauucucuugugccuaggagcaaacaugccaaacgcccaucacuggacagugggaagguggaggcuguuugaguguggcagggguguguuggaagaauguggagcugacugugaggggcccuggacuuugugaaugcacugauguguccuaggagucagaguccauuugugggauagauguaaacuggucuuuguauacugacgcagaaaugcccaucaaaucugugaucagagaccauucuaugugcuccugagucauaacacaagucagaaauccaggaacauuuuggaagugcauaaagguacagaaguuguuccaggcucugggaaaucucuuguuuacagcaagcagauaagagcugugguuuuccuccuaauuguucugugaacugucauccaguaauguguaacuuugucaaauuaaagaauuggaagcaggccuguggcagguucuuuccuguuugucccaagaacuuuaguuguccauaagccauugucucuguaauucaauucuguugaauucauuucagcaugcacuuguggugagccugcuuuguaccagaggugcgcugugcuagguaugagagauucagagauaaacugcagaaugucaccaaaggagagaaaucugacagguccaaaccagugugucaagcacaucagaagaaaugugggugauguuugggcacagaacugaggagggggugaaucaacaccucuuggggguagaagugggaggcuggaaguagggggcuggcagaacaucagggaagccuucuuaaagaggccucugaguugugaagcacagaaugaaauaggauauuccaggcagagggguagagaugugugcacgucuguaauguucuguucucagggucuuggcggggggcccagcucuccaagcccagaccgcccucgugacuuuacuuuauucugguggcugauggccaaccaagcacgaaguccugaauucuuugcucuaacacaaugcuucucaaacuuuaacgugcuuaugaauugccugccagucugacuaaaaggcaguauaagauuccuuaguucuaagguggggguugagauucuucguuucuagauggugccauuuauugguuacauuuugaauaguggguaguaagaaacucuucuuucucagcacaggucccucaugucagacuguuguacccaagcgaguuagugagaacgccacacuuugagacgaauuaagaguccuuuauuaagcggguggccaaagagacggcuaacgcucaaaauucucucggccccgaggaaagggcuugauuaacuuuuauaccugguuuaggaaggggagggggacucagaugcaauaauucuacagaaguaaaaacaugcaagaaucaaaagaagcaaaaugguuacagagagauaaacaauuuaaaagacaaaugguuacaaaaagagcaacgguaccaggugcaaggcucuaaaucuuucauuauaauuagauauagggaguaugucggacccgaacucaaggcuuuauguuguuaucucuuuaagaaaaauccugggaacuucauacauuguuggugcuaguaccuuaucaguuaauugggcuccuuugaaacgcugaggaucugcuuacacaggucaacuccuugcggaaggggguuggguaaggagcccuuagugucuuguaaauuaaggggucaauuggaguuugucuggcuuucccagcuagaaagagucuuauuuacaggagaagcaaggcuaggugauuaaagagacaagcaggauaaaauucaaaguagcgaguuagaguaaaaacaagguuaggcauuucaagacaaccauagcagcacccccuuccccaacacacacaggcacugauuuuccccuucuuuuuccgcuucccaaguauauagaugccaaauuccucuuucuuagauguuguuuuuuguuugguuacccccguuaccuggaacuucuuuucuucuucuucaucuuuuuuuuuuuguuuuuuuuuuuuuaaagacaaggucuugcucugucaccuaggcuggaguucugggcuauagugauccuaccaccucagccucccaaauagcugagaccacaggcgugugccaccaugcccagcuaauuuuuuauagacaggguccucccauguuguccaggcuuguuucaaacuccugggcucaagcaacccucuugccucagccucccaaaaugcuaggauuacaggcaggagccaccgcacucaaccaagguucucucuuauuccuuuuuuuuuuuuuuaauuauuuuagauucaugggguacauaugcauauuuguuacauggguauauuguguagugauggagacugggcuuuuaguguacccguuauccaauagugacccuuauaccugauagguaauuuucaccccacccuccccucuucagcuguccccagugucuguuauuucugucuucauguccauguauacuauugauuagcucccacuugcaaaugagaacacgugguauuugauuuucuguuucuggguuaguucacuuaggaugauggucuccagcuccauguugcugcaaaggacaugauuucguucuuuuuuuauggcugccucuuuuguuucuuaaaucugaauuuccauguggcuucaaugcuagucuggccuacccuuuccuucccaaagucaccaccaacucacucccacccccaccucaugcagugcaccccucacagcccccacccuuggcagugacauuuggauuuccagggccuuuccugauccuuuagagacauccucucccggccaaguccugcaagggagacuugagucagagguucgaugggcuggggugaggugggccacacaauuaccacacccacucccaggccuauucccggugaucuaagcacacagaagcaggcugguacuuagggaagaaggcaccaguguaugccagagcuuaggauggcgugaggaccaaauggaaagauagauauuguaagugguuguugggagaaggaaggcuggagguggggguacuuugugggcugcuuccaggagcucccacccacaggcacaagucuuccuagcuggcagaagaagccaggaacaaggcugaauucugacagaacccgccuggagcuccauuucaguugcagagaccuuuaucuuaugcagcugucuuuugcccagccuccucugcagaugccauaggaccuccucuuucuuuucuuuucuuucuuuuuuuuugagacugagucuugcucuaugaccagacuggaaugcaguggcacaaucucagcucacugcaaccuccgccucccggguucaggcgauucuccucccucagccucccaaauagcugggauuauaggcaugcgccaccaugcccagcuaauuuuuguauuuuuaguagagacaggguuucacuguguuggccaggauggucuccaucucuugaccucgugauucaccugccucggccucccaaagugcugggauuacaggcaugacccaccgugcccugccaggacuuccucuuucuuuuuuuuuuuuucuuuuuuuuuuuugagacggaguuucacucuuguugcccaggcugaagugcaauggcacgaucucggcucaccgcaaccuccgccucccagguucaagcgauucuccugccucagcacccccgagaagcugggauuacaggcacgcaccaccacgcccggcuaauuuuguauuuuuaguagagaugagguuucuucauguuagucaggcuggucucgaacucccgaccucaggugauccgcccaccucggccucccaaagugcugggauuacaggcaugagccaccgcgcccugccaggaccuccucuuucugauauaacaccugcauuuguuuggcagacaucuguguaguucuguucacaggagaaaaaagucagauuacuaaacaccaguguuuaacaguggccaucaguaggugguagcuucagagaguauuugcuuucuuaucgacuaugguuucauguauucucuguuuuguuuuuuacuauaagcauauuuuguuuuuauauaagggagaaauaaagcucuucucaauugggagaaauuacugccugccuauaaugaaugaggcccugcugggcacuggcugggggcuugaugaguaggauauggucccuguuuuuggagggucgucaaacuaaagaggaaagaagauaggggaacaaaacagugcgguugguguucuaaguauccucugaucacagaagagaaagcugccccuacccagggacaugauccugagccaccuggauugugagggagaaucaggcauugaugaggaggggaaugaggaaguagucugccuacaggggacauagcucggcacagcuccacagagcuaggggcugcaacuuggggcaugagaagagagagcagcaagagaaccauuugagaaggcuguccuuucucugucaucacuccugaugcccuggugagcuccacggugcaggaaccuccaugugugugcugcauccccaaguucugguggcagcaggugcuuagcagcccuuguccagucucgccugugacacugcugcucccuuccccuguccugaccuccugguuggcuguccugccagagccuugccuggaagaugaaauuccagcuacccugugggagcaguaacgccuucuuccuucuucucaaucuccagaaaugucuuuccuccaggacccaaguuucuucaccauggggaugugguccauuggugcaggagcccugggggcugcugccuuggcauugcugcuugccaacacagacguguuucuguccaagccccagaaagcggcccuggaguaccuggaggauauagaccugaaaacacuggagaaggguaaguggugacccuucaggucucaguacuuuuccaaggagcugggauacaggcuuacugcuuucuuucuaaacucucuccuuuuuuuaauugaaaagauaauauaacaacauuaggaaaaauuuaauaacaauuuuuaaacuaggaauaauucuguuacccuaacacaguaauuuugauuuuggcauauuccuuuccauguguacauauuacguaguugugcuuggcuuaggugcuguuuuacauuuuagcuuuucuuaucaaaagcauuucucauucucuguuguugucucuguaauuauaaugauaaauugcuccauaauauuuaguaauaauuacaaucuuuuacuaaaccagugcuuccagaguguauucugaggaauuccaggcuugugggaucgucaaacuaaaaggaguuccugagugaacaaguaugggagacaccuuuuauccaauuccaugcuccugaugcucagcacagacauaugcuuauuagaaugaggugucuggauugcugcugauucaggcauggccagccccucccugugaagaagcuguggugucugaggaaucacuucaaggucacccguuagagcagaccugccuaucucccucuucugggggacugcuagaauccauuguggacagcuuagagccacacacccaaauguguuagcucugccuccuugcugugugcucucaguguuagagcuguagcuuggugggauuucagucaugccagugguguggcaagagaguuggaguggugaaggucucauugauggcguggucaccauguuagccccccagguggaagucaucgucaucuguuuaguaaguaaggaagcuugcgaaaggaaggcaggagauugugcagguuuauaguaggucaccuuaguaagauacuaggagagagagagaccuguuaagcuuuguucaacccaggguuucccaaucuuauuugauuacagacucuucuccccacccucucacccaccugaccccauuuuuuuuuuuuccacauaacaucuacgggaacauggaucccucugggaaauacuaaaauaauuaagggcucauauuuauugagcccucaccaacucuauauuaccagacauuguggugagcacuuuuauauucaucuuucaauaugcccuguggcccaaaguggagcuacuagauauuugcauuuuacaaaugaggaagcugagguucaaagagcaaaaauaacuugcccagaguuacacagcuagauucagauucaguuggaccuuagagcugggcuuguugaacuacaguacuguacuaccccaaagcauuuuauuccuaggcaucuucuauccucuccuucguuaauaauauugcagguaacauauuuagguuaaaaauuugagacuuuuucaguuugggccauguuucuguucugaaggauuauuauacaauaucugaugacaucagcaauagacaaaauggccauuuuuccagaaaugucccacuucugaauguucagguuagaaaaaagauuuucauggugggagggaccuaccggguauauaacaggauucuuaagcuugguuaacuuucuucaggaagguguguauucugucugucuguguuuccugugugucuuuucccacgugugaaaugccuguccagguccucuacuaggccgggucucugaccuuggcuggacuuagugugguucaugagcugcuuagugauuggggcugggcugggaggagauaucgaauuucuuuuuuuccucucuuagaaccaaggacuuucaaagcaaaggagcuaugggaaaaaaauggagcugugauuauggccgugcggaggccaggcuguuuccucugucgagaggugagugcagaugaggaucuauucagagaaagggauccuggcaaguaggggccauuguuuuccggccagaaccaagggucgguaagccagcuuuagccuuuuacccacauguucuguucuguuauuugcucuagguauuucuuugauuugugcucuuuuuuuuuuuuuuuuaaacaacucacccucuccuacugggguuagcaacacaucucaguuucccuuaguacucccaggccuuucacccugugcuguaccuucugaguccuggaccauauuccaauuuaaucaggggcagugaccagguccaauuccaugcuucugaugcucagcacagauauaugaugugccuggauugcuucugauucggguguggucagucccucccugugaugaagcugcagugucggaggaaacacuucaagguuaccuauuagagcagaccugccugucucucuuuccuuggggagcucuuagaguccaucguggacagcugagagccacauucucacauguuagcucugccuccuugcugugugcucucagcauugaaucuguagcucagugggauuucagucaugccaguagugcauuuggcaugagaguuuguugaaaguuggagcucacugacuggguggucuccagguuggccccucgaagggaagacaucaucuauuuguaggugauggagcuuaucaguggaaggaaggaacugugauuguugaaacacaaaaugcuagugugagaaggaacauugccacuacuuggaucuagccuugucccuuuauagguaggcaaacugaggaccagagugguuaguggucuguuuguggucacacagccagucaguggcagaagacccagauucugaaauuacugcccugccugggagaaaacugggaaugacaguauuccugcucuugagacaacuuugcaucucaagcaguggcuguggcccuguccaaauugucauccucauucuccugguuccccucccugacccugagacaccaccuuucagccuugcugaucucuccaugcuuguguggcugggcuggugaagaauccacuugcacugcuggaugcaugugaugccugcaguacccuacccccagggcacugugugccugcuaucucaguggguccucaccauagcccuuggaaauacagcuuguuuuacucucauuuuauuauucucauuacagaggaggaaacaguuacagagguuguaacaaagccacccggaucggggagauguauuaauuuucuguugcuguaacaaauuaccucaaacucaauggcuuuaaccagcacagauuuaucuuguaguucuagaggucagaauuccaaagcggaaucugguugcauuccuucugaagacuauaggggagaauccauuucuuuugccuuuuccagcuguuagaggccaccuauguauauugguuuauggccccuuccucuauuuuuaggucagcaauggcuggcaagucagcaacagcauggaagccuguuuugacuugauuucucggggccauuaaaauccagaagguuccaagagcaacagcucucccuaauuauaaccuguuucccucuguacuggucugugcccacauagaacauuuaguggaaacuuacguuuccaaaaagauggguggauggcaaucugaguuauuuugaguggcccaacuaggagguaugugacucaguuuccacgucauggcuuuguauagugccacaccaggaguaaagagccaggaaaagugaguaagaccuuucaucucagccaggugcaguggcucaugccuauaaucccagcacuuugggaggcugaggugagaagaucacuugagcccaggaauuugagaccacccuaggcaacauagcgagacccugucucuacaaaaaaaaaaaaaaaaaaaaaaaaaaaaauuagccaggcauguuggugugcacuuguagucccagcuuuucaggaggccgagggaggaagauugcuugagcccaggaguucagggcuacaaugagcuaugauugugccacuguaguugggcaacagggcaagacucaaaaaaaaaaaaggccaggugcaguggcucacaccuguacucccagcacuuugggaggccgaggcagguggaucacuugaggucaggaguucaagaccagccuggccaacauggcccaucucugcuaaaaauacaaaaaauuagccaggugugguggugcgccccuguaaucccaguuacuuaggaggcugaggcgugagaaucacuugaacccaggagguguagguugcauugagcugagauugugccacuacacuccagcaugggcgaguagcgugggcgacagagcaagacuccaucucaaaaauaaaagaccuuucauaucacaaaaaggugguuuuugauuauaucaaacacuguaguccucugcucuagggcaaaauuugccagucaguaaaacucuugauaaauguauuguaaucaauucugccucauuaguuguuuuuuuucuuacucuagaaaauaaaugaaaaauuaaauguaguugcaaccauacaacagcauauuuguauuggagaugaguagacugcauuuaaaaggauuuuugcucauucuuuaauucugacaccaaaugugaaaaaaggauugaguucuuaauguugaagcuuuaccaugacucaugcaguuucccucauucaucuagcacacaguuccugagagucaaggguaucugcaucucagcucagcugcauucuccccauugucccccuucaaaucuuuccaccugguauuuagcaccuguuuuauacccagccauguucuaggcacugaggguuccaagaaauggaagacauaguuucuaacuauuagaaacauuugggaauguaagagacaacacucaacuuagugguaacaugcagacucaguacagaaaaugucaccaaacagggaagauaggauaugcacagagaagcagggcuuuacuucaggguggacuagccagggagaucuuuuuagaacggggauaccuuuccagaggguaggguugagcugaagagagaaggaagguuauggcuagaggagcgugugucugcugggcccuuguguuaguuuggucuagugcagggaaggggcugggagaugauguaggagagaagcauugugggcaggaggagaggauguguuuggguauggcugcucccaagcugugguuaggacagccauaacaggagccuugccucugcuuuccacuggagaagacaaggagccugggcugcagagggaaccugacacccuauguggaggcccacagccagcugggacagaugucccugaacccuugugucuucuacaggaagcugcggaucuguccucccugaaaagcauguuggaccagcugggcgucccccucuaugcagugguaaaggagcacaucaggacugaagugaaggauuuccagccuuauuucaaaggagaaaucuuccuggaugaaaaggugugugugaugggaggcuuuuagacacagacugcuggggauugugcucagcugugugauagucagguggcccagguaugucuggccuggagcuggaggcuggccuucccuucagcuguccugaacuugcaaggccuuuuucagcccccugagcagagcaugaucagacauuuuaaagcuguccucucaguuacagacagucccugaccaucuggugguuugacuuaacgaucuuucagcuuugugauggugcagaagugauaagcauuuaguuucuacauuucuucaagaacccauacagccauucuguuuuucacauucaauauucaauagacuacauaaguuauucaacacuuuauuuuaaaauaggauuguguuacaugauuuuauucaacuguagguuaauaagaguguucugagcauguuuaagguaguguaggcuaagcuaugagguuagguguauuaaaugcauuucaauauaagauauuucaacuuaugauggguuuguagggacauaaucccauuguaaguugaggagcaucuguauuacuuaagucuuuccugccaugugaacugggagaguaggaaauagcugaaacuccaacagguuccuccacuguugggggccuaguacaaagccccacacccugucccuuaauucauuuauuucuuucucuucugcucccaccucugcagaagguagcacuguuaccauccugucagguggaagacuagugagaagguagagucagaauugaaagcuacggaugucacccuaggucaggccuaccuugaggucugaaacuggacccagcaggguucuguuuucuuggcaguugagaguggaccuggauuggcugggcaugguggcucaugccuguaaucucagcacuuugggaggccgaggugggcagaucauuuguggucaggaguucaagaccagcuuggccaacguggugaaaccugucucuacuaaaaauucaaaaauuagccaggcaugguggcaggcacuuguaauccuagcuacuugggaggcugaggccagagaauugcuugaaccuaggagguggagauuguagucagcugagaucgcgccguuguacucuagccugacugacagagcaagacuccaucucaaaaaaaaaaaaaaaaaaagaguggaccugaaugugggcaguguguguguguugggugggagagaagacuggaaccagcagccuuuugagucuuugccugagaaccaaugccccgucaggagcguuuccuccuugaggaaggcaggcauguagaguacucauaugggaucugucuuucucacuccauagaaaaaguucuaugguccacaaaggcggaagaugauguuuaugggauuuauccgucugggagugugguacaacuucuuccgagccuggaacggaggcuucucuggaaaccuggaaggagaaggcuucauccuugggggaguuuucguggugggaucaggaaagcaggugaguucuugguguuuacuuguggucuguaggugucugugucugugagugugagacuccaaccagaagcuggaguggggguugacuuucccuguuuugggucuccuagccuuccuucuagcaagccagggaacaugaagaagggaagggaaggcaguuguuguuuaucacacaucauucucugcuaguaccucauacuugaaucuacucacucaucacagugacaucaugagacaguuugaucauuuugcagacaaggaacuuagaacugaaaagggaugagcagcugcacaaggagcacagcucaucgguggcucugcuaggccugaacucagguuugcugacuuuaaguucaaggagcacagcucauggguggcacugcuggggccugaacccagguuugcugacuuuaaguuuuguuuucugugcuugaacaaaagcguaguuuuauucuguuuuugaauuuacucucuugcaguguuccaggccaccauggauggaugauagaaaaaaaaauaagaggagaaaauaaggaauagaaccaggcguaauuaggggaaguggcaaggagguugcggggagacgaugcuuuuuucuguggggaucuuggugucagggcuggccuaggaaagguaucugacuccucugcaaacaggcuauuauuauagguccuggcugugaggcuccacaagcagcauggagcccuaggggaagguguggaaaggaggaauggggucucuauaggcccaagagccagguaggcaguuguuugugucagagucuaggcagccuugagccauggugguuccccugcccuggagggcagugucagcagaggccaggaggauguguagcagggauggagcaaaguggaugagggggcugggcgcgguggcucacaccuguaacgccagcacuuugggaggccaaggcgggcggaucacuugaggccaggaguuccagaccagaccagacuggccaacauggcaaaaucccaucucuacuaaagaaaagcuuaaaaaauuagccggguguaguggugcgcacccauagucccagcuacuugggaggcugaggcaggagauuugcuugaacccaggaggcagaggcugcagugagcugagauugugccacugaacuccagccuaggggacagggcaagauuccaucucaaaaaagcaaguggaugagggaaggguaugggagaaggaccuggaaacugguggccugacuucuaggccugucucugucaauuuuggacaugacauuaacguguagaaaguguuuucuuucuguagaaagaugggguuuaucugcauuguuggaucucacuauuaauguugauaauuacauacucuucccaauuugggaggaauaaaagggaauagaaauccuucaaguuuaagcuuuauuucuuuuuuuucagauggaaucucacuguguugcccaggcuggagugcaguggugcgaucucggcucacugcaagcuccaccuccuggguucacgccauucuccugccucagccuccugaguagcugagacuacaggcacccaccaccacacccagcuaauuuuuuuguauuuucaguagagacaggguuucuacucaugaucugcccgccucagccucccaaagugcugggauuacaagcucacgccuggccugagcuuuauuucuuaugucuuccuuuuacagcuugguaacugauucgcuugacuauauuagaauuuagcauaaaauggugucugauuuaacauaaaccuauuugcuaauuuucugguaaaucugucaaagugucuuaguaauaaugguuuccaaugagugccugucuuguucuacgugcucaaguacauggucucaugucuuccucacaaccagucuaggauguuaggcauuuuuauucccauccacauauacagcaguuggccuagagauuuaaaauaacucagccaaagacacagcuaagugguacaauggaaaugaaacuuaggaacucaaaucugucaaacuccagagacccuucccggcccggcccugcccugccccgccccgccccuagccucuccugcccugcccugccccuagccucuccugcccugcccugcccugcccugccccuagccucuccugcccugcccugccccuagccucuccugcccuucccugccccuagccucuccugcccugcccugccccuagccucuccuuggagguguuucccagcgaccacuuccugauguccuuaugcuugggcaggccacuuccccaguggauugcccauccucuucccacucugacaacgugggguuccuuccccuacccgccucugccuucucauggccucuagggcagggcuuggcaugccugccagccuuuucuugccuggcgaugacucaucuggugcucaugggcccuacuggcauguuucugauguugcuagguguguuugacuuuuguucguauucccuggagccccuggccuucauucuccuaggcggaagguuaacuggcuagcugaacuucaggacuuacuucaguucuuguuggguguagaguuuuuguagucuaaaauuggggugguggggauuuccuuuuuuuuuuuuuuuuuuuuuuuuucuggagacagagguucacucuuguugcccaggcuggagugcaauggcacgaucucagcucacugcaaccuccacccccccggguucaagcgauucuccugccucagccucccgaguagcugggauuacagguacccgcugccaugcccagcuaauuuuuguauuuuuaguagaggcagggugucaccauguuggccagacuggucucaaacuccugaccucaagugaucuauccacauuggucucccaaagugcugggauuacaggcgugagccgccgcacccugccugaauuuucuuuuuaauaauaaucuugaaagcauucuuaaagaagaagcagcugggcaacauagcaaaaccccaucucuauaaagaauaaaaaaguuuagccggcguggugacaugcaccuguaguccuggcuacuugggaggcugaagcaggaggauuucuugagcacaggaguucaaggcugcaguaagcuaugaucgcaccacugaacuacagccugggaaacagagcaagacccugucuguaaauaaauaaauaaaaaguguguuugcacuacagaaaauuuaaaaacagcagaacauagaagguggggaaaaccauccuaugagcucagccaccguggaaaauccacuggaacaaagcugaauggccuuuccuuuuguuuugcuuugcucuagaaaauuguacuagauguucuuuuuucauuuaacaguauauugugaacauuuuccuaugucacuauauauuguuaguuuuuuguucguguuuuuguuuguuuguuuguuuagauggagucuugcucugucgcccaggcuggagugcaguggcgcgaucucggcucacugcaaccuccgccucccagccucccagguucaagggauuauccuguuucagccuccugaauagcugggacuaaaggcuugagcuaccguaccuggcuaauuuuuguauuuuuaguagagaccgaguuucaccguguuggccaggcuggucuugaacuccugaccucaagugauccgcccaccucagccuccuaaagugcugggaguacaggugugagccacagcacgcagccuauuaguauuuuuaaugucuguauuaugguuuacugagcaaguaaauauaauuuucugaucugcuugcccauaaucucugcaguguggugggccuuuuuuuuuuuuuuaagucuuuauaaauaaugacacaguguauuuacagauuuucuuuuuaagaugaguuuccagauguaaugaaucaaagaacucuaacaaggauuccuugaugcugaucucaaacauguuauuuugucuuuuuuuuacuaccuccaacuuuagauaacuuugggguaucuugugucuuagugcauuuuuuuucacuguaugagaagaaaguggcuuccaguuucuuagaagacuaaagaaaaaugagggucucucuuuuagauggucauucagugccuuccaaagucuaaccucugagcuccacuuccacaccuuugggccuuucuguguuagcuucauuuuuuucucuucaccugguauguucuuuuaccugcaucucuacuuguagacauccugguuacccuccgugccucugugaggccuucccugauugcccuugucaugcuuuaucacuucugacuuccugcuucuagagcugcugguacaggccagauggauguggccuucuccggucuaucuucccucaaagacugaacuccuugagggcaggagccaggccauauuuggaucuguguccuuugcuauucaagcaaaaggcuugacagacagcugguccucgaugccugucucaugaacgaacgauuuaggaugaggacugacauuaucucuuguuuccuuuuagggcauucuucuugagcaccgagaaaaagaauuuggagacaaaguaaaccuacuuucuguucuggaagcugcuaagaugaucaaaccacagacuuuggccucagagaaaaaaugauugugugaaacugcccagcucagggauaaccagggacauucaccuguguucaugggauguauuguuuccacucgugucccuaaggagugagaaacccauuuauacucuacucucaguauggauuauuaauguauuuuaauauucuguuuaggcccacuaaggcaaaauagccccaaaacaagacugacaaaaaucugaaaaacuaaugaggauuauuaagcuaaaaccugggaaauaggaggcuuaaaauugacugccaggcugggugcaguggcucacaccuguaaucccagcacuuugggaggccaaggugagcaagucacuugaggucgggaguucgagaccagccugagcaacauggcgaaaccccgucucuacuaaaaauacaaaaaucacccgggugugguggcaggcaccuguagucccagcuacccgggaggcugaggcaggagaaucacuugaaccugggagguggagguugcggugagcugagaucacaccacuguauuccagccugggugacugagacucuaacuaaaaaaaaaaaaaaaaaaaaauugauugcugugccucauuacaaaugcauaugauguuugagugcuguuguuugaaauuauuuuucuuuucgggucuucaaaaauucaagaaaaguugaugauugacuugaagauuacaaaauuuaagguuuuuuggcauguguguuuucuauuaauaauugguuauaugaugucaaaguaauacuuucauaauagaauugacaugcucugggauaguuugacaaagguaaauuauaaagugaaaucucuuguuucauuaucuuccauucuaaccucagagaucuguuucucuagaaaaaauguccaucucuggcuuuaauaaaauuaugcaucagaaauca

SEQ ID NO: 17522 - RNA, 1564 nt, Homo sapiens
cugacagccgccacuggugcugagcugcuaggaagccccugucggcgagcuuguuggagcuugaacccacugucaccccuccgacucaccggcaaaaaaaaaaaugguugaagcagaucgcccaggaaagcucuucauuggugggcuuaauacggaaacaaaugagaaagcucuugaaacaguauuuggcaaauauggacgaauaguggaaguacucuugauaaaagaccgugaaaccaacaaaucaagaggauuugcuuuugucaccuuugaaagcccagcagacgcuaaggaugcagccagagacaugaauggaaagucauuagauggaaaagccaucaagguggaacaagccaccaaaccaucauuugaaagagguagacauggaccgcccccaccuccaagaaguagagguccuccaagagguuuuggagcuggaagaggaggaaguggaggaaccaggggaccuccuucacgaggaggacacauggaugaugguggauauuccaugaauuuuaacaugaguucuuccaggggaccacucccaguaaaaagaggaccaccaccaagaaguggggguccuucuccuaagagaucugcaccuucaggacuaguucgcagcagcaguggaaugggaggaagagcuccucuaucacguggaagagauaguuauggagguccaccucgaagggaaccgcuccccucucguagagauguuuauuuguccccaagagaugauggguauucuacuaaagacagcuauucaagcagagauuacccaaguucucgugauacaagagauuaugcaccaccaccacgagauuauacuuaccgugauuauggucauuccaguucacgugaugacuauccaucaagaggcuauggcgauagagauggauauggucgugaucgugacuauucagaucauccaaguggagguuccuacagagauucauaugagaguuaugguaacucacguagugcuccacuuacacgagggcccccgccaucuuaugguggaagcagucgcuaugaugauuauagcagcucacgugauggauaugguggaagucgagacaguuacucaagcagccgaagugaucucuacucaaguugugacaggguuggcagacaagaaagagggcuucccccuucuguagaaaggggguacccuucuucacgugauuccuacagcaguucaagccgcggagcaccaagaggugcuggcccuggaggaagccgaucugauagagggggaggcagaagcagauacuagaaacaaacaaaacuuuggaccaaaaucccaguucaaagaaacaaaaaaaagaguggaaacuauucuaucauaacuacccaaggacuacuaaaaggaaaaauuguguuaccuuuuuuaaauucccuguuaagucccuuccguaauuuuuauguucuugugaggaaaaaaguaaaacauguuuaauuuuauuugacuuuaugacauugcuuuucaacaagcaaauguuaaauguguuaagccuuguaguacuaguguuguaacuuuccaaguaaaggugucccuaaagac

SEQ ID NO: 17523 - RNA, 1564 nt, Homo sapiens
gucuuuagggacaccuuuacuuggaaaguuacaacacuaguacuacaaggcuuaacacauuuaacauuugcuuguugaaaagcaaugucauaaagucaaauaaaauuaaacauguuuuacuuuuuuccucacaagaacauaaaaauuacggaagggacuuaacagggaauuuaaaaaagguaacacaauuuuuccuuuuaguaguccuuggguaguuaugauagaauaguuuccacucuuuuuuuuguuucuuugaacugggauuuugguccaaaguuuuguuuguuucuaguaucugcuucugccucccccucuaucagaucggcuuccuccagggccagcaccucuuggugcuccgcggcuugaacugcuguaggaaucacgugaagaaggguacccccuuucuacagaagggggaagcccucuuucuugucugccaacccugucacaacuugaguagagaucacuucggcugcuugaguaacugucucgacuuccaccauauccaucacgugagcugcuauaaucaucauagcgacugcuuccaccauaagauggcgggggcccucguguaaguggagcacuacgugaguuaccauaacucucauaugaaucucuguaggaaccuccacuuggaugaucugaauagucacgaucacgaccauauccaucucuaucgccauagccucuugauggauagucaucacgugaacuggaaugaccauaaucacgguaaguauaaucucguggugguggugcauaaucucuuguaucacgagaacuuggguaaucucugcuugaauagcugucuuuaguagaauacccaucaucucuuggggacaaauaaacaucucuacgagaggggagcgguucccuucgagguggaccuccauaacuaucucuuccacgugauagaggagcucuuccucccauuccacugcugcugcgaacuaguccugaaggugcagaucucuuaggagaaggacccccacuucuugguggugguccucuuuuuacugggagugguccccuggaagaacucauguuaaaauucauggaauauccaccaucauccauguguccuccucgugaaggagguccccugguuccuccacuuccuccucuuccagcuccaaaaccucuuggaggaccucuacuucuuggaggugggggcgguccaugucuaccucuuucaaaugaugguuugguggcuuguuccaccuugauggcuuuuccaucuaaugacuuuccauucaugucucuggcugcauccuuagcgucugcugggcuuucaaaggugacaaaagcaaauccucuugauuuguugguuucacggucuuuuaucaagaguacuuccacuauucguccauauuugccaaauacuguuucaagagcuuucucauuuguuuccguauuaagcccaccaaugaagagcuuuccugggcgaucugcuucaaccauuuuuuuuuuugccggugagucggaggggugacaguggguucaagcuccaacaagcucgccgacaggggcuuccuagcagcucagcaccaguggcggcugucag

SEQ ID NO: 17524 - RNA, 1429 nt, Homo sapiens
cgccaugucgcagaacggagcgcccgggaugcaggaggagagccugcagggcuccuggguagaauugcacuuuagcaauaaugggaaagggggcaguguuccagccucgguuucuauuuauaauggugacauggaaaaaauacugcuggacgcacagcaugagucuggacggaguagcuccaagaguucucacugugacagcccaccucgcucacagacaccacaagauaccaacagagcuucugaaacagauacccauagcauuggagagaaaaacagcucacagucugaggaagaugauauugagagaaggaaggaaguugaaagcaucuugaagaaaaacucagauuggauauggguuggucaagucggccggaaaauauuccccccaaggaguuccucuuuaaacacccgaagcgcacggccacccucagcaugaggaacacgagcgucaugaagaaagggggcauauucucugcagaauuucugaaaguuuucuuuccaucucugcugcucucucauuugcuggccaucggauuggggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuaaguaaaauaaaagaauagacacuaaaaucauguugaucuauaauucuaccuaugggaucaauaagcaugucagacugauuaaugucuacuguaaaaaauuugguaguaaauuuucauuugauauuagauauaaauaucugaauauaaauaauuuuaauauacuagucaugguguauuguauuuuaaaaauuaucugcaaccuuaauucaguugaaguacuuuauauuucaaaagaaugaauaacauugauaauaaaaucgcuacuuuaagggguuuguccaaaauaaauauuguggccuuauauaucacacuauuguagaaagcauuauuuaauuuaaauggaugcagguugucuacuaaagaaagauuauacauaacuaugcuaauuguucauaaucaacagaaaccaagauagagcuacaaacucagccguacaguucguacacuaaacucuuguugcuuuugcauuauaaggaauuaagucuccgauuauuaggugaucacccuggaugaucaguuuugugcugaaggcaccugcucaguaucuuuucgucuuuaucacucugcauuggugaauucaauccucuccuuugugcucaacuuuugugugcuuuuaaaaucagcuuuauucuaagcaaaucugugucuacuuuaaaaaacuggaaauggaaaaaaaaauaaaucuuugccaaauccuucaaaaa

SEQ ID NO: 17525 - RNA, 1429 nt, Homo sapiens
uuuuugaaggauuuggcaaagauuuauuuuuuuuuccauuuccaguuuuuuaaaguagacacagauuugcuuagaauaaagcugauuuuaaaagcacacaaaaguugagcacaaaggagaggauugaauucaccaaugcagagugauaaagacgaaaagauacugagcaggugccuucagcacaaaacugaucauccagggugaucaccuaauaaucggagacuuaauuccuuauaaugcaaaagcaacaagaguuuaguguacgaacuguacggcugaguuuguagcucuaucuugguuucuguugauuaugaacaauuagcauaguuauguauaaucuuucuuuaguagacaaccugcauccauuuaaauuaaauaaugcuuucuacaauagugugauauauaaggccacaauauuuauuuuggacaaaccccuuaaaguagcgauuuuauuaucaauguuauucauucuuuugaaauauaaaguacuucaacugaauuaagguugcagauaauuuuuaaaauacaauacaccaugacuaguauauuaaaauuauuuauauucagauauuuauaucuaauaucaaaugaaaauuuacuaccaaauuuuuuacaguagacauuaaucagucugacaugcuuauugaucccauagguagaauuauagaucaacaugauuuuagugucuauucuuuuauuuuacuuaauuaggaacgcagcauuuacagaacaaauaaacacaagugacguggccaccccaggaucuaacagcucuucagugagcuauguugcaagcucagaaguaauccacuaacgaaccaagucagacuccaguucuucaucaaaaggugcugguggagguugucagacgccuuccaauauagauccccaauccgauggccagcaaaugagagagcagcagagauggaaagaaaacuuucagaaauucugcagagaauaugcccccuuucuucaugacgcucguguuccucaugcugaggguggccgugcgcuucggguguuuaaagaggaacuccuuggggggaauauuuuccggccgacuugaccaacccauauccaaucugaguuuuucuucaagaugcuuucaacuuccuuccuucucucaauaucaucuuccucagacugugagcuguuuuucucuccaaugcuauggguaucuguuucagaagcucuguugguaucuuguggugucugugagcgaggugggcugucacagugagaacucuuggagcuacuccguccagacucaugcugugcguccagcaguauuuuuuccaugucaccauuauaaauagaaaccgaggcuggaacacugcccccuuucccauuauugcuaaagugcaauucuacccaggagcccugcaggcucuccuccugcaucccgggcgcuccguucugcgacauggcg

SEQ ID NO: 17526 - RNA, 55966 nt, Homo sapiens
aggacccccgacucccgcgcagggucugggguugugcgcgucggguugcgucuccaggccgggggcgucagggagccgggggcggggacgggcgcgggcgcagcggaccgggcggggccgagccgggaagcuggucggugcgucagccucacgcggcgggaaggaaccgguccgaggccccgggcugccggcgcgggcgccgcggcacguccacaggcugggucgcgagguggcgaucgcugagaggcaggagggccgaggcgggccugggaggcggcccggagguggggcgccgcuggggccggcccgcacgggcuucaucugagggcgcacggcccgcgaccgagcgugcggacuggccucccaagcguggggcgacaagcugccggagcugcaaugggccgcggcuggggauucuuguuuggccuccugggcgccguguggcugcucagcucgggccacggagaggagcagcccccggagacagcggcacagaggugcuucugccaggugagcgaugugcgcguuggugcugagggucccggcgcccuccgcggcgugcacugucccgcacgcccuggcgggugagcggcugggggugcguccuugcaucucuucccaccgggaaugagacuccggugcugcugcccgguggccgggacugagucuggcuuggcguggaccgggccuccacggcagccuggacgucgccgcgcccuccggugccucggaccaggagagggguugggugcacgcgguugaguggguuuaugcaucuuuguuggucuuaucugcccggggagagugugcacaguguauaaugcccugccaguauuugcuauuuucacagaaccuggaucuuucucacuucucucuugaccaggaacuuguguacccaguaccugugcugcgugcauuucgccagccuuucuggcuaagacguuugugggcugaucucagauuucgauguuaggcggaagaauggcugcuugcgguuuuucuguguguaagcccaacuaccugaugucuuugggacugcaguugcccucugguuucugguccugugugcucuuuuucucgaauguaaugagauucucuuaucgugacacccguuaagcugguacgaauugggaggaagguccuuauucuucagugcacaaguuuaauuacaagcggauuaugaucauuuccuucuguaagagaugugguuucuugagcaaaaaauugagagaaacuuacaguuuuccauuaucuucaguaucuaguauuucaaugugauuacucuugucaaagccacuuuuugguugacucuguugauaaaaauuacguuuuauacaaaauuaaggguuaggcauccauguuauuccuaaguggauuuugcuauuaauuuauuaucagaaauaccauuuuauguguuuaggggcaugauaccaugucaaaggaaagaugcauuuaaauauuaugaaagguuucucuuucacuacuuuacauucuuggauuuuguuguuuugcugagugauuugggaguugaggugaguguuaucuaggaaacuaagggaaguugaaagaaaauugcuacuuuacaacugagacauugaaaaguccuuuaccuucaaucauuacaaaggacacacaaucaaguacuuaaaaggaaaagggucauuuuucuucugauuagaaauauaacgcaacaccgagauuaaacauuuaaaaaauaagauagaaauaagugacuuuaaaauaaaauauucuuuacggaaagaagauguccaauguaacauuuucagcuacauucuggagauuuggauacuggaauaaaaguacauguugaacucuucaacuuuuacuuuuuuuuuccuuaauaaccuuuuuggaguucugcuuaaaauagaacuuuaaauucuuugcauuuauuuucuuuuucuucuaacuagugauuaaacuuuuccucuuucacaauacccucauauucaaauacuucccuaacauaaaauucuguuaaaccccuuucuuuuucuuuuagaacgagaguggcuaucuguguuucuuuucagacucaaccuugaaaaauaguaaauugggcugggugugguggcuccagccuguaaucccagcacuuugggaggcugaggugggaggaucucuugaguccaggaguucaagaccagcacgggcaacauagugaaacccccgucucuacaaaaaaaauuaaaaaaagaaaaaagcugggugugauggugugcgccuguggucucagcuacuugggacacugagguggcaggauggagugagcccaggaguucgagaccagcuuggagacccggucuguauuaguccggguucucuagagggauagaaccaauggaauauauauauaaagggaguuuauuaaguauuaauucacaugaucacaaggucccgcaauaggcugucugcaggcugaggagcaaggagagccagucugaguuccgaaacugaagaacuuggaguuugguauuugagggcaggaagcauccagcaugggagaaagauguaggcuggaaggcuaggccagucucucacguuuuucugccugcuuauauucuagccaugcuggcaggugauuagauugugccuacccagauuaagggugggucugccuuucccagcccacugcuucagugaucgaggcugcaguaagccaugauugcaucagugcacucuagccugugugacaaagugagagucugccucaaaauaauaauaauaauaaaaaaguaaauugaggaucauauaguuaaaaaaacaguuuuaacagaaauuuagaaauuuagaauggucuacuuauuucaugauuugagggagccuaagcaaaaaaaaaaaaaaaaaaaaaaaaguugucuauuuaagaacagagacuaucaauuccaauucuauaagugaaacaauagggccaguaguggaagggaugaggaucgggggagaagggaggagagguggcacugaugaauagacaugcagagaaaauuagaggcaagcauauagacagacauacacagagaaacagcaugagagggaaaagaaaaaaaauggagaaagaaaaggggagauaaauggugcaaaucauucauucaacaaguguaaccacucugcacguugaccagaguguuugggacacagaaauaacuauggcauuaucccugcccugaagagcuauaguuuagugaauaauguucauuggggauucgugggaggcacagauccuaagcacuuaaaaaacaaguuaggaaauauugcuagaaacuaaguuaaaaacuaaauuuccaccagauguuuggaaauacaaguuaaaaucuucucugguucuguuuacaauauccagugagcugcacagucccguugauuguuuugguaauaguuuuaucuuuucuuccuguugccugucccucuuaccacaucugccuuggguuaccacauccccauccaucaucacacugcugcauggugccuggcuuauaguaggguucaguucacagaauguccgcucugauuugagcuagagcagugaccuuagaaagucacugaauuaaaauguguagagcucuacaaguaaucagauuaaauucaucaagcauauguugaaaccuacugugaacaauuuuugggagaucaaaaaaugaauuaaaggugugacacuuccaagaagugagccuggugaauaauuggugcucaacaaguccuagggaaauuauaagaugcaagcacuaugccaacaggaguauauuuuaaaaauuauucugcuuagcaagccauuugcauguuuucuggaacugaucuuucagauugguugauagcuccaacugagucuuugaauuuggucaguugcuacauaugccuguuaguugauaucaaauccugcuaaaauuauuuucacuguauguuguaaguuccuuugauaauagugcuuaaguguuaguugcucaaaaugaaugauuaauugccuuagacuuguaaaucuguauauguaaccucauguaagaauuguauauacaaccuaggccaggcaugguggcucacgauguuuguaaacucuuacuugcucaugauguuuuaucaaucuuaauauggcuagugcuaguaacacucaggauagcuuauuugagcacaguaaaucucugucaggcuaaugaaaggggagaguagcucagaguccaaaauaaauacuccaaaaauggaucuuuuuuagcuuggagcgcauuuaguagauuuaaccugucaagugucuuguuaggucaguugaaacaaugguuuuaauuguuagccugguggcugggccgugggagagacacuugcuaauauguugagugguggauggaaauaagcccaggauuauaacuuagucagagggaucuuugaaacagguuacacuggagagguguccacugacucuaugugugugcugcauuccaggcuuuucugaauaaacuguguggaagaaauauuuuccugaugguugccagucauuugacaauuuaaaguuucggcaagacuaagucuuuaaagccaaaaugaccuguagcguucuagguccuuaggauggugccuacuaccugguguggaaucuuugguauuucccugcuuccauugacagacuugucccaguguacuucugucaacagaugaguacuuuuuauguuauuuuuuuauggugauaaaacacaguaaaauuaaauacaccugaaguucuuugccaaauaaagcacacuuugagcacauugauuuauuuauguauuucucuccaccuuuauugacacauaaaaauugcauauauuggcugggugugguggcuuacgccuguaauuccaacacuuugggaggcugaggcacguggaucaccugagguuggggguucgagaccagucugaccaacaugaagaaaccccaucucuacuaaaaauacaaaauuagcugggcgugguggcacaugccuguaaucccagcuacucaggaggcugaggcaggagaauugcuugaauccgggaggcagagguuguggugaggugagaucgcaccaucacacuccagccuggaugacaagagcaaaacugcgugucagaagaaaaaagaaaugcauauauuuaagguguaccacauaauguuuugauauauaaaagguccuuauccuuuuuuuuucuuuugagacagagucucacuuugucacucaggcuggagugcaguggcgugaucuuggcucacugcaaacucugccuccuggguucaagugauucuccugccucagccucccaaguagcugggacuacaggcacccgccaccuugcccuguuggccaggcugauuuugaacuccugaccucaggugaucugcccuccuuggccucccaaagugcugggauuauagacaugagccacugugcccggcccuugcccauuuuuuaauuggguuauuuguuuuuuuguuguugaguuguaugaguuccuuuuauauuuuggauaauaacaucuugucagacagauggucugcaaauauuuucucccauucuguagguugccuuuucauuuuguugcuuguuucuuuguuacauagaaacauuuuaguugcauguagucccacuuacuuauuuuugcuuuuauugcuggucuucuuggugucacauaaaaaaucauugccaagacuaaugucauggagcuuuucuccuauguuuuuuucuaggagucuugguguuucagggcuaacauuuaagucuuuaaucagcuuuuaguugacuuuuguguguguuguaagauaaagauccaauuucauuuuuuugcacauggauauccaguuuucccaccaccauuuauugacaagacugugcuuucccauuguuuggucuuggucaaagauuaguuggccagacauguguggguuuauuucugggcuuucuauuguuuuccauuggucuauguauguguuucuaugcugauacaacacuguugugaugacuguagcuuuguaauauaauuugaaauuacaaaguaggcugcuuccagguuuguucuugcaaaauugcuguagcuacuuggggucuuuugcuguuccauccaaauuuuacaauuuuuuuuucuauuuuugugaaaaaugccauuggaguuuugauagaaauugcauugaaucugcagaacacuuugggugguaugggcuuuuuaacaauauuaauucucucaauuuaugaacaugggauaucuuuccauuuauuuguguaaucuucaguuuuuuuaaucacugcuuuauaguuuucagcauacugaucguuccucuccuuguuaaauuuauuccuaaguaguuuauucuuuuucauucuauucuaaauagaauuguuuucuuaauuuuuuuuuggauaguucauuguuaguguauagaagcacaauugauuuuuguauguugauuuuguaucuuguaauuuugcugaauuuauucuaaugguuuucugguggagucuuuaggauuuucuauauauaagaucaugucaucugcaaaaagagacaauuuuacguauuuuuuauuuggauaccuuuuauuucuuucacuuuccuaauucacacuuugagcauguuuaaaagguauuucauaaaaaauguauaugagggccgggcgcaguggcucaugccuguaaucccagcacucugggaggcugaggcggguggaucaccugaggucaggaguuugagaccagccugaccaacauggugaaacccugugucugcuaaaauacaaaauuagccgggcaugguggcaggcaccuguaaucccagcuacuugggaggcugaggcaggagagucucuugcaccugggaggcagagguugcagugaccugagauugcaccauugcacuccagccugggcaauaagaauaaaacuccgucucaaaaaaaaaguauaugaggaauauauucuuauagugcuuugugugaaaaaauaaaaugguaauguauaauaagacuagaauauauugguauacaagaaaacuuuagaaaguguuguuuugucuuucauugcaaauuaaaggauaccucugacaugagaguagugaacaagcgguacgugguaauuuuccuuuauccugccuuuugcauuuggucaaaucaaacagagucaacagagaagguaauugaggcucccuccacagcuaacuguugguuaucuaguucuuuguuccauuggggcuacagaugucaaauuuuugggaaauuuuagcugcaaauucggcuguauuuuucuuauucauuaugaaaaugccaugugcugcuuugggaaguaauacaugcuucccuuucauuggaagcauuuaaguagaaguaggguaauaauaaugauuaacauguacugacaauuuacuuuguacuauuuaucuugguaucaacucuuugagaugagaacuauuacuauuuucuauuaagaugagaaaccaaggccuagagagguuaaauagcugggauaaagugaaaaacuaaugacuggcagagaugggauucaaaccuaaggaggucugauguuagaacauacacgcuaacuauuguuacacacuaccuguuccuugagggaugugaauggagggauuugcuguuuugcuugggagauuguaauagaaagccuuccaaggcuuucuaacucuuaaaagacuaggacuuuuuuuuuuucuuuucuauuuuuuugaggcaaggucuugcucugucauuuaggcuggaguacauuggcaugauuauggcucacugcagccucaaccucccuggcucaagcgauucucccaccuuagccuccuaaguggcugggacuacagaugugcacccaaugccuggcuaguuauuuuauuuuuuuguagagauagggccucacuguguugcccagguuggugucaaauuccuguucucaagcaacccuccugccuucaccucucaaagugcuggaauuacacgugugagccaccaugcuggaacagaaggcuggaauuuugaagugguccauguuacuugucaggccuaccuugguccuccuauuuacuguuccucaacuggggccuucuuaucucugcuuauuagauuggcccucuaccaaaagcuaucauuacuugaagccuagagcaguuagccucaaauguuaggauacuaaccuuuaaaacacauuagcauuuaaaaaaauuuagauuccugugguaggucagaguucuguuuuacuuugggauauagcguaguaauuuucccccuuacccgcauuguuccauguaguaguuauuuaggcagccuuagcacauccugaaacaacauccaguccucccuguuccagguugccaccugucuuuggucuuaguugagguaauaggauuuugcuuuguuucccggauccuguucugugucuauuaacuguauuuuaccuuagcccuuuccugaggcucuauucuuuuuuguuuuuugagacagggucucacucccauugcccaggcuggagugcaguggugcaaucucagcucaccacagcuucgacuucccaggcucaagccauccucccaccucagccuccuaagcagcggggacugcaggcguaugccaccaugccuggcuaauuuuuuuuuguaguuuuaguugagacaggguuuuaccauguugcucaggcugaucugggacucccaggcucaagagaccuaccaaccuuggccucccaaagugcugauuacaggcaugagccugagauucuauucuaguaacaugcuuuguucucugguuucuagaacugguccugccaccaucuuugccagacucucucccagggaucagguuggcaggcuuaucugaguugucagauggcauggauuuccgagaaucuucuugucuuuccuuuacugagcugucuucauccauugaaacuccugccacccuuauacucccuuagcagcccugcuaccugugguuguaguuaagaauaucuccuacuccauauuucaggaaggggcaggacauuuuuuuuuuuuugagauggagucucgcucugucacccaggcuggagugcaguggugugaucuuggcucacugcaaucucugccuccccgguucaagcgauucuccggccucagccuccugagcagcugggacuacagacaugugccaccaugcccagcuaauuuugaauuuuuaguggagacaggguuucaccauguuggcuaggauggucucaaucucuugaccuugugauccgccugccucggccacccaaagugcugggauuacaggcgugagccacugugcccggccaagaacauuuuaaaaucuaccaaucuaccauuuauccugccuucuuucccuuugaggucucuuggcuauaugccaccucugcucuggaggauuuuugcauuucuuucugguuuggggcuucuuagagcuuccuuuguaauuaggauagagauaggaagaaugauagacacaaaagguguuuaccuuugcugcuugcuuuacuugcuauguguguuucugccuccugugcuuguguacucuggggcacugagcacaccauaggugacauggugcuagauauguuuaaugagacaguauggugcuggucuccagugaugagugacaauggacaacauucauucauucacccaccucuuccacaaauaguaauaauuuauuugugacagaaucucacuuuguugccgaggcuggagugcagugcaguggugugaucuugguucccugcaaccucugcguuuuggguucaagcgauucuccugccucaggcgcccaaguagcugggacaacaggcaugggccaccaugcccggcuaauuuuuauguuucugguagggauggggcuucaccauguuggucaggcuggucuucaacuccugaccucaagugauccucccgccuuggccucccagggugcugggauuacaggccacaaauaauuauugagcaucuacugugugcuuucuggaaguauaugauuuuucacucaaggauuuuauacuuuagugggcagggguaaaauagauaaauucacugcugugagguacaguaauacuuagauaauaguguguggagugucuugggagcagcugggagaggcauuuaacccagcgggugguaaggaguacuggaaggacagcuuccugaaaaaggugauacugagcugaggcuugaagauauauuuuaaccuuaaaaaugaauuccucagggggaagaauggaugccuugaaacuugcucucaaguuuuucauguguuucuuuuuguaacuuaaugucucuacuuugcauaugucccuuuggccuuugcagucucuaugucugucauucuuugcauaauaauucauaucaaaggggagaaacagcuauuuuuugucccuagaaguucugcucuuaagguugaaaagaaaguuugaaaaaucauaucauuuagguuagaaguacuuuguguuguugguauccaaaauuaggacucugagauucuuguguauucagagaauuuuuaguaggaaacaaggacaaauuugcauaugaaaugaaaauaguuauuacaugacaaaauauguagaucugauuucuagaaacugaauuaguccaaaacaaguaagagugggaaaagcaguaaaaaguucuucuugaauauugcuguugucauccaaaguauucuuauuucuuuuaggugaaaaauuuccauuacucuuuugugauauucucaaaagaaaguuuaggauuuuacaguguucugaaauacugaaucuuaauucaguauuucaauagaguauuauugauuugcuuccuuaucaguagauuuuuaaauuauuuauuucuaggcuauagaucuuccuaaaauauaauccaaaguaguuuaaaaugcagauaucuagaccaaaguauaaagaucucuuuucuggagcaugcuauauuuaacaguuuuuuccuaaguuuguuuuuguuuuuggaaucaugauauauuuguuucuuaaagcaaucuuuaguucuauuagauguuuuucuagcucaaauaaacaucuaagaauuuuaguuuaauuuggcaaguaacacuggugaaaaaagaaaaaaaaagaauucuaguuucauaauugauaauauuuauuaucauuaccauuguauccuaggauaugugcauuuaguagcuugauuuaguacauaccauuaagacauuagcuuuaaacauuugaagagcaggauugacuuugaggucaguuugcuguuucauuguuacuaaugauaaaugguuucuaagcaccauuccaaaccuuuaagaaauuguuacagcccaauauuugaggauuguuagauccuuacugaaagcuaaggaugggaaugcagcugugccucaggaaggacaguggaagugggagcuggaaaccccucagauacccaaguagcauauacucuaucuccuaccucugcuucuuuguguaucuuuuuuugccccccaagaauuccgaggacaaucaagcuuuguguaucuuuuaaaaacuuuuccucucuuugccaacuggaucaugugcuccucaguucacaugauggaguauuuguuuuacuggucuagccacagggagacaucuuucccuguuauucucaauucuaggauccuggagaggggaccaugaccugguuugaguuggaugccuacccuuggucaggucaacuauggccuggagggcagaguuacaaaauaaagguugccagggggccaacucucucugugugugugugugugugugugugugugugugucaugagcucugcacaccuuccauuccucgguauauagcaagagcagcaguauuacuagauuauugucauaccccaucucaagaaacuaugugggaggagggaggauaaggacugguugaguagggggcuguuuccuaacaaccaugugaggaaaaagaacccuguugcauuuaggacauuucaauuuaauauuucauuuucuuuguaacagguuagugguuacuuggaugauuguaccugugauguugaaaccauugauagauuuaauaacuacaggcuuuucccaagacuacaaaaacuucuugaaagugacuacuuuagguauuacaagguauuuuuaauuuuaauuuuuuauauaugaauacuuuaaauggauaauuagauuuucuuaagaauuacugagcuucaaaauuguaguuguuauuuaaaauugauauaggcuuuauuaagaaaauucaguucauaagagugaagcaugugauucugaaaccauccauuggauaauuuuaauaacugaauuuuacacucuagaguuagaaucuaguugguuaaauugaaguuaggacagaaauuauuauauauuguuaucaaaauggugagaucauaauuuucuaaaacaucagauuggcuccaauuaauuaaaauaauuaaauauuuuuuguagaaucaugacuuuauccugaccuauauuauuuaaacaaaucacuugugcuguuuuaucuugagauaucuacuagaagaguuuagaaaaccugaucaauggaguauuuaguuguagucaguuuacaauugucuauccucuaccuguuaacucuuucuuguuugaaaagaaugugagucgagcuacuuuggcuccuaguugccaucuguucagggucuauuuaguggcagucugugucuuuuuuuuuuugagacagaaucuugcuuugucacccaggcuggagugcaguggcaugaucucugcucacugccaacuuccgccuccuggguucaggcaauucuccugccucagccucccaaguaacugggauuacaggcaccugccaccacaccuggcuaauuuuuguauuuuuaguggagaugggguuuugccgugcuggccaggcuggucuugaacuccugaccucagguaacccaccugccuuggccucccaaaguauugggauuacaggcgccagccaccuugcccagcccaaucugugucuuuuuuuucuuuuuugagacaaagucuugcucuugucaucuaggcuggagugugguggcaugaccuuggcucacugcgcccuucgacuccuggguucaagugauucuccugccucagccucccgaguagcuaggauuacaggcaccugccaccaggccucgcuaauuuuuguauuuuuaguagagacgggguuucgccacguuggccaggcuggucucaaacuccugaccucaggugauccgccccccucggccucccaaagugcugggauuacaggcauaagccacugugcccggcccagucugugucuuucuaaccaagucuaccaauuuacuuauaccagccucacauuuaugcaguuguuauaaacuggcaacagauagguggaagaaauacuguauuugcaccugauaacaugaccaaguuauagcaccauaauuuguaacugucaauuauaauuuugggauucugauuuuuauaauuuuuuuucuauuauuauuuuacagguaaaccugaagaggccguguccuuucuggaaugacaucagccaguguggaagaagggacugugcugucaaaccaugucaaucuguaagaaccauguauacauuuaaaaacuguuacauguuuuuucauucauuauaacuuuuuguuuuguuuuauuuaagaauuuuuuuuugaaaaaauagagaugagguuucacuauguugcccagguuggucuugaauuucugggcucaaacaauccaucugccuuagccucccagagugcugggauuacaggugugagccacugcacccagcccauuacaacuuuuuaaaggcagccaauaaaacuaaaauaaucgugcaguccuuaguuuaaauauaacauucaauauuuauauguuaaaaacccaaacuuauaaaaccuauuuugaauuacacugccuucauaauaauagaauuaacauuuugugguuaauauaauccuuugacuuauuagggagauugauaauaauucuuuuggccugauauuugauuuuccucuuacaucuuuucugaaccaaguuauauauauagcauaauaaaaugaaauuaaucgaaguauaaacaaaauucccccccucuuuuuucggguguguuuuugccuuggauuuccuggggugugaguggacaaaacaccugguuuuacuuaggaauuuuuggagcauuaaaauuugaaguauccuacugugaaaauagaguuuuaaaaauauuuuugaaugacaauuuauucccuuuuuaaguacaucuuuuuauuuuacuuuuaaaauaaaguugaccuuuuuuuuugacaugaugucucacccuguugcccaggcuggagugcaguggcaugaucucaggucacugcaaccuccgccuccuggguucaagcgauucuccugccccagccucccaaguagcugggauuacaggugugugccaccacgcccagcuaauuuuguauuuuuaguggagaugggguuucuccauguugguccaugcuggucaggcuggucucgaacugguaaccucaggugaucugccugccucagccucccaaagugcugggauuacaggugugagccaccaugcccagcuucgauuccuuuuuaacgcugaauaacauuccacuguaugccuauacuauguuuuguuuauauagucaccuguugauggacuuuuggguuauuucuaccuuuuugcuauugugaauaaugcugcuaugcacaaauauuuauuugagucccuacuuuaguuuuuugggguauauacuuagaaguggaauugcuggaucauguguuaguuccguuuguuuuuuucugaggaucugccauacugucuucaacaguggcuguaccguuuuacauuccuaccagcaauguacaagaguuccaguuucuucacauucuugacaauacuuuuacuuucuauucuuuuggauaauaguuauccuaauaggugugaagugguauugugguuuugggugguuuaauuuuacauauguaaauauuguuacacagacuuaucuagcauguggaauuaaggccaaugucauauacuauuuaugggcauuuuaccaugagaaugagaagcauguuuuuuguuacauuaauccucauauagauacaacuuauugaaaauuaaaggauuaauuuaugaaacaccuugucacuauuaaagcaugagcauaucauuaaagugauauuaacaguguaaacauuuuguauucuaaguuuugcguuuguaauuuaguaauagaaaaaauuaguuggggacauuuaccaauauccuaauuauaugaauuaguaaaaaugcugaaauaugguagaugcuuaauaaaggcguuuaauuauacuuguucauuaaaugagcuuuuuauuaauauuagaaaauacaaauacuuuacaguuauugcaaagucaaaucucaucuugagauaccaauuauuucugauuauuauugaugaaguguagaacuaggggacaccauuuggaaaagaagauuggagggagcagaaacccugaaaauacuguagcauaaaauaauagcuuauugauuccaucaguugacagacugaugaaugagauguauuucauuguaaauccaagagaaaacaaccaauuuuagcauuugagaaauguuaaauauauauuuauuguuugauuugaauguauugaagugcuauaaaagaaucagguggaaguuaucaauuugcacugaaauauugagucaggauccaguaauuuuaagcuucugcagagcugggaagaagugaaaggcagaaugccuuucaugccaauacuuuguuuuuuuuuuuuuuuuuuuuuguuuguguuuuuugcuuguuuuugagacagggucucacucuguugcccaggcuggagugcaguggcaugaucuuggcucacugcaaccucugccuccugggccuaagcaguccucucaccucagccuccugaguaccugggacuacaggcggacuacaggcacacaucaugcccagcuaauuuuuuguauuuuugguagagacaagguuucaccauguuguccacuggggucuuuaacuccugagcucagaugauccacccgccuuggcaucccaaagugcugggauuaugggcauaagccgcuguaccuggcagcaauacuuguuuuuuucuugaacugauguuaugauggagaaaagcuuuuuucuuuaaaagaucauuggaaggccaggcaugguggcuuaugccuauaaucccaucacuuugggaggccaaggcaggcagaucacuugaggucaggaguuugaggucagcuuggccaacauggugaaacccugucucuacuaaaaauacaaaaaugagcuggacauagcagggugccacucgggaggcugagguacaagaaucauuugaacccaggaggcggagguugcagugagccaagaucugccacugcacuccagccugggcaacagagugagacccuaucugaaaaaaaaaaaaaucauuggaagguauuuauccaucuaaaaauauucuuaguuuauaaauacagauaauguuagcuuagcagagaaaugccacgauuagaucagaguuagaauguuaacuggcaguauuguggggaguguggaauagcagaugaggagauggggaagagacugguaaaguaacauaaauguguuaguccauuuugcauugcuaugagggaacaccugagacuggguaauuuauaaagaaaagaggcuuauuuggcucacaguucugcagggggaagaagcauggugccagcgucugcuuggcuucuggugaggccuaaagcuuacaaucauggcagaaggcaaaaagggagcugucauaucacauggcaagagacagcaagagagcaaggaggugccagguauggagugaacuaauagauuuguucuagauaauagaacuuauuacuucuagauaauagaaccaguagauuaauucauuaccucagagauggcaccaagcgguucaugagagaucugucuccaugacccaaaccccuagguuccaagaaucuagaauaucuggccaucacagaaaacaaaaacaauucuacuaaggaccacuggaguaauagcaaaaggacacaggugucaauaucaagucagcacucaguggaucuccuaguggccaaauacgggacaauuugaacaucaaaagggauaauggcuaaaugauuauuuuuacaucuccuugcuguaauauacauaauguaugcucagcaauccauagaauaauuuguucuugaauuuuuauuuacuuuuaagcaaucauaugaauacuaccuauucuguuaaaaaauccaacuucgauaauuuguuauaugaauuuuucucauaaaucacagaaauuuaagauauguuuuaagaagauagaauaaaugccaacuaaaaacauauuuuuuucuuuuucaggaugaaguuccugauggaauuaaaucugcgagcuacaagguguguacguauaccuauugauguguccaguaucuuaaugaaaaacuugaaaaacccauuuccguuguaccuacuaucccauuuaucugcuuccaguggugaaaccccuugagagguauuuaugcugaauggcucucuuucuguuuguuuuuguuuaacauuuuauuuuuuauguauuuuauuuuauuuauuuuuuugagauggagcaguggcgugaucuuggcucacugcaaccuccgccuccccgguucaagcgauucuugucucagccuccagaguagcugggauuacaggcacucaccaccaugccuggcuaauuuuuauauuuuuaguagagacggguuuucuccauguuggucaggcuggucucgaauugccgaccucuggugauccgcccgucuuggccucccaaagugcugggauuauaggcgugagccaccgcguccggccuguuuagcauuuuauuauagaaaauaucaaagauaaauaaaaauagaggaaaaaauguaucugaaaguccauauguuauucagaguucuuuaauuuuuuuuuuuuuuuuuuuuuuuuuuaagauaaaaggucuggcucuguuguccaggcuggagugcaguggcaugaucauagcucacuguaaccuugaacuccugggcuaaagugauucucuccccucagcuuuccgaguagcugagaguguaggcaaaugccuccaugcauagauaauuuuaagaaaaaaauucuguagagauagagucuugccauguugcccaggguggaaacuccugaccaagugauccuccucccucagccucccaaagugcugggauuacaggcaugagccuccacaccaggccagauuucuuuaauuuuuaccuaauauccuuuaccuguucuaggaucccacccaagacaccauguuauauuuaguagucauguguucuuaggcuucucuuagccguaacaguuucccagucuuucuuuguuucugauaagguguuuuugaguaguacuagucaggugcauuuuguagacuguccgucaguggggauuuaucagauucagauucauuuuuuugauauauauuauauauauaggaguuacuguguacuuacuauuguguuauaccaacauauaaucucugccuuucucuuuuuucuugauguuaagauugaucacuagcuucauuauacauucaucuuaaagcucccuaauagcuuuucacugaaaaguuuuagcagccuugaugauuauuaccugguugcauuagccaaagugauuuuuuuuaaaacaugagauuaucugucuucucuguuuaaaauccuccuucgugcccauuucuccugagaaaaggccaaagccccuauaaagcaacaagaaguaaauagagugaccauaugccaggguuugucuggaacagaacuggcuuauaccuguuguccugacauccuuucugauuuaucauuuuuucugaguuucuugguuuuaaauaaaauauuauuaacaguugcauuaaaauagguugggauggaauugguagacaaauacuuuuuuuuuuuuuuuugggguagauagggggguucuaccauguugcccaggcuggucucgaacuccuggacucaagcuguucacccaccucggccucucaaaggguugggauuacaggugugagccacgacacucagccaaauacuuuguauuuccaucuuccucuguugucuucucucuuauuugauauguguaugcuaaauagaguucugacuuuaauacaaagaugaccaacaagaacguauccuucuucugauuuucuagaugcaaagaaacuaaaucuuugucucaagcacaguauacuaggugcuugcugaaaaauaauuacacucagacacaaaugacuagggacagcugccuccuuacagccuugggaagcacggggaagguguugcauacugcugccccucuuggucucuuggacuuaguagccauuugugcuguggccuguaucauacccacaauauuacuaagcugccagucugccuuuugacuaguuaaugggaaaccugugaaauuacaugguaaauaaauagaaaccgagcaauccuacauagagagaauagucuugcugugguaguuuuauccuuuauugauaaauugauaacuguguaguuauuuuaugguuugguaaugcucuuuuuauuuugcaaugaauccuuuuggcugaaauaaaaaggaaaaaggaagugcauguuuuaugaaaaguaaaauauugaauuuccauuucuccugauaguucaucaugauauguaacuugcacaaaagaucaucauucacuauuccuaaaggccauaaaaauaacacuggccauaugaaaaucaaaacacagaaaucugcugauaaagccucagugucuacuuugcaacaaauuuguaaaaaaugucagcuuuuaaagguuuagcaaggauggacaugguaguucaugcuuacaaucccagcacuuugggagggugaggugggaggaucacuugagcccaggaguucgagaccagccucggcaacauggugaaaccccgugucuacaaaaaauacaguugugguggcacaugccuguucucaaaauagcaaaaccccaucucuacaaaaauuagccagccaugaggaugugugccuguagucccagcugcccaaguggcugaggugggaggaucccuugagucugggaggucgaggcuacagagagcugugauuucaccacuguacuccagccugggagacagagugagacccugucucaaaaaaaaaggggauuuagcaaauugcaauuauuacuacuuauuuuaagaagacugugucuaaagauaacaauuuaacgugcagcugcagagaguacauuuacauaucauucugugauaugugacuuuucauuuagacuaaauaacuuuuaaauuaaaauuucccauuauuuuauuaugaaaaauuaaaaauauagcagaguuaaaggaauuuucccuugaacauucuuauacccguaaccuagauuccaccaccuuuuuuuuuuuugagacggaguuuugcucuuguuguccacagucuggagugcaauggcgcgaucuuggcucacugcaaccucugccucccggguucaagcaauucuccugccucagccucccgaguagcugggauuacaggcaugcgccaccaugcccagcuaauuuuguauuuuuaguagagacgggguuucaccauguuggccaagcuggucucaaaccucugaccucaagugauccaccugucucggccucccagaaugcugggauuacaggugugagccaccgugcccggccuagauuccaccauuuuaauaaacucacuuuaccacaugucuguucaucuguccauccuuguagccauccauuagaacaucuuauuuuucggaugcauuucaaaguaaauugcuggcaucaguauaccuccuccuaaauaagucauuagcuagauggauuuauguaaguagaaguauauuauuaacuagaguccaauauuuguuuauaugugcuuuuaauaaaaguauuaccauacaaugaaaugugcaaaucuuaagugugcauuugcugaauguugacaaaugcauauaccuguguaaccuaggcuucuauuaagagauagaauguuagcauuauccugcaaaguuuccucauacccauuccauucaaaccacacuccuucuucagaggcaaccacuguuuugaacauuuuccaucauagauucuaaacuaauuuugcucauuuuuaauuccauguuuucuuguacacacacagagucaaagaaugaauuaauagcuuuucacuugguuccaguggcagaagaacuuugcacauaguuaaauggugucauuaucaacuauuucaaauagaaaauaauuucauuuaacaaauugcuugaggcugggcacauaguggcucaugccuguguaaucccagugcuuuuggaggccaccaugugaggauugcuugaagccuggaguucaagaccagucugggcaacauugugagaccccaucucuacaaauaaaaacuaaaaaaaaauuagccaagugugguggugcaugcccauaguccuagcuccucaggagguugagacaggaggaggcugagccccaauguccagguuacagugaccuaugauuaugucacugcacuccagcuugggagacagagaaaaaaaaauuguucgauuuauuucauuuaaucgauagacugaaaguaaaacuuuuggaaguucauucuguugaaggaaaacauuugucacuauugugaaugcuaguguaaauucaguuaaagcucaaaauugaagauaaaauauuuguuugugguaguacacauauaaauuuuuauaacagcaauguucuggguaaaaaccaguguccuuaauaaaucaagaaaucuaugaaacaaauggcauuuguaauaaaaauauacaaauaauucauaauuguguccacacaagcugugauauuuuaccaguuaagauagaagugguaauaagcugaguguguggcaugcaccuguaguccucgcuacucaggaggcugaggugggaggguugcuugaguccuggagguagagauugcaaugagccaagucugugccacugcacuuaagcuugggugacagaaccagauccugucucaaaaaaaaggaguaauuguuaaaauuaguaugugauuuauauauauacuaaguuaugauugugaaauuuuugagaugaagcugaugcugaaaaaauuuacuuugguaugguuuuaguaugauaguacuuacuuugcugucuauuaucaaucagauuuuauaaauguuuugaggcuucgaagaacuaauuuguaaaacaacccaagagcuucucaguaguauugauugguuuuuaauaaaugaacccucuaaguuuuuauugcaauuuguucuaaaucagugaaaaauaaguaucaaugaauggaaugcauaaagaagaaacaaaguuuagcuguuaagguuuagcaaauugcaauuauggcaaaauggcuagaugugguggcucaugccuguaaucccagcacuuuuggaggccaaggcagacagacugcuugagaccaggaguucaagaccagccugggcaacauggugaaacccuguaucuaaaaaaauuuaaaaaauuagccauacaugguagugugcaccuguaguccuagcuacucaggagacugagaggggaagauugcuugagccugggagguugaggcuggagugagcuguggucaugccauugcacuccagccugggcgacagagcgagacccuuucucaaagaaaaaaaaaaaucauuauaacaaagcuuguaaacaaaggccuuuaaauuuauaccuacaaaaaguagagagaaaucaaacacauuaaaugaggaaaguccaaaugguguuuaauaugauucagaaauuguauucugaaauguuauaaauguguuugggaguaucuccauuuguggcaagaauaucuucuugauagaacucugcuuugaauuggauacauuuauauucugaucugagauguaaugaaauugaggauuacaauuucauaguaucuaaguuugaccaaauuuuuuuuguuuguuuguuuuuuguuuuuuuuuuuuuuuuuggucagagacagggucugucucuguugcccaggcuggaaugcagugguaagauuauauaguucacuguaaccucgaacuccugggcucaagcaauccugccaccucaacuuccugaguagcuaguauuauaggcacaugccaccauguccagcuaauuaaaauuuuuuuuuguagagauggggucuugcuguauuacccaggcuggucuuuaauuccaggccucaagcaaacuuuccacuuuggccuuccaaagugcugggauuucaggcaugagccaccacacccaggcuuuaaauuugucaaaacauuuaaaauaaugaaaacauagagacaacuuauuugauguuuugucuuaaaauauuuauuguagaaauguacuuuaggggcaaaagaauagaacuugugaaaauauuugggcuaaaguauuuccacauauuuaccuaaagagagaauguuuuuucuuuuuuuuugagacggagucuuacucugucgcccaggcuggagcgcaguggcgugaucucggcucacugcaagcucugccuccuggguucacuccauucuccugccucagccucccgaguagcugggacuacaggcgccugccaccacgcccugcuaauuuuuuguauuuuuaguagagacaggguuucaccauguuggccagccuggucucaaacuccugacuucaggugauccaccugccucgggcucccacagugccgggauuauaggcgugagccaccguaccuggccugauuaugggcaauuuuaugaaaaauuaaaagcaauaagaacauauuggaaaaauaaaaaaaauaaaaagagcuucagauaacuucuaaauuuuaaacaaguuuuaaaaaugcaauaaguuauuaucuauuuauucccuuuuucauuuuaguauucugaagaagccaauaaucucauugaagaaugugaacaagcugaacgacuuggagcaguggaugaaucucugagguuugauuuuauuuuucagcaguauuucauguuucuuuauguuacauauuaacuuaaaaauaauaauguuauuuuuuuucuuuguuugaagugaggaaacacagaaggcuguucuucaguggaccaagcaugaugauucuucagauaacuucugugaagcugaugguauaauauuuuugauaguaugcauuguguuuaaaauuauaccuaagaaaaaaaaaguuuuuaauuauuuuaaucugggcaugguggugugccuguagucccagcuuaucuggaggcugaggcaggagaaucacuggagcccagguauuugaauccagacugggcaacauaguaagacccaucucagaaaaaaguuauuaaagaaaaaaacucaguuucuaacgguuuggcgguucuucaaaaaccuaaacguagaauuaccauaugacauaacaguuccuuuucuagguauauacucaaaaaaauuaaagacagggacucaaacagauggcaaagcaauguucauuauagccaaaaggugguaacaacccaauuguccaguacuguuugaauggauaaacaaaaugugguauauaaaacacacaauggaauacuauucagccagaaaaaggaaugaaguucugguacauacuacaacacggauggaucuugacaacaugcuaagugaaauaggucaggcaccaaaggacaaguauaaaugauuucacuuauaugaaauguaaacaaugggcaaauucauggagacagaaaguagauuaaagauuaucagagguugggguggguaggcguuauugcuaaaagguuacagaguuucuguuugaggugcuggaaaaguucuggcaacagauaguggugaugguuucacaacacugugaauauaaugaaucccacugaauuguauacuuaaaugugguuaaacuguaaauuuuauuauaucaauuuuauuacaguuaaaaaaacucaguuucuagaaaaaauguaccucuuaaguuuugcaguucuauguagcuugugguuuauauaauuuuguauauacauuuuguauaaauagcuaaaauuuagggauuacaaaaaucugcuucaguuacauugcuguuggauuguuauguauauuccuuaaugaugguccguguugcuuuuggagaagugaauauugaaccguuagucgagucugugaugucugaaguuaagccagagugcugcugcuguuaaaagcuaggagccccagauucauuaaaacucugaucguggcacagugguucaugccuguaaucccagcuacucaggaggcugaggcaggagaaucacuugaacccaggaggcagagguugcagugagcugagauugugccauugcacuccaaccuggugacagagcgagacuccgucucaaaaaaacaaaagaccaaaaaaacaacucugaucaagauguauagauuuuccaauucuuccuuuuucuaguauuuccuuuuucuaaguugaauuguuagccucuuaauucacuaaaaaaaauaaaucaaauugagucuugguauucuucuguggcucuuuucuaguggacuaacgcucuuucaaaaauuagugaaaacgggccuggcuuguuggcuuaugccuauaaucccagcacuuugggaggccaaggagggaagauugcugagccuagccugggcaacauggcaaaacucugucucuacaaacaauacaaaaauuagccaggccugguggugugugccaguagucccagcuacucggggagugggaggauugcuugauccaggggguugaggcuggagugagcucugauugcaccacuguacuccaagccuaggacagagugagacccuuucucaaaacaacacaacaaaaaauuagugaaaacagugauauaaauucuuuuaauuauaagccaaagaugcagccuacaaucuccauaaaagagaaaguauuuuuaauuuuguggcuucuuuuuggggaaaauugcuuuccuuaauggaaaccguagccauguuuugguauauacuuaguuauaauuccuuauuuccaauucuaaaaucuggaaacucugaaaacugaacauuucucccccugcguuuagcagaggcucauuuagugugaguauauguuucacuguagaaauauuuacguguuugaauaaagauugcucccccagguccagcuggaguaauaugcgauauauguugcauguacuguauuaccuuuguaaaaucuggaaaguucauuccagccgagacacgcauggucccaggcauguuggaugagggguauagaccuauaucaagauuuggacuagugaaggaaggggauaagauguucucccaacucccuuauuuugccaucuuuucuacaaggauuuuuuuuuuaccuuaaauauuguugugagauaaaacuaaauuuauaguaugcagcuauaauuuuuuuuaguccuccacuguuagaaaaaggaugguaauauuuuaaccuuaauuaacauccuuuugugacuacaaugugcagcaccaggugagaaucaaugauucauuucuuauaugguagaguuuggugaaucacuugcccauuuguauuagugucuucuguuaaaaaaagcugaauauuuuaaagaaagcuuuagcaggaauaaauaauggauguaaaugguacgugaaauauagaaaguauuuuuaaaauccuaauuggaaauuugagcuuuugucaaaaacagguucuauucagugauagaaaacagcauaucauauagguuuugcagaacgcauguuuucugcuucuagggcuggauauuggcauuuuccuauaagggccaaaugggcucuuaaaugucuuuucuuagauuuuacaaaacauguuugacuaguuuucuaugaaaaacuucagguucuauucagugauaggaaccagcgcaucauaaaaauucuuggcacaaauauaauuauaguaauauuuaauauaauuauaguauuacuucaaauauaauuguauaauuauaauuauaauuauaguauaauuauaagauuuguaauauaauaauauaguaauauuuauuuuuuauaagcuugaagaagaaugaaguauuuauaauaaguagaauuaugaggcaacaaauguuuaucucuagguagaauauuuaaaaauuuaaucauuucuuggugguuaguuuucucaaaguccuggauacugaccguuguuuauguauuuuauuuuauuucauuuuuauuuuuauuuuuuuuccgaggcagaguuucauucucguugcccaggcuggagugcaauggugugaucucagcucacuguaaccucugucucccggguucaagcgauucuccugccucagccucccgaguagcugggauuacaggcaugcaucaccaugcccggcuaauuuuguauuuuuaguagagaugggguuucuccauguuggucaggcuggucucgaacuccugacuucaugugauccacccgccucagccucccaaaguucugggauuacaggcgugagccaccaugccuggccugcuguuuauauauuuuaaacaucaggguuuaaaaaaugaauuuauuauaauuuauauguggcacuugccuuuaguauuaauugaaaugaacaguuauccauuccugaacuagaugauuccaugcuaauuuguuuuuuaaguccuuauauuuuguuuuucuaguuauuuuaauugccacuucugcauugaacucugcuauuuuaagaugccgucauuguacugcuucuagaagcaaauuucccccuaauuuaugcuucuaauauacugugaauuggaguaaaaaauaaccaagcuuaggguuuuuuuuuguuuuugugguuuuuuuuuaauaauaaaaauagguauaguugagagcuugauggacucuaagcacuuuugugcucauauuuuuguuauugacuuugguugcauugagaccguuuuuguccacuuuuuaauucuuuguuggcucauacuguuaagcuuuauauaugaauaaaguauuauuauaguaccaaauaauuucccaaagccacuggaggacuauggcccaucuuuuuuugagacacagucucacuguguugcccaggcuggagugccguggugcaaucacggcucacugcagccuggaccuccugggcucaagugacuuucccaccucagccuccuggguagcugggaccacaggcacgugccaugaugccuggcuaauuuuuguauuuuuuauugaugccugguguuucaccagguugccugugaauuuuagaaucacuccugggcucaagcagucugcccccaggccuccgagaaugcugggauuacaggcaugaaccaucgugcccacccugggaccgaccaucuuuuuuguuuugaaguuauaacacauuauaaaugauaaauaaguaacagggucuggauucuagccuggguguucuggcuccagagcccaugcucuggcuguucugugauguuggauguuuagguugcuuccaauuuucccuuuuauaaauaauguugacacagaaucaugcugcauuguaacuuuugcuuuuggccagauuggaucugcugguggucaucuaagaagaaaguauuugguaacacgcaguguacaauacuaacacuccuucauuuacuguaguuauugaugaacugcugugguuaauguggagggaaauguauguuauauucuuugucugaauagcuuaugauaauugaauuaccauguuucuuugauucuaaaauucacguauuccuauuuuuacaauuccuaaaucauaauguuuuuguagccaguguguacaauuaauguggcuguguguguuucucucucuuuuccuuccuuucuuuucugagacggagucucgcucugucacccaagcuggagcacaguggcgcaaucucggcucacugcaaccuccgccucccggguucaagugauucuccuguugcagccucucgaguagcugggacuacaggcgugcaccaccacgcccggcuaauuuuuguauuuuuaguagagacaggguuucacuauguuggccaggcuggauucgaacuccugaccucaagugauccgcccaccuuggccucccaaagugcugggauuacaggugugaggcaccacacccggccuccuuccuuuguuucuccugaaaaguuguuuuaaaauuccugacacauuguuauauuuguggugcguuagaaucaauggaauacagucuuguguaguagcuuuuuaagguaacugaggauaagaaagguuuaauaagacauuuuauuuuacagacauucaguccccugaagcugaauauguagauuugcuucuuaauccugagcgcuacacugguuacaagggaccagaugcuuggaaaauauggaaugucaucuacgaagaaaacuguuuuaaguaugugucauuuucauuuagaaaaauuccuauaagauguggugauuucucuuuauaaacaaaaucauaaugauuuaaaauuaaaaaucaaauucacuuuguuaaaagauguguuuguacaaggaaacaugacuauucauuaauccaguuuccuucuggggaaauauauagacgugaguuuccacagauuuuuccuuuagaccuuuaugggaguauuguaggcccuugacaaauguuccuugagucgauuauaggaucucauuuuauaguuaagguaaccuagagcuggagagguuugcuucauuucccaagaucacacaguggcaguguagagaaaagaauauacaacucuuaauucucuuuuuggugcucuguacacccuugucuguggcuuuaauuauuuuacaguuaaauugauuucagagaacaauuauaauagguaucauuuuugagcacucacuguauucuaggcauugugguaagcauguuauauacauuuucuucuucaguccuugcaauaacccuguguugcagucaucacuguauuauagacagagaaacugagacuuagagagguuaaaugauuuguucagugucaaagaucuaguaagugaaagagcccgcuuuguacgggguaaccauuaggcuggaggcaguugcugaucacuggguaucugagaaaugcuucagguuacucacacguaagucuugaggugcuaaacuuuguacucacugguuuugggaucaauguaugugcgagcacauuaugcugucuuagagauggagagaguucugggaaagucuuuggaguucccaaauauggggauaauauuauauauuucacuuuuuauaagucaaauauaaguaugagaucaguaauugugcuuacaccaauaaaaugucagacugugguguuuuuuuuuuugacuugaagaauuucuccaguuuggaaaguagagaguuuuuauuaauuacuuauuucugccauguauuuuauuuaaauuaucuugacuauuauuagaaauguuugauuuacugacuuaaagauuuacuuuaaagguuuuuuuuuuuuuuuuuugagaugaagucucacucuguugcccaggcugcagugacgucaucucugcuuaccgcaaccucugccucccagguucaagcgauucuccugccucagccuccugaguagcugggacuacaggcacacgccaccacacccggcucauuuuuguauuuuuaguggagacgggguuucaccauguuguccaggcuguucuugaacuccugaccucaggugauccacccaccucggccucccaaagugcugggauuacaggggugagccaccaugcccaaagugcugggauuacaggcaugagccaccacgcccggcccuguuguuguuauuuuuagugugaauuaagaaugggaggccaaggcgggcggaucacgaggucaggagaucgagaccauccucacuaacgcggugaaaccccgucucuacuaaaaauacaaaaaauuagccgggcguaguggugggcaccuguagucccagcuacucgagaggcugaggcaggagaauggcgugaacccgggaggcggagcuugcagugagcccagauugcaccacugcacuccagccugggugacagagugagacuccgucucaaaaaaaaagaaugacucugucucaaagaaaaauaauaaaagaauccaugaagcauuuguuagauuuguauuacuuuuguagucauuuucuuacuaauuuguguccugauucccauaauuucuaacaauauaaacaauguauaaagggcuaaguuaauuauauuguguauuuuaaaauacagcuuacauauucuguucucaaaaugucuccaguuuugcaaauuuuuaaaauagauguuaaaacaaucccuauaguuuacuauuaauacuaacgcguauuuauuuugggauuuaaaagcacuuuaaugacauaguaacucuccagaaaauuucuguuuuuuccuacugaacaaacaacuuuuauuuaaauuguaacaaacuuagcuacagggcaaauugaugugucuaaagauuaccuaaguggaaaauaaucuacacuauuuuuuuuccauuuuuaaauuuuaaugcuuauauugaauauuuuuugcuuauuugucuuucauuuagggguacacuuugugccauacacacacacauauacauagauauguauauauaauauauauaaaaacauaguagugacuccgagagaagagcuuggcugauauuuucucuucuuuuguuugaagaagugauuaggaaauggccugcuggccgccacaaugggagaagaucaggaacuauuaucacuacaacaaauagccacccucccuuaaagcaauuagaggaaacuaaguguuuuauaaucucaauaaaacaauuugauuuuggauauuaagcaguuuucugagauaauaucacuuaaauauaacaugauugguaacauauuuguguugauauuuuuaauucuuuuuacuucuaggccacagacaauuaaaagaccuuuaaauccuuuggcuucuggucaagguaaauuacuuauuugcguuguuauauuauuucucagccagggaacuuuaauucaaaggaaggggaaggcaagauaaaugacaguaacaguugaagucauauaauccacaguccuguuuccauagaguuaugccucacgcuugcagagauuggugcuuaaauuauuuguacuucaguaaaaaguauuuuuuuuuuuuuuuugagauggagucucgcucugucacccaggcuggagugcaguggcgugacuuuggcucacugcaaacuucgccucccggguucacgccauucuccugccgcagccuccucaguagcugggacuacaggcgcccgccacaacgcccagcaaauuuuuuuguauuuuuaguagagaugagguuucaccguguuagccaggauggucucgaucuccugaccucaugauccacccgccucggccuccgaaagugcugggauuucaggugugagccacugccccuggccaguaaaaaguauuuuuauaaugaaguuccugguauuagauuaucaaaaaauaaagauuaggauauauauuuauucuauauauuuuugcagacauaguaaaaugucaguuuuuuaaucccacagauaaauaaauaucccaaacucucaaauuuuuucuaaaacuugaaauuauugcaaauauugggcaucugauuucaacuuuacaugucuuuauaucuuaauaacauuuuuaauauucuguuuucacucaaggucuggcucaaaugcugcuuuuuccauaaaacuuucccugguccuuguaaccagaaguauuucucccuccucaugaaguaaucugaugcaugcguuuguuuuuacuuguuuuccucuuacggccuuucccacuguguagcauuauuuuauuauuauuuauguaucuaucgaucuacccuaguacucugccauauggguagcauuuaucuguuuuaucucucuauauagagccugacacauaauagauggaguaguuuguuagauacaugaucagugaaaauugcucucuucauuuaauggucuugucuacaauagugaaagccaguuguucuuucagcaaaugauuauccgccauuuacuaccugcuaggcacuguguagaugccagaggggauguaaaauuaaaauuuacaaaaacccuaccccaucuguaauaugaagaaugguuuguugaauaagccauuucaguguaugaguucagacuuuuucuuuagaaauuauguauccuuauucucuucaaauaugugcuuacugauuaaaaucuuuaaugugcuuuuagcaaaaguguaagguuuucauuuuaaaaauuuauuugaaaagaugcugaucucaaauaauaaauauaaauuuccuccuagaaggggaugagauugcaucauucccuaaauucuggcagauuucucuuucuuagauuaggaaugaaaaaucuuuaaauaaggcuuuugaguuuauacagagucacauguggugacucaguggaagccauugauuuaauaucagaugaaaugcaaauuaauagaaaagaggugaucauuaugaucucacauuaugauuugauaaaguaauuaaccacgucacuuaccauaaagauacauaggaacaauuuaaauguuuaucauuagggaacugguuaaaugacuuaugguauagucacauagaaaauagccauuguaaauauugcuguaaauuuuuauucauuuaaaucaaaagugaccaauaacacagugaggaaaaucagguaucaaaacaauauguauaauaaauuuauaauauaucuauaaacuaaaaagauauucacuaaaauguaaauaguauuuaucuuugagcuggggaauuaugaauaauuuuuuauuuugucuuuuuuuuaaaaacauauauuugcaaugauuauauauuucuuuaauaaaccgauggcauuaaaaaaagugggcaaaauuuuugaagacaaauuuucaguaguaaauaagcagcugcacacaaauuacuguauuauguauaauuugaaucuuauaaauagucuaugaaaauauucccgacuaagguuaaauauuauaaggccaggcuggagguuucaaagcaauaauaauaauauuuaacagaaacuacauuauagcuuuaggauaaauaaauguggaaaagucucugucagccaaguaaacguagguccuuaagauauugaagaguacucucaggugauggauuaguuuuuucucuccugucaggguauauuaaaucucacaugagcugaaccucuuuauguacacucauggagauaacaccauuuagucaaaucaggcauaauucauaucacuaccagauagaguugcagucacgaaugucucacuuucagauuuuacuugugugaaugaacuguuggacuaaaacuaaccauuauuaaagucuuauuuuuaugaaaguguagcauuauaaaaggggcacuggaaggaauuuauuuuaauaaacauuuuguuuugcuuuucagggacaagugaagguaaguauaauuuauuauauauuacauauaugaauuuguuuauacauucagauguuuauuauggcaaaguuuauuuuuuucuucucaccucuaaaaaucagaagaacuuaaguuuuacuuauuuaucugaaagucuggagguacuagcacagauuaagggaaagugacuuugugucuggguucaggcauuagaaacagugugccucagccucugaucauucauuugcacauuuuaccucucugaauguggaagcauguccacuccccgucucccccauugccucaggccagggaaauguccucucucuuuuacugguugaacucuaggaucugcuggguuucauguaggaagguucugggcaugaugaguauugauuucagagcuggcuucuaagguugaugcugacuuguuggauguaggugucauugccaagucuaacuaaugcuaacaguuucagcauacauuagguuuacuuuguguuuuugcuuuaagggugaaaaugaaaugacauuuguuauucuuaagaccauaugcuuaacaauaugaaaagacuuaauggugcuuagcuuuagucuaucuaggugaaauugcuaaaaugugaaguaucacuuuucuuucccucaaaauccucuauuuucugaacauaauucuuaugaauugcuuuugcauuaugucuaaauaacagaauacuaaagucugauaacaaugcuauuuuauuauugugcuuuauauuauauuaacuguagcagcuaaauaaaaugcugacucagaacuguuuggaagagaaauuguuuagcagugagauuauuuuuccaaagaugccucauauuugcuacugguacaugugauucuaugauuuucaguuucaaguaaccuuauuuuaccuugaguauuaaccuaguucuaugcuauauuguuagccacauuagaggaggcuacuaugauuuuucaauucuauuugaagaccuuauuaucagaaaaauagaucguuaaccugugggagccauccuuagagaaacugucuuauuauaaguauugauuuuggccaaauaucaaaggguuauuccugagagcuaucauauuaagugauuguuuagaccacagucaggucaacuugagaacagguacuucaggauuauaauauugaacugauuucuuggcugggcgugguggcuuaugccuguaaucccaguacuuuggaaggccagggcuggcuggucacuugaggccaggaguuugagaccagccuggcuaaccuggugaaacccugucucuacuaaaaauagaaaaauuagcugggcgugguggugcacaccugugaucccagcugugugggaggcugagaugggaggaucacuugagcuugggaggcggagguugcagugagcugagauggagccacugcccuccagccuggguaacagagcaagacugucuuuuuucuuuuuuuuuuuuuuuaaaaaggacacacagacacacacacacacacacaaacacugaacugaaaauuucacuggaagccuagguccuaagcaguauuauccccuaacucccuaauucaugaucaaaaacuugaaaaaaagaaccuugaaaauuuuuauaaggaaauaaguuccuuauaaucccaccauccccaaauaauuaauaauaauaacucugugccaggcacuuuucuaagcaauuuacaaauaugauuuuauuuaauucuuucaccaauccuagggguauuauuccugucuccauguuauaggugaagagagguucagcaacuugacuaaaauaauaugauuuguaaguagcagaguuaagauuuaaaucaggcaguuugacuccaggaaccauacccuuaguuacuaccagauacgcuucucugcuaacauuuugauauuuauguuuucuauauauaaguaguuuuguccaacacuugucagcauuaaagaugaucauauuuuuaucuuacuugauagguagagucauguaucuuuuguuuucauuugcauuuuuuauugcccguaagaccaaacaauuuuugucuguuauuaccauauguauuuuuuccuuugugaauuuuuaaauucauauuauuuaccucuuuuuuaagggggcacuuuagcauuuuuauuuaguuuaugagcuuuuuauauauuuaggaucuaaucccuuugacauauuugcaacauacauuuuacugaguuuguuguuugcauuuugcuuuuguuuaugaaguguucugacaaauagauguuuugaguuuuuauauauuccaguuuauugcuuauucccuuugccauuccuuccauuauuuuuaugcuuguuugguucauuuuuaacauuacuguaagcaacuuuaguagaaaacacuguacaguguuuaucaucucuguagcaaaugcauacaugaaucuuuacagaguuguaugauuauuucuuaugccuuuuguauaauauuucaaguaaacauuuuuauguauugccauguucuacauucuugcuauuuucauaguuguauguuauuuuaccauguucacuaguuagauaguguucuaucauguuaauuuaggcauuaucguauuuguagaauuacuaggcauuaaauauauugacaauaaucuuauuaggucauaagaauauaagugauacuugguguuuauaacauuuuccugaauugcucuuuugaaauagugaauggcauguaauauuaucagcuaaauacaaauaguaccccuccaauacugucuuaucauuuuaauuuuuuucuaguuuaaaaagcauguaaugaauccuuaguuuucauggcaugaauuguuaucaaggcuagguauuuucccauucuugacugauuuacuauuuaaauucuguauuuugaccuccuguaaaacacuuuaaccagaacguuaugagacugggucaaccuaaggcaaugcuaaagccuuuuaaagaccaagcagcaggcugguacuuaacugaauccauaaccuuucuucuuccuuucgagaaauugcaauuaagacuuggaccguuagguuaaauaaucuuuacauuguuguuuggcacaaauuugcuauaaugcuuuaaaacuuuugaaaaacuuguauuuuggcauuuuucuauucuuaugacuuauuuuucuuuugauuucagagaacacuuuuuacaguuggcuagaagguaauuagaaacuuuaaaauaaauuucaaugaugguuuuuuucucaugagauuaauuuuaugucuacaagauucacauaugaaauuuuauuucuaagucacugcuuuuucuuaggucucuguguagaaaaaagagcauucuacagacuuauaucuggccuacaugcaagcauuaaugugcauuugagugcaagauaucuuuuacaagguaugugacauuuacuuuuauucagucuaccacucuuaauuuuagauauucuuaaaauuuuccuggcauuuaccugaaugggaaaagauugaccugauugaauauuaggcaguaaaaauucacucuuaaaugguaguaaucagaaaggugggaacuguagauacaauugaacaguuuaacauacucuuagcucucuucaccuucuuuuaagaagcugcucaaaauuguccauaucacuuuggaaauauucuuguuuucuugugggaauuuaaauaguuccuaacagcacaguuugcuauuugauagauauuguuguaucagaaccuuuuuauuugugugcucguaucaggccuggaguuuaaauggguaaaagccuuuccugcugcuguugaugccuuaauacuguugaaaaugagacugugguugauuuucaucaguaccauauuucuucuggaauuaaaguaucacacucugagaaacaaaauauagaaacuuccauuuuauucauugauugauugcuugauugauugagacagggucucacucuauugcccacucuagugugcgauggccaaaacuggggcuuagccugggagggcacuuggcuuugcccaggaaaaaguuugaaccucuccucaugaaggagagcugucccauaggcagugugcccagaguagcagcuuggaggcaguucugcagccauauuuauaguccacuuuuuauuauaugcaaauuaugaggcagauuaugcagaaauuucuaggaaaaggguaguaacuucugggucauugcuauggaaaggggugguaacuucugcauguugccaugggaaugagaaacugacauggcacccuggugggugugccucauggaaagcugcuucagcccccucccuguuuuagcuaguuuucaauuugguccaguguccugagucccaccuccugagccaaguccuaccuucuaccucaugacuacaggagcaugccaccauguccagcuaauuuuucacaauauuuuuuguagagacaagauuuggccauguugcccaggcuggucuugaacuccugagcucaagugauuugcccaucuuggccucccagaguacugggauuauagccgugagcuacugugccuagccguaacuuugauuuuaaauggcgguuuaaacucauuaguaauuuuacuguuuuuuuuuuuuuuuuuuugagacagagucuuguucugucacccaggcuggagugcaguggugugaucuuggcucacugugaccucugccuccuggguucaagugauucuccugccucagccuccugaguagcugggaccacaggugcaugccaccacacccagcuaauuuuuuguauuuuuaguagagacgggguuucaccauguuggccaggcuggucucgaauuccugaccucaggugauccacccgccuuggccucccaaagugcugggauuacaggcuucagccacugcaccuggccuaaacucauuaguaauuuuagaucaucauuuucaaauuguguguuuagguuuuaugaauauguuuauauucagaaguuugacuauuauuuuuuuucaucuuuaaaaaaggaaauuuuauuauuuuccaucacaugaaugaacuuggaggacauuauauuugucaaaaugagccagacacaaagauuauuauuucaugauuucacuuacaaagggauucuaaaaaacuuaaucuuauugaaguagagaguaaagugguggccaccagacaccaagguauuuaggagacaggaggguuugaaaagauguugaucaaaaaauacauaauuauaguuaauagaaguucaagagauauuuuuguacagcguagugacuauagaucaaaauaauguauuuguaguuuugaaaaaugcugacaaugucacuugcucuugccacagaaauguuaacuauguggcguaauuaccuagaauuaagcauuuaacaauguauauauacuuccaaacauuauguuuuacaaaauaaauauacauuuauugauuacagaugguaaugguaugaaagccacugaaagggcaggcguugcuuauggucuuaugacuggccacuuugugaacacaauaaacaaguuugcauuaaaaaaacccagaaaaugguuuaaucuaaaaguugccaugaucuucagaauuuuuccagagaaaaugaccaagaaguugacuacaguuaggugacuaagaauauaagcuguagacaccuucacccacuaaaaaaaaaaaucacauaaaauaagagugagaaauuccucugaguuguaauaucaauauggaaaagaaauauuauuccagauuucaaauccacagagaucauuuuauuauuuugcagccuuuaacauucacacuuaaaaauaaaagauucuacauggaaacaugugcuguaaguguaucauagaacauuaaauuuaaaauuauucacuuaccauuaacucuccuaauacuuuaauuucuaugauauauuuucuagcaaauuagauagaugucacacuuuguguaagaauuuuuuuuuuuuugagacagagucuugcucugucgcccaggcuggagugcaguggugcaaucuuggcucacuacaacaucugccuccaggauucaagcaauucuccugccucagccuccugaguaacugggauuacaggcaugugccaccacgcccggcugauuuuuguauuuuuaguagaggugggguuucaccauguugguaaggcuggucucaaacuccugaccucgugauccaccugccucggccucccaaagugcugggauuacaguugugagccaccacgccuggccuguguaagaauuuaauaagauuuuccuuuuacaaacagagaaaaacaaugcuaaguuacuuaauccucucaccuguggacagguuugccuuuuaucuuaacugauuugaaaguuauauugauaagcaaacucucuaguuaaaaccaauuuuugaaugcauuaaauaaauaccaacuuucucaucaaaaccuacaaaguaccauguaaaaugacauggcaugaagacaacagugagaaaacuguagccaucacauagaaaaagaaggagaagggcugugaugaauacacaguuagaagacacauaauaggacaaacaaaacuaaagauaacuaggaaauaaacagaauuucucuuaaaauucagcaagauuuagcuuugcagcauggaaaaauguuaucuccacaugaagaaucaaucuuauuucuucacuauugauauuuuccuucucugacuugaacuuacaaacuaacuguagcaggaauauuuauggcuuaucauggagcauccguuacacagcaaguacuguguguuuguuugcuacauuuauauauaaaaaacauccucaugacuucugaagcaucccuaguucuuaccugaacaaauuggcucaauaaacauauaaauuuacuuaugucaauuauaaugagaauaaaauaaguaaaaaaaaauacaggcuuauguagaauucuuuaauuaaaagaacaaauggaauguccuaauuaaaugaaauguaauacacaauuuuggaaauacaucuaaaaauuguuuugugugcacuacuauauuuuauaaaaaucauucuuauuagucaugaccagcucacauaauaccucauaaacuauaaaagaaaaaaauuauaagagacaagaaaauuauaagucuagcaugagaaccaggcaaagaaaaacagaaaauguucauggggagauucugaaucauaagucagaagauuuuacaguaaugaauuuaauaaaaagcagaguauagauuugcuuucagcauuuuugagguuuucaguuuucuaguaaauuugucaccuuauuaagauauuuguuuuguuccaauauugcucuauucuucugaaaacagguauaaacucauacucacccaaacacacuuacucuauaauuuucuugcaccuaaggucuauuuuuagaguaauauaugugcauagcuaacucuauguaaaucagaacuaaaauucuguauguuugcaggcagagagaccacauguucaaagaaaaauacauaacaaauuuuuuuaaauguuuaagcagaacucagaauuuuaagacucaggauuuuauuuauauuuauaaauaauuuuuauuauacccauaaaaaugacccuauaaucaauagcaacuuaauuguacauuuuaaaguaacuaaaaguguagaguugauagaaauuucauuugcccugaugugauuaauacauaaauuauaugccuguaucaaaagaugccauauauggcaucaauauaagcagauacuaugcaccugcaaaaauuaagaaugauuuuuauuauuaauaagacuugcuuucucaguaaaacauugaauuuguuuuaaggauggguucuagaaaauaaaauauuaauauaaaacuauuaaaggcuaaauugugaaaaaccauuuucuugguuguuauuauauaacuuaaaaugcaaaaugaaauuaacuucuauaggcaugaauaaccuaauauaauuaaaguaaaaauugucaaauucaguuuuuaauauuuaauucuucuuccuucuuagagaccugguuagaaaagaaauggggacacaacauuacagaauuucaacagcgauuugauggaauuuugacugaaggagaagguccaagaaggcuuaagaacuuguauuuucucuacuuaauagaacuaagggcuuuauccaaaguguuaccauucuucgagcgcccagauuuucaacucuuuacuggaaauaaaauucaggaugaggaaaacaaaauguuacuucuggaaauacuucaugaaaucaaguaaauuauauauuaaacuuuauacauuaauagaagagugacaauuaauguacaagauaaauuuuuuuuuuuuugagacaggcucucccucuguugcccaggcuggagugcaguggcacggucauggcucacugcagccuugauuuccugggcucaagcaguccucccaucucagcccaagaagcugggacuauaugugcaaaccaccacaccgggcuaauuuuuguauuuuuuguagagaugggguuuugccauguuguccaggcuggucucgaacuccugggcuuaagugauugauccacccaccuuggccucccaaagugcugggauuacaggugcaggccacugugcucugccugaaauuuuuaauauucauuuagagaaaggaaaacuauuuagaacauaauuaaaaguuaauuuugcuuguaggucuuuucagauugaauuuugcuuuuguuuuuauuuugauuuggguacugagaggcacacauuuuuaguuuuaagagccauucuuuuaguauuugauaauguauuauuuucauguuuauuugaacaaauuggauuuggggucaaauuucuguauuacgcaguuagaaucaagauuugagguuugaggauaagaauuugauuuggggcaucggaguguugguuuuacuauguuuucuccucuuuauuuaucaugaccaguaaaauguuguauuagcaggacuuuuaauauuuauaacacaugaaaaugaauauucucuguuuuaaaacgcaggucauuuccuuugcauuuugaugagaauucauuuuuugcuggggauaaaaaagaagcacacaaacuaaagguaauuacuuuauacuuaacuguuagauacaaacugauuaacacuuaugcagauaugaauauauaguacucauagaaguagagaguaggccauagaaguagagaguaggccaggggcaguggcucaggccuguaauuccagcacuuugggaggcugaggugggaggauugcuugagcccuggaguucaagaccagcuugggcaacaucgugugaaacccugucuuuaauuaaaaaaaaaaaaaaaaaaaguagagaguagaaugaugguuaccacaggcuggggguggggaguggauggggaaaacggagauguugauccauggguacaaaguuucaguuagggagaauaagauuuagugaucuacugcacagaaugguaacuaugguaauaaugcauuauauauugcaaaauugccaaaaguguagauuuuaagguuuccacuauacaaaaaaugguuaaguaugugaggugauggauuuguuaauuagccugauuuaaucacuucauauuguaaauauacauuaaaacaucacauuguauccauaaacauauacaauuuuugucaauuaaaacauaaacacauguauauauacuuaacaguauaucuugauauacaucuugaaauuaagaaaaaaucagagucauaaucuuucuuuuccucaaaaaaaucaaguccaaaggcaggugccacuuaaagucuauuuugcauuauauucaaaguaacacugauaucuguauauugccguacacuuucuagaugccuuucacauugaugaucucauauaauaaauagagguaauaaaggaaauggauccaaugcaugaguagcguauuagucuaucuuuugcugaagagaauucugaagaugauauuguuuaauuaaaagaucuucauuagugggagaaggcacagugugauguuuugucauucaucuuuuuuuauuauuauugagaagggaucucacucugucacccaggcuggagugcagugauacaaucacggcucauugcuaccuugaaauucugugcucaagcgauccucccaccucagcuuucugaguagcuugaguagcugggaccacaggcacauaucaccaugccugucuaacuuuuuuuuuuuuuuuuuuuuuugguagaaacaggguuuugcuauguugcccaggcuggucucaaacuccugggcucaagcgguccucccaccucagccuuccaaagugcugggauuacaggcgugagccauugcacccccugccguucaucuuauucacugggaauuaaagacaguuaugaauaccagcgugcagcuggggaaagaacagauuccauaccccacggaaugcggucuggucauugccuugccucuuaauagggucugaccucaggcaagaccaucucugaguauguauuugccucauaauacuauaaauaucaaacauuaccaggaagauuuauuacacacucauuaugugcacagcacgauuuuuugucauuaaaaggaaagagagcuuccacccucaagggauuuccagagggggucaaguaaaauuauauuucucuucucucuuacaaaguuccacugguaaguaaaggcagguggaccuccauacuacuggguuugaucugauuuuauauauacauacauauauauacacacacacaugaaauuauauauauguacauaugaaaucauauauauauaucacagaaucuuuguagaguaauauuauugaguaguuuuuuuuuuuuuaaguagguuuaaaauuaguaccucuugccuggaugucaucuggucauagaaaaauaguaaaaauaaaguuaguaccucuuacugaacagguacugaaacacaagauagagaauauuguuaagauaugguaacaauuaacaauaauuugggcuuugucuuaauaaagauacuagauauagauagauacuagauaugguagauauguauagguagauuucuauacaaauaugucugauuucauacauauuguauauauauuuuuguuuuuuuaagagauaaagucuuauuuuaucaccagaguugaagugcagaggcauaaucauagcucacugcagccuggaacuccuggguucaagccaucuucccaccucagccuccugaguagcuaggacuacaggcuggcaccacuaugcccugcuaacuuuuaaaauuuuuuuguugaguuggggucucacuauguugcccaggcuggucuugaauucuuggccucaagcaaucugccugucuuggccuccgaaaagugcugggaguacaggugugagccaccaccauacccagccugauuucaucaaaauauuuacaaaaaucuuccucugcuuuucauucuuucuuucuguaaugaaagaaccugauuuuaugcacucaguuuuuuugcuguuagauaauacuuauucuugacuucccaucuaccuccuacuugaagcauucuugcuacaaauacauaccucagugcuuauauaaucugccuaaacagcuuccaggaacuagaaagugagggggaagaugcuguaauaagacuucuuuuuuuccuacuauuuucaauauguuccuuuuuuuuuuuaguuuacuugcugcuuuauuggaaaguguucuggcaucagcucuuuuuaaaucaugcagauuagaaagauuucucacaauguuuuaauuugaucaaaacucggaaacacucaccuuuaauguccuaugaaguuuagguagagagucuugauguaacagaauuuuucugaaucuuuuacaggaaagauguaaaaaacaaaacaugcuacuaucaaagauuuacuuuuuuaaaaagcaguuucugguaaacaucgauuuaaacagucauauuuacaaauuaauuuuaaaaaucucaucuuguuuccuuaguacccuaucaauguaugguuagaaauagaggacuuguaugaaggagaauuauuuagcauucaauucaaauagaauacgaucucauuugaagacuuguaaaguauuugagaauuugggcaagaauuggucaguugguuucacugaauauaaaucacagcaugcuugaucauucuauugacuggcuguaauuuaaagugaugaccuaaaacuguaugucuaaacaaggaaaaucuguaagugauuuagguacugguuauuuuaaggaccauaccuuuuucuaaccugagauaauuaggggauauacucagguuauuguacauaauuguuauuuguuaagucacaaggauuuucuccugugaaauccuuacuaauuuuuacuaauuugaucuaguaaauuucuagccuauuaauuugguccuagcauauuaaguucacuuaagcagaagaugcaugcuauuugaugugcuugguuuuaauuuuacaauguuuauuuggcuauuguaagcagccaugccugcucucuguacaugucauacaaagacuuacucaagagcugucacauucaaguauuugaauuaacguagaagcaaacauugaaauuagcgucuacaaaagcaagcacagucuuuuagaacagaggcuuccaacucucacaaguaugggagucucuuauacucaggaacuuucaaggccucuucucaugacagaguauuuuuaguaucuguugauuuugaaaauaugauugccaaaaagccaccaugcauuuaguaacacuuuaaaaguaaaaguuguguuuuauugaucauaacauuucuauccauuuggaaauuuauagugcauauaugugagcuauuuauucugugguauauagucuugucucuauguggauucuguggauccucauaauaaccauuaagucuucuggaagucaacagcucauaggaugggaacauguucuuuaggguaacuuucuuacucuguuauuauuguuaaaagugugauuuuucuuuaaguuuuggucaaugcucuaguuuaaaggcaaccuaaaaucagaucacagaaucuuuguagaguaauauuaccgguuaguuuuaaguagguuuaaaauuaguaccuguugcuuggaugucauguggucauaaaaauaaaaaaaaaauaguaccucuuacuguacagguacugaaaccaagauagagaauauuauuaagauaugguaacaaugaacaauuugggcuuugucuuaauuaauaaagauauuacaucuuagauccuauuaaaacuuucuuucauguuacagcuguuugaaagucacaaacugaauaaagcauguugggaaagucugucuccagagcaaauugagguuuccuuugaauaguggguuccaaucauugauuuauuccuauuuuagauuugugguccugccuucaucugguugagccuagugugugguuuaucacauuagaauaagagaaauacugugugcucccuaaauuauaggccaauuuguauaauggauguucuaucugagauguaugucagauuuccugcuaagaauacuguaagcuugagauuccccucuuaguccaguacaggagucucuuggaggaucaguugguaauuuccauugaaggaaaagaaggauguguucuuggcuucccuucuuuuuuccauauuccuuaaggacauauacuauguuuagauuagcuggaugcaugucgcccuauuauaaaugauauaauauucuaggguucauggauguauacauauguauuaaaagcauaaaaacaaaaagggaacaaugccaaauucaauauaguaguagagggugggauaugggacucgagagauaacaugaggggcuucgauuguacuugugacaaauuuuucuaaaacuugguaguggguauguggcauucacuauauuuuauauauuuuugcauuuuaauaguaauaguaauuuaauauuaacaaaggaagaccugauuguuuaccuuauucauaccagaaagaagggcugugguugaauuauuaugaaaccaaagggcugggcacaguggcucacgccuguaaucccagcacuuugggaggucgaggugggcggaucacgaggucaggagaucgagaccauccuggcuaacauggugaaacccugccucuacuaaaaaaaaaaaaaaaaaaaaaaaaaaaaaaaaaaaaaaauuagcugggcgugguggcaggugccuguagucccggcuacucaggacgcugaggcaggagaauggugugaaccugggaggcagagcuugcagugagcgagauucccccacugcacuccagcuugggugacagggcgauacucucaaaaaaaaaaaaaaaaaaaaaaaaagaaaccaaaggauuuuuuuuuuccuuuccauuccugccuucucucauucccucccuccauuccuucugguaaaugaugcucucuaacccugucucacccuccuuucuccaccuauugacauauaguuaaucaccuacaauggacaccuugacaaaguuauuuuguauauuuuugcagauaguuuagcuuuggagucagacaggccugguuucuaaguuuuuuguuuacuagaugugggaauuuaggcaaguuaccuaaacacucugaaucuuguuuuuuacauucauuagguguagauuauaauaauaacuaccuuuggauuuguggugaagauuaaaugagauuguguauguaaggaucugguauguagaaucaaugaauauuagugcuguucucauuuuugguaccccauaguaccuugcacaguguuaggcacauagaaccugcucagaaaauacuuacuaauugacuguauauuacaucuuaauaaaaucuuguuaaauuguuuucaggaggacuuucgacugcauuuuagaaauauuucaagaauuauggauuguguugguuguuuuaaaugucgucuguggggaaagcuucagguaagcaaauuuagucauuccuauuucucauuuacccuuugcaugaauaauuuucuaauuuuucuuuuuuccuuauuucuauuacagacucaggguuugggcacugcucugaagaucuuauuuucugagaaauugauagcaaauaugccagaaaguggaccuaguuaugaauuccaucuaaccagacaagaaauaguaucauuauucaacgcauuuggaagguuaguuugaauguacugaaaugcuucugguagccaaguaagucuaaugcaacauauaugcucucagaaaaaacuggguaaggaauauccuuuuuauuuuauuuguuuauuuauuuuugagacggaguuuuggucuguagcccaggcuggagugcaguggcgugaucucggcucacugcgaccuccaccuucuggguucaagcgauucucccaacuuagccucccaaguagcugggauuacaggugcgugacaccacgccuggcuaauuuguguguguguguguguguguguguguguguguguguauuuuuaguagaaacacgguuucaccauguuggccaggcuggucuugaacuccugaccucaggugaucugccaggcuccaccucccgaagugcuggauuacaggcgugagccacugugcccagccaggaauauuuuuuuugaagaaaucauuucauuacagaauuaugggauauuaugaaauaccuccaguauguagacauauacaauuaguacaugaucgucuuuauuuuccucuauugacuuuuauaaucauaauuagggccgggcacgguggcucaugccuguaauccuagcacuuugagaagccaagguggguggaucacuugaggccaggaguucaagaccagccuggccaacucuacuaaaaucaaaaaaaauuagccaggcaugguggagcaugccuguggucccagcuacucaggaggcugaggcagaagaaucgcuugaacccgggaggcagagguugcagugagccgagaucauaccacugcacuccagccagggugacagagcaagacaucaucucaaaaaaaaaaaaaaaaaaguguguauauguauguauaaaaucauaauuauaauuacucauugaauuuuaauauucaucuuaucgaauuuguacauuaaaaauugcuuaaaagcaguuuuuuuauccaauuauuuuucugauagugguagaaaaaucauguuguuuaacauagguguacauguaaaucucuuugugaacucaccauuauauaaaaagguuaauaauucuuuuaaaaauaauuauuuccuaucaaaaugauuaaagaaaagcaugaaauaaggaacuuacauuaaaauauuuaaguacagaugcauuuccuucuggccuaucaugcaagaaaugcugagauuuauaaaaauuaacauuuuuuaaaggacuacauuuccucauuuaaaaaauauuacaauuuugggcuugaaauaauugaccuucaaaauugugucucuagcauccaagggcuagauaguuaauauuucauugauuauucuguuuuuuucaugaucgagagcagagcuaagugcacuuaaaauaaggaacaaaauuuacuuuacaaaaauuagugaaaacaguguagucauacguuuaauacucuuacucuuuauaggccaauagcauugauucuuucuacauuuacuaaauaugguguauuuuaaguauucauauacuuaugcauuuaaaaaugauauuucuguguuuauauacuuuauacuuacguacuuuaauauuaagcauacgaauacuuuuaugaauacuuauaccuaaauauuguauuauuuguauacuuacauauuuuauaccaaauacuauauacuuuaauauuaagggaguauacuuaugaaugcuuaaaauauagaaguauuuuaauauuuauguaucucauacuuauguauuugauugauugauugaccgacgugaucucaguuuacggaaaccucugccucccaggcucaauagauucucccaccuuagucuccugaguagcugggauacaggcacacgccaccaugccuggcuaauuuucuuguuuuucauagagagaagguuuugccacauugcccuugcuggucucaaacuccuggacucaaguggucugcucgccuuggccucccaaagcgcugggauuacagacaugagcuacugcaccuggcuauuuuauuuauuuaaaagaauuugauuuuuuagagauaggaucuggcuauguugcccaggcuggagugcaguggcaugaucauagcucacuguaaccuugaacuucugggcucaagcaguucuccuaccucggguuuccaaguagcuacgacuacauggcacacacagccaugccuggcaauuuuuaauuuuuuuuuguagagaccaggucucccuguguuguccaggcuguucuccaauuccuggccucaaguaguucucccgucuuggccucaaaaaauacugggauuacaggagugaaucacugcaccuggcauauguauuuaaauacuuuuaaaauaacuaauuucuagacauuaauaucuuaguuuuaccuugucgaauuaagaacuaaaauauauuaaaauacauuaaaugguuuaugcaccuuaaauuuauugaaauaaauuacuuuaaaaauguuuuaaaaugcaaagugaauaacuuuuacagauaaaauuuaucuaagaugguuucugagugaaauauuuuuugguuacagaauuucuacaagugugaaagaauuagaaaacuucaggaacuuguuacagaauauucauuaaagaaaacaagcugauaugugccuguuucuggacaauggaggcgaaagaguggaauuucauucaaaggcauaauagcaaugacagucuuaagccaaacauuuuauauaaaguugcuuuuguaaaggagaauuauauuguuuuaaguaaacacauuuuuaaaaauuguguuaagucuauguauaauacuacugugaguaaaaguaauacuuuaauaaugugguacaaauuuuaaaguuuaauauugaauaaaaggaggauuaucaaauucauauaugauaaaagugaauguucuaagucucucaaacuagcguuuuauguaauaauauguaauauaaauaaaacuaugguaaaugugacaagcauuuaauaggaaaaugcuaaggaggccucauaaaugacccauaauuaccaacguagaauuuuucaguacauuuaggguugcuggauuuagcaaauaaaaauaaagauugcccaguuagauuugaauuucagauaaacaauuaguuuuuuaauauuuuacauggaauauuuggaaaauacuuauacuaaaaaauuauuuguuugaaauucaaauuuaacugggagucuuguauuuuaucuggcaauccuaaaauacauugguaugaaacaaaucacuuuuagaaguauauugcuauuuugauuggguuguuuuuguguguagaaacguacaauaacaacucaaaggcacaggagauuucuaaacauugugaaaaguugaauagauuauauauuuauucucauaauacuuucacuaauacuaaauaaaauuuggggaacacuuuuuauuuuuauauaauuuccaauuuacagaaaaguuucaaaaauaguacaaagagcucucuuacccagauucacuaauuguucauacgugcuuuaucuuucaugcuuucucuguacacacacacacacacacaaauuuuuccucaaucauuugaaagucaguuauaggcaucaugccccuuaaacccuaaauacuucaguguguaauacugaauaauuacuaaaaaugauuuucucagaaaaaaaaacucccacaauucuggaacuauaauacuguaagccuuagaauaaauaauacuuucaaguuccaaucuaaaguucuuuuugaguuuuguugcccguuuuaugcuugauguguauaguaauaggguaggcuauuuauuuuauuaaaauuuuuuuuagagacaagguuuugcuguguugcccaagcuggaacuugaacgacugggcugaagugaucuucccaccucagccucccaaguagcugggaauacaggugucugccaccauacccaguuucauuuuuguuuuuuauacccgaaguucauuuccuuugucucccuaaaacugaacuguaauuuugggagguuuucauuaguggaagcucuucauuuauaaagcuauuugaagggguuuaggaauuuauaucacaugguaauuguagagaaaaagaagcuauauaccucaaaaucgugcccucuuuacauaugucuuaucagguauaacauguugaaaugucacauuaguaguaaagugggguuuauuuauauagugguuaagaaaugucaguuuacacugcuguauacuucuucuucugugucccuaaggccugguacagugccaagcacauacuugguauccaauaaauauuuguuggaugaauguaugcauauguauucaguauauuuuaaaugaauaaucacagaaguaaguuuaauaauuuguccuauuuuucucugucacuuccuuuuucucuaaggcaggaaaggaaagacauuaaaccauuaauuaagucaauccucuuggagacucaaaagacuaugaagugaucacucuauauaaaauauaaauacaguguggguucaaauggccauuuuuugugugucccucucucucaucuuaugcuucccuuccuuuuuuuauuuuuauuuuuuggagacggagucuugcugugucgcccagguuggagugcaguggcgugaucuuagcucacugcaagcucugccuuccagguucacgccauucuucugccucagcccccugaguagcugggacuacaggcgcccgccaccacgcccggcuaauuuuuuuuuuuuuuuuuuuguauuuuuaguagaggcaguguuucaccguguuagccaggauggucuugaucuccugaccucgugauccacccaccucgaccucccaaagugcugggauuacaggcgugagccaccacgcccggccucuuuuuuuuuuagcugccaaucuuuuugaaggaauauucuuaccucuacuuugucaccuucuacuggcuccuuaacuaaaaucugccauuuggcucucugguuaacagucccuuccuguaaagucuaaaaucuuaauucuaaauccacaguuuaauucacaagcuaguacuugacuuuuuuucuguauuugacauuuuugacaaccccuacuuuaaagauuuauucccuugacuucuuacauuuugcucacuccugaaccaccccccaccuuuuggccucuucauuuauuccuuaaauguuauuccucagaccuccauuuuuuuuuucucucuuaaucacaacaccacuucucacgcuuggguaauuuuaauucagcaguuccuaaauccuuaucuuuagccagacuccucaauccaucugccuguugcacuuuucuugguugucccagagacaccugugugugucuuaaaacauucauucucugcaaaaccuacucuaaugccugugucccuuacuuugguuaauuuuagaaccauuauauucuaaguuuucuaggcucauuccucuccuccaccuuccccuaucauuuagugucuaaguuuuacugauuuuaucuccaccucucugauacaucacucuuucaucuucauugcuauuauuaauaaauaccuacaguacuaaccugccuccuauaccuagcuggucuccucucuguugcucaauguuaccacagcaggcuuucuagaagcacucugacaguguuacucccuaauauccuucagugacuucaggaacuuucaggagaaagccaaacuccucuguuugguguacaaggucuucugauguguuuccuccaccgaauguucuggugaaacagacuuacacuucuucagaagccacauuuggccaggccucccgccuugguaaaugcuguacucuuugcaucaaguaugcuagucauccuuccccacuuggaaaauuccuaugcaucuugcaggccugacauaagcauuuccucugugaaaccuccuuugcuccacucaaggagagucaucuaacuuccacuuucgugucaccacuguaauuacaaccuaccucuauuguaugucacuuaaaucguacuguauuguuuuauuuuucaaaagucuuuacuagaaugugagcuccuuaagggcaggaaaaggaaccuuuuuauuuuuugcaucuccauagcauaguuuuuggcauaugaauguuuaauaaauguuuguugaauaaauugauuuuaaagugacaucuuuauuauauuagagguccuaccuauauuccaaauacuuucacucccuucacuuuacagcaagggucaguagagucccaaggauuuguagacuuuagggggucaauaaagcugaaauuguauucaagau

SEQ ID NO: 17527 - RNA, 21515 nt, Homo sapiens
uuaguguuuaugaaacugaaguugucuuuucuuuucaccagcaucuuuaauaauuauugaugcccaaugaugauuccuuuguguacuuuguuauagcuuuuauugccagaugauauaagaaucauguauagguaacagaaaucauguuuugaacauuucugacacuccuacauccccuacaucauacacucuuagccagguauccauacauaccuaaagaguccuuggaugagcuugggaaacaauaaauuuccugaaauuauaguauacgcaaaauuguauguuagaauuuuuccuggaagaggguccagaccuccacauccucaacagggaccuaucgucuuacauaaaccaagaaaacccagucacauauuagcaaauauuacguugaaucauacucuuuaaaaaguuauggaugugcauguauauuuucaauuaaccaacaaugagcuuaaucacaguagaugaagaauauguaaacacuuucugaaaggaggaguacagacauacccacacauccauguuuuauuuaagaagaugaucuuaugaacauuaaguauguguacuauuuuaaaauaauauucaaaaauccacaauccaucuggguuaucaaauaguuuacuugcuaaagaaccuaaaggaccacaguaaauauacucagaaaagacaagaauauauauguaggagaacugaaucaaacagauuuuauucaacuuuuuagaugaggaaaacaaaugauacaaaauaagucauaagaaaugcuuucuuauaccacuaucucaaaccacuuucaauauuuuacaaaaugcucacgcagcaaauaugaaaagcuucaacacuuucccuuuguaacuugcugcaauaaaugcaacuuuaacaaacauacaaauuucuucuguaucuuaaaaguugaauuacuaauuuuuaugauguuacucauauuuuuauucauauacuuuuaaugacaucauuaccaauacauacauuauuuucuuuaacuuuauuuuuacaauaagccaacaucugucaugcagccaucaaaaaucuuacaguaaauuacacagguuuguaguccaauuuagacuccagcuucuuagaaucagccacuuuucugacugcuuucaugaagucuuccuguacuacaaaaucaugaucagcacgaauugcgaacauaccuguagagaauaaaacaacaugacugcuauauaucacauaugaauuauauguucauuauaagaaaaacaauauaauucuauggaauaaaugugaagcuuagauuuauuacuucugagccaguaguuguaauuugcuaaaaaccacuaucuuuuuucaauuaaaauccacaggccgggugcgguggcucacgccuguaaucccaacacuuugggaggccaagaugggcagauugcaaugucaagagauuaagaccauccuggccaacacggugaaaccccaucucuacuaaaaauacaaaaaaaaaaaaaaauuagcugggcaugguggcgcgcgccuguagucccagcuacucgggaggcuaaggcaggagaauggcuugaacccaggaggcggagguugcagugagcugagauaguggcacugcacuccagccuggcaacagagcgagaccccaucucaaaaaaaaaaaaaaaaaaaaauccauagcgguguugugauuauguucuaaaacaaaaacagguaugaccauuauaugaauauuuaacauccgguucaaggcugggcacgguggcucacaccuguaaucccaacacuuugggaggccaagguggacggauuaccuggggucgggaguucgagaccagccuagccaacaugguaaaaccccguuucuacuaaaaacacaaaaauuagcugggcguaguagugggcaucuguaaccccagcuacuugggaggcugaggcaggagaaucgcuugaacccgggaggcagagguugcagugagccaagaucgcaccacugcacuccagucugggugacagagugaggcucugucucaaaaaaauaaaauaaaauaaaaucaggcuuaaauggucccuguaucugauuguagcucuuaauaaaaacaagcauaaaaaaccgaagcaaucaaaacuaccaacacauacacauuuuaagcguaacuuaacuugacaggaagcaauuugcuggaaggcacacauuuaugggggaaaaaaaaucuugaguaaguuugauagccauucuuuguuaauaaucaaaaacguugagaauagggaaucauauagaaagccaacagcggguuuuagcaaaacucggagucauuauucauguguuaaaauuuaccuaauuuauguacaaauugguauuuuuauuugauucauauuugaguaucacaacucaauuuuuuccuucaacuuuuugacaaguaccuucucaaacaguauuugacaaagggguaaaaguuuccuuguaugcaguuuuuuaaacauuaguuguguuauggauaugggucccagauuuugagauaauccuaacucaugauaaacuaaagcagguaaguuuauugcuaucuacuaauuaaaugaauucuaaaauuuccacugaggaucugccuguauugaauuuucacuuacauaaaaugagggaguuaauauagaagauuucaaggauuacuuccuuucuagauuucuacauaaggaaacaaucuauguuguccuagaaaccgggugaauggaaaugacugauuuuuaaaaaauaacaaaguuucaaaacuuguuuagaaagcuacagugaaacuagguaaguuauuuuuguaaaccuugcacacauggcuauuuuccaaaucacuuuagugaauaaguaaaucugcacaagagaugccuggccaggccugguagcuugugccuguaaucccagcauuuugggaggcccagguggguggauuacuugggcccaggaauuugagaccagccuggacaacauggugaaacccgucucuacaaaaaauacaaaaauuagcugggugugguggcgcacgccuauagucccagcuacuggaagauaaaggagaaaugaucaggucugggcuacagggagcagugaucaugccacugcacuccagccugggccagagugagacuccgucucaaaagaaaaaauaaaauagagauguauuauaauccaaaagagauaaugucaggaccugaacaggaagggcaacuguaguugaaucaaguguauuuuaacuuacgaaaaauguuaacaaaaaagccuucaagucuaaaaagaagauaaaaauuucaguauguuuccagaugugaaugucccaccuaguuaaaaaagaacuacaauuuuaauccacacagaaguuauagcucauuugcaauaacuaaagguaaauuuguaagaauauguaaggaaaaaaagcguauauuuugauagcaacagccuuuagguucacugcacagcuugcauuuggauuacaaucuaaccaaagcaaucuucugauaauaauuuggucugguuuacauuuuggaaagagaaugucauaaauuacucuaacuuguucaagcuauaugacaguuuaccucuaaauaguuuaguuuauugauaacgcucugugagcaugauuuacccuaauuugcauugacagcauuucuagacgugaacagaaguaucugaccugcauaucugaugcagauacugacucacagcauacccaauacccaugaagauaccuguacugagaagcccucccugagcagccacuuuaaacacuguguugaauuuacuaaggcuaaacaugauaugaaaagcaagaggaaaucacauauucuaauacuuaagaaaaucuauaaccuauaaagucaguaacuauacuguagaaguuuauuuuuucuauuuaaagauucuguauggaagacaaaaacuaaaugauucuagguaggguauuaaagcuacuugguacuggaaauaaaaauagcaucacacaauuuuuacauaccauguagaagugaaaaaaauaguaucacacaauccacagagaauuauauuuaaauacuacauuuuacacaaauggcaugaucacauaauucauaaaucaaucuuucaaaacacugcucacagacuaguauuagacaacauacacaauucauuuugcagcagauaccucuggugcuggcccauucuaauuccagccacaggugugguaggcaauucuguagcaccucagacuuacuuuagggggccaguguucuauuacaugccucuccuuccacauucugcccuaaggcagguagaagugcaaaggagucaacacuaccaaggacaaaucucauccaaugggggaugaguacugguaaaucaauguucuagucucccaacuuucagcugggugauccuggaaggcauucuguaugcuucucugagaucuaaccucccuuuccuacagcaccuaccucaauggugcacccucauauuagcuuucccucuuuccaucucacuugcccugcuucuccuauuuccuggaaucgauuccuaaaagaacagcaugaacccaaauccuugcaaagucuaugcuccgcuuucagauaaacucaaaacaguuucagcaaauuuuaaaaaucaaaaucaauaguaaaacuguacuuuaaacccuuaccugcuucaguacaaacauuucucagaucugcuccauuaaagccauccgaaagcuucacaauugcuucauaaucuguuuagaaaaaauacuggaaauuaguuuuaaaaauuagaccuuuacuugauuuaugcccacaucgaaaauuuaaacugaagagcuuacuuugaguuugaucagcuagacaucagcucuguuaacuuuccacaauauuaauauccaaaaacuaagacuucuguuaaauaaaccagcaccaagaagaauuagacacaccccugaaacuuuaaaaacaggaaauaucaccaaaaucucaaaauaucuuaaucuauuuuuauacagugaaauagcuaugcacaugugaacuccagauaccuguuaagcugugacucuuaucaaaacuguaaucaaaucuuggauuugaauaaaccuauaacacucaaaaccaauuauaacaauggaauuuacuuuguuuacuuuaaucauacaagccaaauauaaaguauagcaaaacugaaauguaaucauacauaauuguaucacauggaauuuuuaaaugcuacagcaugcauuagcuagcuucucugguuucugugcaagauucaaguggugaaguaucagaucuaugguagcaguaauaaagugaguucuccauccacccacauaacagacaugaaucaaagagcuauaggauugggguagcaacaauggaucugauacagaauaggaagagaaguaagacagcacaggcuacuacaguuugaauaacuuugaugaugcaccguuuggucaggcaauauagggcaugucguucucuauuugaaaucacacauauauucaugaauugucuuuaaucagguuuaaguucauuguaagcuuccugagagcaagaauucccaaggcuagcacaguaucuggcaucuagcaagagcucaguauuuguggaagaaaccuauacauugacauccuuuguucaguucggucuuuccagcucaaaacucucuaacaggggcaaugaagauagugaaauucaacaaucagcuauuugucauuauucuggaccauuaacuucuaaagaguuuuuaaggcugccuggaaauuauacuagauuucccuagucuggaggucagcaaacuuuuuauguaaagggccagagaguaaauacuguaugcuuugcaagccauaugguuucuguuguaacuauucaacucagcuauuccaguaggaaagcagccauagacaacagauaaaugagcaugcuuggguuacaacaaaacuuuguguguuuccaaaaacacagggcaggcagaauuugguucacaagccauguuuuacuggccugcacccuaguccaaucccucacuuccauagauaaugacuuuauaccuucuccuuuguccucaaaucucuaagaacacuucccuaucuucauucugaacgugcauucuacuucacugagaaaacagaagcauucagaaaaaaacacuuccacaaguuccugcacuaucuaagaaccugucaucauaagcaucuauguacucugccuuuccuccagucucauaaaaguacacauauauauagggccaaucccucuucaaggaaagaacauugccaauuucucuuucuccuaggucauucccaguagcauuauuaaaaaaaaaaaaaaaagggcaggggggucauaaacucuuccaucuuauagaaaacucugccaacuccucaucggcauuccccuucuacuucuucugcccccucuguagaacucuuaaaagaaaugucuaaacucaaugccucuccucccaaucucucugaaacccaucugaaauaggcuuucaccuccaccacucccaagaagcuacuuuugacaagauuaccaaugaccuccauauaguuaaauccaaaggucuacucugagaacucuuuaucugaccuauugucagcauuuaacaggaaucaauuuaaaaaacaaacaaacaaacaaccaggccgggugcaguggcacacgccuguuaucccagaacuuuggguggccgaggugggcagauugcuugagcccaguaguucaagaucagccugggcaacauggugaaaccccaucccuacaaaaaaacaagccaggguugguggugugugccuguagucccagcuaaucaggaggcugaggugugaggaucauuugaacuugggaggcagaaguugcagugagcugggaucacaccauugcacuccagccugggcaagagugagacccugucucuaaaaaauaaauuaccuucuugguaaggccuucccugugcuaauccucccugucauuuaaaaacauauccucaugccugguccuggcacuucccuaauuuccuaucccccuuuucuuuuuuuuuccccugaaacagcgucuugccaaacuggagugcagucacaugaucauagcucccugcaaccucaaacuccuggccucaagcgguccuucugccucggccuccaaaaccauuaggauuacaggagugagccaccaugcccgccccccacuuucuugcuuuauuuuucuccauagcacuuaucaucaucuauuauacuuuguuuuacuaacuuuaucuguuuuuuccuaacaagaauauaaguucucuaauggcagaaauuugucuguuuuguuccuugcuauauugucagcccuuacaaaacacuuacaaugguuccuagcuuauaguagaugcucaauaacuauuugcugaauuuaaaaccaccacauuugcugaauuuaaaaccagauuuaggaaacuaucaguaauuucuaaaaguauuuuucuucauuuaccaaauguaaauacauauaaaauagaugacuuccuuaccuauuucaccaugcuuuguaaugggaccugcauggauuuucaguaugucuaaucuugcuuguucauuuggcaaaucaauaucugaaaauaaaaaauuauuuuauaguccaguuuuaucuuuuuuaaaauacaguggaaggugaagugaaguauggaaaaagaaaugggcacaaagggaaauggacaguagguaaagaaucuuaacucacguauuuuucuaucuaaucuuccuggacgcagcaaagcaggauccaguguaucuggucuguuuguagccaugaucauuuuaacucuaugcagaguaucaaauccauccauuugauucaguaacuaagaauauuaagaaucagauuuuacaaaaauucuaaccauuaaaaaaaauagcacacaccuuuuauaugucuaaugccaugaaauguauugucuacagauagauauguucuaucuucagaauggucauuugauagaauucuuuuucucucucuuauauaaagggauauacuuucuagccucaaaguucuaagcuagauuauguaccuuuuaauagcuauguaucuuucuauagcuaccagguaguuuuaauaaaucugaaggcuuccaucaugucaagaauuaugaaauuaaacuauguggaucuaauuuccaauguccaaaauuucaucaauuauuuuuuaaaggaaaagcuaauaauaaaauccaauauauaaagugcuuaugauaugucagacauaacauuuauauuaggauaaauggauacaaagauuuuucuacaaauuugauaauaaacugauaauuuuuuuuuuuuuuuuuuuuuuuuuuuuuugagacagaguuucacucugucacccaggcuggaguacuguggccugaucaucgcucacugcaaccuucaccuccugggcucgaccaguccucccaccucaaccuccugaguagcugggacugcuuuuuuuuuuuuuuuuuuuuuuggagacagacucucgcucugucacccaggcuggagugcaauggggcgaucucagcccacugcaaccucaccuccuggguucaagcaauucuccugccucagccuccugaguaacugggauuacaggcacacgccaccacgcccagcuaauuuuuguaucuuuacuagagaugguguuucgcuacguuggucaggcuggucucaaugcucagaccucaugaucugcccagcugggccucccaaagugcugggauuacaggcagaagccaccaugccuggccuauuuuuucaaauaauucuacuguacacagaaauacuaaaagacauaaaaaauauuguccucaauuucuaaaguuuucuugaauaaaugaaaaaccuuacugcauuuaacaaacucucuaaaauauagcuagucugacaauguguuaguugaugauauauuaguuacuugaauaaaaugaguauuuguguuauuuaaaaauaucucaauuuaagguuucuaagagauuuuauaauuuccaaaugcuauguuaucuucugagcggaucuguauaauuuaugaaaaaagauuuuucaaauacuucuaaggagaaagaauuugacacugcauuacccaugcuaccuaguuucuauuugaaguggaaaauguauuuggacucuugauaucacuuucacagaauuuggaguggggaaagguaaaacuggaggaaggcuuuaugugcauucuuucauucugucaucuauccucuucaauuaucaaaacuauuuuaguugccucagucucagcaauaaagugagagaaaaaaauaauuuuuagagcagcuucauacauaauuauagcucauuuauugccaacagucuuaauaugaccauuacaaaaaaugucuucauaaaacuaccgcaagaucacauucauaagaauuuaaauauaugaaugacugaucuacucaaaaaaacacagaauaguacagguguauaccaaauggaauuuggcagauagccuuauuuuccaguagucauuuucuuagaguuugugauagagaaacauguuuguuccugacaauauuuucaaauuucauauuucauuuaaaauguucuauauauuuugacuaucaaauaugcaauguucaguucuucauuuaauaaacauugguuucuuuauaaacccccuuuaccaaauauuaccuccauuaacguucucugaaucucucugucagcugaaguacccucagaaaaccgacgaccaccuaagauaguagauuuggaaauuuauaugcauuacucuuuuccucuacaaccaucauuuaagaaaacagaacauaacagucuguggcuuaaaacauuaagaugaaaauuaaagagcaagaauuaugcugacaaaguuagacuugauuuugguguaacauuucucauuuuguuaaagugaaagguuauuuauugagacggagucucgcucugucgccaggcuggagugcaguggugugaucucggcucacugcaaccuacgucuccuggguucaagcgauucucgugccucagccuccucaguagcugggauuacaggcaugugccaccacauccagcuaauuuuuguauuuuuaguagagacaggguuucaccauguuggccagauggucucgaucuccugaccuggugaucugcccaccuuggccucucaaagugcugggauuacaggcaugagccaccacacccggccaugaaagguuauuuauuaaaauugguuaaacuaacaucugauucauugugguaucuacuucauacaagucacaauuacagauuaagagagggaaaaagguucuuuuacauuuaaaaaaaaguccuaaaacuuucaacaaggguguuauucuuaccaauagcaucuauuucauccauaaaaaugaugcaugguugaugaucucuagcauaauuaaacauuucucugaucaaacgagcacuuucaccaauguacuugucuacaauagaacuagauacaaccugauuaaaggaaaaacaguaagguaaauauaagauaauucaaguaaaauuaaauuucaauaaguacaaaauaaucuucccuuuaccuuuaagaaauugcaguccagcuggcuagcaacggcucgugccaagaguguuuuucccguaccuaagaaugacaaaagaagucuuaauuagaugguaagguagaaaaaaauuuguuuugagacaggcaaucacucugucaccuaggcuggaguguggcgagaucacagcucacugcaaccuugaccucccagaccuaagcgauuuucccaccucagccucccaaguagcugggaugacaggcaugugccaucacgcacagcuaaguuuuuuguuugucuguuuguuuuucagagacggggucucucuguguugcgcaggcuggucuugaacucuugggcucaggugauccugccacuucagccucccaaagugcugggauuacaggcaggagccaccgcacccggccuaugugaaacaaauuuuuaaaauccuuuuaagaauauaaucguuuggcaaguaaauuuuccaaaaugaaagcuaaauccuaaauagaauuuucauuuaaaauuccaaaguacuuggccaggugugguggcucacaccuguaaucccagcacuuugggaggcugaggcgggcagaucacagggucaggagaucgaaacacagugaaaccccgucucuacuaaaaauacaaaaaauuagcugagcgugguggcacaugccuguagucccaccuacuggggaggcugaggcaggagaaucgcuugaauccgggagguggggguugcagugagcuuauaaucucgccacugcacuccagccugggugacagagcaagacucugucucaaaaaaaaaaaaaaaaaaaaaauuccaaaguacuucugcugucaacauuaaaauuuuaaucaaaauguuauaauuuuuaaaaucuauuuuaaauugacaaauaaauuguauauuuauggguuaaauuaugauacauguauauauugaagaaugauuaaaucaggcaaaucaacauauccaucaccucacaugcuuagcauuacuuugugguuagaacauuuaaaaucuacuuuuagcaauuuugaaauagcuaauacauuauuaauuauagucaccaugcuaugcaauaugucaccuagaacuuauuccuccugucuaagugaacuuuauauccuuugaccaacaucuccccuauccccauacaccaccacaacuucugguaaccaccauucuacucuugguuucuacgaguucaauuuuuuaagauuccacaugaaaaugagauuaugugguaacugucuuucugugucuggcuuauuucacuuaguauaacauccucuagauucauccauauugucacaaaugacagaguuuccuuuuuuaaggcugaauaguauuccaauguguguauuuaccacauuucuuuuucuuuuuuuuuugagauggaguuucacucuuguugcccaggcuggagugcaauggcaugaucucagcucacugcaaccucugccucccagguucaagugauucuccugccucugccucccgaguagcugggauuacaggcaugaacuacuacacccagcuaauuuuguauuuucagcagagacgggguuucuccauguuggucaggcuggucucgaacucccgaccucaggugauccgcccgccucggccucccaaaguguuggcacuacagguaugagccacugcacccggcuaccacauuuucuuuauccauucauccauugaugggcaauuuuuaggcuguuucuauaucuuggcuauugugaaauaaucaugggagugcagcuaucucugacacacugauuucaauuccuuuagauauaaacccagaagugggauugcugaaucauaugguaauucuauuuuuaguuuuuugaggaaccuccauguuuucaaaaauggcugugcuaauuuacauucccaccaguaguguacaaggguucuuucucuuuucucuacaucuugcaaacacuuuugucuuuuuuauaauagcuaucuacuuacaacauggacuaugacagaaacuucuguuacauuaaaauacauuggucuauccugugcacugacuggaucuuuuacuuaugaauauuuuaauaucaagcauugauuauuuggaaacuacugguugaguuaugcaaaucuuccaaauguugacauuuuccaccacacauuauaaaaaauuuuuguuauucucaccacuuaucucaucagaaaagucuuuaaguauuaauauauuagaaagcugccguggcuggacauuguggcucaugccuguaaucccagcacuuugggaggcugaggugggcggguugcuugagcccaggaauucaagaccagccugggcaacauggcaaaacccugccucuacuaaaaacacaaaaauuagccuggcaugguggcacacaccuguaguaccagcuacucaggaggcugagguggaagaaucaccugagcccaagaggcagaaguugcagcgagccaggaugaucacgccacugcacuccagccuggguaacagaguaacaccuuaucaaaaaaaaaaaaaagaaaagaaaagaaaaaaagaaaaagcuucaaccacauagugccagauauauguuucuaaaaauucuaauuuucacuugacauuucauauuuuaucaauggcaauagauggugucaguuguuuaacaugacaggcuuaauuuguucgcuuuggaaaaaaugugcgccaaauaaccaaaaaccagucuugaguaaucaauaacuaauaaccaauaaccagucugauaaucacagcauaucuguaaaugguccauucaagcaaaaauaguauuccauaaaaagcaaugaauucagcuggcaacuuaaauaacugcacaagugcuuuuccuaaagacaacuaucuuauucaauaugcagcaguacuuuauauuuauuuucccuuuuaucaugaagaacacaaaauauuacccaaagaugaagauuuaacaaaauuaauaauuuuuacuguuucaccaaggacuuuauagugaaacugacuuuuuuuuuuuuuacacugcaaguauguggcagucaagaacgcaauggcuacuaacuagcaccguuucaugccacuaaugcugauucacacuacagugcaaguaauuuaauuuuacccauggugcucuugcaccaucagcacaaaugucaacacaguggaagagccaaacaacauuuuaguuuuuuguuuugugucauuguggggcuacauaugucaagcaguaugcuauagguacauuugcuuuauauaaaaaaauuuuuuuuuuuuuuuuuuuuuuugagaaggagucucacucugucagccaggcuggagugcaguggggcaaucucggcucacugcaaccucugccucccagguucaagcaauucuccugccucagcuucccgaguagcugggauuacaggugcacgccaccacgccuggcucauuuuuguauuuuuaguagagacaggguuucaucauguugguuggccaggcugcucucaaacuccugaccucuggugaucugccugccucggccucccgaagugcugggauuacaggugugagccacugcgccuggcuuaacauuucaguauuauaaaguaguuuugaccuuacagaguccaugaaagcaccucugggucugugaaccacaauuugaggacuguugcacuagaaucacauggccuguuaagauaaauguacugugaggcacaaaugcacuaagcaugccucaaagaacaguagacauaaauauccuaucucauucucacucugaagagaggagaaguuggaacugcccacaucaaauuuccaccuuauggccaggcgcagugguuuaugcuuguaaucccaacauuuugggaggcuaaggugggcagaucgcuugaguccaggaguuugagauagccugagcaauauggcaaaauugcuucucuacaaaacauacaaaaauuaaccagacauggugaugcacgccugcagucccagcuacgugggagacugaggugggagaaucacuugagcccggaaggcagagguugcaguuagcccagauugugccacugcacuacagccugggcaacagagugagaccgugucucaaaaaaauaaaaauaaaaaaauugucuuuuuuuuuuuaauuccuuaauucauuuaucuuauugguggaguagaaauaauucaauaccaaccuggugguccauauaacaaacagccuuuuggagguauuauuccuacacgcugaaauaacucuggguuuguaagagguaauucuaucaccuagaaaagaaguuaaaucuuucuuaaaaaguuagucaagauuuuuaauguacuuucaaauacucuaagucaaauaucaccuuaguuagguguacacaucauaauucuuaauagaccuagacuuccaugcuagguaaaaccauuuauauuaagagguuuugcuccagguagauuuaagaucucuuaaaucuaaaaaauuucaaauaauguuuuuuaaauaaaccacacacuugauuggggugaugguuacacagauauauaacuuguccaaacauauuugaaauguacacuuaagaaucuacauuuuuuuaauguaauuauaccucaaugaaaaauuauaccacaaaaaaaucaguuaagucaaaugaacauauaaacaaaaaacacaacucaaaagaucuauacuaguuugcauuugaaaauacaacacaaaauaauucuaaaaugggggauggauuugacaacauaccaagagaaaagguauauacaauuuuuaucuguuggcauuuugccacggcagcuuuuaaagaacaguauguucugcucucaagacugauucaaggaagaaaaguagagacuagagaaauugaagaucugaaaguccaauuuaaauuacuuauaguaccaguaacuuaagagagaaauuucuuuuuuuuugagacagagucuguugcccaggcuggagugcaauggcaugaucuuggcucauugcaaccucugccucccggguacaagagauucuccugucucagccuccugaguagcugggacuacaggcgccaccaccacaccuggcuaauuuuuguacuuuuagaagagaugggguuucacuguauuggcaggcuggucuugaacuccugaccucagaugauccacccaccucagccucccagagugcugggauuacaggcgugagccaccaugccugaccgagagagaaauuucuauugaauaguuguguugggcuaggugcgguggcucacgccuguaaaucccaacacuuugggaggccaaggcuggaggauggcuugaguucaggaguucgagaagagccuggacaacauggugaaaccccaucucuacaaaaaauaaaaaaauuagucacaugugguggcgcaugccuucagcuacuugggagggugaggugagaggaugacuucagccugggagguagagguugcagugagcugagacugcaccacugcauuccagccugggcaaaagaaccagacccugucucaaaagaaaaaaaaaaguuguguccauaugugcauaaagcgugacugggaaaagccagaagugagagaaaucaauacucuaaaguguaaaguaucugcagacaguaaaggauacugcauguauacaugggauucuuucugcuccuauggcuaaugcagcaaaucacuguugaaagcaaguuuucaccguuuuaugaagcaccuguucuuccucuguugcccuuucauuaauacaggugagaacugccuuuuuuuuuuacacuuagaccagugcuuccucaaguauugucaaagaaaaauuugguuucauaaucacuuggaaugcuuguuuaaaugcuaauuccugugccuacccccaaucuaguccaucaaaaccacucagagggccuaguaauguguauuuuuaauaaguguuccaaaaaaaauuaauguacugaaguaugagaacuggcuuaaagcuuaaaucagauuguguaagacauuccaauuauucccauuaauuccuaaauauucacagccuaauuuaggauaaaauccauaggacaauguaauuugcuuuacagauaacaguuaagaagcugucugugcuaugaaguaaggcaauccugauuugacuguucaccuaaaagcuuacaagauuuaagacaauccuaaagccagugguuuucuggaauggcagcaaacagcuuuaacaaaauaaaauauuuaaggaacagguacccuacucuucuguaagagugggaagcuaguauuaaugagguuauggaaaaaacucaucacacacauuauccaaauaugcucugacccaaguaacuuauuaugauaaucaaaaccacaggauaucagauuacaucaauuauuuuuagcuuuuucuccguuccuuugccacaaaaagagcaggauuuuucuaacaccaaauuaucuccaaauaaaaaaaaacaguaauuuucacagcuagaaauucagugcuauucuucuuagcaagaauaguaaauacauaauauucuuaacuaccauuuagacaaaaaguacuuuuucauccuguuucuccuguuaagaauccuaaaacuaguaguauuuauuagcuaaguucagagaacaaggcacacaguaccaaccucucuuaauucccggaucuguucugauagcccuccaaucucagaauaagaaacauucccaggguccucaugagacauguuauaaaccaguggauccaccucucucggcaaauaucuagaaugaaaagguauguauuuuucuuuugaaagauauauuuucucuuagccuacagauagcauauaaauaacuugcucaagcaagcaccuguagcugaucucauaaagaugugcuuaauuagaaacuaguaaaagggaaaaagugccaaaauauucagugaucucaagaagcauauaucucagauaaaaaccacccuuugugaaaauaaaaggugaacuaaauagaauaagaaacccaccucaugauaguuaguguagucauauccaaagcaacucuuguuccuggcuucagcuuacuuuugucaagcuaguuuuguaaaacaaaagauauuacaucaacacuuaaaaacggaauaacacucuaacgagaguuuaauauuuagaagccaaacacucauuuuuacccuccagagagaacacaaauaucagauuauaaacucuaugcuaacaaaauggcuuauaaaauaaguaauucaaagugauuuccaccugcuccuuaaaagcaugccccuuuguguaaucucaguguaaaaugugaaaugacuaacacacaaagcuugaggcagcaaugguacagugacuuugggaauugcuaccaaagcauuuauagaaaaaucccuuagugaacauuuuagggaaaggaaagggaagcauuuuaaaggugugcucaucagauuuauuuugaaauguacagcuucugggaagaauguguuaaaugcucaugagaguagagaaaaaugcacgguuuccccuuagagauuuuuauuaaaaugcuuuaaauuuaaagccccaaaacccagcaaccaucacucaugccuuugcuacaugacaggcacaugcugaacacauuacacauuagguugaaucauacuaaauaauuucuuggcuuaucuggcuaaaauuagaaucuacuagaucugccucacucucaggauguuguuacuuuucaaagauaaaguuacuuuuuuuuuugagauggaguacggagucucacucugucgcccaggcuggagugcaguggcgccaucuuggcucacagcaaccucugccucccugguuuaggcaauucuccugccucagccucaaguagcugggauuacaggugugugccaccaugcccggcuaauuuuuuuuuguauuuuuuaguaaagacgggguuucaccauguuggucaggcuggucuugaucuccugaccucgugaucugcccaccucagccucccaaagugcugggauuacaggcaugagccaccccgcccgacccaaguuacuuuuuaauaguuuaaaaaacugcgugccaauacaauuucggaaucauauaaauuacugaccacuugucacaggauuuuacaaagagcuucaaauuuaggaagauaggcaaaacacuaggauuaauauaacaauuaaggaaaaaacggcuaagaagugagguuacuugaaaaaauaagaggagaaaucaauaugaagcuauuucaauguuuacaucuauaggaaauacaggcugaguauucuuaaucugaaaauccaaaaugcuccacaaugugaaauuuuuugaaugcugacaugaugcucaaagaaaaugcucaucggagcauuucaaacuuuugauuuuuuuuaauuagggaugcucaaccaguacaacacaaauauucuaaaaccugaaaaaaaaaaagccaaaaucuaaaacacauuucuggcucaagcauuuuggauaagggauacucaacuuauauauacuucggcuuuucuaauguuuuuuagucuucaaauacagucuuguccucaugcaaccugaaauaucuuagaaaugccaacuuucggcauccacagagcccugaaagggacaugaaaaucccuugucaguuuagguaucuaauauuuugacuuagaaaaugucaaccgcuuauauacuaggcaaaauccuaauaggagauuuauaguuccuggauuaaauucucccuuacagccauguucugugaauguuuuaaaaccugaaccugaaaugacaauuaaacagagaaaacucuuccaaugaauuuaaaagaauuaucuaaggacacuuccuaaagaauaauacauaaauugauuucagacacuacugaaugacuugaggucauuuguuggcaucuuugauaacuguaaaauaaaauuuagaauuauuucaacuugcccuacccuaaucuaaaugaccucauacaaaauuaacuuaggccaugguacaguccauaaguaacaguucugaaugucuaaauauaaacacagguaacugaugauaucuaacacuuuuaaguccucuuuaaaaaugacauuaaaauaaaaugucuguuuuccaguucuaaaauacuuuuauuucuaaguggcuauuaacagaucugacugagacaauguaauacaguagaaaguacggaaugccaggagucaaagcccaugguuugaauucaggcuuuguuaauaacuagcuaugucugaacaaaucauccuugugaguuaugggcauaaaugcuccaccugcuugccucaagaauuagagacaauaacuuacaugaaacugcuuugucaaucaucaggcacuauacaaauauaaaguauuaccugucgacgacaacccacaacauaucuugguccauugguagcuuuaacaaugacuagaagaaaaaacauaaaagaacuaauugaaaaauagaaaguaaaaaaauacauacccacguugacagaggguuuaguuguauuucuguccuccaaggagacauuaguugaaggaaaacuuaagucuauucaaaaauacucucucucucugcauuauugucauuaaaauaauaagcauuucaaaagugagagagagguggacuguuucuuuacuaauuaauaagcuaauucaucacucacauuuuucuucaguuaacuguuuaagcacuucacccacgaucuaaggaagaaaauaaaaagcauuacuuuuuggcaacagcuaaauaaaaaagcaaauuaccaucacccccuauuccccaaacuccaucaccuaccugcccaacacucuguagggccuucagaucauuuucagacuuuucauacugcuugguaaguucuuuuaauuguucccuuacugaaauaauacaauuugaacauuuuuaauugaacaguaaucuuaguguguuuaagucgcuacgucucacuuuacuguuuacguaagucuacuucacuuuaccuaaguuucacauccacuguuucaaaccauaaaagaaauaaugcuguuuguaaugaguagguggcauguauaacaacaaaauguuacagagaaagcaccauacuuuuacuuuguugaucggcaauacuuguuuaagcacaucuuaaguuauagucuuagaagauauugacacccugacacuuaggauuugcgacuacaaauccgaaugauaaucacuuagacccuuccucaccucuucaccuacccacguggauuguucucugacauucuacccuaaauaaagucaacaaaugcaguucuccacagaaucauguaauuaugguccuccauuuaauuaaacuacucaugcuuuucaaugaaaaugcacuggaaaaaaaaguuaagcacucaggagguaagggaaauuuguaugccugauacaguacaacacgaaacacaagacgauauggguuauuaugacaacuggaacacuucucucuuaagcuccgcggccgucuuucgacuccaagaacaagccgacucccugagucucaucucuuguuugagcuuacuugacucaagcgccuuccccucuccaagucccgggacuccaccaagacugcccuucuugcacccuaaccugggaaacauccucggcccacuuccccacuccuccucuacuucuuuuucauuuucaccucaaggccgccgauguucugucacccgggcuggacugggccauuucuacacccgaaggagugcugcuccacaagcucagggccggaugacaaagcgccuugucccuggcccuaggccuggucaucucuaaggcucgguugccgggcucggcgaaaggcuucugcuuugucagaggcagaagcgagucgaggcacuugauuaaauggaaagaaaggugcacucacacuccuuaagacggccgucgaucuccuuguguucaagcaacuucuugcgguaguccugaagcgccuuaucucuaggguccgccaugaugagaagccgucucucauaggggaugccgggaauggccauggccguccgggcgggggaa

SEQ ID NO: 17528 - RNA, 120860 nt, Homo sapiens
gcggcugcgggucucgugggggcggagcggucgccgcugccgccgcagcucgggucgggauuugaaagauuagaaacuucggguggagagggcggcggcguugaauguguggcggaagcgcugggggucacggcuccgcgcgccgccggacagccggcggcgucuccacagcaugaauuacccgggccgcggguccccacggagccccgagcauaacggccgaggcggcggcggcggcgccugggagcugggcucagacgcgaggccagcguucggcggcggcgucugcugcuucgagcaccugcccggcggggacccggacgacggcgacgugccccuggcccugcugcgcggggaacccgggcugcauuuggcgccgggcaccgacgaccacaaccaccaccucgcgcuggaccccugccucagugacgagaacuaugacuucagcuccgccgagucgggcuccucgcugcgcuacuacagcgagggugagagcggcggcggcggcagcuccuugucgcugcacccgccgcagcagccuccgcuggucccgacgaacucggggggcggcggcgcgacaggagggucccccggggaaaggaaacguacccggcuuggcggcccggcggcccggcaccgcuaugagguagugacggagcugggcccggaggagguacgcugguucuacaaggaggacaagaagaccuggaagcccuucaucggcuacgacucgcuccgcaucgagcucgccuuccggacccugcugcagaccacgggugcccggccccagggcggggaccgggacggcgaccaugugugcucccccacgggcccagccuccaguuccggagaagaugacgaugaggaccgcgccugcggcuucugccagaguacgacggggcacgagccggagaugguggagcuugugaacaucgagccugugugcgugcggggcggccucuacgagguggaugugacccaaggagagugcuacccgguguacuggaaccgugaguagcgggccgggguuagggcaggacgggcugccccugcaugggccgaugcgcaccgguguggguuugggacuggucgccgcgaagagggaggcgcgugaggccuggcguuuggcuggggcaggauggagauugagcagggagcgucggcagcugaaggguaaacgagcagauggcaaaacccaagcugccuggggucaggaggacuggauaccuucggggguagcgccuccugggugagccgggugcugcugccauccccuggaagugauccaggaccggauccgcagcccgagguuuaauuucgugauccuaccagcuuuguccaccuggggaucugguucugucucauuuacccuaaacagccuaugauuuaaauagcggcacgucuucuggaguaggaagguuugagaggaucugcucgagaaucaacagcuuaguuauggguucaggaaaaguaaaagaaucccuggagggaaaggagauagguuguucccacuggguguguucggagagguggaaagcacugcgugaagcagcucuggcaaguggcuccgcucccucgguggaauacuggauucugucucuuagguccucauuuacauauuuuuguguuugcaucuuaaccuugaaaaauuaccauuucuaugccucgucuuccucauuuguaaaaggggagaaauuguaccuaccucacgggauuguugugaaaguaaauuagaaaauauacuucaagggcuuggaacuaugguugguacuuacgugugauaugaguguuaacaguauuuauuagacaacaacacagacggguuuauaguuagaauaggaggaaggugaccguaaauaucugccagugcaugcagcaaauauuacguauguaauauauaggagauauucaauagucacagaaguuacugaccaccaguauuauaauauguaauauacacuuuuaauuuucgugggcccaaugcccuaacuuagaugucuucauugauugugacaaccuuuagauccuccauacaacacucugcccucuauuagauggauugaugacagcuuccuuucuguauguuaggaccuuaccaucggcagagcccgucaccuuuaucuuuguacucugauagggccuagugcaauauauauucaauaacuagguauugaauugcaucagugauucugauaauguuaaaacauucauauguuaagcaugacuuacuaagauagcaauuccaacaugugucaaaucaccaaauaaaauaauagcaggaaauuuaauuucuuacugcacauuaagaugauacuaaaggcauucauuaccauuuuuauaaggucagauuuagugagaucuguuacaucauucacuuuuuuagauuauauacucacuaaaggcaggguauguuuauauucauucaguucuuucauauucagaauauuuauaugugcauaacgguacucuugugaaggcauuaagaaagauggggaaaaggaaaauccuuacccuuucagagcuucccacucgguguuuccuucaaaugacuuaaacauaaucauagauuuuuuuuccugaagauagaaguaccaagacuuaguggagucagaaaguuggauaaaaauacaggguauccuuggagaggggacggaaaccaagagaugaaucuuacccuuagauuaaacugaaguauauucaccaagaauacugugugcucucuugguuuuugauaaaauuguuaaugccugcgugguacuucacuguuuacaaagugauuuuugacauugauuauuuuacagugauagcaaauuaauaccaacauuauauacaugaagaaaugggcucagcgaaauuaaugaacuuguccaaggccacuuagcuagaaagugaugaagcaguucauucauuagucuagugggggaauacagugcaguaugcaaagagcuucugacccauccaagggugaggguaucaggaaagcgucccagaaaauuuaagacagagucuuacaggaugaauuuaaugaagcagagaaauagagggaagggcauuccagcuagauggggcacauacacaaggacacaggucugaaacugcguggcauuuuaaggaagugaggucuacaccugcaggcacugugacacaugagguggguuugggcuuugaccaaccacagagaccaaaguaugugagggaugguguuuggucagggacaggauggagauugugaagggagcaccugcacaugaauggcgcauuugggacaauagcuggaaaagagacaggguagauaugcagugcuaaggaguuuggccuuuauccugcgaguaaugaggaaccaaacaguagaagguucuuuauacuuacaugugauuaaugacaaugcaaaaguugagcuggagaguuggaagcagaauaucaguagaaugcuagugucauaaaucaggugaaaacuggugggagccuacagaaguuaaccuaaagguaauguggacuucccuuucuccaaccuucuuuccuaaagcaaauagccauuaggccaauuauagcuuauaacuagcauaagagcaacaccuauuuuuaucuauauuuuagcauuuucuaaauaguucucuacaagauacaauccuguggauguccaagcccuuguauaagcuauaauaaaaacacaguagugcuuuuugucuauccuguaauuugccauuucucacaaaaucucauauaacuuuaauugguuucuuaagucucuguguguaaguuuucacacuuucuaggaggguccaguccccguauggguucuucagccuuucuucaaauagaaaaacucauacuauacguugcagcuuuugaccuugcccccauuuuacuuuuccuuuuuagcuguuuuggaaacugucugguuagugguaauaaaaguguuugaaaaaaaauguccaguaaguuccuauguagaauggugguaugaauccauuggccauuuagauuuuuguggccuaauuuagcccacugcaucugggugucaaggccaacaaguuagcuauaccuauucuaaaagaaagauuuuauuuuauucuuccuuuugaacuugacuagcagauaaaauuugaacuaauuugggguacaugaaucagaaaggagaacagaauuugucuucuauuaaugaggagcaauauuauuacauaugaaaaaauaucguaguaaacauuuuuguuuuauuguauguuuagauauucuccuggcugcauguggacauuuuagauaaaaacuaaucauugcugaguaaugguuaagugaacucucuuguuugcaguguucuuccuguuuguacucacuucauagacuuguuuugaggauuauuauauguaacauccuuauuacagugguuggcacauuguacuagguguuaacuauaugugggucucacaaaaacuauacaccuuauuuuuaguucacauacagguuaguaagguuaaccagugcacaguuguugagugcccacaauuucuuguuauuacucaguaccucaucagaggugaaagaaugucuguaaggaacauuggcaagaaaguggccaaagcauucaguaauagcagaugggaaggcauauggaacauucuagagauauuucaugagcuuagaauaauucagcaauucuaggccaggcgugguggcucaugccuguaaucccagcacuuugggaggcugagguggguggaucaccugagaucaggaguucgagaccagccuggccaacauggugaaacccugucucuccuaaaaguacaaaaauuagccaggcgugguggcgagugucuguaaucccagcuauucaggaggcugaggcaggagaaucacuugaacccaggaggcagugguugcagugaggcgaaauugugacacugcacuccagccugggcgacaagagcaagacucccucucaaaaaaaaaaaaagaauaauucaauuccaauggcagugaugugugcaguuugcacuagggaguugugugauuucuauucauugacuaaacuaauaaaguuauuuaauugaccaaauuuuuauauguaguuuccaggagucuuaacuauaaaccacagauuucuucuuuccccucugucacccaccaccuucugguauacuuauacagccuacuugcauuauuguaauuuuaaaccauuuucaguuucagaugcuuuagaaauagaccaguuguuuuugugguauauugcaacaacgggaagauuauauuaccaauaaaaugagauuaaaaaauuagagcuuuucccuuaauuacauaauguuuacaaacuugguguagaugugaccguguuauucauaauaacaauccuuuguguggcacagggcaucaugggaaaauaauggagucccaggggguagaaggcacucuuuuuugaccaguuucugucuccaauaaagcaggacuauagggaucgugccugacccugaaaaaguguuggagacuuuuaucuuuuacucuuuauaacuguguuauuucccacuagccuggacuggaaagcagccuuggacugcauuggaacccugacugcucgguuuacaguaccaaggccccaguuuucugagaacccaccucauccuagaucaagucugcuuuagagugcauuuuagaaugcacagugaccugcuaaaacagaaaaaggaugugaauggauagugacauguauggauggcaggacuuggcaccugaccauggcauuuggggcuucucuuucccuuugaaaugcaccauuacuuuaaaaacggaucuaauaucaguuauugauucaccuuacguauggccaaaauguuauaaugcauguuuugcaagugcuuuaugcaaaugcuuagagcaaucagugugguuuucuuaccccugucaaccaccucugguuuucuuuccucuuuuacuguuuucuuauaaaagagaccuugaguaugcuucucucuucugaauuguauuuugggucuuuuaucuccauauaacucuuuauaguuuguauuuugcugagaacuuugaugucuggaaccuacaguugauccuuuuuuguggagagcaagaaaaaucuggaugugcuggucaaggaauccucugagaauuauggacacugggggaggaaaguguaugucagggaggagaacuagaaggagaauguauuauucacaggaagccuaagaugaaaaauauuggcaaaagagauugggaaauagguaguuauggaauuccuaauaacuagggaaucugaccuaagaccuuuguuuuuucgugaguguaguggaauuuaaacugugcauguuauacaaaaaaaaaaaaaaaaaaaaacugucagcauugaugaaggguacagauauacagagucccuucuguuuuuccacaauacacucuaaaaguucaguuaaaaaguagaacaaggaaaaauuuuuuuauaguuacuguauauaaucuacaguucuacucuuuugcgucuacauugguaaagaaaaaucguacccauaacaaguguugaaucacugacaauugaguagauuacuaggaagaaaaccacaaugcagauacuuucugauacuccuagauuaggagacaagugaaauucaaggugguaaaaaauuggaacuugccuguaccagagaacugaagaaaaacaguagcaaaauugauaugauuguguaaaaguaauuauauuuuauguacgcuuuuuagcaucaacagauugugaacaagauugaauuauacauucauuaauuuuuuuuuuuuuuuugagaugcucuguugcccuggaugaaguacaguagugugaucucagcucacugcaaccucugccucccagguucaagcgauucuccugcuucagccucccuaguagcugggaguacaggcaugugccaccaugccuggcugauuuuuauauucuuaguagauauggaguuucaccguuuuggccaggcugaucuugaacuccugaccucaaguaauucacccaccuuggccucccaaagugcugggauuacagguguaagccaccgcgcccggccuuuuuguuuguuuugagauggaguuucacucuuauuugcccaggcugaagugcaauggcgugaucucagcucacugcaaccucugccucccagguucaagugauucuccugccucagccucccaaguagcugagauugcaggcaugcgccacaaugccuggcuaauuguguauuuucaguagagacaggguuucacuauguuggucaggcuggucuugaacuccugaccugaagugaucugccugccucggccucccaaagugcugggauuacaggcaugagccaccauacccugcccauuaauguuuauuuuaaugucuuacuacauuaagcuaucucuagauaauauuuauaaucauugcucuguauguuuaaauaaacucuucaaugacugcugggggucaggucacccuuuggaaaugacauuguuauugguacuucuguauuccaagaccucagauacuggaaaauccuugagaaauacaaauuccaucugaauggauggcuuuuccaaauaauggagaguuaagcuuuuaugugcuagaauguaauauuaacuauaugaauggaaaucucucugauauuacuaauugucucuggcuccuucucaguggacuaucuuucugaacauugaugcaggauauccuuugagaaacaugauaugggacaaauaacuaguuguacuauguuaaaacuuuuuuuuuuuuuuuuuuuuuuuugagacaagguuuuguucugucgcuuaggccagaauaauguggagugaucauaguucacugcagccuugaccucccaggcucaggcaauccucccaccucagccuucaaagaagcuagguccauaggugcacgucaccaugcccagcuaauuuuuaaaauuauuacuuguagagacauggucuuccuauguugcccaggguggucucaaacuccugggcucaagcagcccuccugccucagccucccacagcgcugggacugcagggaugauccaucacacccagccuuauuaaaacugaagauuuuaaaacacgugccauggaaugcucugcuuuauuuuuuuuauuauuuuugagauggagucucccuccguuguccaggcuagagugcaguggcgccaucucggcucacugcaaccuccaccucccagguucaaaaaauucucguuccucagccucccaaguaccugggaucacaggccagcgccaucacgccuggcuaaguuuuauauuuuuaguggagacaggguuucaccauguugguaagccuggucuugaacuccugaccucgggugauuuaccugccucagccucccaaagugcugggauuacaaaugugagccaccacucccagccucugcucaguaauuuuggaugaugcacagggagcagagucagaauuacuucuaagccuuaguguagacauuuaguuaaaugcaaucccacucuuagauuuuacaacuuacugcaacuacuuaauagcaacuuuuaguucauauuuuauuggcugagucuguuauucucauucuguagaauugcuucuaacuaggcccaggguaucucauguguaccugacacaccuacuuagaccuucaguaaaacuugcauuuuaacaucugguaucuguuucaacauuaagugcacccaaguuuguuuauuuuuuaaacaaagucuuugcuguaaaucaaaagacaguuguaggaaagagagaaucuacuucaaaccaaagacguuguugagcauccaaacugaggaaagaaagcacagugugguugcugaagcacuuucagugacucauauucuuccaauguggcuaucuacugcugaaaugaaccuuucuuauauggcuaacaccauaugagacaaguguaccugucuguaagguuuaggaaaagauacuugccuuugcuuaacauucucauuguauagccaaucacuauuaugcuucuuauuuaagauuagcacaaguuacccaugauuccgcucuuugccuuucacuggaaaacauuaggacuuuauauuuuagaauaucugguuggauauaguugcaguuuauucuuucaccuauuuacugguuugcuuguuaugcuauuuuguguaaacuacauuaucuauuuguuuugguaggggagaaaggugcuacuaugucucauguauagugaaugccccuaaucuuggaauacuggguugaaucauuuggaauucuaauugccuggcaggauucucccuuuuauggaaagaccuauaauccaucaagaaguaugauaggccacauacaaagguugagcccuguaaaaaguaaaguagaaguuccucuucaaagaguuuccuccccaucuaauuaagaauaaagaguaacuucucuuagaagcaaaauuuauucaaagaccugugcuaacuuucuuaaauaucugcuagccauaauaaagaaaucaauguacuuuauguucuuagauccuacaauuuagccuaaauauuugcccucgcaugcuuauacugguccaagcaagcauuaagucauagccuguuccucuuccuuauuugaagguguuuuuacuuuucucagcauuccacaaguuacuuccuccuuccuuuguuguccucugccuuugcuucuuuuaaaaaguucuaagucgcuagccaaucaggacagauacagaauaugaggucccguuccagccaguagaaaccagacacaguaguaagguggacgcgucagauuauaaaugacccugucuccuuuguuuggugcacucucauggcagaacugcuggcaaguguacccuuucugcagaaaguaaaaauggccuugcugaggaaauuaaauuuguguucaagagcuauuucuuuacugcaccgaggaacaagcauuucuaacaaacaugguuuacagcauuuguuuucaaaucaccacucaccuuaccacagcucaucaguuucaucucugccaccuccauuucaauucuuacugguuuuucuagggaggcaacauuguuuaguguuucaagaauguuaaggaccacuggauccagacuuggcucaaaucccagcucugcuguacacugugccccugagcaacugaaauucccugugucuuaguuucuucuucuauaaaacguggauaauacuaucuaccucuugugauuguuuuuaauaguuaaaauauuuaaagaucuuaaaaauaucccaugaugaauaguaaguucuauaaaacuguuagcuaugauuguuucuccaucuuccugccuauucuuccaaauuuccaacccgcuugacauucuuggcucuccuguuucaauuuguagucuguuuccucacuuggcauauucuuggccugccaucuugauaaucaacucucaaaugggcacagcccuagauccucuguaacuguugccugccuuuaugagaagcugugauuuuugucugguuucucaggccccagaaagauuggugcugucuugaguucuccuggcuuggaccugggagaaguucaccagucauucuuuuacaaaucuauugccuaugggagaggaggaauuuuuucccauaaaagcauucuaaauucuugagcaucugcuuuuguugguaugcagauccugucaccaaaugugagagauaccaacuuuauccccagagcucauuuagacgacucucccagcuaccaggauuuuugauaaaauagagaacuuuacaguuuucuaaaagacugcucaguuuucaguuaaggcaaagccaguaauguuccuguuuuuuuuuuuuuuuugccaugccggcaagaaaaaaauggcccacaauucuucuuaugauggagaccuuagcaugaaaacuaugagagaauccucuuaauugaucugcaguuaaaccagcaguaguggggauggcagcuagguucuggcacuuaguguaaaaucuaacaguauaaaauaaucuugaaucucuccuuagucaauggacgugacagccauuccuuauccagcauuggcaauaaaaaccaugugggaacagauacacagaucuuuguugucaaauucccuuaguuugaauccuugauuuaccauaguuauaugccuuugggcaaguuauaaucucuguggccuaauuuauuucuccuuuguaaauggggaucauuccugcuuccaagaguuaucaucaggugauuauuauuauuuagauuuaauugaaguacauauaugcagaaugcuuagcacaguaccuaggucaauaaguguuagcuaagccaggcugguauauuugcucuuuaaauagaagccuaucuucugggaauuaaaaaaaaauacgugguaaaccuguuguauuugggguuggggggaaggguggaaagcuuugacucuaucaaaauuacuucagccuauacuugauaaccauauauacacguacauacacacauguacuauauauauuuucauguacucgucuuaaaacuacuuaaucacuccaagaguucugggagucacagugaaguuucacacuucaccuuaauuccuucuuugaacucugaguuugaagaaaauguagaacuuucuagcuaagaugaagacaacggaauacucuucagcuucugauugccucuguuggauucuguagucugcagaauggcaaccuguguuguuaauuucuaacacuuuugugugaccaguaguuugcagauuuaauugaguguaacaguuacugggaagauuguuaaaauacagauucucagaucuuaucccuggagauuugguacaagagaucugagcuagguccagacaaucuuccucuuuaauagaagaaauucuguuuacaagggguucgaagaccuuacuuugguaauucuguuaguucauaaacccccuagucuaaauggccagaagcugccucaucuucacucguuuucacuuacacucugagaauuaccaguucagucaauccaaggaugcauuucaagagauucuaggggaguuaaccuucuucuggcaaauugguaguuuuauuuaaucucuuuuguucuuucuaccuauguauugccacucuguccuucuaauuuaaaacuucuguaucuuauugaucuguauuauuuugucagugaggagaaggauaaagucuccacuauaauuguggauauaguuagccuggauaaaguuauauugguuuuugcuucauguauuuugaagcucuguuuuuagauguguauacauuuaggauuauuacauccuucgaugaaauacugccuuuaucacuuugaaauaucccccuuuaucucugguaauguuucuuuuguugaagucuacuuuauuugauacuaauauagccacucuagauuccuuuugauuaguauuugcaauuuguaucuuuuccuguccuuuuacuuuuaaaccuguaugugucuuuaccuaucuguugggucuugcuuuuuaaaauucauucugacaaccucugccuuuuaauuggcauuuuagaccauuuacauuuagugugauuaaugcuaaguuugauuuuaaaaugaacauccugcuacuaauuuucuauuuguccccuuuguucuucauucccuuucuucucuuuuccugccuucuuugggauuggauuuuguuuaaugauucucuucuaucuuuaauauuaguuuuuagggauacuuuuucguauuugucuagguuuguguucucugaguuuuuuugguugguuguuuauuuuuugagacagagucuugcucuguugcccaggcuggagugcaguggcacaaucucagcucacugcaaccuccaccucccagguucaagcaauucuccugucuaagccucccaaguagcugggauuacaggcguacaccacacuuggcuaauuuuuguauuuuuaguagagacgggguuccaccauguuggucaggcugaucuuaaacuccugaccucaggugcucuacccaccucgaccuaccaaagugcugggauuauaggcaugagccgcugcaucaggccuuucuaagcuuuuugaauuucaauuacguauguauguuagaucauuugauauaguuccccagcucauggaugcucuauucuguuuaauuuuucccccacucuuuuuuuucuuuguauuucuauuugcauaauuuuuauuaacuuauuuucaaguuuacugauucuuuccucagcuguguugaucaaagguauucuuuaucuaucuuaccauuuuucuaguuucuggcauuucuauuugacuuguaguuucuauuuccaugcugaaauuucucaucuaauuauacauguugcuuaccuuuuccacuagagccuuuaguauauuaaucauaauuauuuuaaguuuucuaauaguuccagcaucugugggcauuucugguuugggucuguugauuuuuuuuuuuuuuuuuuguggucucuuggcaguguguugguuuuucccaucuucuuuguaugucuuauaauuuaauuuaaaguuggacaucuuguggugggcaguagaguauuuaugccuagaaauaggcacgccuuguuuuuuguuuuuuuguuuuuguuuuuguuuuuguuuugagacagggucucacucuguugcugaggcuggagugcaguggcaugaucucagcucacugcaacuucugccucccagguucaaguaauucucaaggcacaccuuguauuucgcuagacguuuagugugggggauugagcaaccuaguugggaguugaucuguguuuggguuucauuauugcuguacuuacuaucagugcaccacaggcuucaaauucccauagcauugccuugcauuucgaguagagggcugguucgccaaggauuuuucuucaggucugcuuuauucuuagcuucagguuuucccuuuccaccuuuaucucaagaagguucuucaugcuuuuacucucccccagaaauagaugaaacuuacucccuaacuuggugaugauggugugggcgagaguggggaagggacauucucuguuguucugguucugccuuauucuuaggcacagugucucugggucucacaaguggagccuucucagcaauucugccggaccccagccaugaauguucuaggcccaggacaauuuccugccucugauaguuugccugugugguugugggugugggugugggugugggugugguuuuuuuuuuuuuuucucuccuauuaccuuuucccagcugcuaugguucuuuaguuguugcuuuucuagcagcagcuuaaggcuuucauuccuuaggugagauagggaguaaggaucuagacaagaccuuguaaggauccaggcagaccuuuccauaccugccacuguuccccucucccaacccugcacuaugaaggggauauuuuuucagguuucuugcccuucccucagucuuucuuaugaguuccugguaauaucuguggagaagaaccugcaacaagguguaauuuccucuggugucugaagccccagcaguuuuauacucuuacuauagcccacacuggaccuuuagcaaauuguugaaacauuuuugcugaaaucuuuuuacuggcuuguauggcaucugaugucuucccccuaaguaagcaaguacuuacauauuauuuuucuuauuaguuaguugcacugugaccucagcucucugaaggguucaaaaauuuuugugucacuuguagacuggaagaaccuuauuagcauacuuucauuuacccuccucauagccguuuugccauugucauacauuucauuacuauuuguuauaaacaccaaaauacaaucauuauaaacaccaaaauacaaucuuuuugcuuuuuuucuuuuuugagacagagucucgcucuguugcccaggcuggagugcaguggcacaauuuuggcucacugcagcggcacaauuuuggcucacugcagccuccaucuccagggcucaagcaauucuccugccucagccucccaaguagcugggauuauagaugugcaccaccacaccuggcuaauuuuuguauuuuuaguagagauaagguuucaccauguuggccaagcugaucuugaacuccugaccucaagugaucugcccaccucggccucugaaaguccugggauuacaggcaugggccaccgcacccagccuuuaaguagucaauuuuuaaaaaaacaauuucuuuaaacucuauuucucuuaguuuugaaagauaauuuugcuggauauagaauccuagguggacauuuuuguuuccuucacaacuuaauuaucacuucauugucuuucacuucuauaguuucugaugagaaguuugcuaucguuuuuaucuuuguucuucuaacuuucagcuuuuuuuucccugacagcuuccucccccaacccccugacuuuauugaugacuugcagcaauuugauuaugaugugucuuccugugauuuucuucauaauucaucugcaugggauuuguugagauucugggaacugcggguuuaucacuuucaucaaauuuggcuauucuccaaauuuauuuuucuguucauccuaccccuuaucuuggauuccuacuacauguaagucaguaugcuuugauauugcuuaacaacucuguacauuuugauauugcccuguagcccugugauuuucuuuuauuuuuauuuuuauuuuuauuuuuauuuuuugagaaagagucucacugugucacccaggcuggagugcaguggugcaaucucagcucacugcaaccucugccucccaaguucaagugauucuccugccucagccucucaaauaguuggaauuacaggcaugugccaccaagcccagcuaauuuuuguauuuuuaguagagacaggguuuugccauguuggccaggcugcucucaaacuccugaccucaagugauccaccugccucagccucccagaguguugggauuucaggcgugagccaccgcaccuggccugcccuguuauuuucuuuuuuucuuuguauuucacuuuaguuucuauuauguuucuauugcuguuuucuugaaugaauauguccuguugcuauauuaugacuuugaagaauuucacugaucuuuucuucuguaauuucuaauuuacuauugaucucauuuguuacauguuuuauuuuuuauauuguauuuuucaucucuagaaguucauuuuagguauuuuuuuguaucuucuguuuucuuccucaucauguuuguauuuuccuccaccuucuugaaucuagggagugaggaaugguuguuuuaacaucuuuuucugccaguuuucccauccauguuguuuccggauguuuuuauugacggacuuuucuccuggguauguguugaauuuucaugcuucuuuggauaccuguuaggcauaugcuuuauauguuuuuggauuauguaggauuccuuuaguacuuuuggguuuuauucuaauggacaguuaagauacuucaaauuaauuuguucuaccaaggcuuucuuuugagcuuuguuaggguagucacagcagcauuuaaugggauaauuuaucuccacuacugaggcauuaccuuucugaggacauugcucacugccucuuggauuagguuuuuauauucugacugcugauuggaacaugaacuauuuauugccuuauaugagcucuggagauuguuccaccugcuccuuuccagugguucuuuucccuggcuucagguaguuuucuccuuuaugugcauaagccaguacucagcuaaagaauaaagggaacucuucuagagaucuuuggcacugucuuucuacagugccaaaaugcccuguacuacauugugccucacaaauucuaggucuuggcguuccugaacucuuagcuguuucaaaacucaauuagagugcuaggcuuuguuuggauuaacuuucccugugcuauugccuggaaacucuggcacuaagcuuguacugucucaugcguccgugugaagagaccaccaaaacagguuuugugugagcaacaaggcuguuuauuucaccugggugcaggcgggcugaguccgaaaagagagucagcaaagggugguggauuaucauuaguucuuacagguuuugggauaggugguggagguaggagcaauguuuugcgggcaggggguggaucucauaaaguacauucucaaggguggggagauuacaaagaaccuucuuaagggugggggaaauuacaaagcacauugaucaguuaggguggggcagaaacaaauuacaaugguggaaugucaucaguuaaggcuauuuucacuuuuguggaucuucaguugcuucagguaaucuggauguauacgugcaggucacaggagauaugauggcuuagcuugggcucagaggccugacauuacagugguaggaauucuuucagugaucacuguccucuucugucuuuuguacaauaucugaaaaucauuguuacauauauuuugucugauuuucuaguuauuuaaggugagauauuaaauccauuauguguuauucugucauugcuggaaguagaagucuguucuuccaguuuaacugauuuacucucuucauucuugaccgucuguauuucucuauuaggcacaacccagugcuuacauauccuaugugccuuccuguucaggaauguuaaaauggacaacucuuuagugagcuaauacagaucaugcggcugccacacagaguagaauugagauguguugugugucacacgcguccaugugaagagagucugccagcaggcuuugugugagcaacaaggcuguuuauuucaccugggugcaguugggcugagucugaaaauggagucagcaacggguggugggauuaucauuaguucuuauagguuugggauaggcaggcagcggguggaucucaccaagugcauucucaagggcguagagaauauuacaaaguaccuucuuaagggcaggggaauaucacaaagugcauuaucacaaggguggggaggguguauugucauaaggucaauugaucaguuaggguggggcaggaaaagaucacaauggaggaaugucaucuuuugugguucuucaguugcuucaggccaucuggauguauaccugcaggucacaggggauaugauggcuuagcuugggcucagaggccugacauuccugucuuuuuauauuaauaagaaaaacaaaacaaaaugguggugaaguguugggguggcaaaaauuuuugggggugguauggagagaucaugggcaauguuucucagggcugcuucgagcggaauuaggggcagcgugggaaccuauagugggagagauuaaacugaagaaagcuuuugggguaaggggugauauugugggguuauuagaaggaacauuuguuauauagaaugauuggugauggccuggaugcaguuuuguaugaauugagaaacuaaauggaagauacaaggucugaauaaaaggaagaggaaaacagguauuaaaggacuaagaacugggaguacccaggacauccaauuagagagugcccaaggggguucagcauaauuauuugguuggggaguuuuggggcucuagccuugaguucuuuauguugucauauaccaggccagauugauuuagguaaaaacaacacucuucauuuaaaaauauagagucugcucuuuuuuuuuuuuuuuuagcagugaguaaggucgaggccucggugguucuggaggaaagagaaaugcaaagccaguaacuguuuguuaaggaaggauuagaaauggcuaggagagagugagugagauugauagugugguggagauagccggggagagguagaggguggcauaagacgagaaugaaaauaagagugaguauaaaaguaaagaauaggacuucgucagggcgaaaguauuggagugugcccugucagcaaagaucaucuguucacuccaagagggagucaagaguggcugauuggggauaguaccaggagauauccgcuaugaugguuuggaggaaaaguguaaaccagcaauguaaacaagggcaggguauuuacgaguaguugagaauggugaauaggaguauggcuagacagaagauaggagggaugacaagguuuuggggcacaguccaaguagugggagugacugcguaaagcccuguugcaaaaaguaggguaaggacgaauagaccuaauagaaugaagggauguauuaggcucauaagguuuauuacuguuauucagaaaugcaagugaguuuaagggaaguaggggagaguacuugagacuucaggcuggcuguccgauggacacagcuuuauucuggaauggugaacccaauggggaggguccuguaggcggacggcaguugggguacuauagaugacuaaguagggucugguccaucgagguuguagaauuugaggggucagauucuuaacaagaacugaucauccagcuagggugucuucauaugacugggaaucuggaguaggcaagagaagauuagcagcuuggcaaauuuccuguguagcuugcuggaggacuggaagauagucaccuagagggcuggugucuggaaugagacuggggccuaaugaaaaagagcguccauacaggagcucaaaugggcuguacccuguagcaucccgaggacaggcccgaauucugagaagggcaagugguaaaaguacuguccaguccuuuuuaaguuggaggcugaguuuggugaggugugucuuuaaaagaccauuaguucuuucuaccuuuccugaggauugagggcgauaaggagcacgaaguuuccauugaaugcccagggacugggagacugccugaaugacuugauuaauaaaggccggucuguuaucagauuguauagagguggaaaggccaaaccgaggaaguaugucugagagaauggaagaaauaacugugguagccuucucagaccgugugggaaaggccucuacccauccagugaaaguguuuacccagaccaagagguauuauaguuuccugacucgaggcaugugaguaaagucaauuugccaguccugggcaggggcaaauccccgagcuugauguauagggaagggagggggccugaacaaucccugaggaguaguagaauaguggauggaacacugagaagugauuucccugaggauagauuuccaugauggaaaggaaaugagagguucuaagagaugggcuagcagccuguaaccuucauggacgagguuaugaaaugaugacagaauagaaugggccugugagucuggaaggagauauuuuccuuguuccaagaaccauuugccuuaugugggaaaagauugguagguggaaguuucagugggagaguaggugggagugaccggugagaaggagaaaaacuggccaugagggacagaaguuggaacgcuagcugcuucuuuagcuaccuuaucagcagaagcguugcccugagcacugggaugugaugccuuuugauggcccuugcagugaaugauuccagcuuccuuuugaaguaaaguggccuuuggaaguaaagcggccuugagaagaguuuuuauuaaagaggcauuaauaauggaggauccuuguguagugaggaaaccucuuucugcccauguaacagcaugguggugcaggauauggaaggcauauuuagagucaacauaaauauugacgcacaguucuuuugcaagagugagggccugaguuaagacagugaguucggcuugcugagagguaguggaggggggcagagcgguagacucagugauagauggggaagacacuauagcauagccugccuuugccagugauuggcgauugggccuggaagaacuaccaucaauaaaccaagugugaucagggugaggaacaggaaagaaggaaauauggggaaaugaagugaaugcuggguagaucagagagaugcagucaugggggucaugugugguaucaggaauaacgugggggccagccugaaacaguaaggucaaguuguuuggacagaaaggccacaagguacggucccagcucuuguguaagaauccugaccacacagcccugcgcuuuggcuguguguaaugaaaaaggguugggaugaguuagggagagcuaguggggagcagcuuuuagggcuguuuuuuaaagaauggaaaggggaguggggaaaggauugaggauuuauggggucagcuagguuuccuuugugaauuuauauaaugguuuugucaggauggcaaaacuagguaucuaaaggcgaaaguaccuaaccaugccuaggaaggaaaggaguucuugcuuuguagaagggguugagguuugggagauuagcuggacaugaucagcagggagagcaugcauguuuucaugaagaauuaugccgagguagguaacgguuggggaagaaauuugagcuuuggagggggaugugcgauguccuuuugagaauagauguuggaggagcaggaggguguccuguugggaagauuuguaggaggggcuauaaaguagaagguuaucaaaaugcuuaauaaguugagaagcagauggauggaaagaaaguaaaucaugaaaaagggcuugacuaaaguaauggggacugucccugaagccuuccggcaguacagcucagguaaguugcugagacugaugggugucugggucaguccaagugaaagcaaaaaaaggcugggaugaaggguguaaaggaauaauaaagaaagcauguuugagauccagaacagaauaauggguuguggaggaagguauugaggauaggaaaguauauggguuuggcaccauaggauggaugggaaggaugauuugauuaauaaggcgaagauccuggacaggcuuuauucccuucaaagccuguugugggauggcauacuggcguugagccggguaaggcugauuagauuuuaaugggauaguaaugggcaugugauugguugccauggagggaguaaagguguccuaucacuuguggguuaagguggggggauacaauaggaagaugcaaaggaggcuuugaacuggggaaaagggcagcagugagguguggcuguagcccaggaauagucagggaagcagauaauuuaguuaaaaugccucgaccuaauaagggaacugggcaggugaggguaacuaaaaaaggagugcauaaaggaauguuguccaagcuggcaccagaguuggggaguuuuaagagguuuagaagccuggccaucaauacccacaacaguuauggagacaagggaaacaggccguugaaaagaagguaauggggaguggguagccucuguauugauuaagaaggggaugaacuuacccuccacuguaagaguuacccaaagugucugugaugguccaagaggcuuuugaggagaucaggcagcgucagauuucagccacuaagcuaagaagaucuggaaaggagucagagagccuugggccagaguuccagggcucugggaguggcugccgggcaaguuggacaguccgauuuccaguggggccccacacagaugggacaacagcuuacgaggaaucccgggcugcgggcauuccuuggcccaguggccacauuuucggcacuugaagcaagauccugggggaggagguccuggaggaaugccuggcugcugcaguucaggcguuuugaaguucuugugugcuggagauguggcugggguuugucucacagcggaggcaaguaauugcaacucuucucuauuauuguacacuuugaaggcgagguuaauuaaguccugaugugcguugggagcagauuggguaauaaaauguauguugagaauaagacggacuucuggccccucugggucuagggugguaaaacgucuaaggguuguuaacaaaugggccaugaacugggcuggguuuucauauuugaugaaaaaguccaaaugcuaacugauuuggggaaggucugaaggucugauagagaaaaaggaauauuaaccuugauuaugccuuuagcaccagccacuucuuugagaggaaauuguugggcagguaggggagggcuagucauggaacaaaacuguaaucuagaccgggugugaggaggggaggugauagaaagauuauagggugggggagcagaggccaaggaagaauugggaccuggcucagccuggcgaggagcagccuggggaggaggggagaggucagauggguccguagaagaggaggauucaaaggacucagagcuugggguggaaacugaaggaacagacaggagagaaagaagaaagauuugcgacgagucgcauugcgagcagagacuagggagggaccgauguguaaaagaaugccuggacgucgggcaccucagaccauuugcccauuuuuacgacaguaauuaucuagaucuuguaggauggagaaaucaaaagugccguuuucuggccauuuagagccauuaucaaguuuguuuuggggccaagcaguguugcagaagaaaauaagaugcuuagguuuuuaggucaggcaagaauugaagagguuuuaaguucuugcacaggcuaagggagaagaaggaggaauggagguugaaagauugcccauagugaaagaggcaagcccagagaaaagagaggguagagacaugggcgggaggguggugcuugccucccagggaaggugguacuugccaccaacgugaagguucaaggcaggcauccccacggugaucagacaccucugaaaugugggugaauaaucaggcaggcauccccgcagugauuaaacaccaagggaagacugucuuccucaguccguaaccggcaccagaguuuugagaucacggauaaaacgcgucuccucugucucuaccagaaagggaaaggaaccaaaauuaaggaagggagagauugaaggguggagggauagcgagagagguuggagaagagagugaaaagacugcuuacccgauuuaaaauuggugagauguuccuugggcugguuggucugaggaccugaggucauagguggaucuccucacggagugagggcaaggacagggggcuggucucccaaaggagucccccugucccgggucuucggcaccaaaugucaugcacguccauuugaagagaguccaccaacaggcuuugugugagcaacaaggcuguuuauuucaccugggugcagguuggcugagucugaaaaaggagucagcaaauuguggugggauuaucauuaguucuuauagguuugggauaggugggccagggguggaucucacaaaguacauucucaagggcagggagaauauuauaaaguaccuuguuaagagcaggggaauaucacaaagugcauuaucacaagggcagggaggguguauugucauaaggucaguugaucaguuaggguggggcaggaacauaucacaaugguggaauguuaucuuuugugguucuucaguugcuucaagccaucuggauguauaccugcaggucacaggggauaugauggcucagcuugggcucagaggccugacauuaugcaguuaugggcuguagguagaagugauagacuuuuguaucagaacuguuggcuucuggcccuuuuuugcugacauaauacauauggccuaacugaaccagcuguugcacuuaauuucuuaugcuccuacaguggacugaagguuaauaucuccccaaaauuuguauguugaaauacuaaaccucuaggugaugguauuggggaaguggggccuuugggaagugauaaggucauacggcagaguccugugaaucgcauuaacacccugcuccuuccccacuuccaccaugugagggcacagugagaaggcacaaugaaccagaaaguggacccucaccagacaccaaaucugcuggugccuugaucuuagacuuggcagucuccagagaugugagacauaaguuuccauuguuaaaagcuaccaacuuuaugguauuuuauuacagcagccuagauggacuaagacagauccuuagucuccauauauuaguccauucuuaugcugcuaugaagaaauauccaagacuuggucauuuauaaaggaaagggguuuaauugacucacaguuccacguggcuggggaggccucaggaaacuuacaaucaugguggaaagggaagcaaacucguccuucuucacaugguaggaggagagagaaauauagagcgaagaggggaaagccccuuauaaaaccauuagaucucgugagaacucacugucagaauagcauggggcaaccacccgcguguucuguucaccucccaugagguuccucccccaacacgugaagauuacaauuugaauuacaguucaagaugagauuuuggguggggacauggccaaaccaugucauuccaccuuucuuauucugucuugguucauacaacuauacaacucaauguaaaaacagacucuuaaggaucuauuuucacauaaaaagaccuaccuuuuacuaauaacaccaggaaguaaaucagagcauugaguuagcuugccagucauugugugucuguagcgaucuuaccuucaggucuuaguauguauuuguuuuuugauucucugggcuuccuucuccagcugucauggcauaagguuuuuauuuuagaagacuugguggggaaaaugguguuuaguucuaccaaauggcugaggauucuucacgguuagucuugauguagcuguguguaacuacugcauguggauuuagaaacuucaaacaauauuccacaaauuaaaauaaugccauaauuuggcaugagauuuuguaguuuacaaaguacuuucacauacauuauuuuauuaauccccauuguaacccugcagugagacaauaucuucauguuauagaugauaagcugaggcucagagagguuaaggggugaacuggaauuuuaggcuaggccuccugaguccuuaacccaguucuuuuucuacuguuguacagucugcaacuucacuguuuacacgauuugagcagauaaugaagcuuagguugccaauaauacuuaauauccuggauuauuuuguaaccuguguaaaauuuccucacucaacuuuauugcuauguauuccuccuguuugaugauuuucuaaauaaauuucucaauugucugguaacuuuaguuucuuaaguguuucuucugcuuuuuuaaaaaaacauauguucaagcguuuacaucugugcuuguuagcauuaugaauuuugacuacacaaaucuuuuucuccuuuuucucuguucuuuuuuaaaaaauuuuaguuucucuuuugauuucaacccguuagagcuuaaauucucacgugauuguuuuauuuauagcuaguuaauccuccugacuaguaacuauuuugacagucugacauuuguuugccaucuucuaaacgcugugcuucucuuuuguaacgugaauuguuuucuuucaauacauuuuuucaaaacuuuaauuucauuaauucaacaaauaguuaauauuuacuagguaaaaaaaaagaugggaaugaccacuucuacgucaaguaaaaagcuuuccagagaaauugaugcuugauaugagucuuaaagaaagauguuacaucagccggguggguggcucaugccuauaaucccagcacuuugggaggccaagguggauggauugcuugagcccaggaguucaagagcauccuggauaacaugaugaaaccccaucucuacuaaaaauacaaaaaauuagcuggggaugguggcgcaugccuguagucccagcuacuugggagcugaagugggaggauuaccugagcccgggaagucgaggcugcagugacccgugauugcuccacugcacugcacucuagccugggagaugggagugagacccugucucaaaaagaguaaaauaggguaugcagacacuacauuuagauguauuauaaugaaaauguuugaauucauauucacuucuauuucacccuuucaauuuuucuauuuuuguguaucauaaugaaucaaacauuuuagaacaauaauauauauacauaauuuguaaauauguauacauaaaaauacugaaaauauuuuuaccuuggguaaaugaucagauuuagagaauuaacuguuuuuaacuaguugggaaccagugaucacuuaugcaaggacuguguuuugugauauauaacuugaagaacuuaaaguacauauuucuggacccuaucuucagagacugguuuauuaaguuugggaaggaaucuuaaaaaauccaucuuugcugggcgcgguggcucacgccuguaaucccagcacuuugggaggccaaggcaggcagaucacgaggucaggaguucgagaccagccuggucaacauggugaaacccugucucuacuaaagauacaaaaaauuagccgggcaugguaguggguaccuguaaucccagcuacucgggagacugaggcaggagaaucauaugaacccaggaggcggagguugcaaugagccaagaucacaccauggcccuccagccugggugacagggcgagauuccaucucaaaaaaaaaaaaaaaaauccaucuuuuaauuuaauuccucaggugauucugacuauaggccagguuuagaaaccacagguuuaaaucauggaaaauauguagaguagaaagagaaaauagaaaaguuugaaugacacugugcugauauuaaaaguuucaacuauguuaauacauauucuuuugauuuuaauaaucugauagaauggcuauaaucaguguggaauugauuguaucuacuaagcuaaaaucaacacugaaaauucagacaacuguuuuacgguuguauacuccauuuuauuuagcaagguuuuucuuccauaucuaugcagguuauaucaaauauuuuuuuucuuagcuaaguaccuagagagaaauuuuucccuaagcauauaaaauucugcauugccuagauccaccaaaauauuaaacuuggaagaguugauauaaaauggccugugauuuaaagucucuucuccaaauugagaugcaaagaauugagaauauauaaaagcuaccuccaugaauuaaaauuugcaaaaaggcuaagagucuuauguuggaguccuugcccugauaccucagauugugacaguauuugaagauaagaccuauaaaagaggugauaaaguuaaauugagacauuuaggguagguccuaaacuucccuaauccagucugacuggugucuucacaagaggagggaauuugggcacacagagacacgagagacacacccacacacccacacacgcagaggaaaggccauaagaagacacagcaagaagaugaccaucugcaagccaaggagagaggccuuagaucaaaccagaccugcugacaccuuaaucuuggacuuauagcaucuagaacuaugagauaauaaauuacuguuguuuaagccgcucaaucuuuaguauuuuguacagcagcccuagcuaacuaauacagagacaauaaaucuuuucauuaauuuuacagcuacacugcugaagcacuaagacauauaugcagguuuuaaaacccuuacagccuuguuucuugaaucaaaauuaguaaaugguauuuaggguauacuuacauuguccggaauucuuuaccucuaucaaagugguuuguaaauacuauugacauuaucccuuguugaagcauuauuuaguauucuuagcaugacuguuauuuucaaaugcgaucccaguuauauuuugagguauagguauuuuuuauguaagauaaaauucuauauaauugcuaacuacuauccaacuuagcagccaagcuaaauaauuauuaggauaaugauuaauuacuuuuguccugcauuauucuuuuagauuacaguuucuagcuagugaaugaacaaguauucagguauucuaaugcaagguagcauuuugaugcuagauccuaaguuacuaccuuucauuccauuuaccaauuaaauauuugauuuuuaaccauauauauauauauaauuuuuuuuuuuuugagacagaguuucacucuugucgcccaggcuggagugcacuggcgugaucucggcucacuguaaccucugccucccagguucaagugauucuccugccucagccuccugaguagcuggaauuaaagccgccugccaccaugcccggcuaauuuuuuuuguauuuuuaguagagacaggguuucaccauguuggccaggcuggucucgaacuccugaccucaggugauccgcccgccuuggccuccuaaagugcugggauuacaggcaugagccaccaugcccggccaacuuaauauauuuuuaucacccaucugaguauugucagcuuauuauuuuuaauuguugacuuuauuaugaaauauuucaaacauguaaaaaaauauaaucagcaucucuuucaccuaccuuaagaaauuaaacuuuacagauacaaucaaaaucuccugacuccuccauucuccgguuuuuaauccagaaguaaccaccauuccaaauuucuguuuauuuccaugcauuauuauucccauuggcauuuuuugcuuguuuuagcuuuauguaaacagucucauucuguuugcauccuccuaaaacuugcauuuugguuuaauacagguuuucaagauuuaaccauacugaugcauauaguuccagugauuuguuuuuacugugcauaguaguauuucauuccaugaauauaccacaguuuauuuuccucuuuggacaucuggguuguuugcagguuuguuuguuuugcuauuacaaacauugcuguaauaauuacagcaauuggccaggugcgguggcucaugccuauaaucccagcacuuuggguggccgaggucgguggaucaccuaaggucagcaguuuaagaccagccuggccaacauggugaaacccugucucuacuaaaaauacaaaacuuagcuggguguuguugcacaacaccuguaauuccagcuacuugggaggcugaggcaggagaaucacuagaacucuggaggcggagguugcaaugagcugagaucgcaccacugcacuccagccugggugacacaguaauacuccaucucaaaauaauaauaauaauaauaauaauaauaauaauaauaauaauaauaacagcaauuaucugguacauuugugucucuguacaaaugugccagaauuucucuagauuauauacuuaggaauagacuguuucaaauucucugucugucucucucauuaccggugaaucugagcauauuuuacauuauaguuuuguuaacuauuuggguuucuccuucuguaaaaauguuguuauauuuuaaucaggagacagaaaccacucuuaauuucaacagagagaguauaacauaaagaauuacuggccaggcacgguggcucacgccuguaaucccaguacuuugggaggcugaggugggcagaucacaaggucaggaguucgagaccagccugacaagcauagugaaacuccaucucugcuaaaaauaaaaauuaaaaaaaaaauuagccaggcaugguggcaggugccuguaaucucagcuacucaggaggcuaaggcaggagaacugcuugaaccugggccaagaucgcaccacugcacuccagccugggcaauagugugagacugugucaaaaaaaaaaaaaaacuauuagcagaggaacaaaguaacagagcaaagagaaguguguaaagaauacagaaauaauagauacagguagcagccacuaucuguggaacugagauagagcacccaaggaagagacauucccucucaagguugagauucagaccuaguugcagaguguggcaguggucacaaagugcugccccauggggacuguuagaaaucugcccucgggauagucuuccccagggaggugccuagcuguggaacucauuguaagcugccugaguaggugcuaaaaaaguaguccaaggggaguuacauagcaggugacauuucacuaugaaacugccaggaggucuggggugguuggugccagggaagcagcucaugagaaggugccacggcuguuagcaccuggacgcugccaaaaauuaaaaucugcauccugcaggaacccaauaagguaagcacacuggaaccagaaggagaaacaccuucuucuuccagcauccuucaagugucaucuacugguaaagccuaauuggaccagcuggcaagagagaacuauuuacagaguucagcuccauuauuguagagcacacaaggaaggguagauuuagagcugagaggcaguaaguggauaauuuacacaguaucauuugcccuuuuuuuuuuuuuaacguucugggauacaugcgcagaacgugcagguuuguuacauagguguauaugugccauggugguuuguugcaccuaucaacccaucaucuagauuuuaagcccugcaugcauuagguauuuauccugauggucucccucccuugcuuccugaccccuggugugugauguucuccucccuguauccauguguucucauuguucagcucccacuuuugacugagaacaugggguauuugguuuucuguuccuguguuaguuugcugagaaugauggcuuccagcuucauccaugcaaaggacaugaacgcauccuuuuuuauggcugcauaguauuccaugguguauaugugccacauuuucuuuauccagucuaucauugaugagcauuuggguugcuuccaagucuuugcuauuguaaauagugccacagugaacauaugugugcaugugucuuuauaguggaaugauuuauaauccuuuggguauauacccaguaacgggauugcuggaucaaaugguauuucugguucuagcuucuugaggaauugccacaccgucuuccacaaugguugaacuaauuuacacucccaccaauaguguaaaaguguuccuauuucuccacagccucaccagcaucuguuguuuccugacuuuuuaauaauugcuauucuaacuggugugagagguaucucauuguaguuuugauuugcauuccucuaaugacuagugaugaugaacuuuuuuuucauguuuuuuggccacauagauguuuucucuugagaagugucuguuaauauccuuugcccacuuuuugauggguuuuuuuuucuuguagauuuaaguuccuuguagauucuggauauuagaccuuugucagguggguagauuucaaaaauuuucucccauucuguagguugccuguucacucugaugauaguuuauuuugcugugcagaagcucuuuaauuagaucccacuugucaauuuugacuuuuugcaguugcuuuugguguuuuauucaugaagucuuuguccaugccuauguccugaaugguauugccuagguuuucuucuaggguuuuuaugguuugggguuuuacauugaagucuuuacuccauuuuugaguugauuuuuguauaagauguaaggaaagggucuaguuucuguuuucugcauauaacuagccaguuuucccagcaccauuuauuaaauaaggaauacuuuccccauuguuuauuauagucagguuugucaaagaucagaugguuguagaugugugcugcuauuucugaggucucuguucuguucuauuagucuguauauuuguuuugguacuaguaccaugcuguuuugguuacuguagccuuguaguauaguuugaagucagguaguguggugucuccagauuuguucuuuugcuuaggauugucuuggcuauacaggcucuuuuuugguuccauauaaaauuuaaaguauuuuuuucuaauucugcaaagaaagucaaugguagcuugaugggaauaucauugaauuuauaaacuacuuuaggcaguaugguuauuuucacgauauugauucuuccuaaccaugagcauagaauuuuuuuccauuuauuugugucguuuuuauuuuguugaacagugguuuguaguucgucuugaagacguccuucacgucccuuguaaguuguauuccuagauauucuauuuugcuucuagcaauugugaauaggaguucacucaugauuuggcucucugcuugucuauuauugguguauaagaaugcuugugauuuuugcacauugauuuuguguccugagacuuugcugaagcugcuuaucagcuuaaagaguuuuuagucugagaccaugggguuuucuaaauauacaaucaugucauuugcagagacaauuugauuuccucucuuccuauuugaauacccuuuauuucuuucucuugucugauugcccuggcagaacuuccaguacucuguugaauaggaguagugagagaggacauccuugucuugugcugguuuucaaagggaaugcuuccagcuuuugcccauucagugugauauuggcuauggguuugucauaaauagcucuuauuauuuugaguuauauucuauugauaccuaguuuauugagaguuuuuagcaugaaguuauguugaauuuuaucaaagaccguuucugcaucgauugagauaauuauaugguuuuugucauugauucucuuuauaugauggauuacguuuauugauuugcauguguugaaccagacuugcaucccagggaugaagcugacuuguaugugguggauaagcuuuuugaugugcugcuggauucgguuugccaguauucuauugaggauuuucacaucgauguucaucagguauauuagccuaaaauuuucuucuuuguugucucucugccagguuuugguuucaggaugaggcuggccucauaaaaugaguuagggaggauucuuucuuucucuauugauugaaauaguuucagaaggaaugguaccuugacucuuuauccaauuugccagucugugucuuuugauuggggcaguuagcccauuuacauuuaagguuaauauuguuacauuugaauuugauccugucauuaugaugcuagcuaguuauuuugcccauuaauugcugcaguuucuucauagcaucaauggucuuuaccauuugucauguuuuugcaguggcugguacugguuauuucuuuccauguuuagugcuuccuucaggagcucuuguaaggcaggccuagggauaacaaaaucucucagcauuugcuugucuguaaaggauuuuauuucuccuucacuuucgaagcuuaguuuggcugaauaugagauucuggguugaaaauccuuuucuuuaagaauguugaauauuggcccccacucucuucuggcuuguagaguuucugccaagagauccgccguuagucugaugggcuuuccuuuguggguaaccugaccuuucucccuggcugcccuuaacauuuuuuccuucauuucaaccuuggugaaucugacaauuaaugugucuugggguugcucuucucgaagaggaucuuuaugguguucucuguauuuccugaauuugaauguuggccugccuugcuaggauggggaaguucuccuggauaauauccugaagaguguuuucuaacuugguuccauucucccggucacuuucugguacaccaaucaaacauagauuuggucuuuucacauagucccauauuucuuggaggcuuuguuuguuucuuuuuacucuuuuuucucuaaacuucucuucuuguuuuauuucauuaauuugaucuucagucacugauauuuuuucuuccacuuguuugaaucggcuauugaagcuuaugcaugggucccgaaguucuugugccaugguuuucagugccaucaggucacuuaaggucuucuuuacacuguuuauucuuguuagccauucaucuaaucuuuuuucaagguuuuuagcuuucuugugauggguuagaacaugcuccuuuagcucagagaaguuuguuauuaccgaccugaagccuacuucugucaacucaucaaacucguucuccauccaguuuuguucccuugcuggugaggagcugcaauccuuuggaggagaagaggcgcucuguuuuuuggauuuuucagcuuuucugcugugguuucuccccaucuuugugguuuuaucuaccuuuggucuuugaugauggugaccuacagguggaguuuugguguggauguccuuuuuguugauguugaugcuguuccuuucuguuuguuaauuuuccuucugacagucaggucccucagcugcaggucuguuggaguuugcuggagguccacuccagacccuguuugccuggguaucaccagcggaggcugcagaacaacaaauauugcugcuugauccuuccucuggaagcuucgucccagaggggcacccgccuguuugaggugucugucggccaauacugggagguguuucccagucaggcaacacaggggucagggacccgcuugaggaggcaaucuguccauucucagaguucgaaugcccugcugagagaaucacuacucccuucagagcugucagccagggauguuuaagucugcagaagcugucugcugccuuuuguucagcugugcccugcccccagagguggaaucuauagaggcaguaggccuugcugagcugcaguggguucugcccaguuugugcuuccuggccucuuuguuuacacugugagcuacuuaagccccagcaauggcagaugccccuuucccccaccaggcuacagccucaaagguugaucucagacuguugcgcuagcagugagcaaggcuccgugggugugggaccugccaaaccagugacaggaggguaucuccuggucugccgguugcuaagacugugggaauagugcaguauuuggugaggaguguaccauuucuccagguacagucugucacagcuucccuuggcuaggaaagggaaauccccugacccuuucugcuuccugggugaggcgacgccccaccauacuucagcuugcccuccgugagcugcacccacuguccaaccagucccaaugagaugaaccagguaccucaguuggaaaugcagaaaucauucacuucugugucgaucucacugggagcugcagaccagagcuguuccuauuuggccaucuuggaagggaccccuauuucuucuagauuuucugcuuuauuugcauagagguguuuaugguauuaucugaugguaguuuguauuucugugggauuaguggugauaucccuuuuaucauuuucaugugccuauuugauucuucucucuuuucuucuuuauuagucuagcuagcagucuauuuuguuaauucuucucucuuuucuuuauuagucuagcuagcagucuaucaauuuuguuaaucuuuucaaaaaccaagcuccuggauucauugauuuuuugaaagguuuuuuguguccucuaucuccuuuaguucugcucuauuucuugcuucugccagcuuuugaauuuguuugcucuugcuucucuaguucuuuucauugcgauguuaggauguugguuuucugucuuucuugcuuucugauguggguauuuagugcuauaaauuuccaucuuaacaccgcuuuagcugugucccagaaauccucacucguugucucuuuguucucauugguuucaaagaacuucuuuauuucugccuuaauuucaugauuuacccaguagucauucaggagcagguuguuugauuuccauguaguugugugguuuugagugagauucuuaauccugaguucuaauuugauugcacuguggucugagagacuguuuguuaugauuuccauucuuuugcauuuguugaggauuguuuuacuuccaauuauguggucauuuuagaauaagugcuauguggcacugagaagaauauauauucuguugauugggguggagaguuccguagaugucuauuaggucaucuugguccagaguugaguucaaguccugaauauccuuguuaauuuucugucucauugauccgucuaauauugacagugguaguuaaagucuccuauuauuauugugugggagucuuaagucucuuucuaggucucuaagaauuuguuuuaugaaucugggugcucccguauuggguguguauauauuuaggauaguuagcucuccuuguugcauugaucccuuuaccauuauguaauguccuucuuugucuuuuuugauccuuguugguaaagucuguuuuauuagagauuaggauugcaaccccugcuuuuuuuucccauugcauuugcuugguaaauguuccuccaucccuuuauuuugagccuuugugugucuuugcacaugagaugggucucuugaauacagcacaccaaugggucuugacucuauccaguuuuccagucuguaucuuuuaauuggggcaguuagcccauguacauuuaagguuaauauuguuaugugugaauuugauccuguuauugugaugcuagcugguuauuuugcacaucauuugaugugguuucuucauaaugucauuggucuuuauauuuuguuuuguuuuugcaguggcugguaucgguuuuuccuuuccauauuuagugcuuccuucaggaguucuuguaaggcaggcuuggugaugacaaaaucccuaggcaucugcuugucuguaaaggauuuuauuucuccuuugguuaugaagcuuaguuuggcuggauaugaaauuccggguugcaaauucuuuuccuuaagaauguugaauauuggcccccacugucuucuggcuuguaaaguuucugcagagaaaucugauguuaaucugauaggcuucccuuuguagauaaccugaccuuucucucuggaugcccuuaaccuuuuuuccuuuguuucagccuuggagaaucugaucauuaugugucuugggguugcucuucuugagcaguaucuuagugguggucucuguguuuccugaauuugaauguuggccugccuugcuaggcuggggaaguucuccuggauaauguccugaaguguguuuuccaacuugacuucauucucuccaccacuuucagguauaccaguuaaacuuagguuucgucuucucacauagugccauauuucuuggaggcuuuguucauuccuuuucauucuuuuuuucucuaaucuuuucuucaugccuuguuucagucaggugaucuucagucccugauauccuuucuuccacuugaucgauuuggcuauugauucuuguguaugcuucaugaaguucucggacuguguuuuucaacuccaucaggucauuuauguuccucuuuaaacugguuauucuaguuagcaguuccuguaaccuuuaucaagguucuuagccuccaugcauuggguuaggacaugcuccuuuagcucagaggaguuuguuauuacccaccuucugaagccuacuucugucaauucggcaaucucauucuccauccaguuuugugaccuugcuggagaggaguugcgauaauuuggaggagaagaggcuuucugguuuuuggaauuuucaguguuuuugcacugauuuuuccucaucuuuguggauuuaucuaccuuugaucuuugaggcugaugaccuuuggaugggguuuuugugugguggucuuuuuuguugauguuguugcuuucuguuuguuaguuuuucuucuauuagucuggccccucuccugcaggucugcugcaguuugcuggagguccacuccagacccuguugaccugcaguggaagcugcagaacagcaaagauugcugccugcuccuuccucuggaagcuuugucccagaggggcacuggccugaugccagccagagcuccccuguaugaggugucugucagacccuguugggagaucucucccagucaggagguauggggguuagggacccacuugaggaggcagccugucccuuagcagagcuggugcacuguacugggagaaucacccuugucaguaucaacugcugucuucagagucggcaggcaggaaagauuaaaucugcugaagccucgugcccacagccaccccuucccccaggugcuguguccgagggagaugagaguuuuaucuguaagccccugacuggcgcugcugucuuuccuucagaggugcuccgcccagugaggaggaaucuagagaggcagucuggugacagccgcuuugccccgcuguggugaauuccgcccaguccagaccugccaggcaccuuagcacugucaggggaaaaccaccuacuaaagccuugguaaugguggacgccccuccccucaccaagcuccagugucccuggucgacuucagacugcugugcugacagugagaauuucaagccagugguucuuagcuugcugggcuccaugggagugggacccacugagcgagaccacuuggcucccuggcuucagcccccuuucuagggaagugaagucucacugggguuccuggaaccacuggguuuugaaaaaaacuccugcagcuagcucagugucugcccaaacagcugcccaguuaugugcuugaagcccaggguccuggugguguaggcacacaagauaaucuucugaucugcagauugcaaaaaccaugggaaaagcauaguaacccagcuggguagcacagucccucauggcuucccuuggcuggcggagggagguccccuggcuccuugcgcuucccaggugaaguggaagugacgcaccaccaugcuucugcucacucuccguggguucauuuuuccaaugaaaugaacggggcaccucaguuggaaaugcagaaaucacccuccuucugcauuggucucacugggaccugcagaccagagcuguuccuauucggccaucuuggccucuccuccuuugcccauauuuuaaaauagaguuucucauacuuuuuuuuuuuuuuuuuuuuuuuggcuuguacagggguuuuuuuuuuuaaaaagaaaaaaaaaagaaaaagaaaauauagaauggcuauaugcauuauaaauaauuucuucuaguucuaacccuuuuuuaaaaaauagugaaagauggccaggcgucguggcauaugccuguaaucccagcacuuugggaggccgaagcaggcagaucacuugaggucaggaguuuugagaccagccuggcuaucauagcgaaacccugaaacuacuaaaaaaaaaaaauagaaaaguuagccaggugugguggugcaccccuauauuccuggcuacucuggaggcugaggcaggagaauugcuugaaccugggagguggagguugcaguaagcugagaucacgccacugcacuccagccuggaugacagagugagacugugucucaaaaaacaaaaaaaaagugaaagucacguuuaaauuauuacauauuucuuuaccaagugacuguaacauaucuuuuuuuuauauucaggcacucuucaugauuuucaguaucaugaauagcaugcagccaguuuuguuaaagucaagcagggcuuagugauaggugugaagaacgucuaccauugucuugcaauaauaaagaauguguaggcuccacaaauuauacugguauagaugauagaugcuguaaagacuauuccacauguuacuuacacaaauaggaguagaaaauagucaauaaggacauagauguuuuuaagcagauuauaaguauauuuuuaagcagauugauaaguaaguuauauuaguaauguagaauaagagauauagguguugaauaucauaggcauggagagcaugcaaaaaacuuagucaccauagaaaaugguuuuauuuaugguaauuugagaaaagaccuguuugaaaaggcuuugauauagcaauuaauuuuaccuagcucaauucaugucacauuaaacuguguaacuuuuuuuuuuuuuuugagauggagucucgcucuguugccaggcuagagugcaguggcacgaucucagcucacugcaaccucugccuucuggguucaagcgauucuucugccucagccucccaaguaguugggacuacaggagugugccaccaugcccagcuaauuuuuguauuuuuaguagagacacgggguuucaccauguuggccaggauguucucgaucucuugaccucaugauccgcccacuucggccucucagagugcugggauuacaggugugagccaccacgccaggcccuguguaacuuguuauauucaucuaagacugauacagauuagcaguagacaaaguugacaguagagacacagacaauguuuaacgucuacucuguggucaaaauccuuucaauauaagcaguauauauagcuuccacgacaaagcucccuuucauaauaaauuaagguaaugccuugaaaauguaaauuuauauuuacccuauucuguuuacuaagggaaguguuaaauacuuuaggaaguguucugugcuuucaauuggacaguuagcuuuggaauaucuuaauuauccacaauauuacauuucaauaaccagacuaauuuuaaugagguuguaaagaaaugagguugcaaagaaauuguaccugaauagcugaaaccuuguauuucuguucaacucuaguucuguaaaauggauuuuaauucaauguauauuacauaucaagcauuaaagugaaaaauucuuaauuugcugagucuaauguauuuuuuuggggggggguaauaaacuuuaaagauaauuaccaaaacaccaagauaccuagccuccucuuaguaaugcauaacagcuuuugcaugaccuguacaggaaaacucaaagucuacaguacacagguaccaagcugccuuuugucuuucuaauucagaaaaagccugaugccugugcuguaagcacguuaacuacagggaagaaggaagagucauuaucaccaauagcuacccaguccuagcuacuguuaaaaaaaaaaaaugauuuaugggauauagucuuuacccuaauggagaaauaaaugcuugauggucuaaauuauaacuuagaauauguuuuucuauaagaaaacauaaaggaugguuugauggcaacagugcauuaauacauuagauauuuaauaguucaggggcugaucuggauuagacaauccaaagugcugggauucuaggcgugagccaccgcgcccggccacauaaauaucuuuauugcgaauguauuccuacucacacaugagauccacucaagcauuugcauaguagaaaaugaaccuuagaauuauuuuucagucaagaagaacccauguucuucuuuugauuucaauaaagaccguucuuccuagcaauuguaauuaggauaaugacuuaguuauuuucucuuuuuuugagacggacucucgcugugucaccuaggcuggagugcaggugcgauggugugaucucagcucacugcagccuccgccucccggguucaagagauucuucugccucagccuccugaguagcugggauuacaggcguguuaccaccaagcccagcuaauuuuauauuuuuaguagagacaggguuucaccauguuggccaggcuagucucgaacucgugaccucagaugauccgcccaccucagcguccuuaagugcugggauuacagguuugagccaccacgccuagcuaugauaguuacucuuaucuuuugaguucucaagauguaugaagacauaacaccuguaucuaagaauuccagagaaaggaggaagacuaaauagaauacaguuaagaaaaauacugacagacauguacagaauuauuucagugaaaucauagaaggugaagaaaggcuuuccugaagaaguaaauguaaaagcuagcuaaauguagaaaauaggcacaagcaucccagacagaaggaacagcauaugcaagauacagaaguaagaaccagcacaacacauucuggguuuuaaggaggagagaguaaaugaagggaaucugaauguaugugcauguacuuacauauacacuugcuugugaguaggcauuggguaaugguggugagaguguuguagaguugaaacuagggauacugaguuuacguaggaggcuucugaaauaaaacaagaaaugauuagugugaacucaaauaaugacuguaggccugauaaacaagggaugaauuugagagugauuuaggagauggaauaaacagcauuuaguguccaguuguaagaaguacuugaggaggcagcaucuuggaugacucccagguuucugccuuggguagccaccuaaauacugucagcuuuccauucacugugauagggaaugcagguggaaaaauggguguguguuuuguuuuguucaauuuuuuuccaggaagcuaaggguuucaugacuauuugugguugaacaccaguaaagaaccucuacugcuugggaggugagaacuaaaugagagcugaaaaugcauuuuguauuugagaguauagguuguauuauguaguagaaagagcuugaaugaacuuugaacucaaacuuugguuggaaucuugguucucacauuacuaguagcuaugugccuuuaagcaaauuauuuaguuucacuaagacuuagcuuauucauuuguaaaguugggagaaugauagccuuuuaagauuauuguuaaaugagaugagcuucugggucuggaagauaauggcaacuguccaaaucuaaaucucuccgcauguccuccccaaaagcuguaagaacaaaaggacuccacacacacaugcacacacacauauauauacacagaaaccauacauaacugacacuuucagcacuaccgcaagacagaugauaccaugaauuuuuaauuaccuuuauacaaggaaauagcacauuacaaugguuccuguugcugcuacaaaccugugagugggaagagcuggguaaggaaaggcuuaagagacugagaaaauaggagaagggaacagagguuaaaauaaaccacaggcaacaucacccucagaaaaaguccucagcguugccagguacaaagacaggccuaggacuugguaauuuauagaacuagcuacaggaagcuguaugaaagugagaggggccacaagcagcagcuucagaguagcauugcuccuagaagagacagagaaaagaacgacaccucuuggaggcauggcagcaagaggaaaggaaggaaguggggauaaaauugaggcuucuagagaaaugaaagagaaacaaggcacggcaacccaacccccacccaacaacuccaccguaacaccguccauuauaggcgcuccucuuuacuaaucugcagaagugaaugcucuuaaacuaagaacccaagaacccuaugcucaagaauagaaaugaaucaaaugcuacacaaagcuacuuuaagaggaauauaaaaauuugaaagaaaguguuucaguugauaaaacuucuccccaaaaaagcaaaugcaaagggaaagggcaucucagugcuccaaccaaauaaaauauucucaaacaaaucugugaacauacuacaaaaaccacaaacuuagaagcagaaaucuaaacucugacaugaaaagaagugaaaaaggaagaagugcaacaaaauuugauugaacacaggaaagaaauugaagagaaaggcaaagccaucucgggagacuacaguaauccagcuuuauagcugugguuucgcuuucugcaguuucaguuagccacagucaacuagaguccaaaaauauuaaauggaaaauuccagaaauaagcaauuuuaaauuguuuuuguuuuuugguuuugguuuuuuugagacagagucuugcucugucacccaggcuggagugcaauggcacuguuaccagggguccuugcucccagagcucccaagauggcagcgggcugcuuccaagcuuguggcaagucucacguucucugaccugggguucuuggccucacggauuccaaggaguggaaucuugggccaugcagugaguguuauagcuguauuagaagccgugggucacggaagagaaccuuggaacccagugacuaguguucagcucaauuaggaugaacccgggcacuuagcugugcaggaacaauggcaagccuuuagcccagucgggaagagcagugggcgccucgcuggaucaggagcacagcagacacccugccggauccggagggauggaagucagcggcaggucugcgaugguggcaaacagcagugguggauggggaaugaaagcucagcucgagccguaacaaacacggaccagaaaagagugcaguugcaagauuuaauagagugaaaacagagcucccauacaaagggaggggacccaaagaggguagcuguugcuggcuugaaugccugaguuuauauccugaucauugucccucccgcugugcucucaggcaauagaugauuggcuauuucuuuaccuccuguuuuugccuaauuagcuuuuuagugagcucucuuuacuaccugauuggucgggugugagcuaaguugcaagccccguguuuaaagguggaugcagucaccuucccagcuaggcucagggauucuuagucagccuagaaaauccagcuaguccugucucucagcacgaucucagcucacugcaaccuccgccucccggguucaagugauucuccugccucagccucccaaguagcugggacuauagguguguaccaccaugccuggcuaauuuuuguauuuuuaguaaagaugagguuucaccauguuggccagucuggucucaaucuccugaccucaggugauccuccugccucggccucccaaaguacugggauuacaggcauuagccacuguauccagccacaauuacaaguuuuaaauuggaugcuuuucugauuggugugaugaagucuccagccauccugcuccauccugcccaggaugggaguuauuccuuugucuaggauaugcagcuguuuaugccacugguccauuagucauuuaguagcugucuugguuaucagaucaacuguggugguuuugaagugcuuguguucaaguuaccuuuauuuuauuuaauaauggcuccaaagcgcaagaguggugaugcuagcacauuguuauaauuguuggauuuuauuauuaguuguuguuaaucucuuauugugccuaauuuauaaaguaagcuuuaucauaaauauguauauauugcaaaaacauuauaagguucaauacuauuuaaggcuucaggcauccagugggggucuuggaauguaucccccacagauaaggggggacuacuguauauuaauuacaaggugcccguggagaauagauucaaauaaaaaucuaauaagagccauugauaaaaggaaggaaaacaaccaagagaauguaaaaaguaguuuaaauucaauacaggcaaaagaagaccuaacauacuuaaaauuggagucccuaaagaagaaaagcaaaucacuagaacagaacuaauuaaaccauaacucaacacuuuucagaaauaauaggaaauuucaaauuuuacauauuaaaaggccccaucauggacagauuaauacagaacagcucugagucauagccuaguaaaacuauuagauuuuaaagacuuuuuuccugggccucuugagaggggaaaaaagauuauauuauuaauaaaaucaggcugacaucagauuccuuaagaacaauauauuuuuuuuuggucucacucugucacccaggcuggagugcaggggcaugaucuuggcucacugcaaccuccgccucccagguucaaguaauucucaugccucagccuccuguagcugggauuauaggcaugcaccaccaugcccagcuaauuuuuauauuuuuaguagagcugggguuuugcuguguuggcuaggcuggucuugaacuccuggccucaagugauccaccuggcucggccucucagaaugcugggauuacaggcaugagucacugcaccuggccuagaacaauauucaaaggaaggcuacaguagagcaccauuuuuaaaaacucaaagaaauaaagcacaagcuagccaaccugucuuuagaguaucagauaaacaguuugaacacacaagaauuuaggaaauauguggugauaauuuacuauauuuaaauguagauccaagacuuaaaacaguguuggggacauagauguaauuuuuauauguucugacaaaguaaaaagaauaaaacuaaaaauaagugggugaacaaagaauuaagauuauucuccacaauauagguaauaagugagagucauacaauaccuuuuaaauggauugaccagauaauaaaagguaaaguaggcaaaaagucgauuuggguuacucuaaaacacacacacauacacacacaccaccaccaccaccaccacaggagagagagagagagaaccacuggaacaaaaaauuaaaauuuuccuaacuaccaaaagaaaguacaaaaaauaaaaaaauagcagaaauaccacauaaaggaaaaaaaagaauacguaugaauaacaaacaugguaacuauaaagauagaguugaguucaaauaugucaaucauauuaguaaacauaaaugggcuuaacucaucuauuaaaauaaaaagguguucaaauggcuuuauaaagcaaaacccaauucuaugccuuacacaagagacauauaaaacagugauuccaaccaucaaaaauaaaggaauguauaugauauuacaggcaaauggaaaaaauaagaaaucaggaguuuccauuuugcugaacaaaguagaauccaggcaaaaacuauucaguaugacagaguauauuuauaaugguuaaagccauaauucacaaugaaguuauaauauuuuuuaguaucuagguaccaaaugacacagcaaacaccuaaauauaccagaaucacuauagcagaauauaggagaaugcaaguagcaauagaaacacauaauagaaaauuuuaaauacaucacaguacaaaucugguaugacaagaugucucaagaucaucuaguauauuucuugucucaaaccugaaguuagccauuuuuuucaaggacucuugguuucuuuuaaugggaaaugauauuuauaguucacaaucuuuauauuaggaguguucacuuauacuggguuugucuucaguucuaggccuuuacuaggacauuuuuacaaagagaaaauacaucacuaguccauacugaaguuuuuaauuaaaauuuaugauuacaagcuuuuuuauuuauuugauuuuuauauuuguaucucuuuugucuuaugcuuaaaaucuagguuccuaaugauauuaauaaaauuaauacauucaucuuaaccuacaguuucaaauuaguaauacaaauaguauuacuaacaauaugguuauugcaaaagguuuaagauguuugcaguucuuuuucuccauauuuuauuuccaaauauguauguacaaaugacggaguuuuaaauucacuugaaauaauuucucuuuauaugauuaaaccaccagcauucuacauaauuagauccauuuguuucauuuugcuuuuuacuuuuaggguuuuguuauuuuuauuuuauuuuugcuuuauuaaaaaauuguuuuaaagaauucaagauaguuuagcugacaguuguaguuuauuuuaaauaacaacuaaaagucuuggguuucuaggaauaguguuucaucaaaaguuagccaagaaaguuuuucuugauuuuuuuucccuaaaguagaugaaauauuuacuaauauaauaguuucauuuauccuguauauguacuagaagccucuagucuccaaggcagcucuaaaaagugccacacacuacuaccacacacacuauuucuaaacacuagucuggauuuuauauuaauauuuucuaagacauuggaacuaucaucagagccuugcaugaaacucguuuuaacaaacccuuagccuacuaauuuugguuauucagagucucaauuauauacauagcugcucaucuaucuuucuagugcuaaagugauuuuuaggcauaauaauuuaauauaaguaaaaguaugugccauagaauaugauacacucuggcucaaaaucuggauuuuacaacuuuaaaugggccaggcgcagcagcucauaccuguaauccuagcacuuugggaggccaagguggucacaucucuugagcccaggaguuugagaccagucagaccagucugggcaacacggcaaaaccacaucucuaccagaauaauauaaaaauuagccuggaaggucaaggcugcagugagcuguggucacacuacugcacucuauccugggcaacagagcaagauaaauaucucaaaauaaauaaacauaaauaaaaguuuagaugauuguauugggucaugaaaaucuguuuuugugacagcaguagcaaaauauaagauuguagauacugugucucuuuuggggaaguugaaucuuaaaauguguauaauucugugauuucucuuuuucagaggcugauaaaauaccaguaaugcguggacagugguuuauugacggcacuuggcagccucuagaagaggaagaaaguaauuuaauugagcaagaacaucucaauuguuuuaggggccagcagaugcaggaaaauuucgauauugaagugucaaaauccauagauggaaaagaugguaagaucaauugauacauuuaauauauucuacaaaccaaguaaguuguugauaaaguuuagagugguuuguaaauuugacauaauaauucaggagguuuagaauuagaaaauuugauuuuuuuaaacauuugauuauucuagaauuuaaaaauuaacuacuauaaauaucugaacuaucucaauuuuuauuuuaauauguaugguaagugucaugauauuaacacaguuuacuauaaauguacagauuguuacaaugcacucccuauuuaaucuuuuuuaguaauuuuuuaguuaucaaaggaaauugaacuuaacccaaaaauuccuuguuguuauaucaagacaaguuucauuaauauuucaauguucuuuuccugaaguucaaaaaaaaaaucuuuaauuaucuuuguguaucucuuaguuauccccuauugaaaaccauaucaaguuuuaauuugaaacaaucuacucauuacauuucuuuauucagcacuugcauauuuuuguaacaguucaaaauacuguauaguagcuaagauugccacauuuucauugugugucuaaaucuugaguaaacuucaaaauaugugguaaaguuaaaaauacuucuauuguuccauuuacugcaggcagugggaucaacuauucuggugaguauaacuguacagguagauuagaauuuguagauuugucugaaguuuuucuucuaaaaccguuucuucauccaugcuagucuuuauuugggagguuucuuggcaagcucuacugaaucuaaugaauuaaaauauuaauugauuuuuucccuuccccuccuaaaacaucucuaaagcagaaaaacucaauauugaucaggugauuuacagaaugaagcuugaaaaaaacgaauuaugugguuggaaguaauuguuuacauaacauaauuaaugucagcacuaagcuuuaaguuggcaggggauuuuuuucuucuucuuguuaguaacacuccauauuuuuucucucugccacucuuugcucucucuuaccucucugaacauauguauacauuugucacaagcaaggaaacuguguaguuuagcuuauaucaaauuaaaauaucauuugcaucuaguugauuaaaagucuauauaacugaggaaacuugugacuucugaauaaauuagcaauuaaagcuaacaaauuuauauaauaauaguugucuuuuaugugccagauaccauacucuggaaauucuaaauauauuuuccuaaucgguagaaucaaauauguccuuauuucacuguaaaauuuaaacuaaagguucuuacauaucaauaaauaaggagcagcccaguguaagagcucuagguauguuucuacagauugccauguaauacuuuguucuccuuauaguaaaaauagcaaguuuuauauaucugugaucuuaugguagugacugaaauauuucauaacuucucaucacuauuggucagaauaauuucaaaagucuacuucauaguauuugaaggauagaccuuuuaucauaaaauaaucuuauugccauuggagaagucugaguuccagauuuuuuuuuccuucuguuaauuccccuaaguauucugccucaaaaaugucaguucaccaucacaaacccaguuuagccaccugaauuucuuauuauuaacacaugaaaaaaauccaggagcuuggaggagaaagaggaugaguaugaaaaauacaaguagaugguuccccuuucucauucuguguucagaacuuuuuuuuuuuccauuugcuaagucacccuguggagauuaauaaucagcucuguuucuucucuagauucugccuguuucuaaucuuguuuuuacuacaauaaaaauuagaauuuaauauguacuuuuuacuucugcuuccugccuaaaugcuaaauguagcaagauacuucaguuuuucucaaaguguuugaauuuaaauaagacugauguaagaagaugguuuauuugugugaguacauuuuuuagaaugucuuugcguauguguaugugugaguguauauaucaguucuaggguagcaaucucuaggauaucguaauauuuuuuguuaucuuuauggauauacauggaguaguaaaauuuuaauuaguaauggaaaauuauuaaauuauuagaacacuuuugcauuguaaucuuucaaaaaugaugauucuuugagguucauuagaagaaaauuuguuuuuauaauguacuguggcauauaagauucagcauguucuguuauuagcaaagauguguucaacugaacauaucuuugucauaauuuuuggucacuuuauuuuuauucaauauuaaacauauauuuauaucuuguuacauuuggcuuugaaaauuaugggaaauuguguaguacauuugaaaauaauaacaagucuuaaggaaagaacauuugcuauccaaaaagcuaccauugucgggaaaaucauucaaauuuguaacuacaaagacuaaaaaauauuauaaucuuuuuaauuuacuguuagcucuaagcuucugaaauuuuauacuucauuaguuugagggaggaaaauacccuuuccaccuaaauuuucucauguauaaagccuugacuauucauauugucagauuuugaaugaugccauguauaguaaugugguaggcacuuuugugaaagaaaucgacaagguuucuacccucaaggaguuuuaagccuguuagaguagacaaagccaacagaugaaaacaguuacaaaagaguaaguacaagaagacauaguaguagacagucaauauuacauauucugaaaagauauuuggaauaaagugaguagauaaucacaaugcaguggaauuauucacauaaggcuuucuggaaaaaccucauuuaauaauuuaaaacauuuuaaaauacuauauucagggauguuuauuaaaugcucuagggaauaucaaagaaacuaauaguucuugccuucagggacauuaaaauaaauaauaauuccuuuuucuucugaccuuggcuguuugguuaggguuguucuugccacaaacagauuagcuguacaguugucccuugguauuugugggggauugguuuuagguacccccuaccaccaccagauaccaaaaucugaggacauccaagucccuuuaauaaaauggagugguauuugcauguaaccugugagcauacucuuauauauuuuauuuuacuuuuuggagacagggucuuucucugucacccaggcugcagugcaguggcauaaucacagcucacugcagcuucuaacucccgggcuccaggacccucccaccucagccucccaagaagguguacacuaccacaccaggcuaauuuuuuuuuuaaauuuuuuguagagacagggucucacuauguugcccaggcuggucuugaacuccugggcucaaguguuccuccugcuucagcccccacaaagugccaggauuacaggugugagucacugugcccagcucugucuuguauauuucaaauaauaucuagauuauuuaugauaccuaauacuaugugaugccauguaaauaguuguacaccauguugguuuuugauugauaauauuuuuuauuuuuguguuuuauuguuuuuuuccccacauauuuuuggucugugguugguugaaucugcagaucaggagugccaacuguauuuaaucuuuuccuccuuauuaacuuuccuuacuaaucucaaaaugagcauugaauuaaaaaaaacaugaaaauuugguacaguguguaacucuuuguagcauacaaauaaagauaacccacaaagagauaaugacuuugugauuuagauacuuuaaucuaaauuuaguucucugugagaguuaaaaugaaaauugauuuucuucuuacccuaccuccugggcuagaaaauguuuagcaguuuaacaaaugaaagccuacuguuucacuugggaugaaacauaaaaauagaaaucaagaugucaacaaguaauuugguaaacauuaauacuuaaaucuacugcuggauuaguguuucacucauuuuacaucuuauugauccaaacaugcauaguaaucaguaaaaaauagguugaacugaauggguaagugcagcacaucacucugcccaaaaaaugaguaaacucaauucagucgugagaaaacucguacugagggugauucuacaaaauaacugacugaccagcagucuucaaaagugucaaggucaugaaagacaaguaaauauugaggaauuugucacagaauagacuaaggagacaugacaacaaaaugcaaugugguacccuagauuggaucguagaacagaaaaagauacuaguggaaaaacuagagaaaccugaauaaagucuguauauuaguugauaguauuguaccacuguuaaugucuuaguuuugauaauuauacuauaguuaugcaagaugcuaacauuaggagaagcuggaugaaggauaugucauagcucccuguacuauuuuugcuauuuucuguuaagucuaaaauuauuccaaaauacaaaguuuaagucuaguagaggaauuaaaauggaauacuaaaaaauauucaauuaacccaaaauaaaccaagaaaaaggaacagagauacaaaaaacagaugggacaaagagaaaaauaaauggaaaaauggcagaccuauucacccauaucaauaacaacaaauauaaauauauuuguauauauaagauaauuaauacuccaguuaaaaggcaaagugacagauuguuuaagaacgcaagaccugacuauaaaaaucacagauaaauugaaaguaaaagauuggaauucuuacuguuccagguaauuucaggugccauagcagcacagguguuggugucucuguaaagauuuaugacauuuaacaaguugguggaugaaguguguauuccuaucacuguagcugaauaaauauaccccguacugugaacauagcauuucaaagcucgauuaaaaagauggaggggugcucaccuucuaacuagcuuuccuuuucuucucucuuuggugacuaagaggauucccaccuucuagcuuuuaguuauuauuuaauuuuuauaaauuuaucuaacuuuauuucucugagguccaagaaagauugccagaaauuuucucauuauaguuggcagguuagagauguguaagacugcuucccugggguuggaauuuuucagguugccagcuuuucuaaagggaaaaguuaguuuuucuguuguaggaauuaguaugucaucagcagcaguaacccucuuuugugauacucuugugcuuucagaguuauauaaugcagaaaguuucuuuaagauauaguaaggaaauuuauuggaaauauuuuuaguauuuuaaaucuuuuucauugcuauguaagacuuuaacauauuaauuuuuauuaaauguuagcacuaauaaauuagcauuugcaguuguguuuugagguuaugcaucuuuugcuaauacuguguaagaauuucuaacuaaaacuguauuuuaaaaaaagaaaauuaaauagugcuuucuggcacuugaauuuucuuuaacagugaucuuuguuuggaucgauaguaaacucuuuuuuuccucuacuguacuuaucauaguaccccuaauucugugcuuuggguugaaaaaguuaagcucuguaugcuacaggauguguaauaaauaaagcaaaugacuuucaagugaaaauaagaauuacauuugaaaagaaagaaccaugucuguuuaauuuugugaaaauguuuuaaauauguuucucuggaggaugaaaaaaauuuuuuucuuuguuucucuguguauagggguguuugucuuuuuauuaauccuuaaauuauacuauucuuuuagaaaagaaagccuucauuuguguaucuuggcuagcuuuccgaaagcguuuacauaauuuuaaaacauggucaaaugguccauacauuucccauuucguucucguuuaauauuuaauaauauggaauugguucacguuaguuuuacuaccagaucuacaaaaucuaguuuuuguuucaagcaguaaagucucaaguuugugucaguuugauuuacuuugauauauuagcaucuuuuuccuaaugaauuuuuuguuuaaaacuguuuccuggucuaagugguacaucugcuccucaguaacugaccagaaggcacaugaaagaagaaacauuuucagugaagaaaauugcaucaguugucauuuuuuaccucucugugacaaggaaauguuguuauaauccugacguagcacagcuuuuaguuccaguuuauaguuuuguagccaucuaauuacauauagauauaguuauugugucuuguaagcauuucucaauuacuuuuauuacacaaaucuuugcauauacuacaucugcauauucaacagauuuguuacauuucuaguauuauaaaacaggaauuaaauauuuuuguauuugagcaguauuuaaccuuugaaugucacauuaauauagaagggagugaggaugaaaaucaaauguauuugaacaugaauuugagcuaaucauaaagauccuguaauuuauuaacuggugagaaacuaauuuguaagguucaaguucaagugaacuuuuaaauaauugcuuacuuaaaauauaaagaaauuuauauaacuaccaaaauuugacagggaaaauguugacuuuaagguuaucuacugauuugccaaauaucaagucugugccuagcuuuacucuauguugucuguuuagugcuuacaaguugucacagcauacauuuuuacuaaugacuuuuuucauuauuuuauuacagucuuuucaaaagcaaaguuaaaagcagagcuuccaguuugauuuuuguuuuuuaguaaaaguuuuguuuuuuaaagucuuuuaagaacuugaauggaguugagaaaagaauuuuuuuuuuucccuaagggaagguuccauuauacuucagcaguggaaagcaucuaguagaauguaugcugugguaucuucucaggaagguugcauuagauauguaaaauguuauuuauugcauuuucaauuuguacaucagcuguuggcugugucagucacaaauuuggugagaguaaauaaccuuaguguuguaaagauggaguuuauaaaucucuuggcauuugaaaauguuauguucuuuuuuaaaaauucuuucuaugcaaagacauuaaacaugauaaucaguuguuuuuaauaaauuuagauauuauuugccuuuuuucuuucaguaacagcagcuauuugauaaacauuauacuaauguuuugcuuuacugauucuuagaaaucauauaaaugaagcauuuagaauaauguuuuucaaauacaacucauuuuuuaaaguuaauacuagaacaaaaaggcaaaauggcaaaucucauuuaaaauuuacuuugaagcucaguguuuuugcuuucuuaguugucuaccaccucccucccuucucccucccuucucuguucaaauggagaagauauaaggagaguacagaugcgacaggucuuaaacgaaagcauucccaagguacaguaauuguaguuuuauuucuccauguaguuauauuccuggcuuauaguauucaguugcauuuaaagcauagaaauuauuaguuuuuuuuaaauguguccauuguauuaguuuguuuacugcuacuuuauuauguguauaaauauugguaaacaguguguauaguccaguaacaggauauucagauguuccccaacauuaaaaugguuuaagaugauauauggaugauuuaaagaggaaaauaauuuuucuggcuuaacacucaucucuaaauaucuugaucucauaguuuaacguuuuaagcaucuguugcucacaacuauuuuaacaaaaaugugguuuagaaacauauaagagcuugaaguaguggcauggaucagauauguaauuagaaaagugauuguuaaacccuugcaaaagauuuuuuuuaguuuaugaaaagcucuuuuauuuaaaaagcugaccuuauacauuauuuucuuuggaaccgaagauauaauuuauguuuauuauguuaauugaaucuugaucugguguacaguguuaguaaugugccguggcagguaaguaaaauauaaauugguuuuucauaaacuucugaaguugcauauuuaauauaacuaagaaguacaauuccucauaauguacuuguauccuaguggggaauagguuuucauaaaaaugucuuaugaucauacaucuugaccagagcuauaucuuuuuauauuuagcuugagguuauuuucagcccaucuuuaaaucaguagaguuagacucugccaguagcuaacucuguggcaggucaguuugucucuuuguaccucuguauuuuuguaaguaaaaugggagauaauauuuugccuugaaagaauuuuaagaaaauaaaucaagcauagugauuugaagguacuuagcuuucugaagauggguauguuaauuuuuccuaccuauauaccagagcuauaaaggaaaagcuuaagguccucaaaacauaagaauuaucaaauuaugaauugauggauauguuauaucaauuucuucacuacuuccacaaacauugcuguauuugugguaugugccagacacugugauaggacauucuguuuggugcuagggauauauaagaaauggucaagacacauucccuggcuccuggggcuuacgaauuccuaaagaaaauagguuuggaauuuuuuuaaggccucauuuucaccaagcauauccccaguuacagaaaugcagcaaccauacugauuuuuuuuuuuuuuuugagacaggaucucucuguguugcccaggcuagagugcaguggcaugaucauagcucauugcaggcuugaccuccugggcuuaagcgauccuccugccucagccucccaaguagcuggaaccacaggcacauaucaccaagcccagcuaauuuuuuaguuuucuuuuuaagagacggggucucauuauuguugcccaggcugcuaucaaacuccugggcuccagugauccuccugccucagccucccaaguagcuggaaccacaggcacauaucaccaugcccagcuaauuuuuuaguuuucuuuuuaagagacggggucucauuauuguugcccaggcugcuaucaaacuccugggcuccagugauccuccugccuaagccucccagagugcuggauuacagacgugacugacugcacccagccaaccauacugauuugaacaucauggcagaaaaacauuuccuuaauuuuguauuacuaaaauaucuuucaauuuuggauuucugcuaugaugagcaauauccaauaauuauuggcuuuacuauccauuccaaaaauaccucauuuucuaauagauuauuuuuuucccaguuuaaagguaaauuuuuuuccccucugagucuuauuuugucuaguacuuagugaaauuuuuuucuuuuuuuuuuuuagacggagucuugcucuguagcccaggcgggagugcaguggcgugaucucggcucacugcaagcuccgccucccagguucacgccauucuccugccucagccuccugaguagcugggacuacaggcgcccgccaccacacccggcuaauuuuuuuuuguauuuuuguagagacgagguuucaccguguuagccaggauggucucgaucuccugaccucgugauccgccugccuuggccucccaaagugcugggauuacaggugugagccacugcaccuggccacuuagugaaauuuuuacaaauccuuugauauuuuuaguaaaaucaguagaagaaacugaaauuaaguugcucugucaaagcuauugagggcuugagguauauaugccuuagacccagugaagagucagccacaucacccgggaaagcaguuaauuaucaaaacacauagaagcuguauauuagagguuaaaauuaugauaguuaaguaacucaaugguuuaaaaaguugccauucccuguagcaggauuaaucauuuauaaaauaaagucccuauccauuacuugcuucacauaacuuuuuuuaugugaaauaguguuuuauugaauuaaguuccauaucugaguuuuuuagauaacauauugauuuuaaaaucugaguguuauaauucuucaaacaaauaaaguuugucuuggagaccuucaaauuagcuuuuccuuuuugcaauagcuguucauaguuucaaguugagucgaaaccauguggacuggcacaguguggaugaaguauaucuuuauagugaugcaacaacaucuaaaauugcaagaacaguuacccaaaaacugggauuuucuaaagguaauuguuaaauauuacuagagcuuaucaaaauuuugggaaucugacuuucucucauauucaaaauagacaauucauauucuguuuuuaguauguuuuaaguauauuaaauuuagugacagauuccuuuuuaaaugaaacuuuuauuaaguugauugaguugacauguguucaucaaggaauaauuauuauauauuuagaaugauuugacaaaauuaauaaauaucuuuuauacuucuaaaagcacaaaagcuguuaaaccuaaaauguggcaguugaaauauagugucaaggaagaugaggacugaaaguuuuccauuguauuuagugaucuggaggucacuggugacuuagauggauugauggggcagaaaccagaucggcauggguugaagcguaaguagaaggugaagcaauggaagcaaugagaauagacaacuccuuuuuuuuuuucuucuuuuauuuuuaagauggggucucacucugucucccaggcuggaguacaguggugugaucauagcacaucauaaccuggaacuaauuccugggcucaagcaauccuccaaacucagccuccucaguaacuaggauuacagggaugcaucacuaugcccagcuaauuuuuuuuauuuuuuuguagaaacggagucuccuuguguuguccaggcuggucucaaauuuuugggcacaagccauccucucgccuuggucucccaaagcucugggguuacaggcuugaaauacagugccuggccugacaacuguuuagagaaguuugacuaaaugaaagaaaagagagaaugauaccugggaaagaugugagagcauuaucaaaaaauaaauguaaaaagaauuuuaaaguuugauaaaauuuuuauauccuauuuuaaaauuuuaauuucaucaauaagugugcuuugaauaucuuuuuauguuuauuaguuauauuuauuuugaauuaccuuccauaacuuuaacuuauuuugcuauuugaaugguugucuuuacuuuuuaauuaguaagcucucucuguauacuuaaguaauuauguguuauauuuugcauauuuuuuuccaguuugccauuucuuuuuuccugauauuuucuuauuauaauauagaagcuuuaaauuuuuauauauucaguuuguccuucuuuccuuccauuucuuucucuuuaugguuucuggcuuugguguuguguccaguucacuuuauaucacagcugaucaauauauaccuucuuacaguuuuuauuuccucccccacagccagugaaauuuuuucauaauauuccuuuuacuucuuuuuuuucuuuuaacauauuguggaaaugcuauuucucagauuaaauaguaaacuuagaauuauaauuuuucuacagcaucaaguagugguaccagacuucauagagguuauguagaagaagccacauuagaagacaagccaucacagacuacccauauuguauuuguugugcauggcauugggcagaaaauggaccaaggaagaauuaucaaaaauacagcuauguaaguucuuugaugaaugcauuguauaucuaaucuagaauccaaacuuugauccaggguauaagagauauuaacaguauacuaauuccacugcauguuccuccagugccaacuauucuaauaccucuuaagucauagaucaaguaucuggaccaaauuuugagagggauuaugucuacaggaugaugacaauguuugaucuuucuccccacaguauggagaagagggauaaggaagccuuuuuuaaucuaauacauuaaguuaauuuauaaucuaacauugaaagcaagaagaagaucuaguuuuaaguuacaucuuacucucugaacuucagaaacuaagaauacugcaaagcugcacaacucuaaaaaggcuaagaauuagccaguuagcagcuuaaccuauccaauuaauugcuacccaaggaaacugaacucugaauuuuauguggaaaacaguggauuauuuaccaacacaccagacagguuauuuaccucauuaguuuauuuauauucagcuuuauccugaaacuuuuuaagaugucuuagggguauaugugauauuugcguguuucaaaaacauuaacaacuuuguugaaagggcauguuaggguuaaggguuccaccacaaauuuggcucugagcuagcaaccaguauaaagaaaaauauaaucaguuauagaugaugccaagagaacaagucuguuguugacaagcccaguuuauuugauucugaggcuuauaaaggcuugaguccuuauaaagcaaacagugugugauaccagaaaguauguccucagcaacaccucuauaauaauaaugcaaugcugaguuuuauuucacuuuuuauuguaacaucucuuaaugccagcuaacggauuaaaguuaaaauacaauucaacuuuuuuuuuuuuauuauacuuuaaguucuaggguacaugugcacaaccugcaggauuguuacauauguauacaugugccacguugguuugcuguacccauuaacucaucauuuacauuagguauuucuccuaaugcuaugccuccuccauccccccaccccaguggggcccggugugugauguugccuacccuguguccaaguguucucauuguucaguucccacauaugagugagaacauacgguguuugguuuucuguccuugcgauaguuugcugagaaugaugguuuccagcgacauccauguccauacaaaggacaugaacucauccuuuuuuauggcugugucauauuccaugguguauaugugucacauuuucuuaauccagucuaucauugaugaacauuuggguugguuccaagucuuugcuauugugaauagugccgcaauaaacauacgugugcauaugucuucauaguagcaugauuuauaauccuuuggguauauacccagucauggaauggcuggaucaaaugguauuucuaguucuagaucccugaggaaucaccacacugucuuccacaaugguugaacuaguuuacagucccaccaacaguguaaaaguguuccuauuucuccacauccucuccagcaccuguuguuuccugauuuuuuaaugauugccauucuaacuggugugagaugguaucucauugugguuuugauuugcauuucucugauggccagugaugaugagcauuuuuucaugugucuguuggcugcauaaaugucuucuuuugagaagugucucuucauauccguugccuacuuuuugaugagguucuuugacuuuuucuugucaauuuguuuaaguucuuuguagauucuggauauuagcccuuguuuaaauggguagauagcaaaaauuuucucccauucuguagguugccuguucacucugaugguaguuucucuugcugugcagaagcucuuuaguuuaauuagaucccuuuugucaauuuuggcuuuuguugccauugcuuuugguguuuuagacaugaagucuuugguguuuuagacaugaagucuuugcccaugccuauguccugaaugguauugccuagguuuucuucuaggguuuuuaugguuuuaggucuaacauuuaaguccuuaauccaucuugaauuaaauuuuguauaagguguaauuaauuuuguguaaggaagggauccaguuucagcuuucugcauauggcuagccaguuucuacauauggcuagccaguuuucccagcaucauuuauuaaauagggaauccuuuccccauuucuuguuuuugucagguuucucaaagaucagaugguuguagaugugugguguuauuucugaggccuguguucuguuccauugguguauaucucuguuuugauaccaguaccaugcuguuuugguuacuguagccuuguaguauaguuugaagucaguuagcaugaugccuccagcuuuguucuuuuugcuuaggauugucuuggcuaugugagcucuuuuuugguuccauaugaacuuuagaguaguuuuuuccaauucugugaagaaagucauugguagcuugauggggauggcauugaaucuauaaauuacuuuuggcauuaugaccauuuucaugauauugauucuuccuauucaugagcauggaauguucuuccauuuguuuguguccucuuuuauuucauugagcaggguuuguaguucuccuugaagagguccuucacaucccuuguaaguuggauuccuagguauuuuauucucuuugaagcaauugugaaugggaguucacucaugauuugucucugucuguuauugguuuauaagaaugcuugugauuuuugcacaucgauuuuguaucccgagacuuugcugaaguugcuuaucagcuuaaggagauuuugggcugagacaaugggguuuucuaaauauacaaucaugucaucugcaaguagggacgauuugacuuccucuuuuccuaauugaauacccuuuauuuccuucuccugccugauugcccuggccagaacuuccaacacuauguagaauaggaguggugagagagggcaucccuguguugugccaguuuucaaagggaaugcuuccaguuuuuguccauucaguaugauauuggcugugguuuugucauaaauagcucuuauuauuuugagauauguuccaucaauaccuaguuuauugagaguuuuuagcaugaagugcuguugaauuuugucaaaggccuuuucugcaucuauugagauaauuacaugguuuuugucuuugguucugguuaugugauggauuacguuuauugauuugcauauguugaaccagacuugcaucccagggaugaagccaacuugaucuugguggauacgcuuuuugaugugcugcuggauuugguuugccaguauuuuauugaggauuuuugcauugauguucaucagggauauuggucugaaauucucucuuuuuuguugugucucugccaggccuugguaucaggaugauguuggccucauaaaaugaguuagggaggauucccucuuuuucuguugacugcaaugguuucagaaggaauggcaccagcuccucuuuguaccucuggaagaauuuggcugugaaucucucugguccuggacuuuuuuugguugguagguuauuaauuauugccuuaauuucagagccuauuauuggucuauucagugauucaacuuccuccugguuuagucuugggggaaagguguauguguccaggaauuuauccauuucuucuagauuuucugguuuauucgcauagagguguuuauaguauucucugaugguaguuuguuguauuucugugggaucaguagugauaaucuuuuuaucguuuuuuauugcaucuauuugauucuucucuuuuuucuucuuuguuagucuugcuagcggucuaucaauuuuguugauuguuucaaaaaaccagcuccuggauucauugauuuuuuugaaggguuuuuugugucgcuauuuccuucaguucugcucugaucuuaguuauuucuugccuucugcuauauuuugaauuuguuuccucuugcuucucuaguucuuuuaauucugauguuggggugucaauguuagaucuuuucugcuuucucuugugggcauuuagugcuauauauuuuccucuauacacugcuuuaaaugugucccagagauucugguacauugugucuuuguucucauugguuucaaagaacaucuuuauuucugccuucauuucguuauguacccaguagucauucaggagcagguuguucaguuuccauguauuugugugguuuugagugaguuucuuaauccugaguucuaauuugauuacacuguggucugagacacaguuuguugucauuuggguucuuuuaccuuugcugaggagugcuuuacuuccaacuguguggucaauuuuggaauaagugugaugugaugcugagaagaauguauauucuauugauuugggguggagaggucugcagaugucuauuaggucugcuuggugcagagcugaguucaagucccggauauccuuguuaaccuucuaucucguugauccgucuaauauugacaguggguuguuaaagucucccauuauuauucuaugggagucuaagucucuuuguagggucucuaaggacuuccuuuaugaaucugggugcuccuguauuaggugcauauauauuuaggauaguuagcucuucuuguugaauugaucccuuuaccauuauguaacguccuucuuugucucuuucgaucuuuguugguuuaaagucuguuuuaucagagacuaggauugcaaucccugcuuuuuuuuuuuuuuuuuuuuuugcuuuucauuugcuugguugagcuuccuccaccccuuuauuuugggccugugugugugucugcaugugagaugggucuccugaauacagcacacugaugggucuuuaucccauuugccagucuguaucuuuuaacuggggacauuuagcccauuuacaguuaagguuaauauuguuaugugugaauuugauccugucauuaugauguuagcugguuauuuugcccauuaauugcugcaguuucuucccagcaucaauggucuuuacaauuuggcauguuuuugcaguggcugguaccaguuguuccuuuccauguuuagugcuuccuucaggagcucuuguaaggcaggcccgggggugacagaaucucucagcacuugcuugucuguaaaagauuuuuuucuccuucacuuaugaagcuugguuuggcuggauaugagauucuggguugaaaauucuuuucuuuaagaauguugaauauuggcccccacucucuucuggcuuguggaguuucugccgagagauccgccauuagucugaugggcuucccuuuguggguaaccugaccuuucucucuggcugcccuuaacauuuuuuccuucauuucaaccuuggugaaucugacaauuaugugucuuggaguugcucuucucgaggaguaucuuugugguguucucuguauuuccugaauuugaauguuggccugccuugcuagguuggggaaguucuccuggauaauauccuaaagaguguuuuccagcuugguuccaguucuccccgucacuuucagguacaccagucagacguagauuuggucuuuucacauagucccauauuucuuggaggcuuuguuuguuucuuuuuacucuuuuuucucuuaacuucucuuuucgcuucauuucaugaauuugaucuucauucacugauaaccuuucuuccccuugaucaaaucagcuaccgaagcuugugcaugugucacguaguucucgugucaugguuuucagcuccaucaggucauuuaaggucuucucuacacuguuuauucuaguuagccauucaucuaaucuuuuuucaagguuuuuagcuuccuugcaauggguuugaacaugcuccuuuagcucagagaaguuuguuauuaccaaccuucugaagccuacuucugccagcucaucaaagucauucucuguccagcuuuguuccauugcuggugaggagcugcgauccuuuggaggagacgaggugcucuggguuuuagaauuuucagcuuuucugcuguaguuucuccccaucuuugugguuuuaucuaccuuuguucuuugaugauggugacguacagaugggguuuugguguggaugucauuuuuguugaugcugcugcuauuccuuucuguuuguuuguuuuccuucuaacagucaggucccucagcugcaggucuguuggaguuugcuggagguccacuccagacccuguuugccuggguauuaccagcggagucugcagagcagcaaauguugaagaaaagcaauuauugcugucugaucauuccucuggaagcuucgucucagaggggcacccggcugugugaggugucuuuuggccccuacugggaggugucucccaguuaggcugcauaggggucagggacccacuugaggaggcaaucuguccauucucagaguugaaaccccgugcugggagaaccacugcucuuuucagagcugucagacagggauguuuaagccugcagaagguucugcugccuuuuguucagcuaugcccugcccccagagguggagucuacagaggcgugcgggccucauugagcugcagugggcuccacccaguuugagcuucccagccacuuuauuuaccuacucaagccucagcaauggcagaugccccuuccccagccaggcugccgccuagcaguuugaucucauacugcugcacuagcaaugagcaaggcucugugggugugggacccgcugagccaggcgcgggauauaaucuggugugacauuugcucagaccauuggaaaagcacaguauuuaaguggcagugucucgauuuucccauuacagucugucacggcuucccuuggcuaggaaagggaaauccccagaccccuugcgccuccugggugaggcaaugccccacccugcuucggcuugcccuccaugggcugcacccacuguccaaccagucccagugagaugaaccagguaccucaguuggagaugcagaaaucaccugucuucugcaucgaucaagcugggagcugcagaccagagcuguuccuauuugaccaucuuggaaaagaccucacaauucaacuuuuuaaagaaaaaaccuugucacauagugccaggccaaccuugauccuuuucaauguccauagcuuauauuacagaaaucucuucacucugauccugauuuuacucucugaugaauuauguauuacuucccgugauguuuauauuuauauguuaguaugcagauauuuugcuugaauaucuaggaaccugagaacuagguuuacuuguauauucucucuggagccauugauaaauaagaagguaucaguuugauuccuuugaguacaggugagggaaauccuaacccaaaaaggcuuaagccaaaagcaggauuuaguaaaucauaaaacugaggagucuaggagucauauugccaagcaagucaucaaaauccaguuuuaucugcucuauagccuucauuuuggagccauuaucacacaucuccuuugauuccaaaugugauuuauauaaucuuguguucaaauucaagaagaauaaguccuuuuuuccaaaagucccagcuagucugugcauuagcuagugacuaaugauguugauccaacuuccugaaucuauguauguagccaagcaggguaugauuggcuaaacuugucauauucccaaccuagaaucagauggaaguugacuucaucuuaacuauaggaagagcuagauucacagauaaaaaucaagagcuauuauuggaagcaggaugaaugaauccaagguggcucaaaaaaaaacccaaguguccacuacaaggagcauugcuaucauuucuucguagacagguuaauuugauggaaaauucuacacauaacuuaguaaucaauggaaaauauucauauaaaaaggaauucugcauaauaaaagagagaaagaugggaaaauccauaggauuucuuaccauuucccugcuugcugucauuccuaaguucaguguucgggccuauacaaaacuucauccuuaucagugccauccugaagcuuguguguacuugugauugauuugacagccuuuuguucucugaggauuucuuuaaaucaugucuuagauuccugggaauagagaguuuucccucuuaaccuuauuuuagcaaacuugcuaaugauuaguucagacuagcuucaaucaccuuuguuccagaaaaauauguuuaccgcuuacauagacugagaagcaaauuuuuagacaacuucugggaaugucagaauuaguuuacuaaaagggauaaauggaaggcauuuuaaauacaauugaauuuacuuuuuguggaguuuaauuacaagggaacucuucauagaacuuggcauaucuaauacccuaaauuagucauuuuaaagcuauaaucuuagaagacuauaaagagguuuucaguuaaacacaguauguugaacacaugagcuuaucuuauucccuccugaaaccuuuuugaacaugauauaaaaaagaauuuuaaaaagcaaaaaggcauaaacccguaaguacagaaaaaaaaugggagaauaaacaauagugacaagaauaucaacgaaacuuauuuuuuugaacaggacauacauguaguucacaaaacaaaauauuaaaauauggaguaaaaaggcugauucucauuucucuccccgucuucccucauuauccuuuguccuuguguccccauuuagagucuucuagauuuucuuuaggcauacacaaauuuuuuuccacacaaaaggugcaugcuauagacuucuggaccuuguuuuuuuguuuguuuguuuguuuaaaaaauguauuuuggauugcuugagcccaagaguucaagacuguggugugcuaugauccuaccugugaguugccagugcacugcagcauuggacaaugaagcaagaccccaugucuuuuuuuuuuuuuuuuugagauagagucucacucugucgcccaagcuggagugugguggcaugaucuuggcucacugcagccuccgccuccuggguugaagaaauucuccuaucucagccuuccuaguagcuggaacuacagucacacgucaccacacccggcuaauuuuuguauuuuuaguagagacagggcuucaccauauuggucaggcuggucucgaacuccugaccucaggugauccacccaccucagcuucccaaugugcugggaucacaggcgugagccaccaugcccggccaaccucaucucuuaaaaaaaaaaaaaaaaaaaaagguaucuuggagaucacuguucaugauuuucuauuuauaucuuuuucuauuuuuuucuauauuuaugucacacauauauuuucuuaaaaccaauuaguuuaccaauuuuuuucuaauugagaggaauuaugaagacuuauguuuuacagcuauuuaaugauccucaguuguacaguaauucuuaaaugcuauuaaucucuaucuucucuucuuacaauaugaaguaaacauucauugcucagagaacauggaaauugaaauaagcuuauaacaggacugaaaucaugauuuuugugcaugcauagcagcacaguaaugggucauugucugagguauaguauaauauuguuuaaucauuccuuuuucucauuuucucuaucucccauuggucucaguaguucuuaugagauauuuaagaaauagauuuuacuguuuuuaguaaggcaaauuugggcguauagccagaacauauccaacuucucucuucccucucccugucucccucuuccucuuuuccccaucccccuccucucccuucuccuucccucauuauuuuuucauuuuucuuccauccuuuucuuuuuuuucuuaacagucacuccaguacuccaaaugauucaguagacauaccuguuugaucaguuuuuaaucauuugagaauuaugauagcgauccuguggagugaaggauuguguaaguuugcuuuauaacaaaacaacauuuuaagcagauguaguguuuccaaguugagaacucaaaauuaggguuucccagcuacaucacuauugacauuuuugacuggauaauuuuuuguuaugauggcuggccugugcauuguaagauguauaacuguaucccuugccucuccucacugaugcaaauaaaacccuuaguuguuagaaccaaaaauaucuccaaacauugccaagugucccucgaaguacaaaauugucuaugguugagaaccacuaaucuaaaugaacucuuuugugugcaaauucaaacagcagcacauguaccacuuccuaauuacuaugccacaaugauuuacauaagaacuacacagccaucaaaauugaaugaguggguagaaaaauauuagaaauuuuuaaauauguucuuccuugcauauacucauauuuguuaaaacugaacauuugaaaagaugacaaagaaacuuuaaaaauguuuaugcgauuacuuaucugauguaaaaaaggaacuuuuagacuuuguggauaauaaagaaauccugccuucaagucuaaaguuuuggcugucauuuuauuuucagugaugauaagggaagcacaucuuuauuuuggcaaaguagaaucuaggcuucuuaaaaugcgaacuuuggggauaugcagucaauaaacauaauuauaaugcaaugucuuuuaaaauauacugaaaaugaagauagacuucucaacaaguacuauugggauaacuagauuugcauauagaaaaaaauuaauuggauccauuucucacacaaggauaaauuucaauuggaucacauuuaagugaaagaaaugaaaccaggacaugguagcacaugccuauaguccuagcuacaugggaggcugaagcaggagaaucgcuugagcccaggaguuugaggcuguagugcccuauaaccacaccuaugaauagccacugcacuucagcuggggcaacauagcaagaccucaucuccaaaaaaaaaaaaaaaaaaaagggggaaggaaaagaaaugaaauuauacaaguauuagggauuuuuuuaaaggagaguuugaauucuucuagaacuuaggaauagagaaaauuauucuaugacuugauccacgagaaauaaggaaaaauauugauaaauauauugucuaggaaaaaaaauauauggcaaagaaaaauuaaguugaacugaaagaaacauuuucaacuuacagaugaaggauucuuaauauguaaaaucguucuaaaaauaaaaauauguucaaccaccuuauaggaaaaugggcuaaagauauaagcaaguaguucccagaaaaggaaauggcucuuaaccaugugaaaagucuuuuuuuuuguuuuuuggagagaguuuugcucugucacccagacuguugugcaguggcaugaucucaguucacugcagccuccaccuccuggguucaagcaauucuucugccucagccucccaaauagcugggacuacaggugcacaccaccacacccagcuaauuuuauguuuuuuuaguagaguugggauuucaccauguuggccaggcuggucucagacuccugaccucaagugaucugccugccuuggccucccaaagugcugggauuacaggcgugagcaaugcacccaaacagaugucauuucuuaacuaucagauuagcaauagcaaaaguucaaaauuugacaacaugcuuuuuuuggccaggcuguaguuaauagauguucuuguacagcugauggaaugcaaugaaaacgaguauguggcaguaucuaucaaaauugcauauguauuuauccuuugacccagaaaaccuacuuccagguacuaucccaaaaaaaaucagcaaaaaauaaaagaggcaugcacaaggcuuuugauugcagcaucacguaggaaacuacucaaauauucaucaguaagagauggcuugauaaacuacagcuuuuauuuauauaauggaguaguaugcaguuguaaaauagggaagaucuguauguauuacucugguucuuugaaaagauccacaaaguugagaacauuuuaacuagaccaaacgagaaaaagauucaaauuacuaaaaugaaaaauaaaggaggagacauuacuaccagcaaacuuacagaaauaaaaaggauuguaagggaauacuaugcacaauucuaugcuacaaaguauauaaccuagauuaaauggacaaauuucuagaagcaaacuaccaaaacuguuuuaguaaucacuuuccaagacagacacaaacuaggaaaacugaucugguaacgaggaagaaauagaaaaucugaguagaccuguaacaaguaaagcaggaguuccaggcuauaguacaugucgguuccagugacuagccacugcacuucagccugggccacauaguaagauccugugucuuaaaaaaaaaauagagaaaaauuagcaccacuucucuacaaacucucuaaaaaauggaagaggaaggaagauuucccagcucauucuaugaagccaguauuaccccgauaccaaaaaccaaugaaagcaucauaaggaaaagaaaacuauacaaauauuacugaauagagaccacagaaaugucaaugaaaugccaacaaacuugaauccagcaccauauauaaaugguuauauaccaugacuaagugggauuuauccaggaauacaagauugggucaacauuuuuuuuuuaaucaagguaauccaccacauguguagaaugaaggaaaaaaaaacacaucaugugauuuucagauacagaaaagacauuugacaaaaucucaacauacuuucauaauaaaagcacucgggaaauuagaaacagaagacaacuuucucaaccugguaaagggcaucuacaaaaagccuguggcuaaacuuauucuuuaauagugaaagacugaaaccugcuccuugagaucaggaacaagacaaggauauccacucucaccacuucuguucagcauuguacuguacguuucagccagagcaauuaagcaagaaaagaaauaaaaggcaucuagauuaguauggaagagauaaaacuaucuccguuugcaaaugacaugacauuauaaguagaaaaguccuuuuguucuucaaaggacagugaagaaaaugaagacaacccucagaaugggagaaaauauuagcaaaccacauaucugauaaaggucuaggauccaggauauauaaaguacucuuacaacucaacaguuuuuaaaaaaggaagaccccaguuuuuuuaaauggguaaaggauuugaguagacauuugucgaaauaggauauacaaauggccaauaaauccaggaaaagauguucagcaucuuuaguuauuagaugugaccuugaacgcuaccacuuuaaagguaccacuuuauacccacuaggauaacucuuaucaaaaagauggaaauuaacaaguauuagcuaggaugaagaaaaaucacaacccuuacauguuucuugugagaucagaaaauaguacagcugcuuuggaaagaguuuggcaguucuuccaaaaguuaaaguuaguguaugagccaguaauauugcuuauguguauacccaagagaucugaaaauguauguccacaaaaacuuguuaaaagaauguucauagaagcauuauucaugauagcccaaaaauggaagcaacacaaacauccaucaacugaugagcggcuaaacaaaaguggcguauccauauaaugaaauacuauucaacaaugaaaagcaaugaaguacugauuuaugaugcaacauggaugagacuugaaaacauuacaccaacugaaaagccagacacaaaaggccccauauuguaugauuauaugaaauguucaaaauagacaaaucugaaaguagauuagugggugcuggcaggugggaagaagagggauagagagugacugcuaauggguaugguguuucuuucuggggugaugaacguguuaugaaauuagauaauggugauagcugcauaacucuuugaauauacuaaaagccacaauuguuuuuuaaaaaaaaaaaacaaaaacaaaaacuaaugaaguugugucaaaagcaacuuggagagauucacagaccuaaaauagacaauuugaaccuuggcaaggauaauaacuacaguggauugauaugcaucaaauaugcuuaaaucugugaguuagcaaugacaucaaaauauauaaaaccuaaugacuuguuauuuugaaaacuguuaauaaagggaagaauuaaccauuuauccuaccuuuucuagauuaacugugccucaguucaugcagaaacuauuugguuauaccccagugcagcuaaauauuuaauguaaggaaauuucucuuucuagaaguauaagccuauaaacaaaugaagagugauggaauuuaaaaggcccuuuugccaccaugauaaacuaauggauuuaaacaaugaucaucaguaacugcuaucaucacuaaaaagagaagaaguuguguguaccuauguacauauggaguaguagucucgccaaaacagagcuugcaucugaugaagccccuauaacuaacuaccaaauuauaggaaacgggacaaagaacauguuaaacaacaccauagggaugcagugaaugaaaaucggacucugaguaacucuauaggacacauacacaaaaaauuacagguauaccucaaagauauuguggguuugguuccauaccacugcaauaaagugaauaucauaauuaagcaaguugcacaaauuggcuucucagugcauauaaaaguuauguuuacacgacacuguaaacaaguaugugauagcauaaugucuuuaaaaaucguguacauaucuuaauuuuaaaaugcuguacugcuaaaugucgcuaaccaauuaucugaggcuucugugaguucacagcaucuuuuugcuguugaagggucuugcguccauguugauggcugcugaccaggaugguaguugccgaaguuugggguggguguggcaauuucuuaaaauaagacaacagugaaguuagccacaucgauugauucuuccucucacgaaagauuucucuguaacaugcaaugcaguuugagagcguuuuacccacuguagaacuuacuugaaaauuugaaucaauccugucaaacccugccacugccuuaucaacuaaguuuauggcauauucugaauucuuuguugccauuucaacaauauucacaucuucaccaagaguccaucucaaaccacuuucuuuguucauccauaagaagcaacuccucauccacugaaguuuucucaugaaauugcagcaauucagucacaucuucacacucugcuuauuuuaguucucuugcuauuuccaauacaucugcaguuacuuccucauugaagucuugagccccucaaagucauuuaugaggguuggaauccauuucuuccaaacuucuggaauguugauauuuucaccccccaugaaucacugaaucacaaauguucuuaauggcaucuagaaugaugaguuccuuccggaauacuuucaguuuacuuugcccagauucauccacuaucuauagcagcuauagcauuauaaaauuuguuucuuaaauauaaggcuugaaaguuaaaauuacuccuugauccgugggcugcagaguggauauuguguuagcaggcaugaaaacaacauucaucuccuaguacaucuccaucagagcucuugagugaccagguacauugucagcgggcaguaaccauuugaaaggaaucguuuuuuuuucugagcaguaggucucaacagugggcuuaaaauauucuguaagccaugcuguaaaaaagaugugcugcuauccaggcuuuguuguucuauuuauagagcacaggcacaguagauuuagcauaauucuuaagggcccuaggcuauuugggauggucagugagcauuggcuucaacuuccaaguuaccagcugcauuagcucuucacaagagagucagccuguccuuugaagcuuugaagccaggaauugacuucuccucucuagcugugaaaguccaaaggcuuuuuugucuacauugagaauauguuguuuaguguagcaaccuucauggauuauuuuggcuagaucuucuuaacuugaugcagcuucuacauuagcacuuaccucgcacuuuuauguuaauggagacagcuucuuuccuuaaaccucaugcaccaaccugcuagcuucaaacuuuucuucgguagcuucuuugccccucucagucuuuuagaauugaaaagaguuaaggcuugcucuggauuaggcuuuggcauaaaugaagggaaaguuguagcuguuuuggucuucuauccagaccacuaaaacuuucuccuuaucaacaauaaggcuuuuucauuuucuuauuuguguguucacuggaguaguacuuuuaaucuccuucaagaacuuuucccuugcauucacaaauuggcuaccuggugcaagagguccagcuuuuggcaugcuuggcuuuugacaugccucucucacuaagcucaaucauuucugguuuuuuauuugaagugagagauaagcgacucuucuuuucacuugaucaccuagaggccaguauggaauuauucagugcccuaaucucaauauuguugugucucagggauaauacggaagcccucggagcaggagaaagguuggggaauagccagucaguggaacagucagaccacauacauuuaucgauuaagcucaucuuauacaggugcaguuaaccauaguggauguaauaauaaugagaaaauuugaaauauugugaggauuacaaaaugugacacagagacacagagugagcacaugcuguuggaaaaaugcacuaauagacuugcuccaugcaagguugccacagaccuucaguuuuuuaaaaaguggagaaaaaggcaauaucugcagagugcaauuuuuuaaaaaaugaaugcaguaaaacaggguaugccuuuacaaggcaaauagagaaaggagccuauaguagagacaugucuuccaauugcagugcauggauuguauuuagagcugaauuuaaacaaguguaaaaaaauuuuuaauauuauaaaauaauuuaaaauaauauuuuauaguccaacugggaaaauaggaccacugaacuacauauuugcugaaauuaaagaauuauuaauuucuuuggcaugauaauacugaauagguuauguuuuucuuauauuuuagaaguagauacuaaacuacagacaaaauaaugcaauaucuaggauuugcuuuuaaauaugggggaggggagugacuacuaaaagaauagcauguucugaaugguaauacuaauuguaauacuaauacuaauuguaauuguaauacuaaucacaaaucugcacaugugcuaaaauuuauauaacugacaccaaaagggagaaaagggucaauuuuauaguaucuuaauauuuuuaaauaaaauuuuaaaauuuauauuauggaaaggaugaagagagcaauagaugaaacaagauagggcaugacuugcuaauauuuggagcugggugauggcacagagguauucauuaugccauucuguguacuaaaaauucuuacauauaauuauuuagaauauaauguaaaagcuuagaauauuugaaaucauagauggcaaauuuaggaaaauaaccaugaaaugaagguauccuaguauugcagacuuguuuagugugguagucacuggaauguaacuggacaaagcuauaagcaaauggaaguguuaugauuaaacacauuuuaucucauauaaauuuauaugugaaguuauucucauaaagcuuuguuugcauuuuuguuuguuuguuuuuuuaggaugagagaagcugcaagaaaaauagaagaaaggcauuuuuccaaccaugcaacacauguugaauuucugccuguugaguggcggucaaaacuuacucuugauggagguauauuuauuuaaaaauugaaugauuuagccaauggcaaacuuuuaccaaaauaaaugcagaaaguuuuagaaaacacuuuuuguuaauugagaauguagugucuucaauuuaauugucuugagauaugcucacccuuuguucuagauuaagaaaauaaaauccauugauuucuagaauaauuauacugacuaauaucauuuggaccauuacauagauuucauagauagcacuguuuucaugcaugcccucuggauuguggcagguggagggauauagugggaacaaaauguuuucuaaaguuuuugacacgaaguugauuugucaguacuuuaaaaauauuuguuuuccauaauuccauacgagcuuacauuuuucuuucuaauaauuuucuccccauaaucggaagauaaaaaucucagguuuuuuguuuuccuuuguuguuuuucguacauucccugggcuggugaauuacaaucuagcauagauaauuuguauauuuguuuaaauaaaaucaguuuaguugucuuccuuaaagagcugucaucaaccaaaauaugugucuuucuuuacacaaaguuaugucuguuaaauauuaaaaccauaaaaacagaauguuuagauuauuuacauaaucugcaaaaugagagaguuguuauacuggauauaauauuagcagcugccauuugggauuguguuuugacaccuguucuaaauauguggccucauuuugcucugaguaucccugaauuucaugcaaaagccaguacauacaaaaaagggugacgcuuuauagauuugauaauggcuuucauccuuuaauguuucuuuucaucuccuauguugucuuuuacuguuuuuuuuuucuugaaguauuuuauaggaagggaagauccauuagagccaaagcuggucuugaauauuuaaauguuaacuuaaauaguuacuauuucaggcaacguaauuuucuucacuauuacuuuccuguaacagagacuuucuauaaguuaacuugcuuuuuuuguuuguuuuuguagacacuguugauuccauuacuccugacaaaguacgagguuuaagggauaugcugaacagcagugcaauggacauaauguauuauacuaguccacuuuauagagaugaaguaagugucaugauuaucuugcugguggguauuuuuuagugauagcuuauaaauguccugaauuuuuacauuuuauguuuuuuuuaagcaaaugagaaauuacaggaauucauuaaucuauaaauagccuacuuuuaauaaauuugauagucuucaaacuagacauugugacccuuaauaaaacagauggucucagguugggggacuguuuagaaaauaguucuuugagacaugacauuuuucauaaaucuaauuaauuauaucuaugauuguugucuucacaaaagaguuuuagacauaaaauguccuuuaaacuuuuuguaugugauggacuuuuauugcuucacuucuguaaugaauucguacaguuuucaaaugguaguggagcugaugucucccaagaguaacacugggggcgagaggugaagcuuuauucaagaagaugagagaaucuccaccaaaugcauucugucacuuuauugauaagagggaaaggagaauucuguuuaguaggaauaacuaacauuuguuaauugccuaacaugugugaacuuguuuaacccuuauuuuaaaaaauccugugaaguagguaugauuaguauccucauuugaaggaugaggaaacugaugccaagagagguuuugaggcuugcucauugcaucucacuuaauaaguggcagagccaguauuugaauccaggcaauacagcuucacagcuuacucuguuuacugcuucucucuucuguguucacaauauagccagucucucuguuauuuauuggcugauuauuuugacuuuccugggccuuuaaucaguaaauauuuagugagcccuacucuaugccaaacacuagcuaacagggggccacuuuacugcagacuguuacccuucauuagcagggagacagggaaaaucagugcaaguguuugaaagugagauaagucacuuugguaaaauuuauuuaucaggaaucccagguaagauuugauaauauauacauauacugaaucagcugguuaaagguguuuugaacuaagaauauggucuacauguuuauugaaaauuuguuuauugagaacuuacuacguauaagauacuguacaaggaucuuguacaagggggagucugugccuucaaaaaaguuuaaaauauuacaguacauagggccacauuuaugaaauguauggaaggaagagauaaccguggaaauauuugcaauuauucuuuuuuuucccucugaaaaaagcauuuacacuuauuguuauaguacuuaagauaaauuacauuuccacauugccucauaaucauauauggccccaauuuuuguucuaaaaaccaugcaguagaaauuauuuuuugccaauuguauaugggcuguagagauagacugcuugauuccagucccacuguaacacuuaauuuuuguauggcuucucuaucugcaaaguggauauucuaacaaguagcuacuucauagcauucuuguaaagauuaauugagguaaugcuuauauuaacauguggcacaugguagucaagaguuacuguuauuacagguacuauaauaucaaaucauuuuaguuucugaauucugaguaaaauucuccaaugcugaaacagauguguugcugccuguagaucccucugcuuucauaagagaaagaaggguucgauguuuucucugggagcuuucuuucaucaguguuuuuaaucuaaaaauauuccuaacuaagcuuugaaaaacuaaguauggaauggauucaguguauauguuuucuguacaaagaucucagauuucuuaagguuucauaaccuguaacuauuuuuauaauagacauguaaagcauuucagaguuaacagguuuauuuuguauguauuaacuuauaaauuuaauuugccaaauauuuucugagcacauuuugacacauuuucauuuuuauaagcuaguaaaaugacauagauuuggcaaaggaaguaacagauaguguugugucucauuucuccccaauauuuuuauguucuugagaaugaaaaaaggaaaaaacaguucuauuccauaccccaauucuaucuucauaaauucaagugagcaauaacaagguucuaacccaaaauaguaucaauaggaauaaagagaagagauggauucaaaauaugauagaauuaaguggucuugaaaugauuuguuauggaugauacaggaagagaagagacagaugaugcuuacaauuucuagcuuaggcaacugguagauuguucugauauuaacuauaaacggaggaaagggaaccagauuuuuguaggggaagagaguagaacauaaagaaaauaaugaauuauacuugcaaauuuuugguauguuuacgauuuccuucuggaguuuuauagcacagaauauaauauuaaaaguaaaaccagugagaguggagggaggaggauaucagagcacauguuaccauacaaauacacauaugugcauauauaugguuggugguaccccuaagagggcucagagcucuggcuguuggcuaguggugacugagcaaauggucacuuucuguaaugcucuuauauguggaaagauaacuauccucagaaaggaacugaauaaaauagauaguaggaagagggaaccaauggcuaugauaaauggggggcaaagggaacacccaguccuuugaauuagucuuuugauccagaugaauuucaugggagagcaugagaacuggugacugagauucaucagcaaucuuuagcagugauuuucaaacaucccugacuagaaucauuucauacucauuaaaaauaacagcaaaaauaaacccagggcggggguggcagguacuggaauuugaggguaccauuguaaauucaacaauuucuaaaauaugcauguguguuguaaguauuacuuauauauguaggugaauauguauauauacaggcauaccuuagagauacuguagauuugguuucagaccaccacaauaaagugaaugucacaauaaagcaagucaugcaaauuuuuugguuucccaguacauauaaaauuaugguuacacuauacuauagucuguuaagugugcaacagcauugugucuaaacagauaugcauaccuuaauuuaaaaauacucuauugcuauaaaaugcacacagacaugaagugagcacuguuggaaaaguggcaccaggguugccacaaaccuucaauuuguaaaugcagugucuacaaagugccauaaaacaggguaugccuguucaugcauguauuuccuaacuuuguccauuaaaguggccaauaagcaaagacacccuaauugagcacaccuagcacccagaucuuuuccucuagcgcuauuauuucccacugaggaaaaccaggguuccucaggaaaauggcugauucuggggcugggacaacuuguuaugacagaagguaggaagaugcucaagagaaucaugggguaggucacaagaacacagggccaaauuaagcagcucacacuggccaaaucuggaacauuugagcaccaaaauuauuauuuauagaucauugaaaaaauuauaaguucauauugacuauaaauaagcaaauaaauggggagaaaggagaauccuugcuuacaguagaaugccaaagggcaacugauggagggaauccuggaguuggaaaaccauuuugcagcuaucaugguaggauuagguaagagaagacuggacacaaaucaucgauggauacuaaauugaaggcaguauuuugaugaggagcaggauauuuacauggucuuaaaguauauccccacaaacugauaauucguuuaagaaagagcgacaauaaucauacacuggagaaaucaagcaguaccuaaacuggguauuccugaggagcagauggacauuaugcaccucuggaugugacacacacaggagaacacaucacuuuacaguauucugacaaugagaaaacaucagacaaacacaaaaugaggauguuguaauaaaaaguagcaaugagacuguauucuguaaaaauauuauuaucagucuggguguaguggcacacgccuguaaucccagcccuuugugaggccaagguaggaggaucacuuaagccauggaguucuagaccagccuggacaacauagccagacccugucucuaccaaaaauaauuuuuuaaaaauuagccauguauggugguuugggcuguaguccuagcuacucggaaugcugaggccgaggaggacugcuugagccugggaggucgaggcugcagugagcuguucucacaccacuguacuccaaccugggugaaagagcaagaccccaucucaaaaaaaaaaaaaaaaaaguaucauaaaggccgaguggcugcggaaaauguuccugaucaaaggaugcuaaagagacauguagcuaaauaccguaucucauccugaacuggauccuguacuggauaggggaaacugcaauaaaagauauuauuagauacgcuggcagaauuagaauguggaugguagauuagaugaaauauuauaucaaaauaaauuuauaaaguugauuacuaugauuauagaagagaauauuccuaguuuuagaaaauauacaaugaagaauuuagggguaaaagaucaugacauauauaauauauccucaaaugauucccaaaaaaggugacgguuuauguguuuaucauagaaacagaacaagugaauaaagcaaauggaauacaaugcuaacaauaugugaaccuggguaaagguuauaugagugaucuuuguguuauuuuuauuuugcaacauuuuauauauuugaaauuauuuucaaauaagaggcugggcagggcacgguggcugaugccuguaaucccaacacuuugggaggccaaggcggguggaucaccugagguugggaguuugagagcagccuaaccaacguggagaaacucugucucuacuaaaaauacaaaauuagcugggcgugguggcacacgccuauaaucccagcuacuugggaggcugaggcaggagaauggcgugaacccaggaggcagagcuugcagugaguugagaucacgccacugcacugcagccugggugacagagcgagauuccaucucuaaaaaaaaaaaaaaagaggcuagacaugguggcucaugcugguaaucccagcacuuugggaggccgagacgggcagaucacuugaggcugguaguucagaccagccuggccaacauggcaaaacuccaucucuacuaaaaauagaaaaauuagccaggcauggugacaggcaccuguagucccagcuacuggugaggguaaggcagaagaaucucuugaacccaggagacggagguugcaguuagucgaggucacgccauugcacuccagccugggccacagagggagagcccaucucauuuaaaaaaaaaaaaaaaagaaaaggaauaguuucccggaucucccagagauucucauuuggugguucugagauggagccugugauuuuguauuuuuaacaguuccccuacuugauacuauccugggaauucugggaaaacacugcuuaaggcauggugaagaacaaaaggggugcuuccuaagugagaggugggcaaacuuuuuuuuuuuuuuuuugagacagguucuuacggaggcaggagugcagugguacgaucucagcucacugcagccucugucuucugggcucaagugauucuugugccuuaggcuccugaguagcugggacuacgggcacgagccaauacaccuggccaauuuuuguguuuuuaguagagacaggguuucaccauguugcccaggcuggucuugaacuccugacuucaagugauccucccaccucggccuuccaaagugcugggauuacaggcgugagccacugugcccggccuauuccuauuuuuaaaaaagaaaaguugauucuguaaauuaaaauacauuaacauggcauugguguuaggcaauauucuaggauaaauuauuuaaaaguauauguuuccuuagggaaggaaugauuaggacuaagucacaugccuggugaaugaaccuuguuugguuuauuugugaggcauuugaaagagccuuuuucccccuucuucucugagccuuuguagucaaauagaugcagauucaaagccugccacuucuguaaucccagcacuuugggaggccaaggcaggcagaucacuugaggucaggaauucgagaccagcccaaccaacauggugaaaccccgucucuacuaaaaauucaaaaauuagccaggcgugguggugcacaccuguaaucccagcuacucaggaggcugaggcaggagaagcacuugaaccugggaggcagagguugcggugagcugagaucacgccaccacacuccagccugggcaacagaacgaaauuccaucuaaaaaaacaaaaauaacaacaacaacagaaaccugccacuuaaccagcucugugaucuuagaucgaauuucucacuuucuuagcuuccccacuuauaaaaugggauaaaauauguacugauaaaauuugucauuaggauuaaaaaugaaauguguauaaaguuuccgguacaauucaugguccuuagacauucaaauuaugauugauucuguguauauuuaugucuuacaagggccaccauauuuuuaauagacuuauucuguuaacucuaaaaaguaaaggucaguggauagaaaauaugggaaggaacauguuuguugacuguaaugaacuuuguaguaacaaagcugucucuaaagauagaaguggacacuuuaaaauggagauaugcacuaagguagagacugagugaccacuucucagggaugcuacugaagggacuccuaccuucacagcaguuuaaauuagaucauugcugaggucccuuuuaacucucagauucuuacaugcucaugggagaacccuaaugauuuuccuaauaauuucugaaaagucaugguuaggggaaaaguuguguauaucaaucaguacuucucagaugacuuucugaggaccaguuuaaaaaaucaaccaaaaaaguuaauuucagacuaucaagagaucaucagagagccuuuggcccuuacuucaacucuaaaguaacacaagaaauccagagagaccuguacaucuuguguaaaucugaacucucuuuuuaauagcuuuuaaaauugaagaauuguaaagagaauuguccuagcuguaucuugacauuauuugaauuauuuaauugauauagaugacuagaacucucucaauuacauuuucucauuacaauuucuugaagcagggagaacaaaggacuaacucuauuccucagccauauuuuguguauuuggacucaacucuugaaacugccggguuuuuccuccuuacguucauuuccuucguaaauuuuaacucuugagcagugguuauggaaauuagaaauuguuuuaaacuuuugaaaagcuauccagugcuuacuguguaagagguucguugaguugauuagaucauauuguagaccuaauagauaauaaaguuaagaucacaguauauauuguuaaucuuggcugagaugucccaaaugaauacacuuggucacaaagggauccuaauuaggagaauauaauuggaucagaaaggagaaggaaaaggaaaaaaaauuccaauuagaguaaacucguuggauacaacauagaaaugaauuucuccuuucacugaugagcggaugagauacagaagcauuuagagguaguacaaagcuguuuaaaaaguuggcuuucaaaaucauaaugucugaccauagaugucucauauauaugcauaagcaauagaaaaagaaaaugcugucaaauccagauaugcucuaauaaggaaauacaaaggccauuucucuucaaguguauaauuauuaaaacagaugacaucaucaaggucuucagaaacuguccaugcuaugccucauuccauagugaaauauuuuaguaucaaauagacuuucucugccuuagauaauuugaucuuguuuuuuuacccauauaugauugccaaacuaaugaaguauuugguguagugagagauguuuuaaaauuuuugaauaugaaauagguuaauuacugguagugugauuuccuuuuuuaacaaacuuuaauaugggaguaagcugguauuuuauaaaaacaaaaagauuagguauguuuugucagaguacuaaaguauauaucuuuuagugcuuugagauuuacaugguacaagucuuaaaaucaaggucuucaaaaauaaaaacgauuaagaacuguugcuuuuaaaggaaauuauuuuaucuaaacauuagccuucucuguaccuaccucauguagauuguaaaucaggaaaauaaugaaauuuuaaggauugguugauauucuuaucaaagccaaauccaaagcauauuauagcuccuuucagacagagccauguaguauuucacacugcauauuccugaaacuauguuaauuagaguuuuacuuaaaacccaugucuuagaagauguuuauguacauugccauuaaaucaguaguuuguaaaguguaggaagaaagaagacugccuuaaaacucagaucagggcccaggauggguuugaguaacaaaagaaccuuauucuucugacuuuauggaauauuucaguaauauuuguuaaagcuuaauuucaaagaaagcacuuuuacaaagaaaaauuacgaaaauacuccccacauuauuaaccucuaaacuuaaaauagcccugcuuuccagacauagaaaacaacuuuuuacuuuuauaucuguauugccaacuuagugggaacuuugaaauacccaguagaucaacuuuuguuuuuucuucaaucauucaguggccuuuuauuacauuacucuaucuaaaugcacaauaauuuauaauauguuaguauaccuauuaucauaagcccagauacucauuuucuaaaacuuacugacuaaaaacuacaagguacaaaaauuuagaauugcauguggguaaguuacaacaaaaaagaaauuugcgggggucuuugaaaaucuuauugguauuugcauagaacuuugguuuuuuuuuuuuuuaaucuauggaacugcuggcuuauacaguugguuuaaggacuacagaaggaucuauguagguaguaucugccuauguucuuagugaugauauggauuauaauaguauguauaccuuacuucauuccugcaagauuuugaaagaccuaaguuaauuuuaauaaccuagguauauuugaucgguaauguauguuuuucuaccuuaauguauuugaguuuagaauaaguguauaguagucagugacaagucuaauaugauaauguuuucuuauuucaaacagcuaguuaaaggccuucagcaagagcugaaucgauuguauucccuuuucuguucucggaauccagacuuugaagaaaaaggggguaaagucucaauaguaucacauuccuugggauguguaauuacuuaugacauaaugacuggcuggaauccaguucggcuguaugaacaguugcugcaaaaggaagaagaguugccugaugaacgauggaugagcuaugaagaacgacaucuucuugaugaacucuauauaacuaaacgacgguaaaauauccucaucuuuugaaaaauuuuuaaaugucuuuauggaauuacuggaccucuuacgagaaaacuaagaauuucaugauaaagaaauaaugcauuguucaagauacaaagauuacuauauagcaugccuaaucaagcuggagacuguugauuuucaugcuaauuacaugcauuuuccuguagcauaaaauaaauucuuuuguuauucuccuuguuuuccuuucaucguuucuucacaguuuguuaggagugaaauuuaaaacuuauuccaagcuuagucacugcauagaauccuuauugaaaauguuuaccaguuuauaauccuuuguaguuuuacugaccuuuugagguggguuucuaccuuucuuauuauucugaaaauaauuuuuaagugcuuuuuuuaagcaaauauauuuuuuuacauguuauauguauaaacauaauuauauguguuauauaauuauaagauuuuauuauuuaaucauuuguggcccuccugauacuaucuuuuaauucuuugcugcauuccuaucuucaucucuaguuacaugccuuaucuucuuuguucucuuuauaugauuaauucuaauauaaaaaugaaaaaucacucauuuugauaauuuacuagcauauuaaaacaaaugugcuaauugacuaaaauuuuuacuaguuuuguuuuugucuuacagauguuaacuaaggauuucauuuagaaucuuauuaaguaccauaggcuagacacacaaauauuauagugucaaaauaauugacagguuugaaauaaaaugucauguuuggcaauacucggagcagcauuuuagauguauaaauccaguaaaacuuuaaaaaaagaaaaaaaaagcauggaaaauaacaaauuuuuuuuuuuuuuuuuuuuuuuggagacggagucuugcucuguugcccaggcuggagugcaguggcacggucucagcucacuacaaccucuugucuuccagguucaagugauucuccugccccugucuccccaguagcugggauuacaggcaacugcuaccacgcccggcucauuuuuguauuuuuaguagagaugagauuucaccauguuggccaggcuggucuugaacuccugaccuuaagugauccacccaccugagccucccaaagugcugggauuccagacauaagcuacugcgccuggccaacuauagcuuuuaaaaaauaauaaugauaauaauaacuuaauuccauaguuuacuaaauguaaguagcuaugaaacauuguaauugaaaaugauguucaucaacagaaggguuagacuauaugguucaccuguauuuuggacagucauaguuguuacaaaaaaaaaauugaaguaggucaggaggcaaugaaaugaaaagaucucuaaacucuuaaguauagaaaagagagaacaguauauaugguauuaaccauuugguauaauuuuuuaaaagauguauaugugcuuguauaugacucacauuuuacuacaaaaaagcuguuaacagcagguaucaugacaacuagcgguacuuuacuaauuauuucauaaauuuuuauauacuuucuguacuguggcagagacauuuauuaaauacugucaaccaggauuaaugugagggauagugggccaucaucugcgucuuuauacuuuaguaagcuagcaagcaucuaauauuuaugaaauuauaaauacguguguguauauaaucucauaccccuucuuaggcugaaggaaauagaagaacggcuucacggauugaaagcaucaucuaugacacaaacaccugccuuaaaauuuaagguaaggaaagagcaauguguucuucaacauugaucucaguauuuuuuuuaacgucaugugaaauaugccuuuaggauucaaaugaaaguuuauuguucuuucaaaauaaauauuuauucaacauauacuauauguuggacacugccauuucugguuguacaaagaaaagaauagacaagucaguuccccaguccucagguuauauggcacaguauuauugaugcuauuaucaguauacagaacaauauauguacaggagagggagguucuaauuuugccugcaaaaguuuacaaaggagugauauuuguacuuggucucaguaaauuagauauugccaagugaaagaaaggagagaugcuauucuguuuaagaggaauggcauaaacaaaggcauagagggcuguaacuucauauaccucaagaaacaucagcuaaucuagaauagugguaaagaaaaauagagacagaugagaaauauuuacuauuuagaauuaagaaaucuuaaugaccaccuaguuggucaguggugagaaaaaaaucagaggaaguauaugaguaaugauuccagggauggaaagcugacauuucaauggaugaacaauauaugacaaaagcacaagacagaggugcacagguuagcuuggagcugugugagcaaacuuaguuuagcuauaauauacagaagucaggacaaggaggcagugagagagcaggaauagcuagaaauaaggaacuuacauugauauaggcauugggaagcuuugcaggguuuuuaaguauuagaaugaccuguugaaagcagugauuuaggaaaauguggcagaggugucagcauugacuagacuauuggaaaggacauacccuauagcugaauaacaaauaacuugcuugcaguguuaaaugggaaaugucauaaguuuccuaauacucauuuccuguugaguauuugcucaugucuaguauacuguauuaccucuucuugaaauguguuucuuuucucacaagaacuuaacacacagguuaagauguggaaugaugcagaaauuucuuuaaaacguuaagaguuuuuaaauugaaucuaucuccauuacuuacaaaguguuuuuuuaaaaaaaauauauaccauacauuguaaaacaauaugguaaguuauaacauauuuuuaaaagccguaagaguauggucuuuggagugaucccauuguagaauuugcauuucaucucuacuaucauuacuuuuuuuuuuuuuuuuuuuuuuuuuugagacagagucuugcucugucacccaggcuggagugcaguggcgugaucuuggcccacugcaaccuccgccccuccgauucaagugauucuccugccucagccucccgaguagcugggauuacaggugcccgccaccacgcccagcuaauuuuuguauuuuuaguagagacgggguuucaccauguuggccaggcuggucucgaacuccugaccucgugauccgcccgccacggccucccaaagugcugggauuacaggcgugggccaccgcacccagccuaucagacuauuuuuauucucaaaaauaaaccagguuauggcugggcacgguggcucacaccuguaaucccagcacuuugggaggcuaaggugggcggaucacgaggucaggagaucgagacuauccugacuaacacaguaaaagcccaucucuacuaaaaauacaaaaaaauuagcugggcgugguggcgggcgccuguaguuccagcuacucaggaggcugaggcaggagaauagcgugaacccaggaggcggagcuugcagugagcugagaucgcacuacugcacuccagccugggugacagagcgagacucggucucaaaaaauaaauaaauaaaugaaauaaaauaaaccaaguuauuucccaccuuggcuuuaguucauuugguucuaucagccuggaauguuauucuuuccagcaccaauauccaaccccagcuguagaaaccuuucucgucuuuuacuggccaaugcauaugcuaccuccucuguaaagccuucaaaguuggaauuauuuuuuucacucucuuaaagcauuauuucccucuguuaugcacguauuuuauucugcuuuccccacaggacuguaaauuuugagugcagaagcugugucuuacuggucuuuauaucuaucacagcaccgaguguauuacuucacacaaaguaguaccucaauaaauauuugauuuguguauacaaauauauaagaaaaugauccuuaucuuccuuuuauucaacuuguauuagauuuaaagauaaugaaguaucucauggaaauagauuauucuagaaugguuaaugguuggcagagcccaucuggauaacucuuauuaaaaacgaauauacucaaagauauuuuauuauuuguauuuugccauauauuacguuaugcccaaauuuuguugaaagauaacacuucaccauuuuuaaacuuuaagaugacuuuaucauuuuagguugagaauuucuucuguaugggauccccauuagcaguuuucuuggcguugcguggcauccgcccaggaaauacuggaagucaagaccauauuuugccuagagagauuuguaaccgguuacuaaauauuuuucauccuacagauccaguggugaguugcaauauagacucuuuuuuuucucaaugucaaauuguuccuaaaaagaaucuaucagcugggcacaguggcucacgcuuguaaucccagcacuuugggaggcugaggcgggcgcaucaucugaggucaggaguucaagaccagccugaccaauguggugaaaccucaucucuacuaaaaauacaaaaauuagcugggcgugguagugggugccuguaaggcaggagaaucacuugaaccugggagguggagguuggacugagccaagaucaugccacugcacuccagcuugggugacagaguagugagacuccaucucaaacaaaaagaaaaaagccgggcguggugcucaugccuguaaucccagcacuuugggaggccaaggcaggcagacugccugagcucaaguucgagacuagccugggcaacauggugaaacuccaucucuacuaaaauacaaaaaauuagcugggcacggcuguaaucccagcuacucgggaggcugaggcaauagaauugcuugaaccugggaggcagagguugcgguuagccgagauugugccacugcacuccagccugggcaauagagcgagacucugucuccaaaaaguaaaaaucugucuaagacaucuuacaaggugccaucgaauuaaugaaaacacuucauuuaucugauuauuaaacguguguuuugguuaauuuagggcucaugagauaaaguaccuuagagauggucugguuauguugcaccuguaauacaagaguguaauguaaaaauauuauucccagacaguuaguacaagagacaggagucuacuggacuuucaaaccuuaaccaauuguaauaccaguaaccuagaaaccauaaaucuuaaaaauccugcucuaaauacuuuuuuaaucuaaaguaugcuacaauauuggaauguauuuuguagacucucugaaaaaugaaaauauucaaauacugaacaucaaaauaaaacuuuauuauagccuaauagaauuguaagauguuggauuuuucuauucucuauuauguuuaugcuguaaauauuuuuuuuaauggaagcacuccaagaaccuugcauccuguuaaacaguguaaugccaaguaagauuuucagacaagaaaaaugcccccuuaauacuucuuugggacaaggcugguuuaacuaaauauuaaacuauuuuaaauagcauuuauucucugaaaaaauagcuucauauaauuguggaaagucuuuuaaaggauccuuuuagcuaguaccaaauaaauauaacauugacuaaccauucgaauuuuagaaaaucucucauauguuaaagacuuacaacugccauauuaacuucacugaacuggaaguuuaauauaagauucaaauacaaacugcacaauccugggcaaguuauuucugagauuguaucuuaucuguaugauguagaugauaauauuuugccuucuaggauuguuaggauuaaguaaaauauauauacacccagcuagacaauaagcauuucauuaacauauacucauuuuauucauugucucguaacuugaaagugaauuucaguucauaggucugcucugagcccuguccuuuguauaacuuaaacuuuguuguaacuuuaaaggaggauuccaaacucuuaaauuuuuauuauucauuuuauaguuuuucugugauuuuuaaaaaaauuaauacuuuguuaaauaguuuacgucagaacggugcaaggcaguuuuuacaaauguuaucuguucuuucucacaucucuguaagagaggaaguguuaccuccuuucuacagcucaggaaacucagggcuccgagaccuagugacuuaacaagcaucaugcaauuaauaagugacagaggcugggcgcaguggcucucuauuaucccaacccuuugggaggcugaggugggaggauugccugagcccaggaguuugagaccagccugggcaccaaggcgagaccccaucuccaucuuaaaaaauaaaauuuucuaaaaauguaaauuaaaaaauaagugauagaaaccagaauaugaauuugggggauucugaugccguauccauugccuuuucugcugucucauugcuacuucacaucagacagaugcucuuaugcuggcaucugauuuaugcuguuacuguaucaaucuauuuuaaaacagagcuuaaauagagcuccuaaaauauuaaaaauuggccuuauuugcuguuucccaggauuaccaucuacuacuucaacuuugcuccuaagacuaaaauaaaucuaauuguuacauaucagaacauaauaaaaauauuucucugaaaaacuaauugauagacacuauuagccuagacuguuuuucauaaucucaucauuagaucaagugcauauuaacagugaacaaauagaaauacauguuugaaauagcuauuguuuuuuaauuaaauuccuucucggagguuuacuuaacaugcaguagaguaagaacaguuuacuaaaauccaagcauugugauuuaacacuguguuucuuugaauuuuuuuuuuuaaaucaaggcuuauagauuagaaccauuaauacugaaacacuacagcaacauuucaccuguccagauccacugguacaauacuucaaauccuuuaccuuaugaacauaugaagccaagcuuucucaacccagcuaaagaaccuaccucaguuucagagaaugaaggcauuucaaccauaccaagcccugugaccucaccaguuuugucccgccgacacuauggagaaucuauaacaaauauaggcaaagcaagcauauuagguaauuucucuuauguauuccuuaucuaugcauauaagcacuuuccuagacauaaguuugggggacuagaaguauucuauguauuaggaaacucccagcaguuaaucccugugucuagaauuaacuacccucccaauguucauauuugaggcccaaaaagcucuaaaguucucugauuagaucagaucuuauaguuuuagaauauaagauagcuggauggaccagaaaaagcuguuaugagaaucaagucccucauuuuaaucuugguccuaccacuugcugugagaucuugaguaaauaauauaguuuuuaaugcucuacuugcucaucugugaaaugagaaagcacuugugucagagggugcucccugucaaccaguucucugaucuauucuaaaagucucucaaacugugugauuccugagggcaacaaggauguuuaauuuuucuuugaaugaucuccaguacuggcacaauguuugcuguaucacuggaacucgauuaugugguauuugaaucuguccauugccuuugguuacaaguugccuuaauguaaaauaccacaagguggcacuauaaauaggcuuuaucuccuggacucauuggcuguuuuacuuucucauguuaauacauuguuuauugauggcuuuuucuuacauguccauuuaaauucaguaguaaguauaucaauaguaaaucuauacucaugucaauggcaugguucuuuuaucaaagacuuuaaucuugccaaauauuuuaauaaaccaugaucacuugaauaaaauagaaucuuuauuccuuuguuuauauauuccuguguuauauuccuagagcuuauacaacucucauucuauucaccauuuuuauuuagaaaccugcaauauaaauuauaauuuucuuauguucccacccuggaaaaacaugacuaggguuuggucccucugccaguuggcuauaauuauggguggugcucuuuagcuuagaguguggugugauucaacagaaugacuacccugcuuugugaaauacaggggcugcuagcauuggaaagggacuuggaggaauguuguucucaagauuuggacguucaucuacaacacagucaucugaaacaucaaaagacucaauggaagaugagaagaagccaguugccucaccuucugcuaccaccguagggacacagacccuuccacauagcaguucuggcuuccucgauucugcauguuaguucauacauuauuuccuuaaguugauacuguaucuuuuuaaaacuuggggagggcagggagguauaaaauauuaauacuagcuagucaacucuaagaucuaaagugugccuuaacuuugaaagaaaaaaaugcuuuccuucugcuuauauuuuuaagaauaauuuccaggaaaaugcaguuuuacuuucugcauugaugaauuaauagaauauuaguaauuagggccuuguggcacaaggucuuaaccaucaagcauaaaacaaaucucuuuaggguaaguacccccugaaguuuauaaaguagauuuuuacuaaugugaucuucucagucucaaaaaucguguaauuauugcuuuagaucuaugcuguaucuggucuugagacuuuaaaaacugcuauaccaaagucauccuacuucuauucaaagcuuagaaauuuuauuggaucugcugaauggcuuccaauucuaucccagcuaccuaguguaaagcagauauugaaaaaaugaguaaauaaauggauaguuauguuggacuuagcauuauauggaucuuuaagcuuucuccgguggacuuagaaaguuugaaauguugaguaguugugaaacacgaauacacuuaguauauauuuacuuccaagagucugaacuugaacauuauuuuuaggugucuaguaaaauaaaacuaaaacgucaaguccuauuuuuucauugacaccuauaaugaaauauaaauucugaaacuagcuacuccuuuucuguaacuauagcagggagaaaacuuuucuuucucuagaaauuuuuaaacagauuuuauuuguuacuuagaguauuguguucuuacugugucugcuacucuaaauuguaaaaugauggcauucauugccauccauccuuagaaaguucaggugugacacuccuagaggcugaauaauucuuccacagucaacuccacuccaggaugaauuauuaauaggguugaacauuccuacuugggccaacagcauuuuuaauuuaauuauaucugugccagacucuggacacugaaaauuuuauaauugcaagucuggaaaauucuuuuuuagacuuugauauuugcauuaaauauauuuuaccuucuauaagaguucucauacuauuucugacuuguuuccuuuucuacuuaauaucaaaaaugugauugugaaaauacaaaauucugucgugacaugcagaugucaagaaaacucuaacugcugaagaaaauuaauuucaaagaauuuuguaagguagcagguaaaaagucaugguucucuguaaugucauuaaugugcaacaguagugcuaguaaacaucagagugagggagggagcaagaagagcaggguaggguuuaacccccuagaaaaaggguaaugaaaacguauguauagaaucuacaggcucugagggaauaaaacuuuuuuagguuuuuuuuuucuguuuaacauaguaauuucaaaauaauagagaaacccccaguuuuuucuuccagaacagcaguuaguagaggugcauagcuguauugcaucuuuuuauuuugagagcuuaacaaaauacauacuaugucauucuuacacauaaauucuuugauaguccgaaugguaaaauagucaacaagacucaauaugagguaauuaugagucuuacacauauucacauauuacacauacuuauauauuauacauauuacacauauucaccucuagauauagauauaacuauuaaaauuggacuauuauaauaagauucugccuuuuaaauccuauucccaagauuugcuuuacuaauuauuuggcuugcuucaauaauguaaucuguguaaucgucauaauuucucgucguuaagugcugucuuggcuauaucgugcaaaucauaaaacuuuucuucauuaaaucuucuuucugaaauuuggucauugugauuaggugauucuggcuucccuccuuucuuccuucuacuuacauuaauugccucaguucuucuggauaaccuuuauucugaagcuaccgacuuugauucacuugcuauuugaggguaaaauggggcacaggcuuagaauucaugaucugucuguuucuuuaugugaagaacuaguguugucaauugaaaccuauuuuauuuucauccaguugaagcaucuuaccuagcuauucuucuuuugaaaagucuagacuucuuuucuaacauauaaugcaaagaucuguuucuuuuagcauuguuuugcaucuagguuaggaacuaaauuagcuaugaauuuggggacuaucuggguguuaacagauuaugagauuauauuucaaguuaguuaugcuuacauuuuccaugaaagagcuccuuacaaaaauuaagauguguacuacuuuauguaugcuagauuuagucaguuuauuugggaguauuguucuaacuuuuggccacuacaucauugaaggccauuuuuaaucaucagccaacccuuuacagcaucuuguguuuuuuuuucacagauuucagacuucaagaaucguucuuuaaucucccacaacuucuuuuuccggaaaauguaaugcagaauaaagauaaugcccucgguaugguauaugucaggaauagcauucagaauacuauaaaaaugaucuacuuagaguucuucugcuuauugaaaaauuggaucaguucuucuaugagaucccagcuucaguguuaccauuacagacuauuuuauguguauuuucaucccauauuuucuagucuuaaaugguagugguucugaaaccugaaaauugacuagccacuuaaugugcuaaaguauauuuguguauacuucuacaaagaaggaaccugaagaaaagcauaaggucauuuucuuccuucuuuauuguccuaaaggcuccaaagagguuugcuauuucuuuucauuuaauacauuuagauauaaaaggguuucuaauaguacaaagaaugucaucauucuugguuauuucagguaucaguaaauuuaccacuuaggguuguagguaugucauagcugauugcuuucaacacagauauuuaauguaguuuaggggaguacauucacuuuuaaaaacaguauucuuggauguaagagauauuuuuaaucucuuaauuuucaguauauucuaaauguaucacuauggauuaacuuuagcaguuuaaaauuauuuuuaugacuaacuucugauucuuuuuccacagcuucucuuuuaaaaaaaaaaaugcuggauuuugucuuugacaaaacacguuacagggcuuugugggauuuuuuuucuuuuaauguuuuaaccaaaucucauuuuacaguuucuuuauuugaucaccaauuuucauaaauuuuuucaaguaaaaaaaaaaaaaaacucuuacauuacuucaguuugcguugaucuaacucagugaauuccccuuaagaaauuaucuuacauaagugcugucucuggucucugcccaagccagccuguuucauaaauaaauaauuuuauuuauguuuuuugcauuuuugguuggagaaaggaaaauuaauucauucauauuuguccugcaaccaaguagcccauauauccaguaucucaaaaccauccuaccuagcuaccuaaguaguuaaaccuguagucauaacuacacaaaaugauucagaugguaauaucuauauggcuucuuuuugcgcuuccuguuuucauucacucaacaauuauuuacuucacuguuuaccuugagccaagagaccauggcagucacuagaaaagauaagaugaaacaaauuucaauacugccuauaaagaugcuagugugaaaauuguguauuuucuaaagagcauaaacucuaguagggaagguagauaacugcauaaguaauuauaauauaugguagaaugugacgaaccgcaaaacauagguacaauaaaggacucucucaguucuagggaaugaaagauugcuuucaccuggagaaaggucucaaucauucauacaaagaaaugaauggcuagauuuguuugacccuaugaaaaucauucauacaaagaaaugaauagcuagauuuguuggacccuucacaauuugguuugacaaaauuuucuaggcaaauucagaacuacucccuuuuaaucguuccugauuuuucucaagaaaacuaacuuguauuucucuucauaccccaugcuucccaccucugcaguuuugcucaugcuguuucuucucccugcaaugucuuuucaucucuacauguccaaauccuccuccuuccagagagccucuuaugauuucuccaggugaaagccaucuuucauuccuuagaacugagagaguccuuuacuguaccucuguuuugugguucaucacauucuaccauauauuauaauuacuuauuauaugucuguugacaagccuugugcacaaaagaauucucugaugaaagcacgcuacugaugacacuugaccuucacacuauggagauuccuugauugucaagcacuuccacauggaauguagcagauacucuacuuuggggaagagggaaagaaauaugccuauguaugugacaccccagaaagaaaauaauccguguuuuaaaacaguguaagcaaagaguugaugauuguuuaaaaacacaguuucuuuucucauuuuuacuucucuucaacuguucagaaaccugauucuucuuuuuuauggauagagaaauucugucacuugggcauuccagagagaaaaagaagugauaauuuauguucuuuuuuuuuuuuuuuuuuuuuuugaccuagcucaguuagagaaaccagggaaaaacuaccaaccugaaugacaacacccauucuugagaugguaauaaugagaaaguagguccuaggcuaauccauguagauuugagccuacuuuggccaagagcugaucucacagcacauacagaaugaugcuacuauguagacccucacucccuugggaaaucugucaucuaccuaaaagagagaaaaaagauggaacauaggcccaccuaguuucauccauccaccuacauaaccaacauagaugugagguccacugcacugauagccagacugccugggguaaaccuuuucagggaggacgagaaacugaaacagguucaucaaguacaagcuagcuuccuaauacccacuuugauggagacaaucuguagauaaauauggaaggauagauggagucaaucugguuagugacacugaguaaagucccuuuaagugauaaaaugauaagggcacauaauauaggacaagaaugaaauuuaacauuugagugccuacucaaugaaaggcaguguuguaagacaguaauagcauauuaagaauaauuucaggaacauaaaaucaaaguggagccaaauaacacauguuauaaacaggaaauaucuuccuuucuuugacuuaaaaaacagaauuguaacuaaagaguguuggacuaggaaaacauuaugaaguggcauuugaaagugaagucuuaaaaauuauaacuuuguggucuucaccaauauuaacacauuuuccaacuguuuuucaucuucuuuuuccuuuguaauucaucuugacucaucuucauugugcuugagcauuccaguuucuuguucuauuuuugucuucccgucuacugugucagaauguacuacaaaucuaauacaaaugucccauggaauacaaaagauuaagacauuuacuaacucaccaguccacauggauuucagcuauuucugacuuguuauugauuagcuuauuguaauuuaaauuuuaaaaaugcaguccaggccgggugcgguggugcacacuuguaaucccagcacuuugggaggcugagguggguggaucacaaggucaggaguuucaagaccagccuggccaacauagugaaacaccaucuguacuaaaaauacaaaaaaauuagccagguguggugguggacaccuguaaucccagcuacucgggaggcugaggccagagaaucgcuugaaccugggaggcggagguugcagugagcaaagaucgugccacugcacuccagccugggugacagugugagacuccaucucaaaaaaaaaaaaaaaaacagcccaaaaaacuuaguuaaaagcccaugucaauguauuuuacaaguauuuuauaaccuaauugguauuuauaccacuuaaauguaaaccuucucugaaaauguguagcuagauuuaugaacauaccuuguaagaagagcauaguuuaauagaaaaauaacaacuguauaagcauuguuaaauuaccaaaugguauugucacaaaauaccuauuuaaaauaagcauuaacuaagcauuuauaugaaauauuucccuagaguauuaugauuuccuauguaugauuaccaaauucccaguauaaagcaaaacccaacuuuuucuccaaucuccuucuuaauuugugccaguuuuacucuuaaaauccuuuuggugcauguucaggggcagacuuuacagugucugguugguagugauuugagcauuuuuguuuuguuuguaacauagacccuucagaacacuguacggcucauuaacaguuuaaaggaguuccuaaggaucaaaaugucauauucuuaaguguuuaucucuaauaauuuauuaaaugagcucacuggaauuauuuuagagccuugauuuguuaaggugauuuuucucuaacagguaaucgcaaggacuuucugugggcuuuagaaaauacuugauugaauucacugaauuguuuguggacagcacuguuauaagcaaaguccuuccucccaagaaucaccacugcuccucccuguuuaacuuucccagccacccugcauguucuucuuuuguugaacaaacacuuaaugagcguuuguaugucccaggcacauguuagacccugcugacuggauggacacuaggguuuauggggguugccugugagacauucagccuaguagagaagaaaacauucuaggauuguacacagaugguuaucuucuaacauaucccucacacaacuaguggauauauagggccucccuaaggaggagauugaaugaucucuugcacucccacgggcaucauugcaugcaagccuggcccguaaaucuucaagagggguguuuuccuuauuuuauagauuaggcacaaggauuaaaugguaaugccaaguuuugaaagcaauuuuuuuaacucugaaaauauucugugauaugccaagugauuuuuuuuugucuuccuuuauuauuuuauauuaacuuuagcauacaaaggaaagaacuuuacaaauagaauccuguacuacugaggcucuuuugaguguuuuucucuuaagaugauaauggaaagucacuucuuaaaaaagugacagaaucacuucuauuuagcuaaauuuuuacucucaacuccaguaagucuauauagaacauauuuuauuauaaucuguauucauuuguuuaacuucuuuucuuuuuaguggaguuggaucacaggauugauuuugaacucagagaaggccuuguggagagccgcuauuggucagcugucacgucgcauacugccuauuggucauccuuggauguugcccuuuuucuuuuaaccuucauguauaaacaugagcacgaugaugaugcaaaacccaauuuagauccaaucugaacucucuugaaggacaugaauggccuaaaacugauuuuuuuuuuuuccguuaaaaugugugugucaagauacggagauuucaggguuaaaguauauuucaguuuucuuuagggcaacauauauuugaauuuaaaagcacuuuauuuaaaaaaaaaagaaguuuucaguucugaagaagucauuuacaguuugcaucauuuuaauuaugagucugacaaaaccuucuccagagaaucaagcaagaccuggaugugaagaagguuuggguaaacugcauguaaaggcuacaaaucacaaucugauuccucccaaauauaaaggcauauggaacauaauguauuaaccaaaguauguuauaaaucaaaaauggucaagguucagcauauucuauaugaagaucacaaggugguaucguuuuagauuucuaugaaggcuuucauuuguacaucccuuugaaaaaauauaacagauuuaaaauguuuugaauuuaacuuguuuagaaaaacuaaugcuuaaaacaauauuugaacuacuguauuuauaauuuauuaccucuaauugcuuuauuucaguguaugagacauuacuguuuuaauguuugcuuugaacauaauuuaagaaccagauuuauuuucuauagugauaaacccuuuuuucucagaacuccaucuuuguacucuucagaugaauauauagacacuguggcauacauuuuuuuucauuaaaaacuuauggcuucauacaacacuaguucaauuuuuuaaauaaacuuuuuauuauguuacauguacuucagagaaagcuaaaguuucucuaaacuugacacggaguacuccauaauggguacauuucauuagcuuuauuagaaaacuaguaaaugcuuuugaauagguaguaugacagcuauuuuaaauguauaaacauuugugugccaaacaacauauaugaagggaugugaugccacuaacuagugcacauuguuucucaaugugccauugagacacaaggcacaguaagucaggauucugaggcauuggaaggguuuucuucagcuguaauuguuuccacagugcuuuucaucugaggggcucaaaguuuaagagugcauucaauaacccauguacuagcuucuugagguaaguaaauaaaucuuguucucauguuacauguuaauacaccaaggcaccaaaacauuuaaagugccaugaauuagauuacaucagaaaucagaaaagcuuggauugagcuagucaccgugguucacgccuguaaucccaacacuucgggaggccaagaugggaggaucucuugagcccaggauuucaagaccagcuugggcaacauagugagacccucuucucugcaaaaacugacaaaaauuagccacuuguagugguguacaccuguagucccagcuacucaagaggcugaggugggaggaucacccgagcccagaaguucaaagcugcagugagcucugaucacaccaaugcacuccagccugggugacagagccagacccugucucuaaaaaacaaaaaagaaaagcuuggguugaagccaggccauauucuuuuauaugcuguucaaugacuugauucacaugugaccuuuuaguaguuugcaaacaauaauaacagaaguugcaauucauaauucagagaaaugaccaugaagccgguguuucccugcuugauuucuauguucuuggauucucacacaaaagaggaguuaccuagaggggaucaguagccaucccuguugcacacaacccucacuucugagugguuuccacuagguuccacuuaaggugcugucuuuucuuaacuugcaaggaauugcuuagcuucccaauaaucauugucaaacugggagcaaaguuggucagcuguaucucucaccuccuccuuucuucauaagauaguagaaucuguggcuuacuuguagguuuuacuuagugcuucaguacuguuggcuguuuuggccuuuugcugaauuugcacaacaacauaaagcacuucuuuuuaauguuuaaaaaaaauuccaaggcuccaugaccaaguaugugacucacuaagaaacccuugcuauaaaaggcuuuugaugaaaucuuagcaaagcuaaauuaucucuaacuuagagauuccuaugaacucaggucauuuucauagccuguuuauuuuguaggucuaauuuaguucucaggaaaauuaaacucaugcuauaugacuguaucguuaaagguacuugagcguauguugcuguaggugguaugacacucaaaugcauaagaacuugaagggauuuauucuuaaccacuagaauaugaagagcccuuuuuaccugagaagagugaaauuaugucagaccuuuuaauuugauaucacugaguaaaagguauguuccuauagccauaggaauaugucugcuuccuuuuuuucauguugagaaaacagucaaauuuaaccauuuggaguuuauuugaauucuuggaaagagcaauauucaaaaccuuuucaaaaauaagauauucuggacuacuggauggauguuuuguuuucaguucauuuuucaucaguagagauggugauuucgguuuuguaguauccuuguuucuaugucugugcauguuaacauuggauguauuuguauauacuuaauuaauauacagacugugugucauucuggcuugauuagaagcuaagucaguuacugaguaacauuuugcaacuuuauuccagcaaguacuaaaucggccaaaaaaaguuuuguuuuugauaccauuaaaauuuuauucucuauuuuguguacaugcuaugaugauucucccaaguacugauuagaucacugaacuuuaguuagcuucccaagaauuauuaaccguuagaauaagacuuagauuaaaucuugcuuuauuuuuacuuuaaaauuagucuugcuaaggccuuauguuaguucauacuuucuuuucaacaguaaucuuguuuauaauccaguguuucuguguuuuaggacauaauuuaaaaauauacuggauuuuggccagguguggcagcucaugccuguaaucccagcacuuugggaggccaagcagggaagauuacuugagcccaagaguugaaaaccaaccuggacaacauggugaaacccagacucuacaaaaaaugcaaagauuagcuggguguguuggcagacgccuguggucccagcuacucaggaggcugaggucgguaggacugcaugauuccgggaggucaaggcuucagugagccaagauugcaccacugcacuccaccuugggugacagagcuggacacuguauccaaaaaaaaaaaguauguauuuacacacacacacacacacacacacacacacuggauguucuaauaacugcucuuuuguaugugaagcaagccuuaggaaucuuacguuuuacuucuuucuguuaaacggcaucuguuaucuuuugaaguacucacacugaacaugcuucaugcugaauacucacgcuaaaggccucagacauguaaacauucauccuuagucucuuuuuucucuguuuucucauugggagcugaagcauccuagucugcagaaaauuuaacacaccauauuccagcuuugcaucaccuagacaguagacaaaaggaaaagaaauugucaguaccguaucacagcuagugccucuguucauuccagugauaguacaugagccccuuccaguggagucagaucaagccaaaagauuuuccuguaaagucuguaguagaagacaaauuucuuuuugauccauuagauugguauuucuaucuucucagcuaauuaaugaguaaggcauguggacaaucgagaaaacuaauuugaguguauguauuaaaauugcucuucuaaaaacacguaaaauauuaaagaucaaggcagagcaaaaaagaacguagcaaucauauacuagaaaaagaaacuaaguuuugcuaaacuauguuuggguuaguugaccucuguagcuauucuaaaguuuucuaucccuuaucuguauuccgcugucauuccugugccucaagccucugccaggaaucugaugguacucuggcugaacuuaaaacauaagaaucucaaaggucucauuuaguaaauguuagugcuaaguuggugacagccuggguuauaugcuuucucuuucagucuucaguagaugcuugugauaguuuucaaagaacuguaaaauuuccgggucuguacagauuuuuagagaucauuuaauccaacccuguuacaguaucaugucagcauuuaaauagcaguaaaggucaugaaaagugaagugaaaggcagcaaacuccaugaaaaacuaaauacagugacaacugagggaagugguaaaguaaaaaaauauuaaugauggaauuuuaaagcuggaaggggcauagagaccauucuuuucucaauaauauucugcaaauauuaacaggugucaugucagaaacuaaguuuaggaauugacaaauucaaaaaucucccuuacagcagggcuuugagagccuuugcuacacuaaaugcucugugaaucuaucuggugcugcgugggggccuccaaauuuauuuaaccauauuuuuuaauuuggcauuuaccuagagaaaugcuaucacauuuaauuccuucguuuuacaguuucaccuccucaugugauuccuucauuuuguaagugaccgauuccacccuauacaaucacauggccaaugaaugacagucagaauuagaaccuaguccccugauucccaaccaugucuuauaccagacuguuuccccuaaucgauaggaaacuacuccuaaagggcagaaacugccucucuuuguuuuugucccccaaccuccccuccacacauacaccucuguaaucugaugcuuuaagcucagauuaaagcaucagcaagcuuuaaucugacacauggccguaggcuugaguuagcaguuggucccuucuuucuuccagacucucauaagaguacccuaucaggucuggacagacuuccguuuaugccucagauucaaaauacccaggaaaaagaagaagaaauacaaaacaacaaaaagaaaaucaagaaaaaaauaagauauccaggaaauauuuuguuaguuuucuauucuggugacaaaugcaaacuuaaggaaacaaguugcacaguguuaacuaauguuuaacauuccuuuccauaguguuuaugugggccuuuuaucaauucaugacaaauaggucaccuccaaaacuguuccaacauagguuaacucagaaauuuaaaauuuaaguacuauccuuuuuggagacuaugagaagaguuuuuacuauuguguuuuguuuuguuuuuugguguguguguguauguaugugcauuccccaaaaauaguccauuggcagauuguuagggugaacuuuuccucugccuuuguguuuguauaagggcgggugcaugcuuaguauugucugcuaccuuaugguuuuucauuuauauguaacaugguacaacuugcuuccuccccacccaacaguugucaggauauguuggggaauauucuuuaggaagauuacaucuggucuucuguuggaguaagaugaaaaacaaguauguuaacacuugaccuuuacugcuuucuccuggaagacauugaauaucuaggagcgucacucauaccuucccuugacuguacccacacccacugcggucccugcuugaucucucaaacuuuuuguuucccuuugagcuucaugacaaaaaauuauaaccauuuucugguucuaaggcugccauaaucccaacuuugccaguaagaagauggagaauuuuugcucauagggacauuucucagaagcagcuggcaccauaacucuccugagacccuuguuuccuuucuuucagcuccuaugacuucuuauguucacucucucuaacacuacuaaauguugucaaugacugcaaucacaacucuuugaaggcaggcuuuuucuuuuccuuuguuaccucuuauuuucaauagccaaagcagguuaguuuucucagaaucuucaguuuuacugaagcaugcauuauuucuguuuucucucugcagugaucaguuuggaugacagaaacuuuaaacuuuuauucuggcauuguccaguucugauuuucucagcuggaacuggugcaugcacauuuaauaauuucaaagaagugagagguaaauguuuucuccugcauuauacuguguuucucuagcugaauugauccguuuguuaucuugcucacccgaaacaaguaguugugcccuacagugagcaaccucagacuaggcuguucuaagcauucuggagaaaauaauccucaucauacaguuugugguaacucuuccaaaaaguuuaugaaaauugaaagaucucccuaugcaucagcuguggcugccacauuccguucuacuaggaaggcuaguggccacaacucccucuagaacaucagaggauaaaguacacuuauauauuagaaaagacaggcauauucugauuaugguucauucacaauuucucaguccaggguucagucagugaccauagcucugaggucuucaggcuaacuccaagaacccgugccagauagaaaccuacuccuacuaccuuuccacucaccuucccauucccccaccuuugcuaccaaagugacuuuaaaagucgaguuuuagguguuuguuuuuuuaacagucuaggaauuucagugcaauuccgugagguggugcugaccuuagaugagaaauacguggccaggcuauaaggacuacauguagaauugagaugggacaguguacguauggacugugaggggaaagaaaagguaaaugugugaaaggaaagagauuggugcauggucaugacagucugacagcuuagacauuucagaggcauuguuuaugagaaaggggauagggacacauaggucugaugacaaccaaagcccuuugaugaugccaucugucacucaaggcuccccacagccugcccaaccugacucuccugccugcuucuccacugccuaccuucaacaaucaaacuauauuuuuguuacagcaaacuacauuccauuugccuuuaaaugcuugcauuuuaguuauuguacuggcuaccuguuuuugucugcccagcauccuguuuccccuccuuuuggauccucuccuagccaauuccaugucuugaauccuuuccugcuccuuguuaaaauuauuuucugcuuugugugagucccuguaagcaccagcagcucaaucagcacugucuguaccauggucaagagaugaguacaugacucaggucagaccuuauuucccaccccauaagccacaaugauuagacaagaaauaggcacagaacccuaacuagauagggcagaagccuuccauaggauuuuauuugcuggcccugaaaugcagguagccuucuauggcuguuaaacacaauccaguggcacauggggugauaugaggauggagccauccauggcaaaacuccacccuuuccugugacauggauuaugugcaucugccaugaaaaggaagcauacacaagaaaugagccaagaguuccuggagaacugaagcaaguaucaccuccagaucaguuguacuuuuauuugcuuacacuauucugaggugggucucugucucuuggauccaaaagaguucaaauuaauaaucauuugacaaaaaauuaccuccacauuccuaaugaaguugucuuugaagauaaugucuugugauccccugguugaaguuaauuacugcuugugagcccccauuaacaacguguuccuuuccccauugcuugcuuguaucagcuuugcugaagaucuauuggcuguaggugugcagcuuuauuucuguguucucuauuguguuccauuggucuacgugucuguuauuguaccagugccgugcuguuuugguuacuguggucuuauaguuugaagccacaucugugugaugcugcuggcuuuguucuuucugcuuuggguugcuuuggcuauucaggcucuuucuuugguuccaucugaauuuuagaauaguuguuuucuaauucugugaaaauguuccaaccucugugaaaaaugagguugguaguuugauaggacagcauugauucuguaaauugcuuugggcaguauggccauuuuuaaacuauauugauucuuccaauccaugaacauggaauguuuuuccauuuuuugguuucaucccugauuucuuucugccauguuuuguaguucuccuuguagagaucuuucaccuccuugguuagguguauuuuuaaguauuucaguuuuuuuauggcuauuguaaaugguauuggguucuugauuugcucucagcuugaacguuauugguguauagaaaugcuccuaauuuuugugcauugauuuuguauccugaaacuugacuaaaguuguuuaucagucuaggagcuuuuggcagagucuucgggguuuucuagguauaaaaucauaucagcgaagagagcuaguuugauuucuuuucccaguuggaugccuuuuauuuauuucucuugccugauugcucuaaguugaaugggagcgaugagacugggcauccucuucuuauuccaguucucagaaggaauaguuccagcuuuugcucauccaguaugaugucuguggguugguuguagauggcucuuauuauuuugagauauguuccuuugauaccuagucuguugagggguuuuaucaugagggauguuggauuuuauccguauucaauaaaugguguugggauaacuggcuagcccuaugcagaagaaugaaacuggaccccccaccuuucaccguauaugaaaauuaacucaagauggauuaaagauuuaaauguaagaccucaaacuguaaaaauccuagaagaaaaccuaggaaauacccuuaucaacaucagccuuggcaaagaacuuuuggcuaaguccccaaaggcaauugcaacaaaacagaaauuggcaaguggggaccuaauuaaagcacucugcacagcaaaagacacuaucaacagaguaaacagacaacauacagaauuggagaaaauauuugcaaacuagacauccaacaaagaucugacauccagaaucaauaaggaacuuaacaagcaaaaaacaaccccauuaaaaaaugggugaaggacaugaacagacacuucucaaaagaagacauacaagcaaucaacaaacgugaaaaaaugcucaucacuaaucaucagagaaaugcaaaucaaaaccacaauaagauaccaucucacaccaguuagaauggcuauuguaaagaagucuaauaacaugccaguaagguuucagagaaaagagaacauuuauacacuguugugggaauguaaauuaguucagucacuguggaaagcaguuuggagauuucucaaauaacuuaaaacagaucuaccauucaacccagcauauggguuuauuucccaaaaggaaauaaauccuucuaccaaaaacacauauggucaucacagugcuauucacaguagcaaagacagaucaacguggcugcccaucaacaguggacuggauaaagaaaaugugguacauauaaaucauggaguauuaggcagccauaaaaagaacaaaaucauguccuuugcagccagccacauggauacagcuggaagccauaaucuaagcaaauuaagaacagaaaaccaaguacugcauguucuaacaaaugggagcuaaauauugaguaccucaggaugcaaaggugggaacaacagacacugcagacuggaacacugugggugaggagggcagaaggauagguugaaaaacuaccuauuggguacuaugcucacuaccugggugaugggaucuguaccucaaaccucagcaucacacaauauacccuuguaacaaacuugcacauuuacccacuguuucuaaaugaaaaguugaaauauuuuuuauuaaaaaacacaaaagcaauauguuucucaauaauugcacugguuucauuuugccuugauuugggguuugauuacagucucccacuuguguguguaagcucuuuaaagguggggagcaauccuaaucaucaccagacccuccacaguacaucauaggugcuuaaauuuacugaauuauaucuacaccaguauauacaccaggcucuaaguacugggaauaaccaugaguuuuaaaaauacaaaaaucuuugccuucaugggcaauucugugaccaaaauaaugagaauugcugaauugggagaagccuugagaaagggcaaacccuaccuggaaccaaacggcucagacaaaaggaagauuccuuuuuccacagccaaagaaagcaaaauuaguagcuuguggggcagggcagaagaguagaaauuauaugucagggugaacuugaaugcagaacuggggugugcuauuuuaaaaaacuguuacauuaaccugugcuaaaaugccuaacaaaauauuuauaauugcaggcauuccccaacuuggucccauaguaacucaguggcaguuuccuacauaaaccaagaaguauuuccugcuugcccugugcuguucccuaaacauaacggugcguguuugccccucucuaccuuugcauuugcuguccccucaccccagaaacuuccauguauugaacuuucacuuauuuuggagucagcaaugaguugcagcuggaaaaaagacacauucccagugcuuucucaaugccuuccagcugcagacuauuuugucucuaagcuagacaguaauuuaugauucacucauucugcaacugaaauaaaauggaagggaaaacaaaggagaaaaagaugagguuuguggaaaauggugguugaucaauuaauuugcuuuugugagggauacuaaaacauuuuguuguuuuguuuauaaggaauggaauguauuccaaguuuuaaauaaauagcuauuaacuuuaggaaugcaacuauuuggaaggcuaaggaucaccaguuucuaccaguauauaagcgcauuuuaagguguggcugauguacuaaaaaugauuucuauggggagagaaaaccacaacacagugaagagggaacuaaugugggagagaaaccccucccacagauaguaaugguggaaaguuacuuaagcaacggagacuacuggggcaucuuauuuaggggccgagucuggcuccuuauaguaaugccaaaauagagaacacucauugcugauacaucaaaggcugagcauuuuucucaacaagaucaguggcuuuaaauauuugcuaacaccaccuguuacaaagaauucucauuuuuccccgucaacuguaaaaauauuuaagaauguggcuauguauauaggagugagagccuacuagcuugcaaaauuuauuaaauccuuaauugugcagcuuguauuaagaucacuguuaacauuacugaagguuugcuauaccuggcacuguaggugcuuuagauacauccccucauuuaauguccacaauaccccuaugagggaaauacuguuguuagcucuuaacuuuccacaaagaaacuaaggcacagaaagguuagguaaccacagccacacagcuaugagauagcgguggagccgugauaugucuaugcuuaauccuguacucugcugccucucccagcuuaaugugugggaacgccuucuagaugggccuugagaccagacuccacauaaaugucuguauguagaggccugaaaauuguaacucagccaaaagucuagccuacuucccugcuagugaucucaguugcuaguaaaauaacuacagugugcacaaguggaaaagagagaaaccuuucacauggaagaagaaaccaaggugaucacuuccuguuuugccucuucugggcuuugagcagaaugguugguaucuugacaagugaguugcccaaugaguauaaucuuaaccuguauuccuuccaguacaugcaacagcuaaauauucuuaucuaggaauaacauaguccuaggaaugguucaauucacacuccccagguuuaagucugaaaauauccuguauuauaaugucauaaucauccuggagccacauuuuuaagagugugaaggcuuuuccagaauaaagacccugaaaucuuucaaagguucuucagaaucacacauauaugacauauauguggcaugcaugucauauauauguuauauguuuuauuuauguauguauauauguauauaaaacuaagacucagauuauuagcuauacagagguccuuaacgaguccacaaaucuuaaauuuuaaaaauugucaucaaaaggaacuggaauacccuuuaguuuuggaaucauguuuuacguuucucugagaggcuugucagacucagauuuccguuuaucugagauuugcugagucuuguaaccacagcacuuaaugauacuuaaggcacauguuaaaacucagcauggucacuguuugaaaaaaguauuccucauauaacucaguugagacaaauucuauuaauauaaggacaaucugccacaugugguggccacgccugaaauccuaagcacuuuggaaggccaaggcaagaagauuacaugagcccaggccuucaagaccagccugggcagcauagcaagaccuccucuuuacaauuuuuuuuuuuuaauuagcuagguaugauggcacacaccuguaguccuagcuauucaggaggcugagguggaaggaucacuugagucuaggaguccuaggcugcaagugagcuaugauugcaccacugcacuccagccuggacaauagagcaagacccugucucuaaaaacuaaauguauguggagaaucaugaaaucuguguuaggucauuuuccuagaauugaaaaugcucuccuaacuugauaaugcuuuaugcuuaauuuaauguaacaguuucuuuucgcugccuauuuugcuucaccuuuuuuuaauuuauuuuuuauuauuauacuuuaaguuuuaggguacaugugcacaaugugcagguuaguuacauauguauacaugugccaugcuggugugcugcacccauuaacuugucauuuagcauuagguauaucuccuaaugcuaucccuacccccuccccccaccccacaacaguccccggagugugauguuccccuuccuuuacuuagcuuugcuucaccuuucaauaauuucucauguacaaauaguuaauauuuauagcuugagguguugccuuuauagugggaauaaaaggcaaaugauauauuacaccaucacgccaccucuucucuguucaaagaggucuaauuucaugauuuuggcaacauucuuaaugcucaagaaaccagugagaucauugaauugaauagccaugucaaucacagcucaucuuuacacuuuuacuagccagauuuuacagccuggucucugcuuugguaaauauuuuaucauccauaugccuuuaacuuuauugcuuagaacuugccccaaguuuuugcuuuuaaccuuuguccuacuuuuugguugucacuguacaggcugagcuuucaguaaacuguaugcuguucagauucuugcauaacauucuaguuuagaaaacaguagucuuuuugcagagggacaagcuaaagaauguucucauuuauaugguggcaggaaacucagacuuaccuagguauguauaucauacugcuauacaucuuaaaaaauuuaagucagcucuuaauuacucauggcauugagaaaaguuugacuacaaugaaaugaugaaugcauuauuuguuuuggaaauguaauccaaaaauacacucaagucaacacauaaguuuauccucaaaaauaauucaguaacuaaugcaggcucuuugucagcucucaacugaacuagggcgaugguaagaaggaccucccaguuuauaacgguuuggcugacccuuggugagugcccauuugucaaaugaggcauuaaagauagauuuuaauccacucgaucuuuuuuuaaagacuugaagauccuccagcugaaaugucagugugcccaaguaugcaacucacuauucacaaaagaacuuucuuucaagaucucugccuuccauaagcaauucacaaacuccucuuccucuuugcacccugugucaaggcuuccugaguaccauuucaacagagaacuuauuuauaacugcaauauaucuaaaaaucauaguccaaaaucuuucaggcagacaaaugccauugaucucaaugucauauucaggaagucacugauccaagugccauauuccacaaauucccaggcauaaucgaacuugcuagaaaaccaaaaagggaaaaccu

SEQ ID NO: 17529 - RNA, 3233 nt, Homo sapiens
uagaaaaauaagcaaucaggaauaaaacauacagggcaaagcccuauauauuuguaaaauagagaugggccacagauucugagcuuuccagcagauuagcuaugugauucauagucucaaucagaugaaaguuaguuacugauauuuguucuucauauguaagcaagggaauaaagcauuauucaguagagggaauuacuuauuuucaucuuuagaauuuuagacgaaauauaaauuaauaaauauauguauuuuuugagggagagucucgcugucacccaggcuggagugcaguggugcaaucuugccucacugcaaccucugccuccuggguucaggugauucucgugccucagccucccgaguagcugggaguacaggugccuuccaccacacuaggcuuuuuuuucuuuuaaguagagaugagguuucaccauguuggccaggcuguucucaaacuccuaaccucaagugauccacccacuuuagccuccuuaagugcugggauuauaggugugagcuacuacaccuggccugauaaauauauuauuauaauacuuugcuacagauauucuucucuuuaauuucucagauaagucauagauguuucaaaaaauauuuuugggaagccaaugggagagagauuaucuuuccuaaaaccuuacugacauagauacagguauuagacaagauaauccaaaguguauuaucucuguuuugaaaaccaagcaagaacaaaaaaccaaaaccagaaaaacuaaaaacagaaaacuauucuauaguagaaaauaucuugaucuaagaaugaaaauagcagaaugguuaaauagccuauuguacaucaugacuauggaacacuauggaaagaagagcuaagcugggcacgguggcucaugccugcaaucccagcacuuugggaggcugaggcggguggaucaccugaggucaggaguuccagaccagccuggccaacauggugaaacccugucucuacuaaaaauacaaaaaaauuagccggguguuguggcgggugccuauaauccuaguuacucaggaggcugaggcaggagaaucgcuugaaccugggaggcaggggcugcagugagucgagaugacgccauugcacuccagccugggcaacaagagcaaaacucuguaucaaaaaaacaaaaacaaaaacaaacaaaaaaacagcuagaaagaauguacuggcacagaaagaacucaaagacauauuauuuauuaggggaaaaugucaaguuacagaauaacccaugguuugaucuuauuuuuacauuaaaaacacaaacauucccacacuguguguguauauacauauaugcauauauuuuuauauguuuaccuacauauaugcaaguuguugauaaaaggauauguuugaauggauauguuccaaacuauccaccuaguuaauucuggauggugagggggaaauaaagguagaccuuaaguucuauaucugaacuuuauaugaugagcacauauuucuauguuacuuguagaauuaaaaauagcuuuuaaaaauaaguaaaauaggccaggcguuguggcucacgccuguaaucucagcacuuuggguggccaaggaggggugaucacuugaggucagguguucaagaccagccuggucaacauggugaaaccccgucucuacuaaaaauacaaaaauuagcuaguugugguggugggcaccuguaauuccagcuacucaggaggcugaggcagaagaauuacuugaaccugggagacagagguugcagugagcugagauugcaccacuacaccccagccugggcaacagagcaagauucugccucaaaaagaaauaauaaaauaaaauaaguaaaauaaaagggaaaauauaauuuaauguugaccacaccuaccugcuuuuagagauuucucuucaagcagcccucuccuuucuggacuguaucaauuuagacaauuaacacauuugaauaaaaucacugucuacaggugucauacaaaucacaugcagaugacagacagagcuagguucaguuuucaguccuguggaagacugacugugagcuuugagccucagauucaccaucaguuacaugggaauaauaacaaugcuugccucacuuuguugugguaaagauuauuuaagacaaaaugagcuaauguguaugaaagcucuugugguaccucccaugacugucacuugccauagcugacagcaaacauauuaugcaacaaaagacuuccuauuuuucaaaaguauuuuccccuugcuuucuuuuuaucuauaagucuuacaaaguagaauuggugagauucagcaucuaaaacaccuuacuuauuugcauuucuuucuauuccucugauacguuaguuacucagccuuguucaucucagaacuguuggccaauccaaacagagaugaggaaaagggacucaaccucucaguccucaaagggccuguaauuacccauguucucuucucugaagcuguucauaaacccuuuuuggcuucuccauguuagugcaacuucucggaaaggccacagaccugaauucuagaucaugugcaguccuuguugcaacuuugugcucuccccuacuuaauaguacuggccuucuuaauaccaguggagcaauccauggaguuuuaaaaacuaaaauuuagcaacucuuuuuuuuuucuuuuuuugagacgaagucucgcucuugucccccagacuggaguacaauggcgugaucucggcccacugcaaccuccaccucccggguucaagagauucuccugccucagccucccaaguagcugggauuacagacacgugccaccacgccuagcuaauuuuuguauuuuuaguagagacaggguuucaccagguuggccaggcuggucacgaacuccugaccucaggugauccgcccaccucggccuccuaaagugcugggguuauaggcgugagccaccgcgcccggccaauuuaauacacucuuuaaugugcuuuguuugaaaucuucuuuugaagaauccaggaacccaugagauucuuuggugccuacaaauucugaucuccuuuaaaggucaugaaaacugugagaaccccauuagagcuaaaugaguuuuaagguaagugaaacuuccuuggaguuuucugauugaugaccuaguagucuaagucgcaggugaaaacauagaauucuuagggagaaaaaagaugcaaauagaa

SEQ ID NO: 17530 - RNA, 868 nt, Homo sapiens
uaugcuaccaugcaacgaaaccuuuauuaacauuuugaacagguucagcuauuacugaaacuuguaauuucuaaacuuaaguuggggcaaauggcuauagugcagaguaaugccaucacugggcacugcgaaugccaugacugaagaauuaacagccaccccucaggcgcaggaccaggugcagggucgacucuuucuggauguuguagucagaaagagugcggccaucuuccagcugcuugccugcaaagaugagccucugcuggucgggggggaugccuucuuuaucuuggaucuuggccuucacauuuucgauggugucacugggcuccaccuccagagugauggucuugccggucagggucuucacgaagaucugcauaccaccucucagacgcaggaccaggugcagggucgacuccuucuggauguuguagucagaaagagugcggccaucuuccagcugcuugccugcaaagaugagccucugcuggucgggagggaugccuucuuuauccuggaucuuggccuucacauuuucgauggugucacugggcuccacuuccagggugauggucuugccggucagggucuucacgaagaucugcauaccaccucucagacgcaggaccaggugcagggucgacuccuucuggauguuguagucagaaagaguacggccaucuuccagcugcuugccugcaaagaugagccucugcuggucggggggaaugccuuccuuauccuggaucuuggccuucacauuuucgauggugucacugggcuccaccucaagggugauggucuugccgguaaggguuuucacgaagaucugcauuuugaccuaguuuaaaaguaaaacauaagc

SEQ ID NO: 17531 - RNA, 1998 nt, Homo sapiens
ggagucacgugagcgccgaggccccucccgcggcaggcggcgaaagggcuugcgcgcccuccccuccuccacagccccccgccccucgcgggcccgccccuccaggcgaggccaaccuccgcgcccgccgcccgagccucagcgguccgggaggagcucccggcggcgcucggcagagcccucggccggugccccgcggccgccgcgcucccagggcuacuggcgcagcgcacggagaacccgguucucggcgcggugcgucgugcugggcccccgcgccgggccaccugaagccagaggauuuggggcgcacugaagggacugcgucucccagcucgaacccggcuuaaguggggccgggagcgaggucgggaaagucucacccgcccaaagccucaccaccgagaggcacuuaaaaaggaaagcgcagagggacccugcccacgcgcguguacacacacacccccccacacacacacaagcaaacacgagcuccccgccacuuccuccccagggucuccucaaggccaaauauugcucccaaugacagccagucaccccuuggcgaacgccugcuaaggcuccgaagagccgggccaccgaucuagcucccggcugaaagcagccgaccuugucacgcgcggggccgggaaugggagggaggguguuagagggugaucgcugugggaaagugagagggagcggcuguuagucauugcuccggguccauuaccgagaauccccaaaccuaguccgccgcugcguggccccucuccccaugcaaagcagacccccgaagaagccaugccaggcugagggacagacgccggggcucgaagcuccgggcagauucagaaagaggcgucgcugcagaaaggacgcaucacaguuuucagaucuuaauguggccgagguuuuacaacucccgacccggcgcagaaaggaaaucccaccauguuccccggagucgagaaaacggugaacagcuuucggccugcgcucgaccucugcgucugcgucucucucgccucggcuucccuuauuuuuuaaaccaccaccacacuccuucccccgccacuuccuucccccacccccuuccuccguugcaccagcagcagagucgcacgcagcaaauacuccuucaagaauuuuaccuaccuacaguucaagcaguuacugggauguccugacuaaucgaagaugcugccgcgcgcgugggucgcucugcgcaagggccucuucgaaaacccgacuaggcgcaacucagcguucagcagggccgggagcgccaggucguccccggggcccgggccccaugacuccugccccaaagcccacuccacccgaccucccuuuccugaggcuguucccaguugcugcuuugggucgcuccggagcucaagaacucggguugccugccgccccacucuccacgcacauacuugguuuucuucuuaggggcauuggcagguagacuuugaggaagaaaaguaaaggaucgaacagcucagcccucccucccgaccguggaugcccggagucgaccaacaccucagguccgggugcggaggccgcgggcgccccugcgcgaccguccgcgcccggcaagagccgcgcggcuuucgccuuugcuggucccgcgccaccgcuggggcgggcugcgaaaggguugggaagagcaaaggguuuuuuuguuuuguuuugagacgcagaagcccuuuaaaaagcccggcgaggagagguccagaaguagagaaagcagacggaggcaagcugugcccgcggggcaaagggacaguagaaggggcgggcgcccggguuccccggaaaacccucggccccaaggaaucuccuggggcgggagagcgcgguucuaaaaccgagaggauaggaaggggaagggggaguuguguuucaauuucggauucaccaggauucaucucuagucacauuuuucuucucaaauuuuuaaaucgaaaagauaaaagccaaaagaac

SEQ ID NO: 17532 - RNA, 23327 nt, Homo sapiens
aauugcauaccaauuuuccuaucccaauuuuccuauuccuauaagaaaugaaagagacacaacgaguuuugucaauaaaacuuuaggaauaucugcacauguacauuuacauucaaguugauaacacuggugguuucauuucaauacaaauuaugcuagagaacugacauuucagacauggucauauauaugcuauuugaauuccuuuaucuugauacagaucuugauugugaaucucuugaugauagaugugcagcuaauuugucccgaaacucaugaagauaauuguauugcugaaaaaaguaaagauacauuggaauacacuguagaaaacuaguuaucagugugggcacaauauuagcagguaucaggaauaaaaaaaaauacuugcuaagcacaauucuacaucuuuuuggguaaggaagcauuugcaucauggggaaguuuuaucuuuuaguaaagccauauagugugaaaaacuauuguucuacaagucucuaaaaaucagaaggugaaaugaaauguagauggauauguuuuaagucuaaaauucuuucucucuuuacuuacaggaccaaauaagauuaaaacaguacauaauggcauuauuuuugcuaacauuuuuccccccugguaagaaggacagagcacuuucuguagcaaguaacugguauauuuaacaaaauccauuucucaauuuauagaagcccuagucuucugcuuuuuugugaugacauaaugcacuagggauaauuuucauagacaauauuuuuuaaaaacaaacuguauugcuaaucucagcagauaagcaaaauaaaagcuuuaaauaauuuauuuggaguuuuaauagccucccaaaagauauucuuacucugccaaucaucucauuucauauccuuauugagauguggaaacugcauugcuaacaccagcaagccuguuugccacagaaugcugaggugauaaacugagucuguaguaauauggacuuaauuaucugcaauguuaaagauguaaaacauauggauauucauauauacaucuggccauggccauguaguuuguuuucaagagaagagaggugaacuuuuuggauuugaagcaucauuugauuuuuuuuuuuuuuugagacagggucucacuuugucgcccaggcuggagugcaguggugugaucucgguucacugcaaccucugccucccagguucaagugauuuuugugccucaggcucccaaguagcugggacuacaggcacacauaaccacccuggcuaauuuuuguauuuuuaguagggacaagguuucguuauguuggccaggcuggucuccaacuccuggccuuaagugauccacccagcucagccucccaaagugcuaggauauaggcaugagccaccgcgccuggccgcaucguuugauuuuuaacauaaagagaguugucuguuucagaccuguacaguggaguggaucuuguauggauugucccguuaaugaccuuauuuaagcccuaagaaucagguugcuuggugaauuuaucaguaauuaugauaauucacuguuaaugacacuggauuagaccuccaacccugggaagaugggcucucaagucuagggagcugccuaacagccaggauucuuuggugcccacuccucugaugagcggauucuaaugcugagagggcacgcuucugaaaagaaggcacauuagcuuuacagaucuacaaaaugaagugacaucugcagaaucuuuucaguaacaugauuaaugcaauauccuuggcauugcuagugcaguguuuugaaguguuaggggaauguacauguggaagauguccccaguuaucuacugcaaaggauaauuagcacugcuuuccauuuuuuguauuauagucauucaucugucuuuauuaaauguuuuggugauauaacaagaucuuccauagauuuuuuuuggccaagaaucuacccaagaacguaccaaguuuguauuaacaauaaccaucucauuguccuaggugagaggauccauucccaaaacggacuggggcaaaaacugagaaguagguagauccuggaaaaguaaaccaggaaguucaaauuuucauuaucuuguuugaaauccugugugcuuuuuuagacuaccuggauuauauuuacuuguaaauuuuuaaaaacuaaaagcauaagcaagugguauuugaauaacagagugcuuuggauuuucauuucacugcccuuuuggauuuucauauguaaccuuuugguuacacaugaaucuguauuuguaacaacgaccccaaccacaaccaagcaagcaccgcccaccuccucaccuugauggucuguauugccccggauccucuuaggucucgcaggcugucuauggcuugcucuggugauauugugucagacagguauaguaggagacaagcagcuacuaauggaacaugacagaaaaauaauauguuauuaaauaacuagugacaggguacagcauuuuauauuuaauaagacuucuguugauacagaagacugguguaauuguuccaaaugaauuaaaagacugagacuuuuaguguguguuuuugacaguuaaauuaugaucuuaaaugaccguaugguugaauuagaguuuaacacuggcuucauucuuucauccauuuaaaguguucauccauucagugauuuaguauauuuacagauaugugcaaccaucaccacagucaauuuuaaagcacuucaucaccucagaaagaaguguacccuuuugcugucauccucuauuccccaucaaccccugccauaggcaaccacuaguguacuuugucucuguagaucugccuauucugagcaaucacauaaacggaaacauacaauauuuuuuugugugugucugacuucucuuagcauaauguguucaggguucauacauauuguagcauaugucuguauuuaauuccuuuuuaugaucaaauaauauuccauuguauagauaugccacauuguguuuaucuguucgucaacugauggacauuuaggcuguuuccauuuuuuggcuauuaugauuaaugcugcuauaaacauuuguauacaagucuuuggguauauacuuuggagugaaauugcugggucauauguuaauguuuacuuguuugaagaacuacugcuagacuauuuuccaaagccgcugcaccauuuuacauucccaccaacaguguaugaggguucgaauuucucuacauccuugccaauacuuguuauuuuucauguuuuuauaauacccuuccuaauuggugucaagugguauccacugugguucugauuugcauuuccugaugacugaugauguugagcaucuucucaugugcuuacugacuauauguguaucuugcauguagaaagguuuauucggauacuuugcccauuuuucaguuauguuguuuguuuauuauuauuauuuuuucuuuugagagagacgaucucacuuugucaucuaggcuggagugcagugguguaaacucgguucacuggugccuugaccuccugggcccaggcaguccuccagccucagucccacaaggagcugggacuacaggcaugcaccacuaugccuggcuaauuuuuguauuucuuguagagaugggguuucaccauguugcucaugcuguucucaaacuccuaaacucaggugaucuuucugccuuggccucccaaagugcugagauuacaggcaugagccacgacgcccggccuaucuuuauuacugaguuguaagaguucuuuuuauauucuggauacaaaucccuuaucaaauauauagauugcaaauauuuuuucccauucuauggguagucuugucauuuugauaguauucuuugaaacacaaaagcuuucaauuuugauaucauccaacacuaaaaaaauaacuacuacuccaguguggcauuucacgaacucuuuuuuguuuuucuuaguacauuaaaacauuuuuuaaauuaacauauaguaauuaacuuugguauucauaaauaguuacccauggaaacuauuuggaaguuacucuauuauaacaccuccacaggaagaacaucaaaaaauguuaaaaaauaagaaugcagguguuaagacuuguaaaugauguuuugccagaauccuccagaacaaugcugaaaauaccucccacucccacccaagcuuuccagggaacaccauguuuagggccuuaaguaauccuuugagucuuagcaaacuuauauuuugcuugguuccauuuuaauacaaaaugaacauauggucuggaaacagaaguuugucuauuuggcgguuaaaaaaauaauagaaauauauuucuuaccaagacaagaucucccaaguccuccauagcagcugaaagggaaauacaguuuugaaguuuguacauuucauuccaucccuaguuacaacuaaagacuugcucuuucugccuucuauuuacaacucuaaugccuagcacagugccuugcacacgaagauuaauaaauauuuuugauuuaaucaacugagagcaaggugugcuuauuucuuuguugggaggaauucugaacaccucuaagcaucaagauaggcagagucuucuuauugaccucuuuagguuccaagauccacaucugagaaauggagcauguuaccaauagauagaaaucagacuuuuaccaacugucacuuugauuauuccucugucuaaacaaaaucugagugguuacugcacaaaugccauguagauaauaaccauucauguaucuaaaggaguccagagauaggguaucaccgaagucuggagcaugggcucuggagcaccacugccugggcuucaguccuggcucugccacuuauuagauguguaaagcuaagcaaguuauuuaaucucucugggacucagccuuuucaccuuuaaaauggugauagcaauaguauguacaucagagugaggauuaaaugaggcucacaaaugagugagcauuugccaaggacuuagaacacagcuuugugcagaguaagaaguaaaugaacauuagcugcuguuaucuagcacuguaaagaaauuagcaguuuuguauaacuggauuuuccagaaaaauggagauuaauccucaguagcaaaacuauucauuuaagucauuuucaaagauccuaaaaaauguauuacaugcuuccuaauguacuuagaggguauacugagccuaauuuaguguggaugacuuaucguuauggacaucaauuacuguauuguauuguauuguauuguagguaaagcuguagauauauauuuugcuuuaggaugugaaauagaggacugaauagguauugaccccuagucuuacucgugaacuugcuuuccacaaaguguuccagacauagaacuguuucagagaucuggaucuaccauauaaagggagaggcugggcaugauggcucaggccuauaaucccagcacuuugggaggccaaggugggaggacugcuugaguccaguaguuuaagaccagcuuuggcaauaaagugagacccugucucuccaaaaaaaaaaaaaaaaaaaagccuggcacgguggcgcacaccugaaguccuagcuacucgggagccugaggugggaggaucgcuugagcccggcaguucaaggcuacagugagcuaugacagugccacugcacuccagccugggugacagagaagagacaacugccuuauuaaaaaaaaaaaaaaagaucaagauagaacacuucagugucuuuuugcaagauuaauacuauuuuauaccuuuugcuauuuucaucuuuuuucuucuauuugaugaauuccuacuuaucuuuuaaaaccucaaauuucauuuccuaaaaugccuuugugcuccuacagaaaggaucauuuuccugugugcugccucuccugucuuauugcaguuaaaugguaguguuaguuauagguuccucgaagguggggacugugccucguuugguagucuuggcgugugguacacgguagguguuacugguugaauuauguccccccaaaagacaugcugaaguccuuauccuguaccugugagugggaccuuauucagaauuugagucuuugcagguauauucaaguuaagacgaauuagagcaggcccucauccuagaugacuaguguccuuacacaaggacaacaccaugcaaagacacagacauccgaggaagugugugaugacagaggcagacuggagggauucagcugcaagccaaggccugccauggauugauggccaccaccagaagcuaggaagaggcauggaaggacucuccucagucucagagggcauggcucugcucucaucuuaauuuuggacuuacauccucuagaaaugggaaagaagaaauuucuguuguuuucagcuaccugguuugugguacuuuguuacaauagccccaagaaacuacaaaauacaguaggcaagcaguguuguucacuaauuuuauaaagggcugcaaauguccaggcagaaccagugagacagcacugguagacaacaggucagugaaaaagguuuaccagauccuguugcugaaggauaagcucuauagcugucuagaaguguggguccucaaagauggcagaauggauagaaaauaaacuagucaccguaggacaccuucgaaagcucuaggacaaugaaaaaugccaguugucagaugcuuuauuuuaugggagacugaaacauucagcauaugcaaagucacccaucuacugucuauccuguuuguacucugcacaaacaucagagcauuuggguugccagaaccagcuacaguagaauuuguuaagcuucacuucacuaaacagagcuaguuugauuucuggaaacuuuucaguagaggcugcuuucaaaaauuuauuugaaaaaaaaaaaaaagaucucaaaaugguuugaaaaauagggcccuauguuggaaaauauuuuuccccagcuacauuuaacuaucuaauacuauuuuaccuauauguaucagaaacuuucacaucaucaacuggaucuauuugaaauuuagcuuuuauaauuaguacugguuaagugacuaugcuuuuuccauagaggaagaugggaaacaauaggauguagaauggcuucuaguucucuacugcauauucugcaaacuauauuucucuguaugucagaguucaguuuggccacaaacagguguguguccccaaagacccucguacuaguugguuugccuucagaacugacacuguuggcaugaggccccugggcuauagguuuaagaggagaaguuggcugggcuuguccuaugacuaggugcccugagaaccccauggcuauuugauauaauuucuauacuucuagcucaaagcaauguccuuaaggaacuuggggcuuuugaggucguaaacuauuuaauacccuaccuuauucgagaaaggauuaagcagguuauuagaauaugaaauauacauuaugcacggcaaaguccaguuuccuccccauggcuggcucucuguugcuuuguguguuucacuuccggcagagcaucucuuguuuuuuauccacaucgccccuuugaaucuuugccaugcuacuaucuacugcccauugccacucucucuggccuuccuccaagcugcuuuucuuuccuccucauuuuguccccuuuccuuaacccaucuucuuuuguuuuaaacuuucacaccagcagcuuguguuuuuauagccacugacacacaaugagaggcccucuuucaaucuguuagcagucauaucaucaaauguaauuuucaagucauauuuuuaggauugcuuauugcuuagagguaacuuuuuugguagcuaauuuugaaaaaaucgacuuucuuuauuuuuuuuuuucuagauggggucucccugucacccaggcuggagugcaguacugucaccuuggcucacugcaaccucugucucccaggcucaagcaguucccccaccucauccuccugaguagcugggacuacaggcacguaccaccaugccuggcauguucuuuuguauacuuuuugcggagaugggguuuugccauguugcccaggcuggucuugaacuccugagcucaagugagccacccaccacagucucccaaaaugcugggauuacaggcgcgagccacugcaccuggccaaaaaauugauuuucuugcuauugaaagcaacuaagcaauugaaaagcuaauaagugaggcagugauggugaugaggggaaaggagggucccaaaauugcaacuaaaggucuaagacuaaaggaaagaaauaaaaaagaaaagcuuguaaccuuguucuaacaauuuccaaaucuacucauuuauugucccuacucuugaaaaguaauaacagcacguauuugacuacuuacccuguaccagacauugugccagugcuuuccuagugcauuauuaccuuuuaauccuuacaacaaacuaugaaguaggugauaacugaauagggcuaccauaauuccagaaaucauuuugacugagacauuucucacauaguguauggagaaaagaacguacuguauuaagguuuuucgguaauuuuuaaggcagguuguaagcucuuccauuauuucacagcagcuggcuaugucaggagucccuccaucugcgauuggaugaugaugggugauaauuccacauugcugguagagauccagaagguuugggacucuauauuuugacaguuccccucuggugcagaaaacaaauaugucuuguauaccacagcucuuuaguucuucugccaauagaccaggauacacagacacacacacauagaaaacaucacacauuuaaauaccaucaagagggagaauaugaaauuaaauuucuuaagccaaacuaauaccaaaugacaaucuauaaaucugaagugccuauugauaugucugaaucaaaaggggucuagaauuaaaccucauauuacaagucaaaaugccuuuuacugaauuucaaaauaagucaauugcuguucuugcaaaaaauuuuuuuuugcaaugaauacugcuuuaaaauaacccccccucuuuuuuuuuuuuuuuuuuuuugagauggagucuugcucugucaccaggccggagugcaauggcacgaucucagcucacugcaaccucugccucccagguucaagugauucuccugccucagccucucaaguagcugggauuacaagcaugugucaccacgcccagcuaauuuuguauuuuuaguagagacgggguuucaccauguuugucaggcuggucuugaacucccgaccucaguugaucugcccgccuccgccucccaaagugcugggauuacaggcaugagccaccaugccuggcauaaaauaacucuuaaaacacuuaaaauugaguagcaaauaugguugauuuugugagaaaaagaaaaaaagugcuaucaauuaagguaugauagaucuauguucaauuaaggaugauagcacuuuuuuucuuuuucucacaaaaucaaccaugucugcuacuucaucacuuagcuguuugcuugacucugaguauuguauauaaaaucuccagcauggccauggugucagaggugcuaguauucucccucauaucugcacuguaacacauccuuguguauuuaauuuuauagacuaggucgccaguaaauaaaacauuaccuguauuaaacuucugugaccuagcuauucucauuauaaugauaugaauacuauaggcauucuauacacuaggacuucuuuauggcaauauuaacuauugagcauuugguuuaaaauaaauaacuggaugaucuaagugcucccaacuccagcccucucccugucccuuaaauccaaggacauguagcuauuuaaguacaaaguaccuucucaugaacuaaucccugagauguacaguacuauacaucuauuugccuuuuguacacauuugguaauuuuuauuauccagugauuuuccaacuuucugagaaagggcuaagaaaguaucucaggaacugcugcagggagauucuaggucuccaaucaaacauauugaccuguuuuauguacuggauuccauuuaagauuucauugcagaaaaaaaaguauuuugaaaaaaauuggaaacuguuuuuauagaaaaugcuaaaugaauaugacauuccaaaauguacaagacugacuuugaaccaaugauuuaaauuacauauauuuugcuuaugaccuaaauguucuccaaauagaaauuuccuagcauggugggugugucuaaagcagaaaaguuuuauaaauacuauaagggucaacuaucuauuacugucuuuaagucuuuuuuugguagguaaggaauacuuuuuuuuuuuuuuugaggcagggucuugcucugccaccagguuggagugcaguaaugcaaucucagcucauugcacuccagccuggaugacagagcaagaccuugugaucucagcaccaucucagcucacugcagcuuugaccuccugggcucaagugauccucccaucucagccucccaaguugcugggacuacaagcacgcgccaucaugcccaguuaauuuuuguauuuuuugcagagacaggguuuugccuuguugcccaggcuggucucgaacuccugagcucaagcgaucaacccgccucggccuaccaaaaugcugggauuacaggugugaaccacugcaccugaccaggaauaaauuuuuaaaaguacauuagcaaacugauguucuagaauaaccacgaaaaguuuuuaagauucagaaaaucuauacuaguuagaaucaagcaauauauacauuuuaauuugccauacuauaaggauaucgguaggacuaguagguuugagacauuccaggccaaucagaauaaaaucuuuugaaaauccacauuuguuaguaucaugcaauauguaaauuccaaauuggggcagauuaugaggauuauuagacuuguggcuauaaugguaugaacauccuugagcaggcaacaaccaguucccauucugucuuuuccaucuagaugcuggcucucaaaauuuuccauccaggauucacaauuucacugcuaacuuggaguucccagcucauguuuaauuucuacuaccacagucaagucugcaaggaacaguaaagaccuggggggagcaauaugucaguuuccuauuuacauacuuuuuuucaugccaacuucuacauucuaaccucaaauguaguuuauauguauaauauaacuacaacaaucagugaaaagcaacuccaugguuagguaaaugauggucuucacaaauaccucuuuacauaucagaauaagucuauaguuuggaacuucacacaauauugaaaacuuauuuuuauauuaaaaaaaaacugauuuguucuuuuugacagagaguuuuucaaugcuauucauuuaaaaaacccaugagugugguugcgugauauuauaccuaccuguaucuuuuuggacauuucuucuaacaucuuuaaauuuacaaccuauaaguaauaauaaagcaaguaaaaaagucaguuuuucgucauauguaacagguauguuuaaacacuuauauagcuacuuuauaaagucauuucacguaaucauuuauauguuucaauuauauuuugaauaugaauuucaauuucuuauauuucuaggaauauaauuacagggauucauccuaagcaaggauucuguauucuguguuucuucuguaacaaguaccugguuguaguccucagccucauuuguacuccaggcuuuaagcuuuauuaagauuggcaaaguacaaguguagggcugugacugcagaucuggaagggcugaaagguagaucuauguuccuuuaacuauaguccaccaugagggcuucgcaaaguguguuccccagugcugauggucugugaaauuuacuuauugcccaguauagagaaugauguguuaguugaccaaauacuuguucuaaauauauuguuggcacggauguggugaaaagggaacacuuuuacacugcugguggaaauguaaacuaguacaaccacuauggaaaacaguguggagaugccuuaaagaacuaaaaguagaacuaccauuugaccagcaauccuacaacuagguauauacccagaggaaaagaagucauuauaugaaaaagauacuugcacacacauguuuauagcaacauaauuuccaacugcaaaaauguaaaaccagcccaaaugcccaucaauuaaugaguagauaaagaaaaugugggauucccgggcaagauggcugaauaggaacagcucuggucugcagcucccagcaagaccaaugcagaaagaagacgggugauuucugcauuuccaacugagugguacuuggaaugccagcaagacagaaccauucacuccccuggaaagagggcugaagccagggagcugaguggucuugcucuguggaucccacccccaacggagcccaacaagcuaagauccacuggcuugaaauucucacugccagcacagcagucugaagucaaccugggauguuccagcuugguggggggaggggcauccaccauuauugaggcuugagugggcaguuuuccccucacaguguaaacaaagccagucggaaguuugaacugggugcggaacccaccacaguguggaaaagccaugguagccagacugccucucuagauuccuccacucugggcagggcaucucugaaagaaaggcagcaguuccagucaggggcuuauagauaaacucccuucucccuaggagagagcaccuggcggaagggauggcugugggcacagcuucagcagacuuaaacauuucugccugcuggcuccgaagagagcaacagaucucccagcacagugcucgagcuuugcuaagggacagacugccuccucaagugggucccugaaccccgcgccuccuaacggggagacaccucccagcaggggucgacagacacuucguacaggagaacuccagcuggcauccggcaggugccccucugggacgaaacuuccagaggaaggagcaggcagcaaucuuugcuguucugcagccuccacuggugauacccaggaaaacagggucuggaguggaccucgagcaaacuccagcagaccugcagaagaggggccugacuguuacaaggaaaacuaacaaacagaaagcaauagcaucaacaucaacggaaaggacgcccacgcagaaacccccauucaaaagucaccaacaucaaagaccaaacguagauaaauccgcgaagaugaggaaaaaccagagcaaaaaggcugaaaauuccaaaaaccagaauaccucuucuccuccaaaggaucacaacuccucgccagcaagggaacaaaacuggacagagaaugaguuugaugaacugacagaaguaggcuucagaagguggguaauaacaaacuccuccaaguuaaaggagcauguucuaacccaaugcaaggaaacuaagaaacuugauaaaagguuagaggaacugcuaacuauaauaaccaguuuagagaagaacauaaaugaccugauggagcugaaaaacacagcaggagaacuucgugaugcauacacaaguaucaauagcugaaucgaucaagcagaagaaaggauaucagagauuggagaccaacuuaaugaaauaaagugugaagacaaaauuagagaaaaaagaauuaaaaggaaugaacaaggccuccaaaaauaugggacaaugugaaucaaccaaaccuauguuugacugguguaccugaaagugacggggagaauggaaccaaguuggaaaacacacuucaggauauuauccaggagaacuuauccaaccuagaaagacaggccaacauucaaauucaggaaauauagagaacaccacaaagauacuccacgagaagagcaaccccaacacacauaaucaucagauucaccaagauugaaaugaaggaaaaaaauguaaagagcagccagagagaaaggcuggguuacccacaaaaggaagcccaucagauuaacagcauaucucucugcagaaacccuacaagccagaagagagugggggccaauauucaacauucuuaaagaaaauaauuuucaacccagaauuucauauccagccaaacuaagcuuccuaagugaaggagaaauaaaauccuuuacagacaagcacaugcugagggauuuuguccccaccaggccugccuuacaagagcuccugaaggaagcacuaaaccuggaaaggaacaacugguaugagccacugcaaaaacauacaaaaaugcaaagaccaucaacgcuaugaagaaacugcaucaacuaaugggcaaaauaaccagcuagcaucauaaugacaggauaaaauucacacauaacaauauugaccuuaaauguaaaugggcuaaaugccccaauuaaaagacacagacuggcaaauuggauagagucaagacccauuggugugcuguauucaggaaacccaucucacgugcagagacacacauaggcucaaaauaaagggauggagaaauauuuaccaaacaaauggaaugcaaaaaaaagcaaggguugcaguccuaguuucugauaaaacagacuuuaaaccaacaaagauaaaaaaagaaaaagaaggggauuacauaaugguaaagggaucaaugcaaaagaagagcuaacuauccuaaauacauaugcacccaacauaaaagcacccagguucauaaagcaaguucuuagagaccuacaaagagacuuagacucccacacaauaauagugggagacuuuaacaccccacugucaauauuagacagaucagcgagacagaaaauuaacaaggauauccagaacuugaacucagcucuggaccaagcagaccuaauugacaucuacagaacucuccaccccaaaucaucagaauauacauucuucucagcaccacaucgcacuuauucuaaaauugaccacauaauuggaagcaaaauacuacucagcaaaugcaaaagaacagaaaucauaacaaacagucccucagaccacagugcaaucaaauuagaauucaggauuaaaaaacucacucaaaacugcacaacuacauggaaacugaacaaccugccccugacuacuggguaaauuaaggcagaaaaaaagaaguuauuugaaaccaaugagaacagagacacaauguaccagaaucugcaguguuuagagggaaauuuauagcacuaaaugcccacaugagaaagcgggaaagaucuaaaauugacacccuaacaucacaauugaaagaacuagagaagcaagagcaaacaaauucaaaagcuagcagaagacaagaaauaacuaagaucaagccgggugcgguggcucaggccuauaaucccagcaccuugggaggccaaggcggguggauggaucaugaggucaggagaucgagaccauccuggcuaacacggugaaacccccgucucuacuaaaaauacaaaaaaauuagcugggugugguggugggugccuguagucccagcuacuagggaggcugacgcaggagaauggcaugaacccgggaggcagagcuugcagugagccgagauugugccauugcacuguagccugggcgacagagugagacucugucucaagaaaaaaaaaagaacuaacuaagaucagagcagaacugaaggagauagagacauaaaaagccauucaaaaaaucaaugaaucuaggagcugguuuuuuugaaaugauuaacaaaauagauagaccacuagccagacuaauaaagaagaaaagagagaagaaucaaauagacacaauaaaaaaugauaaaggggauaucaccacugaucccacagaaauacaaacuaccaucagagaauacuauaaacaccucuacaaaaauaaacuagaaaucuagaagaaauggauaaauuccuggacacauacacccucccaagacuaaagggacuucuucccucccaggaagaagucgaauccgugaauagaccaauaacaaguucugaaacugaggcaguaauuaauagccuaccaaccaaaaaaagcccaggacuagauggauucacagcugaauucuaccagaggugcaaagaggagcugguaccauuccuucugaaacuauuccaaacaauagaaaaagagggaauccucccuaacucauuuuaugaggccagcaucauccugauaccaaaaccuggcagagacauaacaaaaaggaaaauuucaggucaauauccuugaugaacaucgaugcgaaaauccucaguaaaauacuggcaaacugaauccagcagcacauuaaaaagcuuauccaccacgaucaagucagcuucaucccugggacgcaagguugguucaacauaugcaaaucauuaaauauaauccaucacauaaacagaaucagugacaaaaaccacaugauuaucucagaucuggaaaaggccuuugauaaaauucaacaccccuucaugcuaaaaacacucaauaaacuagguauugauggaacguaucugaaaauaauaagagcuauuuaugacaaacccacagccaauaucauacugaaugggcaaaagcuggaagcauucccuuugaaaaccgucauaagacaagaaugcccucucucaccacuccuauuuaacagaguauuggaaguucuggcuaggggaaucaggcaagagaaagaaauaaagaguauucaaauaggaagagaggaagucaaauugucucuuuuuacagaugacaugauuguauauuuagaaaccucauugucucagcccaaagcugauaagcaacuucagcaaagucucaggauacaaaaucaaugugcaaaaaucacaagcauuccuauacaccaauaacagacaaacggagagccaaaucaugagugaacucccauucacaauugcuacaaagagaauaaaauaccuaggaguaaaacuuacaagguaugugaaggauuucuuuaaggagaacuacaaaccacugcucaaggaaauaagagaggacacaaacaaauggaaaaacauuccaugcucauggauaggaagaaucaauaucaugaaaauggccauacugcccaaaguaauuuauagauucaaugcuauccccaucaagcuaccauugacuuucuucacagaauuagaaaaaacuacuuuaaauuucauauggaacaaaaaaagagcccauauagccaagacaauccuaaguaaaaagaacaacgcuggaggcaucacgcuaccugacuucaaacuauacuacaaggcuauaguaacaaaaacagcaugguacacaugccaaaacagauauauagaccaauggaacagaacagaggccucagaaauaacaccauacaucuauaaccaucugaucuuugacaaaacugacaaaaacaagcaauuaggaaaggauucccuauuuaauaaaugguguugggaaaacuggcuagccauauguagaaaacugaaaguggaccccuuccuuacaccuuacacacaaauuaacuuaggauggauuaaagacuuaaaccuaagaccuaaaacucuaaaaacuguagaagaaaaccuaggcaauaccauucaggacauaggcaugggcaaagacuucaugacuaaaacaccaaaggcgauugcaacaaaagccaaaauugacaaaugggauuuaauuaaacuaaagagcuucugcacagcaaaagaaacuaucaucagagugaauaggcaaccuacagaaugggagaaaauuuuugccgucuaugcaucugacaaaggucuaauauccagaaucuacaaggaacuuaaacaaauuuacaagaaaaaaacaaacauccccaucaaaaagugggguuguaaaguauaauaaaaaaagaaaaugugagauauacauacacacacacacacacacacacacacgcacacacaugccauggaauacuacucagccaugaaaaggaacaaaauggcauucacagcaacccggguggaacuggagacuauuauucuuuuuuuuuuuuuuuugagacagagucucgcucuguugccaggcuggagugcaguggugcgaucucggcucacugcaaccccugccuccugucaaagcaauucuccuaccucagccucccaaguagcugggacuauaggcacgugccaccaugcccagcuaauuuuuguauuuuuaguagagacgggguuucaccauguuguccaggauagucucuaucuucugacuucgugaucugccggccucggccucccaaagugcugggauuacgggugugagugacugcacccggucacuggagacuauuauucuaagugaaguaacucaggaauggaaaaccaaacaucauauguucucacucauaaacaggagguaaacuuugaggacacaaaggcauaagaaugauacauuggacuucgggggcugguggggaacagguggaagggggaugaaggauaaaagacuucacauuggguacauuguauacugcucuggugaugggugcaccaaaauuucagaaauugccacuaaagaacuuauuuauguaaccaaacaccaccuguccccccaaaagcuacugcaauaaaaauauauuaaaaaauauauacauauugauaggaagcccauuauuguguuacccaccuggaagagcacauaaaccgagaaacugagaacaauucacucgugacaaagauagccugaaaagaagaaaaauuuuucauguuuaguuaaguuuuuaaaaaguuauaaauggaaauucaguuuaaucaauaugggugcuugccaccaaauaaaguuguguuaaaguuuuacaguagucacaaaguaagaauucacaguuaaguaucaauauguuggucacaaaaaaaaacauagaaagacaaaguuuuaaaacagggacuuauuugcuuuguuauuauuuaagucuuaaaaaugacaaguuaggcugggugcaguggcucaugccuaugaucccagcacuuagagaggccaaggcaggcaggcuguuugaguccaggaguucaagaccagccuggacaacaaggugaaauccugucucuacaaaaaacaagaaaacaaaaaaccaaguuaauuuaaauuuaccuuaaagauaauaaugccuagauugccaaccgguaguauacgguguacuuauguuauccugugguauauuaccugagauaauuuguauuagugauuuaggaaaaugaauuggaaaaugacuauuggacaauuuucuccccagcauuuauucuacauuacuauuuuaagauuuuuaaauagaacuuccuuaacagauauaauuucauaugaugaaaaccacagguuuuugguuaaaaagaaauaaugugaagaaaucauauucccaguuugcaguacucagggacagaggcucaccuugucugcaugucagaagaugauuuaaaggaaaacaggaggcaucaucuaaauaccaccugacuuugaaaauuagaugaauuuuuguguuuaaaugggaguuuuaaguggaaauggaaaguaaugcuauuugauggcaggacaaaagaccuuuaggacacucuuucucuucugacaguagggauagugcuuucuuaagaagagagacuauuauauuugcagugaugagagaaagcauuugauugcucauuguaaagaaucugguauaaccauaagucacuugccaagauuaaaaggcugauuuuauguagaaacuuuuuguuauugcauugauguggcuuuuaucuuaaacagagucuguugauagaugcauuacugugacauuacuucuaaguauuaccuaggauuugauuuaaugagaaaugauuaaauaucucaucucauauuugguauauuauucuuuugucauaaaagaauaaguagauuuugauacuaaaugggagauuauuucaauccuaccucuauuuccuacuuacuuccuucuacuaaguuaguagaagggccaaaaaaaaaaaaagggucuuauaaagaguaaaugaaucauggaguuagaauguauaaagaagggccaaaaaaaaaaaagggucuuauucuguauuauagauaguaaaugaaucauggaguuagaagauccuuuaaugauuagaauuauauaaucagagggggauaaucccuuaacauuuucaauaugugaacuacauucuacuaagauuaugauguaacuaaauuuacauuuaugauguagauugugauuuuagcucaucauugaucagaaaugcuaacauaccaugauauaugaauuggagucuguucaucuucaauaggcucuucaucugaugagucaaacucacuuguuuguauugaacugggcuucaaaagaaauguuauguuaaauaacuguaaagaauuuuuuuguaguuuuaggauagcuaauccuugucuaaacacacacugaauucauauuugcaauguauucagccaucaauccagaauauuaacgagaucagcaauauuaauaauaaaugacugcuauuuaccuuccuauuaauaauuauagcacugcauaguggaaagagaguuggauugggaaccaagaaaucuggcuucugaucuugguucugccacuuacuguauacucucugacaagccacuucaguugguucuggaucucgauuuuccucaacuauaaagugaggagauuuauucauucacaaauauuucuuggccaccuucauuugccaagcacuggagaugcaaaagaucuauaagauaaauagccugccuucaguauggcuggagagacagaugugugcauagauuacagaagaaagguauuauauaagugcugaaauggaagcagaacuauacacuguggaacagagaagagagugaccacguagguagcuggagaaggcuucacagaggaaacgcuuuagcuggguuuugaaggaagagcagguuuuaaagaagauaggaaagggagggugcgguggcuuaugccuguaaaucucagcacucugggaggcgaaguugggcaggucaccugaggucaggaguuugagaccagccuggcuaacauggcaaaaccuggcucuaccaaaaauacaaaaauuaaccaggcaugguggcacaugccuguaaucccagcuacucgggaggcugaggcaggagaaucccuggaacccaggaggcagagguugcagugagccaggaacacaccacugcacuccagccuggcugacagggcaugacucugccaaaaaaaaaaaaaaaaaaggaagaagaaaaaagaaaggaaagaaguuaagccaagggcuuguguauugaggaacugugauaucaaaauagagauggaguagaggagaugaaguaguuuugcccaccccuuuucucaaaaaacauccccacauggccuaguaguuuggugggggugguguaggugaaauaaccugccuccaacuuuaugaaucacuagacuagagagauugagauagacuucguaugcugaucuaagcaguuggaacuuaauccugcagcauuuugacauggaagacuucuacacuccuuguugaaauuuuaaggaaucaaaagaaaaagaaaaacaaaaacaaaacagaacaaaacccauacccuuuucucacucccuaguugaaaccaauugaaagauaaagaaauggaguuuuauuauuguauaucaaauggaguaugcagcuuaaagcuguugccacgugggcuugccccuuguucaccccagaauuagacaaauguauccacccagucacagguggccauggacagucuggggcuccugugugccagagaguggaccagaaagcaccuucugcaggcaggcagguagaucccaagaaagaaggaaagaaaaaguugagauacugguguucaguuccuuccaaacucggggaucagauaacucaauggggacagguggagaaagaggccaggagugaaggacagcugaugucccuccacauggcaacauagggauuagcaauuguaagcaccuaaugcucuuucuagcucugaagcuauauucuacaacggucuugguacuagaagaucacaggacggcuaauuuaggcuacggacuuuuuuuucuuucuuucuuuuaucuugagauaggguuuugcucugucgcccaggcuggagggcaguggcgugauauccgcucacugcaaccucugccucuuggguucaagcuauuugcguggcucagccucccgaguagcugggacuacaggcgugcacuaccacgcucagcuaauguuuguauuuuuaguagagacgggguuucaccguguuggcuaggcuugucuccaacuccuggccucaagugauccgcccgccuuggccucccaaaguguugggauuacaggcgcgagacaccacccggcccuaggcuauggauuucuguugcuuuggcucuaucugaaguauuauaaucaacugcacccaaaggaaaggcuuccaguagguugucaagccgggcaguaggaaauauggguuaggugggggaucuucagcuccuugccugcaucuguuuuuucuuuaaagcaacuuugaugauucauauuucaaauuuguguggcccauucaccagguuuauuaauccuaacagagcuggacguuucugcuuccccaggcccugugauucugaacgucacgggaaaagagcagcauugccagguggcccuggggcauggugacagcgguggugucgcccacaagccgcggcguggcauucguacucaagguuuccccaggcccugugggcgcagguagcgcccggccacccuucggggcugggguaucgcgcccacucaucgcugacacucaagcucuucggcucgguuuccucgguacaacgaggcucggcccucuuuggcugggcggcugggaggcuuaugagaccccgcaggggacaggugacagcccacagcaggugcacagcgaauguccgucuuuccuucgucggccaccgacccugcuccuucgucucucgugcccgugcugggcccgugcgagucaccuccccgacccgcagaacgguuacggcgccagucgcacugcuaccaggcuagggcugcccuccggcccaggaucggguccccgggaccgcuugcgucccugccgccucgcuccuccaaaccccagcacguccgacucaccggcuucaucgcuggccgccccacgucgagaccagugccgccucccucugcagcgccggcgacucaccggugccccggccgagcccgcgccccgcagcuuagcucacugguucguccuuc

SEQ ID NO: 17533 - RNA, 14658 nt, Homo sapiens
ggggcggcugggcuggugcgcaggcgcgcugagagggcuggcgccgcggcgguagcgguggcggucgcggcuguggccgggggaagugaaugguuuuacccagagggcccugcgccgccuuucuccgcuggcaacggcgccgcuccccgcuccuccuccccagccauggcguucacguucgcggccuucugcuacaugcuggcgcugcugcucacugccgcgcucaucuucuucgccauuuggcacgugaguagcuggggcuggggaaaggagggcgaggcggcaacacagccucuuuucgccccgggcccgcgguccgggccgccacggccgccggggcuuugcgcgucggggaugcggcccggcuggcacgggccgcgcggcgaggggucugggggccgcggguacuggaggagccggggcgcgcagucgccagguggacgcgcccgcguugccucggcacaggccgcgcgcaccgcuacuccuccccuacuggauggggcggccgcgguccaggcgggcgcccgcgguuccgcgcugcguucgcaccgaccucugccggcccgcggcccugcauucccggggaggaugucgacagcgcggugggacggccguagugugaaugaaguuuuccgaauuuuuguuaauacagauugacuuucuuuuaggguuuccacagaacuguggccaaaauguaaccuacuuagggugaauuuccaacucuacuuuucagcacuuguucggugcucuucaaaucaaaucacuuuuuuucucuuuuuccagauuguuguuuccuggugaacuuugaugcaaguucaauugauuacuuuguugauugcaugugcgcguuucccccccaaaucauacuuugaccgcuggaguuucaacaggcagcuuuccaagccacccuuauauucaggauugcuugauuuaguagagggaguuuucauuugauuuugagaugcucagaaaccuuaagcuuuucuggggcaguauuuauuucuguuacacacaucaucaucacuauugcaggguggaagcacagccuuacuggucccucuaaggaaaaagucguaaguucccugugacauaguucuacagagauaagaauuucuguugcuuuagcacaaaauuaaaagccuugagagccuucuggaaaucauucauuaaaaauuuaucucauacuugcuucucuuuuccccauauuccagugccuucuggaauguugcuuuuaauuugaaugaccgcguucacucuuacguagauuuuaagucagguuucaucaugccaguaacaaggauuucuaugaaacauacggaggggcagaaugauuaaacagcagcagcgucuugugcaaaaaagucucgaaaguggaagcauaucacaaauccauuccuuuuugcuaagcagugugauuauguuuacaauuauuuuaggaccugacugcuuauuguaaucaggaauacuuauguaggcuauuaacugugucggaaauaacugcuaccucagaaugcuugucaguaggagcaguaauuugaagagcaucuucagcccugcuuugauggaagaacaauaccuaagauaauuugggauacagacuagcucaaccuuaguaggccucugaugaaaaugugugguuccauggccgggcgcgguggcucacuccuguaaucccagcacuuugggaggccgaggcgggaggaucacgaggucaggaguucgagaccagccuggccaacauggugaaaccccgucucuacuaaaaauacaaaaaaauuagccgggcaugguggugggcgccuguaaucccagcuacucgggaggcugaggcggaggagaaucacuugaacccaggaggcagagguugcagugagccgcgauggcgccacugcacuccauccugggcggagacuccgucucaaaaaaaaaacaaaaaaaaagaaagaaagaaagugugugguuccauuccaucuguagauguagcuuuaagucauucugcuugauggguauuccuuuuuucugggaugauggggauucuuagaguggugggguaggcuuuuucacauuuuuacguuuugaaccagguuguguuuggcuuaaggaaaaccugaaccgcacuuucaaaaaauggguaauuucagcuuaaacaaaugcgugucugggugaaguaaauaauuuuaagucguguuauacaaugaaaaaaaaauuauaccgcagauucguggagagcuuuuaugcuuagggauuucuucauucagagaauuaguauccuuuuggaaacaauucuaaauaaauagauaguuuuaauuuuucuauuacccauauaaccuuauguuuaucaucuuagguaguaucuuaguccauuccuuuauaguguuuauaguguugcuauacaggaauacgggaggcugaguaauuuacaaagaaaaaagagguuuauuuaccucaggauucugcugacuauaagacugggcaucuggugaaagucucagccugcuuccacucauggugggggaguaguguguggagaucccauagugagagaaagcaaaggaaaaagagggggaggugccaggcgcuguuuacaagccaguucucuuggguccuaauggcaggagaacucacuuauucccuccaagaugacaccaaaccauucaugagggaucugcucccaugacccaaacaccucccguuagaucccgccuccaacauuggggaucagauuucaaccugagauuuggaggaguuaaaccaaacucuagcagguaguugaaguaucuuucagaagacucauuuuacaauuuuuaaauuacauuccaaaaaucuuauuuacauuaaucacuguauuagagaauguuuuuuaugcugaugauuauaucugucaauuuaguccuaauucaugucauugaugcucuguggagaauagagucgggagcauagauuguuugaaaaauuaaaagcuuaaaagucauuccuuaaagauguguauuaaauuggaagguauucugaauuguguacuugggcaucuuuagggauuuaucuguuuuauuuuuguuauacuucuguaggaaauuuugugggugucuuugcucagccacauagcugcaaaaagauuugaaaaucauuaagaauauucucagaagagguucgaaaacccuagccuauagcacucaaagagaaacccauucaacaacauaguuaaaaaaucccugugaccaggcacaguggcucauuccuguaaucccagcacuuugggaggccaaggcagguggaucaccugagcucaggaguuugagaccagccugggcaacaugguaaaaucccaucucuacaaaaacuacaaaaauuagccaggcaugguggcaugcaccuguagucccagcuacuccggaggcugaggcaggagaaucauuugagccgaggagguggagguugcagugagccgagauugugccacugcacuccagccugggugacagaguaagacccugucucaagaaaaaaaaaaaaaaaacccuugaagucaccuggagaaaauguccaauuaaaugucaguuuuaaagacaaguuuuguauucuguuaaguuggaucuuguuauagacaaguacuuaugauuaucauccuugucuugagcuuuauuacuaaaaugcauugggguuauauaccacggcugacgucaaguagcagacuaauaacguccauaaguaaucagaaauuaguauuuucuaauuacacauguauguuuuuaacauuuguguuaggugucauuagccaagggaaaucccccuggugaguucugcauuuuuuuuuuuuaaucccuagugcuauuuuuuucacccccuccuuccaguuaauauuuauugaacacuuaacuaugugccaggcacuauuuuauauuuuaggcccugggacauaauaguaaauacaacaaucuuuguucuuucagagauuacauucuaauguuuuauuauuuuccuucuauuguuguuugguuggaguuuuuauuagggcaggugggugaauuuuauggaacucuagaaauuaaaaaaaccgucuuuuuaugaaucuaaauuuuaacagggaaauaaacagucauguuaaaagauggaaauauguaacuuuacugauuacugauaauauugagcaacacuuucacauauaaagauacuauuccuaacucauuaagggaaggguagcuuaguuugugugucccuggggugaguaguguuagcaacuaaaauggcucccccaucaacuugcugccuuuguuuucuuucuuugucaccugaaaugaugccacaaaguggugcagagucccuauuuugacucuuaauguacauucuagugacccuugagguugaagccacauuccuccagaguguggacaaaagcauccuuacaaauguauguguuugggcaccaaugggaacacauugaagaguucgaauccaucucuagugucccacugagcacugugccaagggaggaggagcaugcacagauaaauaaaaaugguccuucucccugagaguguagaggggcagacagaccuguguguaaauaccacacuccagggugagaaaagccauaucgauggcauuauagagucccaugcuguguggagaugugggcaauuacuucugcccaaaggaguuaggaaagccugcagaaagaaguugaccuaggaagguuuguuuuuuuuuuaggauaaagaggaauuuggauaaacaguugaaauuauuuuucuacucagaagauuauuucgaguagagauaaguugaaauaacuugagcagaggcauugacgaaauugaaaauugaagguauuuauuacaguaauaccaaauuuuagugauacugagauaagaguguuuucacuuuaaaucgcauucugguucuuuuugucauauaugaguuuacuguaaauugguauuugggaucuugguguacuuuuguucuuguuuuauuaacuuuaauaauuauuugaagauggggcagguuuguugcugcuuuuaauuaaagugagugguccuaacuguuuuaauuuuauuuuagauuauagcauuugaugagcugaagacugauuacaagaauccuauagaccaguguaauacccugaaucccguaaguuauaauauaggauuuaucuuuagauuuuaaaaauauguuuguuuuuaacuugaaguaauuugaaaauggccaguauucugaguagcauaauauauuuguacuuuuugaaguaggcagaauuuaaaaaaucuucuuuuuccugucgugcuugacuauucuauuauuaaucugcuggugaucuugucagcugucauacuaacauucuuccaaucugcuuuuuacauugucggccaaagacaguugaaaaggucaaaaagauuaaaagagucaaaauugcauuaaagguguguacugcuuuuuaguuaaauguuuuaaugcuauauucauuucauggggaggguuagggcauuuguauuuguaacguuuuguucagugugcucguucauaugccuguugagguuuaugauuucaugaaauuucauauuuuaugcaaauauaugcuugcuggcccagucaaguagggaaagcuguuaaaugcguaugcguuuuuuuauguuauagccauaggcacuucuaugugaaauuauuugguguaguacuugaaaguugguuaacauaaaaugacuaauagauggugagaugauucucggguugugacuuauugugagguaguaugugagugaaaucuuuaguauggacuuaucugccauaucuaguuuuaucuuugguuugcauauucuggaauaaaugagucauucuuucagcugauguuuauucagagccuguuagguggauagcucuguucugggggcucugggaucucgcagcaaugccauucuuuggacuuagggugccauaauuuuguagauaacaauuuguauacaaaugucuaugugguuauuucuaguguguaucuacuuucuguuucuaaaacaggccugaauuacacugaguucugagccaucaugaauuuagugauaauguagcuccauugugcuuaggguuuuugaaaaaauauauauguauguauuuuuaaauuuucuuuugagaugggggugucucuauauugcccaggcucuuaucaaacuccugggucaagugaucguccugccucaaucuccuggguagcugggauuacaggcacacaccaggguacccaguuuguuuuuuuguauuuuugccugcauuuaggaagauacucuuuuagccuguguauuugauuuugccugacuggucaguaauugaaagguugguuguuuauaagaaagcaguggguaugucuucaagaaauaaaauacaguaauucagcuuuaaaaauuacuuaacgaaggggagaguuuguguagauuuuaauugucuagcauacuaguguacuagcacuaggugcuagagggauuuuauuuggaaaagcaucuagaaaguuaguuugguacuuuauuauuguuucccagauaaauguggaugguggaagagauuucuaguuugucuuuagagaacuguuacaguaagaguugauguagguacaauuaaaaguauuaacuuauuagcuguuucuuugcucuuaugaaacaagacauaagaagaugaauuugccuucucuuggaaagcauuaaguguuaauuuuaaaacaucuuaaccuaaguaguugaaguuguuaccaggaaaugaagaaacugaaauuuccccuuuugauagcuguuuauuaauaguauucugugcuguuugucuuuucauuacuucaauaaccaaaugaugaugaagguaaaaauauuugaaaucagaugaggauuuuccugggugcuaggcucugugguaagcacuuugccugaauuuuuaaauuuaauucucaugacaauccugagguagguaaauuguuaucucaugaauaggagaguaaacugaagcuuugccagguuaaagcacuuugccgaauguuauacagcuaagauagagucagaacuugaacucaagacagccuaauuuuugaagcucaaguucuuguauuuuccuaauguauuguaaauuuaggagggacagguuucauuuuaacagguaaugugcgauuccuggcuuuucuuaacggaaagaaauucucacugagaagagacaugugcuugggacauccuaaugcugcaggagguugaaggacguuuuuauagcagcacagguugccuuuuggauagggugccaauaauuggcugaauagcagugcaucugacaguuuucccuauuuaaauuuguuuugacaguucugccaaaguaugggggaagacaaauaucacuauuuuuuaaauugugaacuuuaacaagagaauauuauauuuugcauguuuaaauguuaucauuucagccauauuugcuugagguuuuuuuucuggauacuaguuucuguuugaaccuugguuccuaaauugaauaauuuuugugucucuuauggggaaauuuugucauuaaagaaugcucggagaggguugguuuuuaagagagauggguaguaaauguuucuggacuccuuuugaggagaagggagggaauggcauuguuucauauuagaacugguagaguuguagauuaucuuuauuaacacuuuuauuaaaguaauauuaagagcgggagggguucaugcuuucaaaaucauucuuuccauacuucauucuguaaguguaggauaaaaccuugcaugaggauuuguuuguuagguaucagauggcuuuuuagggcugaaauaggcuuauauuuuaaagacaacgucuguaauuuaaacaaguauuauaaaagcaacucuaguggaauucuuaauaaaauguauauuuuucuugguuuguucugguuauaguccuugaguuucagaguccuauggcccuuuucuuguuuagagaacuuugaucuuaaauagaugcuggcuuaaauguuauuuagaaguuuagguacauaugccgaguuuauccuuuguuauuguauugcuuaaguuuguagaaaauauuugguuagugguguagaugaguuguuuaccuggauuuuuuuuaaaaauaguauucauuagaaaguccccucuacagcuuuaaauuggaaagaguaauuugggaguaugagaaaaugggucugaguauguagugugauuacaauaucuacagccaugguuuccccucaggagugaucugaugaugauaaguauucauaugauuuccauuugguaugaaguaaacauuugagaaacuggcuuuguagcugugacuuacaggagauacuucggcugaaacuugcaaugagagguuuugguauuuuuauuuaacaaaguccucaggcugaaaucuuuaggaugagaaagauaauuuaacauaaagcauuaacuccuggucauuuuauaaaaagcauuuugcucgaauuaauuuuucuucacuuaauauuaccuaguaccaaaagguuuauuuuguuuuuggguucugagcuucuacuggucuucuguugugucuguagcauuuuguuggcaagcagggguaaagaaacggaaaggccaccuaagaaugagaacuugggaaccuggaaaaucuuaauuucaugguuaagaacucagucuuuucccuccuacauugcagaaagcgaaucuuuuacauuugcgcauauuaguguucuuccccucacugugcugagauuauuggcugauuggcuuuccauuaaaaaauuacuucugugggaaugcaaugugguuugcuaaauauuguguauguagcauuucugguuuuuguuaaaggcuuaaaaacacugauauguaaaauuccaaaggggaguuuuguuucuguggaauuuuuaauauguugcaugugaucagauaucucauuuuuguacuucuaucauuguugaauggugaaaagaaaaaguauucuaguugacuagcauauuguuuaacaaucugggugguaacuuuauauaauuugaucuguuucucuaaggauuugagcuuugaauuuuaagucauguaucuuacuauguuagugcaagcuauaugcucuggucaguuugccuguaauccuacuuuugguaaaaaguuaaacauggaaauaaaacucaguagcaucuuuuauuucugagucuaagaaaacagugauuuuucauuauggaaacuugguugccaccugcuuuccagauuaguaguugacuuaaugcugaggcauuuugauaacuggcuuguguuuuccuuccagcuuguacucccagaguaccucauccacgcuuucuucugugucauguuucuuugugcagcagaguggcuuacacugggucucaauaugccccucuuggcauaucauauuuggagguaauauuuagauacacuuuuaauauuuuuuuaaauuaaaacuuaaauauacugugguugauaugguuaucuuacaugcuagucaccuacauaaaaauggaagaucaguuggcauuuauuuuuuuaaaaaucaagugggugaacaaaaacuauuucaauaccucauauagagcuuacuuuauuuuuaaaggaauuuuuuuaaaaagugaaguauaacuuaguguugugcacaagucugaaguauauagcucaaugaauuuuuacauacguauacaccuguuaaacuaccacccagaucaagauacacaacaguuguagccuccagagcauucacuuaugccccaucuuaagucaguuacccuccacaccucccaagaccacugaccucuaucaacuuagauuagcuuugcuuguccuugaacuucagguaagucaaaauguacaguaugugucuaauuucuuucuguguuuaugacuaauuuugguuauuuguaaaagauaauauuuuauaacuuccauaguaauaucugccguauauagaguuagaaguuuuuguuuuaaauaggcaugucaaaaccuuauugcccuugauuuuaggagacauauacugaagaaguauuuagaaguaaaguguuaucaggucuacaauggacuuugaaaugauucagaaaaaaauguacuuggccgggcgcaguggcucacgccuguaaucccagcacuuugggaggccgaaguggguggaucacaaggucaggaguucaagaccagccuggccaagauggugaaacccugucucaacuaaaaauacaaaaauuaaccaguagugguggcgggcgccuauaaacucagcuacuugggaagcugaggcagagaauugcuucaggcugggaggcagaguuugcaguuagccaagaucgugucacugcacuccagccugggcaacagagcaagacucugucucaaaaaaaaaaaaauuuacucagggccagguacaguggcucaugucuguaaucccagcacuuugagaggcugaggcagguggaucacuugagcccaggaguuggagaacagacugggcaacguggcaaaaccccccucuacaaaaaaaauuagcuaagcaugguggcgugugccuguaguccccgcuacuugggaggcugaggcagaaggauugcuugagcccaggaaucugagauuguggugagccaagauugcaccacuauauugcagccuggguuacaggguaagacccugucucaaaacaacaacaacaaaaaaacaaaacaaaaaaccaaaaaaaaccaguacucagaaugagaaagagaaggagaaagcaaauauaguaaaaauggacauuuggaauaucugggugaaagguucuuguaucuuuucuguaagucuaaaauuaugccaagauaaguaaaaacaaaacaccuauuuucuuuuuacaguucuuccuauuuuucauggauuucugaaaaggcagagacuagaagaaacuuguuuagcuaucucauucugcucauuuaggggcucuacuuuuaaaauuaagaugguaaaaggaaagcauuuuacccauaaguaaaagaaugcuucccuuuauggaccaccucucguaacagauguuuuagaagaaagaccugcuuucuuaucugaacauuuacugcccuuucugaaugccuaauagacuguguuuauuccagguauaugaguagaccagugaugaguggcccaggacucuaugacccuacaaccaucaugaaugcagauauucuagcauauugucagaaggaaggauggugcaaauuagcuuuuuaucuucuagcauuuuuuuacuaccuauauggguaaguugaaaagguaaaaugaaauaugcuuucacuuugcugcuuuaaaaguuugcaggcauuaugguuuucacaccucaaaauccauuugaagaauaacuuagugucuuaagugugcauggugcacaccagcaaauucgcacacauucaguguggcccacacuggugcuugucaaggcaguaaaccagccugccaucagaggcagaagguuuggucagggaugcugcuucauaaguuuucagacacauucagucaguaaaggaugguccucauucuccauggcaaagugaugucauugaaggauagggaugugugaguuugcagaaauuucugcuugucuucagggucucuccagacauuauguuucauuuuuuccuuaucauucuucauaaguggugugcucugcccuuuauuuucugauuugcuugauuugagugguaugaaugaaagaaguaguucuaccuuacaggguggugcaguuuccgauuuuuguucuuuuuuuuugagucggagucucuguugcccaggcuagagugcaguggcgcgaucucugcucacugcaaccuccgccccaccaaguucaagcaauucuccugccucagccuccugaguagcugggauuacaggcgugcaccaccacgcccggcuaauuuuuguauuuuuaguagagacagaguuucaccauguuggccagguuggucuugaacucccgaccucaggugauccgcccaccuuggccucccaaaguacugggauuacaggcgugagccaucgcgcccagccugauuuuuuuccuuuuauacucucauggacucauuguuccucuaggucagggugucucagcuucggcacuguugacgcuucugggcugugugggaauuucugugggaagcuguccuguauaucaugggacguucagcagcaucccuggccuuuacccacuaguugccaugagcacccuccugcccccucaugacaaccaaaaaugucucuggacauugccagauguccugaggggcaaaauugcccugggugagaaccacugcuguagguguguuguaggugcagugaaaugacugcuuauuaaaacuagaaaaggacacuguuaaauguagaauuauauauuucuuuaagcuaugugaauauacuuuuacacaucacuuauauaaaauacuuucucauuuuuuauuaauacauacucaacuagagaggacuuucuccuugauuuucagaauauuuccaaaaaagcuguaagcuuuaaaaaacagcauaagcuucccuucucuuuuucauuacuugaaaacuugcuaagauaggcuuauauucauauucauauuucucuucauacauaaguuuccaucauagaaaagaugaaugguuagacugaaauuuaggaaaaagguauuuuugguauuuuuaugccuuuagaggcuauuacugugaaaaugaguauccuuuagugcauaugcagauauuacucaucuaugaaacaaagaagugcucugaaaagugaaauucuaugugucacuuuaauuuccuguuaauuuucauuucauaaguuuccauagcaaaugucuggaacgggcugguguaugauaggcacuucauacguauuuguugaaugaaagaaaugaaaugaaugauugaauaaaugauaaaguuggagaugugcaguugugggaaaauguucagcaggauaugguagcaccaggacauuuguuguguuuuaagguugucuaucaagcuuguucaacuccuuuguauuucuguuuagaguuaugugcuuuuugaaucaugccccuaugccguucccauagcacucuguagaauugcccuuggcaguucuuaaaccuaaaucaaaaggucauugccuuuuauuuugcuguuuuccccccuuuucuuuuuuaaccacuuccuaaaaguugcuauugcuuagauccuuucuguaaugggaaagauccuugauugaucauuccuuucuauacaauggggauacacaugguaccugccuucuaggacuccuugaaggauuaagcaagguaauguauauaagagaccuaacagggccuggcgugaagugagcccuccagagauacucauucuauuauuagacacaacuccagagugugugauguuuggauggcuucucuaagcucugauccgccauuaagcuuucagcugugccguucuacuugcuaaaauuggaagggaauaggggacaacuacagcauaugcacugagccaagucauauguuaggcaaaaguccauaaaugcaaauuaaaaucacugugaacuugucauuagucuugucauuuucugugauacuaguuugcuauauaaagcauacucucucaugcucugaguuuuuuuuuaauaauuaguaauguucaaauuaacaucuuuuuucuucuuuucagcaugaucuauguuuuggugagcucuuagaacaacacacagaagaauugguccaguuaagugcaugcaaaaagccaccaaaugaagggauucuauccagcaagauccuguccaagaguagccuguggaaucugaucaguuacuuuaaaaaaugacuccuuauuuuuuaaauguuuccacauuuuugcuuguggaaagacuguuuucauauguuauacucagauaaagauuuuaaaugguauuacguauaaauuaauauaaaaugauuaccucugguguugacagguuugaacuugcacuucuuaaggaacagccauaauccucugaaugaugcauuaauuacugacuguccuaguacauuggaagcuuuuguuuauaggaacuuguagggcucauuuugguuucauugaaacaguaucuaauuauaaauuagcuguagauaucaggugcuucugaugaagugaaaauguauaucugacuagugggaaacuucauggguuuccucaucugucaugucgaugauuauauauggauacauuuacaaaaauaaaaagcgggaauuuucccuucgcuugaauauuaucccuguauauugcaugaaugagagauuucccauauuuccaucagaguaauaaauauacuugcuuuaauucuuaagcauaaguaaacaugauauaaaaauauaugcugaauuacuugugaagaaugcauuuaaagcuauuuuaaauguguuuuuauuuguaagacauuacuuauuaagaaauugguuauuaugcuuacuguucuaaucuggugguaaagguauucuuaagaauuugcagguacuacagauuuucaaaacugaaugagagaaaauuguauaaccauccugcuguuccuuuagugcaauacaauaaaacucugaaauuaagacucacuuucagugcauuguuugagauuaaaaauaguauuucuuaaacuugcuuaauccaugauaaagacauguugcugucauuuuuaaaaagugacg

SEQ ID NO: 17534 - RNA, 2388 nt, Homo sapiens
gcauuagauauaaaaacagagcuguaagcuuuaauuauuugcuuuauaaaugagcaaaaguauuaaaaucucuacauaaagguaaaugacaauggauaauugccauucauuuaaucauuugauaaauauauauugaauacuuguucugggccaaguccucaagauaaaauauuaagacauuugguauuuuuuaucuaacacaaaagcccauauagcaaacauauauaugauuauauuauauagcaagaaaauauauaaauaaaauuucauauauucauuacacauuuuaaaugcauauauaugccauaggaaaaugugugaaaagauuuacaccaaaaugguaacuaauggugaucuucucugcaugauaggauuucugaguauuguugucuuguuucuccauauuuucuaacuuuucuacugugaguaagaaaacuaaaaccaaaacacuacgugaguucaggccuacugucuaaaacuuaauuuuaaaagaaacuaaagaaacucuacuauaaaauuuaggucuauaacucccaagaauuguuugagccuguaucacuuccuaccuaggucuuauccuagacucaguagugggucucccuuccucacuucugaucucuccacucucuagcucagacauuuucugugguuucugaauagacacugaauacauuccagacuauuugggcuggcauacaaagacuccaggauucggccacugucugcccuucugcacgucucuucuacauuucauucacugauucauucacagaaaguauuuguugaguauaaaucacugugcuaggcaauuagaagagacaaagguagaagaagaaccaugcucucuucaaccuccaguguguagcauaaauuauguucuuggcacgugcgugcacacacccacacuucacaaaaacguacaaugugaagugggucugaggggaggcaacacaguguugagagagauaagaagagguagcaauucugcuagaaaauuaaggaagacacuguggcucuguugccuuuugagcugguguucauuggauaaauaguuucaacacagauaggcaaaauuuuaaacauuuaggacacccuauggggaccaggauaucuagauauuguuuguaucaagaaagcauccugaggacuccguguucguguaucuuaaguucauauuucuucuagcaguuauaaguaaaacaagggaaggaaaugcaggucuucccagacuuugcuguacgcuaguggaaagugauccuccaguaaccgcaucuacugaaugagcuauuauguauccuuuuucagauuaccugagaaugcaauuuuuaggacucuaccccacugaaguaaaagcaccauugcuauaagauaaaguauacuaaaauauaaguauaaauacaaaaauguuaauuuuagcaguuuguaauagcaaaaugcuagaauaucuaucugcagggcaaugagcaaauaaaguauuaaacugccauacugcgaacuuuaugcccuuuuuaaaaaauauauauauauuuuagagacaggguucacuauguugcucaggcuggucucaaaacuccugggcucaagcgauccucucaaagugcugagauuauaagcgugagccaccucacccagccuuaugcacuuauuuuuuaaaauaaguucuacuucaccuguaaucccagcacuuugggaggucaagguggguggaucaugaggucaggaguuugagaccagccuggccaacauggugaaacccugucucuacuaaaaauacaaaaauuagccgggcgugguggcgagcaccuguaaucccagcuacucgggaggcugaggcaggagaaucgcuugaacccaggaggcagagguugcagugagccgagauugcgagauugcaucacugcacuccagccugggcgacagagcaagacuccgugucaaaaaaaaaaaaaaaaguuauacuugaguaaaaugcaucaaaauauaauagacugauggauagagaaauagauaacgugauaaaaaacaaauacagcaaaauguuaauuguaguauauagguggugaggauauaggugcucacuguuuaauucuuccaaauuuucuguauguuugaaaauguuuauaauaaauuauuggagauaaaaaggaaugauucgaguuuacauguauuggccuagaaagauacguuuuaaaagugucuuuaguauaauuguauuuuugugguuuaagaaggcuggcucuagagcaagaguccugagucuucaagccuagugcuccaucauuuaccagcccugugaccuuucucacgccacucccacucuaugguuuaguguuacugauaacaaaccuaccucguuguuauuaugaggaguaaacaaauaauacacuu

SEQ ID NO: 17535 - RNA, 18132 nt, Homo sapiens
gaauaccaaaugcucuuuauuaaaggaagguuuucauugaaaagacuucguuuuuuucagucuguucuguuuuuacagaaaaccucucugaaccgauggguuuuuugcuaauguuuucaucuuguuaaucuccuaagcuuuuuuagugcuguguuuuuucccaaugaucuccucuggugggaagccucguaagcaguuuccugagcagagaaugcaaauuaaguucaggguggccuaguugggcacaguggcagugugcccucccaauaugacagagcuucucugcuggccaaccccuuccaggugccaggaaagauggccuugcuggagacaguaugcuaaugagucaaguccuuuuaugggaagaggaacgggcagggagaggaaagcacagugaaagagguuccaaugcuugcaacucaggaauggagaaagagaggcucacaucuguuggccucuaggauuggugaucugacaccacugacacacucagggaccauugcuuccuuucuuuaaaaucuccccuaaaaucauacagaacuuauauacaagugcacugggucuguuuggacuauuacuuacaacagcaugugaaccuacaguuaucucaaaaguuucaacugaggaagugcuucuccuccaaggccccacuggcaagaguugccagccuggcuccacccacaaggaagccaggaaccaacccccugugguggccucagcacgccugucacuuggguccuccagcuuucccuggaacacacugccacucccuucucacacccaaguucugccaagcaaauagagaugcugcaucugguggaccaguucuguaauauuggggcuuggacugggacaucagcaaagccagggaggcaccccacagcccugucucacccacauuuaguggucacugaacgcaguuauuccuaccgccugugauggcuaauccaugccucucucugcucacuggaaaaaauccuugucaguucuggcacagacuguuauaggggccucuuaacugguccaccugccaccagccuuauccuuccucagguuaucugaugcagcugccagagaaaccauucuaaaauuaaaucucauuacucuacugcuuauaauuccccaacuaccuaccucuaagcucuuguucaugguaugcaagacccuauggucugcuccuggggaccguucuagaacccacguguaagcagacagccaaaaaggggccgggcaggccucacaccucugauggucauauccccugccuucucuguagccugggucauccacuucuccaaaacguagauguggcagauucugggcggccucagcacucucccaccuccccaagacuguucaguucuaagugcccacaacaccuaccucagacaucucugccuuugaucagauucucgagacagagaaucuggauuuguuugggucagauguguccaucccucuggucugcucagcuguggacagggucacagccaccuuguccccagugucucaucagggacguggguugagaaggagaggcugccaaagaaagggaugugagcuagacagguccaccugcguguccguugcagccccugccuggcucuuccaccccaucuccucuacugcauuccccauccuucauccuaaaccuccaacgcacccucagcuccaccaccggaugaccuaucaucccaccuaugcaugcaccgcacaccauccccacccuccuccuccugccagcaccagcuacaaaagucacuuuguaucucucugaaacuguccuugacuucccaggccaaccgggcagccaucauuccuuccuccacgauccugcucucuugguaccuacuccauuacagcagugaucacauauagcauuauugucugucuacaugucugugucuacccucaaauauaaguacuugggaggugaggauuagauauuuucaucuugguucucagguucaauauggcuccuggcaaaaauagcuguuccccagauaucauguggguggguauguaaaugcgugaacacaugaacguaggugcccuucucugcccucagaggcugggaggcccaccgugcauggcguuggcauaggugggcacgaacuggauuguuuugcucaccugugcccaucguuugcugcuuucucucccagacgggguugaccggaccuccaccaucuagaagcugaagacgagagugaccgcgcuggccgugaaaucgacugcugcggguccaguguccgccaucuucaggguugcacagaauccuccaagauacuuugcagccuuuuuucccccuggucccucucccguuuugauuuugugagagcguaggucauccucguaaacauaucaguagaccugggguugguuauuuugucauuuguuucugucaugggaugguuuggugugugggguggggaggggucucuagggaauuaugagacugggagggggguggagggaaugcagguagcucucuggauggaacggggacaggggaaagaguacugccaugaaagagauaggagacacauaagaggacagcagaagcccuggcccuggggaggcuucucggaaggccuggcuucacaggcaggccacagaaggauaucgcgggcacgugcacccaaagcaagauaguggcuucccuuuuauauccaaucuaauccugauuggaugucccugaggccccugcuggaaacagccauaggagagggcccauggcaguaggggaaagaaggaagaaauucccugcaacaaaacuucagcuaaacuuugauuuguguauuguuuacauaauaauuuuaaaggguacauaauguguaaagaguuuggauagaaccucucuucauacuaugguuuucguaaaggaucuguuguuguuacggauucauuuuuucccucuauuuuuauaagagcagcagaguugucuucucaaaacggcugccaagcucugcuucuugggaagauggaugcagucauguaggccugagcuguccgucuuucaccguuaggugggaggagcguauggguggacuugaaggacauggacguggcuggaaugagcacagcauugggugagcgcacaaggaugaggacaucaugugaucaguuauggguuugcucgcagggcacccagagauucucaaagaauccugcagccucuuucugugcuggauuugcuugucacggagaggccucccucccuuuccaccccacccauggggcauuauccugucacucccagccuugcuccacacacacacagguggguacaaguuccacuggaggagaaaaggcaaggauggacuuuuuccccuugugagagguuugauacccagaaaaugagcucaaaaccuuuacauuaggguugcuuguaggaacuggagccuggaggcugcaucuacuucaccugucacugcugagggagaggaggggagaaaggcccagcaacagcguacagaggggucagucagcaaguccagagagcacaugcagggagauguuuggcccacaccgcacagccccgccaucuccagugggcgaugaaagauguaggaaagguugauuucaagauggaaaugacagcgcuauccgcacaguaugaauuagggauuugcuguguuaguugauuuauccauccacacagaggggaggaaaaagacacucguuacuuggugggagauugagaaacugugguaccuaccacaaaguaauagcucuguuuaugaagggcaagaaaggcuacauuucagaauuugacacaguggaggguauuagaggaaaucaaagaggaguuguguggaaaaucagguuguguaaaugaagguaugaaugcucagccagaggcaagaucagggagaugguacaaggccuguuuguuacauggaugagucgggugccugguugugugugugugugugugugugugugugugugugugaagucagaguugaaauucagaagaucagacuauggaaaucacugcccuuuuuuuuuuaaaagcuaaugaacuacauacagaccuaaaaggccuuaaugaaauccgaacaauuuucuuuuacuuucaagaucaaaaacaugcacccaacccagccuuggaugccaccaccagguuuuugaagcccuuuugagucuaagaaggugagaacaauguaaccauagaaagccuuucgugagcagagaaggcuugaauccacaauuucauucgcugaauuaaaaaaaaaagguucagaccucuccuugggugacuaaguucuaaagaugcaaauccaugugcagaaagagauggcauuuuuuaguugauuauuuuuaaccaagugccauuaacauucaucccccacaucccuuuucuaaacaagcuuaguguuacuuggggaauguguugggauggacgaucacauguaaggcaggaagaauaggucaaagguugaaggccaaagguaagaccagaggguuugcgaauguggguuuguaggauacugagaaagugaauaaagaggagaaaaaaccaugguauuacacaucuugcugagaaaggaaagcauucggaucugcugcaaaaacacauauauccauaaagacucauguuauucagaaaacagauugugaacacaaucacauucgcaugaauccuuuaaaaggaagaagaccuuaaaguaucugcaaaucugaauuucuauuuauuccuucacugaauauagaaacaaugguuaucugauuauuagagauauuauuuuggauauguuacuuauuaacuugcuauggcugguaaccaugauaaagucuguuauuaauaacaacauaauucuuuuuuuaaagaagaaaagcuuauuuuucauugacaguguauagauuuaucuacuuaguuguguuuugcuauuaguguuuuaauuuuuuuuuuaaguugaguguuugauaaauuuuaagacccuguccccaccuuguuuugaguccuguguugacuacagguauauagcucaauuuaaaaauccuaaagcaaaagaauuuuauuuauaaaagaaucaaacaguugcaugcaugaggcugugaagucagauauuuaguaauaaaagcagcagugccuuuuuuuguauuuacccauugacccccaccaaaugcaacuguuuuauauuaagaaaauaguaacaauuuuaaaaucucagaguaaaaucuauuucacuacaugcuuuuccccccuuguucugauuuaagcaguguguacuuggcaucucuacauuguccuagggacagugguguucuacaauauuaucauguaugauguuuuauuggugcuuuuuauucauaguggcuucuuaccagaaacaguaggaagaaacacaugaacuguguacaagacaugaaacauugcugcugauauguuguuuuuucacaugcuuuugaguuuucacuuuuuaaacgagagccagcaagcaaaauagauguggcugggucugccuguccgggcggcucuuugcaccgagcucucaaauccuguguauugaggguuccuuuuugguacucaggauuggagcuacagcugggccccccucucucccauucguuugaagagacacugagggaaacaaggguuucuuuugagguguccuuggcugccuuuuacgggaugggagccuucuccggaucuuuuguucuucugcaccucuuguagcuacugccggugcaagguuguagauguuauuccccaggagccugggcuugggggcugagcugggcugaaugcaaaagcaugcaaccagaaggcgggcaaggggaggaaaagcaggccuggccucauugguccccuggagaugucuguagcagucagcuccagcuugggccuggggaagcagccugaccaaggcgcucaggugugccuguuacaagaagaaccugcagaaggauaauuugcacauggagcugugauaacacuaauguugauuuuuuuuuuuuuuacaagucaucagagauguuugcaaagugaguuuuauuuuuuuguaauuccuuuaucuuuacuuaaaggugaauguguauuccucugggaggaauaggaagaaaacaggaauguuaauaaugucgaacagaaaacuuccucccuuauuaauauauaauccucauguauuuaugccuaauguaagcugacuuuuaaaaagcuuucuuuuguugcaugcccugugcaggcaucuguauuguacaugcaugccuuucguccuguuuuccuguauaaaguuagugaacaaagaaauauuuuugccuaguucauguugccaagcaaugcauauuuuuuaaauuugucauauauggaaagagcauguuuguuacauguaaaagcuuuacugauauacagauauacuaauguuugaagaugcuguucuuugcaaguguacaguuuucaaauguuguuaccagugaaacacccuugugguuuaaacuugcuacaauguauuuauuauucauuuccucccauguaacuaagaaucauggcuauauuucauaucaacguuauauugaaagugaagggaaaugauuaauacaagguuuuguaacacuggugugucuuuuucuuuuuuucaacauacaugauugaauagaaaauaagaacugaggccuggcgugguggcuuauaccuguaaucccaacauuuugggaggcugaggcagguuggucacuugaggucuagaguucgagaccagcuuggccaacauggugaaacccugucucuacuaaaauacaaaaaaaaaaaaaaaaaauaagccaggcaugguggugcaugccuguaaucucagcugcuugggaggcugaggcaggagaaucacuugaaccuagaaggcagagguugcagugagccaagaucgcaccacuguacuccagccugggcaacagagggaaauucugucucaaaaaaaaaaaaaaaaagacgacaagaagaagaaaagaagaacugagucaaauagcccccucaaggaaaaaccagaaugggaucucuguuaacuauucccaccuggccauucugcacaugccacaucuuuagcuaugagcugcuuuuuaacaaaaauauggagagaggguuuuagaaauguuugcaguuugaucugugcccaaaacagccaauaaauuugucaccagacuuaggggcauguuucuaaauacaaacucuaacuuuacagacauuguuguuuauagcuuguuccccucauugucuuugaaauauuucacaccuuaaucauggcaucaagaaacagccucuuuggagcuuaccuauccauggcuugaaucucauucuaauauuucuaauuccuguacgauauacauucuaaauauugugucaguuaagcauaugaguggagagaugcaccugguuuugaauucuggcucaagcauucucuagcugugugaucuuagacaaguuacuuaugucucuaagccuuggguuuguuuuuuggcuuaugauauucaaaguuuauauaauuaaaccucuaauaaaaggugaaaacaaaagaaaacauaugauagagagguuccugccaccauagccuagcaaccccagaguucugagaggcagccacagcuugacauuaugacagugaccacacagugacucccuuuugaucaggcucagcugcucaacugacauguaaaaccgaaauuggucccuggaagcaaaauuucucacaggcugagauguaaaauguaauuccucauaaaguugaauccuuguaacccagaugagcuauaucuaguaugacugcaguauuauaaaggaaggagagaggagugugcaagagaaaauuugagccucacuuugaaaugcguggaaugaggguaaauguaagaguugugagcuuaaaggagagggaccaugaagagcucagcauggugucugaagagggguugcuuagugauuuuuaucagcaaagcuguagcucuuugccagugaucuuuguuauagaauguucauuccuggagaaaacauuacccauagaggaaagcagcuaggacgccccucaacagccucccuuccaaaaugagauuuaaugccacuuguuagaggggaaugaacauguauauagcacaaugguuuggaagaggcugcaggggauuugagccgggaguccagaagugggucuuaucugcacauacucuaugugcuaacgcagacaggagcuaaagaggcagcacaagccaggaauucaaacucugauggaaguuucuuguucccuuggacagucacuacaucuaucacuggaccugacucacaaucagcccaagaccuacuguccccagugguuguagggaagguugggggacagcgccuucaucagugaaaaugucauccacaaccagugcuuaauccuucucuaggaaaacauggagccuuuaggguggcucuggcccacccaagagcaccauuguggcagcccacacuuugccauuuucccccauagugcaccccagcaccagucucacagaugucauuccacaggcuucuguaagcacuuccacguuugcuauuuuccauccauaccucuuaacacuugaaagccaccccuucacugggcccuucagccucuggacccuuagcaguagcucuagguccuccuagcuuauccagugagucucaaaccaucugugaauuccaguugugauacugguugguuuuuuuccaauuuacauaguccaauuauuuuguaaaauacaauaaaaauaaacucacaacuucccucccccaauaucuuauuuaacagacaaaaguauuucauccaacugcuauaaaguauuucuauucuggcucccuaaguucugagggcaaccugcaaaauucaguaugggagacugcucucaggaugagaugauggaaauccugauaccaacauaccccuaaccaggccaagaaugcccucaauacaauagagagggacgcaucaggucagaggggugccucaaaguuggcccaagaauggcgacugauuuguucacucaucauuucuaaaagcugaaagcaaaauaguugggaaaggggacauggggaaagaagaggaagguccaggagguaacgggacugguggugggagguuagagccugaacuggaagucuuuggaagugggucaauuuuuagagcgcuguuuccagagcaacccuuagaccauggccuuuagacuucccacugucgguuucuggccucuagagauuaagaacaaagaaugauguguguguguguguguguguguguguguguguguguguguguguguguguguuucugucuauacauuugggagacaugauugggaaauugggacacuuuggcaaaacuuaagccuuauaacucagucaucacugaggagccuggagccccauuggagcaaaugauuauucacagugcacacuguccucccaaacuucaacccagcccacuggcuucccacaaccugccuugcccauggggcucuuguccacagacauugacuucucugugacguaaaccugggaauucaauguccaagaauuuccuccauggaauauuuuucacucuuaagugguuucuacuucaauuuuugaaaccaacagagaaauguucuggcaaccuuauaaagcuugugcuuuauaaaauaucccuuuguguuuacguuugacuuggagugcauguuuuuaaauaguguguugcacaguuuuuugagguuuuguuuuuuaagucuaauccaggagaaacaaaaucggagcuuuggugagugaaaugguccuaccagagcuguuguuacuugggacugccaaaaagcuccaguuaaaucuuccugugggaaccacagccaggccugggugucccucggcuuucuccaguguugggacauauuucugguuguccaugucagaaaaaauuuuugagagggucucugucacccaggcuggagugcaguggcacaaucacagcucacaguagccucaaucuccccaggcucaggugauccuuccgccucaaccuccugaguagcuuggacugcaagcaagcacuauuacaccuggguaaauuuuauuuucuguagagacaagguuuugccauguugcccagguuggucuccaacucuugagcucaagaaagccccccaccucagcuuuucaaagugcugggauuacagguauaagucaccacaccaagccccauaaaacagccucaguuaagugaggucaggagaaccuacaaacccaaaucaaaucuguccaacuggaccucagcaauuugcuuuguuauauuuaucccagaucucuucacugagaagaggcuaaacauugauuuccuaugauuguuacucauccaagauggaugaguauaaagacagcaaguuguggaugagagaaaaugcauauaugaugaaucauucuccuccauccauugucaguugugccaauccaauuccagggcagugagcacauucuacacacuuucucuuguuccugugcucuggggucuggacuacuucaucuuuuagccaacuccauuuugcucuuguaagacacagaauccaagcccucauucaccugaaguucacugaguuuacccagugugugccuuuuuaagagaaaaaaagagaugagggucugcauucccaggcuggucuugaacucccagccucaagcaauccuccuggcuuagccuccugaguagcugggauuacaggagugagccaccacaccuggccagaugugcaucuuaaguguuuauauucaacccauccuccaaaccacaaagauuuaaggggacaggcugucuuccuuguacacaggcuugaugaggacagggugcuaaccaacuggaugucuggaaauaggagauaccuugcaggacacaagcaccaauuuccuucugcaaaugggaggugaaguccagaguuacagugaggcgacuucccuauggccacuugggaaagcacgagaugccucugcaggccccuggggcucuuucagucucuuagccugaaugauaugagcccaggaguaagcaugccuagaagagggcaggagggagaauaaagccugcuaugcugcuccccaggcaggagacggacaccccccagagggggcagagcucugcccugguccucggguucccuggggaagccuccucacccauggcccacugcccggaagguagacaccacccaagccacccagguccuucggaagaaaggaagcaacaccagaaggacuaaaagcaggaauuccuggagagggccucagggacaguccagauuuaggggcaagagagaacaugugaauuugaagaacugaaauaaguaaauacccagccggaauucugaaugcagggaauguagaguuggaggugugggguggguaggaguggggacuggggauggaggcagggccgguccuaaagggccauggcaaaaagcguaggcucucccugaagggcaguagcugugcugccggcaaguggcaucaucagcuggaaggguuuuuguggucuuguggaagagaggggcauaagugaacagucucccuucugucccaugucccagucacucaguuccccucacugcaggcccccaguguaggcuuccuguguaccugccaagagauauucucuccaugugcaaacauggaucuauauuuuguucccccuuuguacacacacaaaagcauaccaugcacgcuguucaucaugguguggcauuuuucuuuucucacuaaaucaguuuuggagaccauucuauauugacagcgacacaguguuccacgcuguggaugaacagaacuccuuuaaccagcucuuuacugauggacacucagguuuccuuuacccuauuacagacaaggcucugaugaauaaauuacgugugugucaugcaaggguucccacugugagaaggcgggauugcuggauuaaaggagauuguaucagccaggauucucugcaggaacagaaccagucucagggagguguggaagggagagggaggagggagggggagagauacucauuuuaaggaaagacucaaucgugagggcuggcgaguuugaaauuugugcaauaggcuggaaacucagccaggauuugauguuucagccuugagguagaacuucuuucagaaacgucaguucuuggucuuaaggccuuuaacugauuggaugaggcccaccuagguuaucaaggguaaucuccuuaaugccaaaugguuguggauguuaaucagaucuacaaaauaccuuuacagcaacaccaauuagugugugauuaaauaacgguauuauagccuagccaaguugacgcauguaacuaaccaucacaaguaucauugcucauccugcuaguuauugccaagucaucuucuauagauuuauacuuccagcagcaauggaugagagugcuuuauuuccuauacucucagcaauucauaaaccaaacuuuuguauauucuccuaucuaauaugugaaaaaaaugcuaucagcacccuuuuuauuuauuucucgagugagacugaguuugagcauuuuuauaugcuuaauagucuuuuauauuuuccuuugaacuggguguucauauauuugcccauuuuaucauugaguuguggguccuuuucuuauuuuuguagccgcucuuuguauauuguagaaauuggccuuuggucugugauauaaguuacaaauauuuuucccaguuggucuuuugucauaaagaacuuauuuuuauuuuuaugugguugaauuucuucaucuuuuauggcuucuggauuucaaaucauauuuuaaaaggccuuuuccacuuugagauagcuauauuuuccacuaguacuuucauggauucauuuuauauuuauauauauuugaaccauuuuuaguauaaaauacgagguuuggaaccaauuguauuucuaugcaaagguggguacccaguugugucuacacuauuaauauauuuuuccuccacugaucugauaugccaccccuuuaacaaagcaacuuccucuauguauuuagaucucucucugcacuuccuauuuuucuuuucaucaauacauuugucuauucauguacuagcacucccacuauuuuaauuauuaauuuuaaauuuugggauaaugucuaacagggaaauuuauauuuuggaaaagucacuccgacugcauuuugggaaauggauuagaggagagcgcaagugcaggagugaggaugccccaggggacagaugauccagacaguucacaagcucaaggguauggcagcagggacagagagaacuggacagaucugugagauucauaagauguagccucuccuauucaacauaguauuggagguucuggccaggacaaucaggaaagagaaacaaauaaagggcauuuaaauaggaagagaggaaaucaaacuaucccuguuuguagaugauaugauccuguaucuacaaaaccucauugucucagcccaaaagcuucuuaagcugauaagcaacuuuagcaaagucuugggauauaaaagucaaugugcaaaaaccacuagcauuccuauguaccaacaacagucaagaugagagccaaaucacagaugaacucccauucacaacugccagaaaaagaacaccuaggaauacagauaacuagggcggugaaagaucucuacaaggagaacuauaaaccacugcucaaagaaaucagagaugacacaaacaaaagcauuccauacucauagauaggaagaaucaauacugguaaaauggccauacugcccaaagcaauuuauagauucaauguuauucccauuaaacuaccauugacguucuucacagaacuauagaaaacuauuuuaaaacauauggaaccaaaauagccaagacaauccuaagcaaaagaacaaagcugaagacaucacauuacccaacuucaaacuauacuacagggauacaguaaccaaaacagcaugguacugguacaagaacugacacauagaccaauggaacagaacagagaacccagaaauaagaccacacaccuacaacaagcaauggagaaaggauucccuauucaauaaauggugcuaggauaacuggcuagccauaugcagauugaaacuggacgcuuuccuuauaccacauauaaaauuaacucuggauggauaaaagacuuaaauauaaaacccaaaacuauaaaaacccuggaagacaacauaggcaaugccauucaggacauaggcacaggcaaagauuucauggugaagaugccaaaagcaacugcaacaaaagcaaaaauugccaaaugggaucuaauuaaagaacuucugcacagcaaaagaaacuaucagaguaaacagacaaccuacagaaugggagaaaauuucugcaaauucugcaucugacaaaggucuaacauccagcaucuguaaggaacuuaaacaaauuuacaagaaaaaaaaaacauuaaaaagugggcaaaggacaugaacagacacuucucaaaagcagacauacuaugugaccaacaaacauaugaaaaaaagcucaacaucacggaucauuacagaaaugccaaucaaaaccacaaugagauaccgucucacaccagucagaaugguuauuaucaaaaagucaaaaaaaaacaaaugcuggugagguuguggagaaaaaggagugcuuauacacuguuaauggaguguaaauuaguucaaccauuguggaacacaguguggcaauuccucaaagaccuaaagaagaaauaccauucaacccagcaaucccauuacuggguauauccucaaagaaauauaaauuguucuaucauaaagacacauucacgugaaaguucauugcaacacuauucacaauaguaaagacauggaaucaaccuaaaugcccauuaaugauagacuggaaaaagaaaaaauaguacauauacaccauggaauacuaugcagccauaaaaaagaacaagaucaugucuuuugcaggaacauggagcuggaggauauuaaccuuagcaaacuaacacaggaacagaaaaccaaauaccacauguucucacuuauaaguggaagcuaaaucaugagaacacauggacacauagaagggaacaacacacacuggggccuaucggaggguggaggguaggaggagggagaggaucgggaaaaauaacuaauggguacuuggcuuaauaacuugauaaugaaauaaucuguucaacaaacccccaugacacacauuuaccuauguaacaaaccugcaccauguaccccuaaacuuaaaaguuaaaaaauacaacggacuuuggggacucaggggaaagggugggagggaggugagggauaaaagacugcaaguuaaauucagugugcacugcucggaugaugggugcaccaaaaucucacaaaucaccacuaaagaacuuacucauguaaccaaacaccaucuguuccccaaaaacccaggaaauaaaacauuuuaaaaauaagaaagccagauaucaacgagagaaaaaaaagacguagccucauugugcuugaugauggaucagacaugggcuguagaggagaaacuaaugaguccaggaugccucccaaagcgucuugcuuggccagcugaggugcuggggaagaauugggcuagggguagggacaugaaauuuguuauguuacauaacccaccuccucauccagacaaaauacuguuuugcuaagcugauacauuuguuguuagauuaucccccacuuugcagauggaaaaacugagacucagagauguuaagcaacuuguccaacaucacagaauuguuauggaaugaggcuccacgauaagacucaaauccaggucugucuacccuaaauauugcuaggagauggcaauggcugguugucuuaggcucuggagaccccauaugagcacacacaguaaggagacugugaugaaccuccaggccuucccuuuccaacaucuguugcagccugagacacgagguuacugguaggcagcagaauucugcaaaaugaccauccuauuuguuuaaauauagccccuaauugaaagagaagagccgacauggcugugguucucaaucugacuccauaugggagucaccuggggagcuuuaccaacuacugaugccuggaguccauccugagagacucugacuuaguuguucuagggcauggccugggcgugagguuauuaagcucccaggugauucuaaugggcagccaaaugggaaaacugcacaucaaaugaaacugcuucuccuagcuuacuggucuaugagguuaagugcaucugcagccuugguagaugaggguaaaaggcagcugcuuccacggacucauuacagaacuaagagcaagcaccugauccacccuguuccuugggugcccuaccuaugggaaucaucuaagccaggcagcauuagcagugggguuucagcacacucccagucacuucucaaauuucuuccccauuggcuucaauggugcuugcaaugccuaccgcaaagacucaauuuuguaagcuauguguacuuuaauuagguugaugaauuguucccugggauacugucaugccagacaccuaucaccuccaaucgggauggcaccaggcucgagaggcuaaagaagagacccagagccagcaaacgagacacggggcuuauugaggggaacuuacggagcagcccagugguggggacuggacaggagaaccaccacuuauaagagcaugcaguuuauacagcguucucacuuaacacccucccccuagcaaccaucaccuggcaaccuucguuuaacccaaaacaaagggccucaauacucuguaugacccacauuuuaugggacagggcaggaugggggcucagauaugccucacagauaaggaaugaguccccagguuggccacgcuggaacucuaaacacacauucaggugcgucugccauacagggugauucucagaaaaugcuuaaguuaucgcugucaggugugucugccgugcacaggugcaucuaccauacaguugcauagcauuaacagcugagugaucuauuaaccagaauucaucagccugauuauccagguaucugccaguauaguuucggguugucuguuaaugcagauuagguuacacuccauuaacagauacuccccaaaaccucaaugccuuaaaaccacaaagacuggccugcauguccaucacaggucaucagggacaucugcucuauauggcuuccucuggaauccagcuucuggcacaguugccaccuacuggaguacugauauuugccacagcagagggaaaaaaaggacaugccuuccacuagaagugaaaugugucacuuccgcucacacuucgucagccgaagccagucacauggccacaucuaacuucaguggagcugggaagcacaauccuacccugccaugaaggacucacagacagggcuggaccacagcacuaauaucucccacccggucaccgcaugcugccucccagcagagcacaaacgaauguucaagacggcuaaggucuugggguccccauccggccaaugucccuccccacuuuugaggaaugugagccuguuacaaagacaaacccuggucacuuuaccuggguuugcugcuucucuucaggaccucaaagucuggaggagcuuaaaguggcgucaucagacgaggucauguccuggguggcugggugaccuccuguuacgcucccagugugcugcaggaucacuagggucccagggccaggcccagccgcgcauucaucaaacucuccuucucuguuagcucccacccgacucugagcgggccaauuucuuucaucauccaccuccagcugggcugcaaccuguggaucacuccugguucaaagacucagaagcagggaaauguaaugcucugaaaggugcuuucacgcacagcggcucucgccuucaggggauguuugaggcugcucugacucagucucccauucaaaggcuggguucaguggagagcccgcaggaagcuaacaaaccggacugucugagggacugacucaaaaaaauaaaaagaaauagaugauagaguagcagaagugccugcagcggccucccgcccgcgaugugccaggagugaggcagcuucugc

SEQ ID NO: 17536 - RNA, 722 nt, Homo sapiens
cagcggccuccgacaccuucucccuggggggcgauccccaggcagcccgcagcguggaggaaggcgaccgauagaaacgcuuaguccuggugccaggcaggcgaccacggcccgagcacuggacgugacucgaugcaccucggucaccgcgcccgcuucccgcuuggccgcgcccgcgggcuccgcaaccccagcuccccgauuccccuucacgacucccacuaguaccgaagcagccucacccggcaauauccgagaccgcaguagggucuagaagcggcgauggguccgagggacugggcccugaagacgcgggcgcagccugacugacggcagcuagagcagcggcggcaacagcaccagcagcgcgcggcuccuccuggcgccggaacaggaagcgccgagcgcaccgccuccgcccguucucccccuccccucaggccgcgccgcgugcgccucccgcaggccccuggcgguacugcggcccgccaggccuagggggaugggcuccaccuggcgccggcuccgggccgcuuuccccuggugggcgggcuaaaagcucccagaguuuccggaguuccgaggacucggaggaaacgccaguggcugccgauguucacggcuucccggcggaaauugcuaacuugucuugaguugcuugagggcugauucuggauuccuuuugcucagcgguuuuuacagcuaggccucgaaggaggcug

SEQ ID NO: 17537 - RNA, 106517 nt, Homo sapiens
gaaaugauuagaauaaaaaguauggauacuuuuaaccagcccauguacaggaaauucuguugguguagaaacgguucugcuguucauuccuuaacugcuucuguucccacuuugucagauguagggcgagguggugguggugaguccuaauuuuuucuaucucuauccacagucuggaaucguuaggauuauuuuaagccuucauaacauuugcggacagcuuggaguguuuuguacauguaguggggcagugccuggccuccugugagagauugaucaucgguaaacaauccacacgaaacucacuugccaguggacggggaggaucgcugccauccuuucagcaaagagcaaacgaauaaggagagauccgggcccaucccuccucgcgcagcaguuucuagauuuuuaccccggcuucauaaauggcuaccagcuggcagucacaacacuuucauaauguuugcacacaacucauuugggucgcuuucuuuucuuuccuuuuuuuuuuuuuuuuuuugagagaaacggagagucuuacucucucgcccaggcuggagugcaguggcgagaucucggcucacugcaaccuccgccuccuagauuccugcgauucuccugucucagcuucccaaguagcuggggcuacaggcgugcgccacuaugcccagcuaauuuuuuguacuuuuuuuggcagagacggguuuuacuauauguuggccaggcuggucucgaacuccugaccucaggugauccgccugccuuggccucccaaaguacugggguuacaggcgugaaccaccgcgcccgaccauuauuugggucgcuuucuaauuucuuucuccguuuguagcuagcguugcccgaaggagauuucagagagauccccuggagaaagggacgggggaugucguuuuccaguaauuucugggggaaaucugggauagucaggggguaaaucuagugccguuugcugaaguuaaaaggcguggggagccagguggugcccuggagggagggccgcgcgagacgagaccaaccuucgggacaggggagagcggggcuacugaacgcaggggauuccgcugagccuccagccccugagcguccaccuucggcccagcugggggacgcggucucgggaagaaagcccggaaucccgagccggccagccgcgagcagcgaguaccggagcgcgugggcaggcgcgcggaggcagaggcgggccggcggcugucccuuuaaggggccggucucccggcgccgccggcccagacgccaggacgugccggguccgccccgccccgccccgaagccgcccguuuccugccgagcggcgcgacggcaccugagcgacugcggcggcggcggcggcggcggcggcgccucggagcgggcggcccgggcuguagugccggcgccgccgcgucuucccggucuccuuucccggccgcacagggugagggagagcaggccgcaccgggacgggcgccggcggcggggagcgcggggggaggcggcgccggccgcgggguccuggggcaggcgggagggccgcgccgggcgggggggcgcggccgcggggcccggacgccgcccgcuggguaggccucgggcauccgguugccgccgcggggcucuuguuggggccgggacgccgcagggggcgggcucggagggaccuccucggccucgcggggccgcucugggcccgaccccggcucugucgcggcacccggggcgcggccgagggacaccccccacccuccccaaggacgacucucccgaaggcgaggucgacccgagcgggcccuggggugaccgaggcaccuauuuuuagccaagccugagggcccccgggagggaaggcggauuaccgccuccucggccgguggacggaggcagcgcgucuccggcggcguccccgggccggagcugggccacacuuacgccaugcuggaguuccaguccucgccgcugccuccggcggucugggcgcucgcccccuuccccggcgccccucccgcugcccuuugcgaguccccaggucagggcgggaggcgguugggcacggaaagcagcaugaggggggacuuuggaaaaauccauggaccacucucgacaccggcgaaguuaucccuuccuguccccgagggguguguccuagcgauucggccugaccccuucaguuuccaaaagugagauuuuuggccuuggggaccucgccggaaaacuacgcgggaagucuagagaagucgucuggcucucagccauacgucuggugugggaugugcagccccgcaugcuggcggugaaggcgcugggugcacuagaugugggcagccccggacgcgggcagcggcgucccagccggccccaguugcaccuugacuagguuagguugaaaguaagcuguucaguguuggcccuucuuuccugugggaggaaggaggaaucuaaauucagaacuguguuggcaaacggauuccuuagccgcuauuuaaguuaguagugcuuaaagagcuacgguugaaguuaacuguuaaggugugugugugugugugagugugugugugugaugacuuuguggaaagccuugaguaaagagcuacgguugaaguuaacuguuaaggugugugugugugugaugacuuuguggaaagccuugagaaauguagacacucauggccagcccagcuaaagauaagcaucuucggugaacuaaagguucugaauuguauaggaguugacuuaaaguuagaauuuuugcuaaauuagguugcauuuguuuuccuuagcuuaccuagcaggcuaauggcaacagugucuccaguuugguccgaagcaauugcuggugagacuugggauaaugaucccaagcuggugagacuugggauaaugaucccaagaauaacacuaaauuacucuugaguauuuuggguagacaugccuugcaguagacuuucauauuugaugugcugccugauaaaaaaggcucuuuuuuuuuuuccuuuuuccuuuuuuuuuaguuuaaggaucuaaccugaaauagcugggucuguucaugaguuucccucccaccccaacauugaguuucaaaugucucuucuaauuuuguagccuucaucagacauaacaauaccuuaucaagugagcuuagagaauaagguguucuacuugauuuacuugaggcugauaaugaauuugaaaauauaacaagaucuauugaaaaauuuucuuaauacuugaaaauuauaaagaauaucaaguauuuaacucuuaaugauucagcgucagcauuaugaagagacauuuacgauuuuguuuccaauuuagaucuuucuguauucuuuuaauaccaguagucucuucuguuugauguuguguuugucccuaaaaaugccucacuucagucucccuucuaguuuauaggcuuuaaucugcuuuugguagggagaucguuuuaauaauuauauuuuuaauaucagucaauauggcuuuuuaaaagagccuaagacgugaaaaccuuuuugagacuucuaaagaacccauauuaagauugucacuguucuuaaguucuuaacuugaauguuaaguuaugguuaaaaguucuuaaucagccugucaugguuaagaugacacguagaauacugaaucauaauuguuuuuuuaaaaguugaaugugucuuauacauuuccuauguguaaguuaauuucuuaacuugaauggaacauguguuuuuaauuguaugccuauaauuuuuauagcaaaugaaguuuuaaccugaaagaucuccaauacuuuguuaaaauauuaaauuguuaaugaacuuaagugguucuaggaagguuuugguucucuugggaaucugaccuaauauguaauaaggaaaugagaaaaaucgugcuuugcaagaucguucauauauuugagaauacaccuuaugaccugcuuguucucuguacuguuuuuagugacuuugaagguaaauccagaguauacuuagaggauacaagcaaguaacuauuucucuagaagugacauuggugaucacucaugcucaaagagaauugcauuucauugcuuccucuuucaguuccugugaacaugacuuugucccaaucaaaaaauguaauuuauuuucaaaucacugggaaaauauuggucuagaugagaauauaagccuuuuucccuccucuauaaauagaaaauuaaacauuaaggggaagaaccuuaugugcugugaacuaagggguuuaauuuaaccuucuguaucugaggucuagagaaagagaaauaaugacaguuuacaacugugugccgagcuguugugcuuaaauguguuuuugacagagguggcagugaaaacuaggcuauuuuucuuuuuuaaaaaaugguacaagcuuuuaauugguuuuauguaaaagaaaauaggcaagauauacuuuuaauucuaacaauaguuuuaguagauacucugauaggaaauauaauauuccucggaaauguagaagacauacccuaaaaaaaguuaugauuuaguauuuuacgaaucguccuagcuacuacagggagauuaagaacucuuccguaacuuaaaucugguuucagcaaagugauuuguacacuaaauguaauuuguuugcacucuucuuccaggacauucugcuuuuugggcuuucuccuuccuaauugcuuuguucauucuaucuuacaucuucuacucuuaaacuugacaugcucaguccuuguuucacuuuucuuuuuauauuccucugacaaucuuauccagugucaugguuuuaaauaccuauaugcugauggcucccauauuuauaucuccaacccagacuuuccacaugugcuguuaggccuauccacuuggaugugcaguagucaacuccaacuaaauuuccguauuuuuccucaaacauguuugauguuugauguuuccaucaaacauucagguaaaaaaacguuggagucaucccugacuuauuucuuucacacuuggcauucugugcucugucuuaucuugaaaauauaaccagaauccaaucaguacuuacugcuuccacugcucaccagccuggugcaagccauucuuaucucuuaccuagauuucugcaauuagccuccuaacugaucucccugccucugcccuaacucccugcagucuuuccaacacaacaacuggaucauauuacuuaucuucucagaaugcuacagugacuuucucuaugcacagugaaagcugaaguucuuauguccuuaaggccaugcagaaucuggacacuuccacucuccucauucccccuuaccucuaagguuagcuacuaucaucccucugcuuacuucucucuggcuccaaugguuuuccuaagggcagcuacauaucagacacugcccuaaacgcuuaggcuccaucaauaaacaaaacagacgaaaagcucugcccugauagaaguuguguaauaguguauguuugagggcaaggggaagagauaauaaacacaaucaaugaggaaauuauauacuguuuacuucuccuggcaagaaggugacaagugccauggaggaaacagagcuguuuuuuacacuggcuguuacccuguagauacaugcauggcuuguugucuccguccagucuuugcuuuuuaaaugucaguuucuuaaaaagaugugccuauuuuauuuaaaacugcacuccccuacgucugauucuuguaccuugcuccguuuucuuuauagcauuugucaccuucugucauacuauauaauuuccugguuguguuuauugucucuuccacauaacccucaaacacaguauuacauagcuucuaugaggguaggcuuuuugucuguuuuauugaugacucuuuaagaguucagagcagugucuagcacauagcagguccucaauaagaauuuguugaacacaauaauuaaauccuggcugggugugaugacccacaucuguaaugccagcacuuugggaggccaagguguguggauugcuugagcccagcaguuugggaccagccugggcaacguggcaaaaccccaucuuuaaaaagaauauaaaaauagccaggcaugguagcgugugccuguggucccggcuucuugggaggcugaggugggaggauugcuugagccagggagguggagguugcagugagcugagauggugcgacugcacuccagccugggugacagagugagacugugucucaaaaaaaaaaaaaaaaaaaaaaaaaucucacauuccuuccuuugauggauaacucauuauuggauacauguaguuuucaguuugcuccuuuccucuuucagggauggucagagaguggaagaaaguggcauggagccuuugggagcugcuugguggaaggaaugauguuagagugugguggagacccucuuacauacuccacaugauuaggaccauuuguuaguuaauucaaaaaguugguuaaagcaaggaaucaaaauauaugugcaccuuaaauguuuucacuuaaaauauuugauuuuacuuuuauuugccuuuuuauuuuuacugauuucuuuucuuaaaauaaagguuauccugauuuuccuuucauagauuguacucuaaaagcauuaucuaugauuucuaguauugguuucuuuaaaguggaaugaaaagauaggcacugggaaacucuccaaguacaaaaucuuuauagauuuuuccaguuauucaucaaggccuuccaaaggauuuaaugucauuuuuauagaaauaacaccuuuugacucuauuuucauguuugauagauauauagaaauaagugaguaggagaguaauugcuagccagaaacagcuuucugaagacaccagcccauguauuuuuacaaaggaggagaaugucaguuaauccagugagagauccuguaagacagcuuccacuuugaauagguuccauaggggccguaggaucauagcagccuauaauuacuagaagagaauguuauuuacccuuauuucuuuauuuugacucugaguaacaucuacaauuaguuuucagaacuuaugugaauucaaguaaguguacauugucuaucaggagacaugauguuacacugcauuuucgcuggaaaaugugggacaauuauuauucuuaugcaugagucauugaguuguuaaggaaacaaucuggucugguauaauaagcuggaagucacuaguuaggagaccuacaggucuuagaccuuauuaacucuaagguuuuaugcaaguucuuuauuguccaguucuuuaauuacauaauguucugugggguaguggaaacagcuugggcacuagggagccugaagaccuugggcuugaauuuaguuuugcuagucaguaccacuuacugcaugugugaucuuaaccuauauuaaccugccuaaggcucauuaaggaauuaucuuaccucaguaguugccucauaagugauagcuaacauuggaguacauauuugcugucaaacucuaaaugcuuuaggugcauuaucauaucauaucauauuuaaucuucucaacaaccuuaugagguagguacuauuuggugaaaacuagggagacaaauaauuuguucaaagacacaaauaucuuuaggaggagccugaauuuuaacugaggcauucugacuuagagcccauucuuacccguugagcuguuuuauaagaaugcuuucugaagaaaacaaaacgcuguccaugugcagcugucuaauguuaggcauuacaaagcuaaauuaagguuauaaggaucccccucccccccauaggaauuagaagauuaauucuuaaaacuagugauuuaaauuuaaagacuugaaguuuuucaaguggagaaaacaguaaaagcuacuuaaaccacaugcuauaaaauguuuuaguuauauggaaagcaguagauagaaugucguccuuuuguuuccaagaaacuuuucuguuucauuuccugcauauguucauuauaaguuacucuugugugaucuuauagacauuucuuaaugguuaccucgaaaacgccaacucugacccuaccuaaaaaugcauacccucccuauucuuugucacagccuuauuuuuauucauugcauuaucagucacaaccugauguuauaauacgcuuauuucuuucuugguaucugccucaccuacaagaauauaaauaaugugaggcagggacugucuuguucaucgcugugaacuauaugucugacaccuagcuagugcucaauuugaaugaauggauggucugaugcuugaaaaugauugggacucauugagucuuuugcuuuacuugccauccuuuauuagcauggcuaacugagugguauuugguaugccauauaaagugaaacucuaagaauaaggguuuuagguuuacucuugggagaguggaauggaaaacaauuugaaacaugaauuucagcaaaaugggugugcuuagucccaguuaaucuuguucaucaguaauguaaguguucugaguggaaucuguacauaaauaauuuagugaaugcuuguguuuagaucuaauuaccuuuugaaauaaauuuggacaagcuaagcugugcacugaaaacucccuaguguucugaaugcuauguugcagaacguugaagauguugccuuaaaucuguaauauccacacagguugaauucacuuacgugccaccaaccuguacuugccuacuuuauugggaagucauguucauuugaaauguuuccguaauuacuuuacguaguuuucauaaucugggucucuugagguuggcugaaugucaugauuucuguaaagggaauuccucaagcuuguauuuagugcucuuauuucuggguacaguuucaggugcugugcuggauaaucuuugugcuugguacucuauugcuggagaaucauuucuuaaauagcuuccaguuugacuagauguuugcuguaauuuuaaguuuaaauugaauccuuuuguaaaaguggcuuaauucuuucacucuuuuuuuucuuuuagucuaaauaauuggauuuaguuuuaacuugaaguauuucugagcuugaaaauucuggagcacuuuucaaguaaaaaauacagcugaccuuuggacaaugugggaauuaggggcacuagcacccuguacagucagaaauguuuguauaacuuuugacucuccagaaacuuaacuacuaguacccuacuuuugacuggaaaccuuaccaauuacauaaauagucaauuaacauguauauuguacguuauauguauuauauacuguauucuuauaauaaagcuaaagaaaagaaaaugcuacuaagaaaaucauaagagacuguguauuuacaauacuguacuguuuauugauaccauaaguuuauaucaucuguaagaugaaucaucugucugaaacagugagcaacuguaacugcagaccucagucuaaguacauaucaaguaauucaacuuuuccuugucaugacuuuucucugcuucucgggagcacuuccagcauuacuaguggcacuuggcaugggucucaugguguuauucaggguuuacaguguugugcuaaaaaugaugaaaaauaugcgagaacuaugaucacuuuuuacugugauacuguuacuggaaggacagaaugcucauguggagauaauuagagucauggauaggagucagggauacuucagacacuugagcucacaguaauaccaacaggagguggccacaaaauuauuacagugguacaguauguacugcaguuaauuuuaugcaguugugauuugguacuguaucuugaccuuuguuuacauuuccaucuauugcaaauggcaccauguacaguaaccauauagggucugguuuguguaaguuuugauaaauuuuaacuuuauuauuuguguauauuuuaugguaguaaauuaugaaauagacugggaucuacauauauuuuaugcauucaugacauuuuucuuaauuuuuuucaauauuucuaggcugugguuucccugugaguuuuuuucauauuguugcagucuccaaaaaauuuuccaauauaguuaccgaaaaaaaaaucugcaugaaguggacccacacaguuuaaacccauaguguucaaaggucaguuauacauucaagauuagccuuggaauuauacauaaaauacagccgaggcauuuaccuugucugagguuuuggggagaaaagaaguaauucauaaauauaaguuaguuguaaagugaugaaagccgaauuuuugucugcucuuuuaggauuaauuaccuggcauaaauugguaguuauauuucauauccuuucaguguuauguaaccuucauuuaagcagaaaguccuggcagcauucaaaauaacauacuacuuuugguauaaagagauucuuuuuuuugaaacggcgucucgcucugucacccaggcuggagugcagugguacaaucuuggcucacugcaaccucugacucacugcaaccucugccuccugggcucaagcgauucuacugccuccugaguagcugggauuacaggcaccugccaccaaaucucgcuaauauuuguauuuuuaguagagaugggguuucaucuuguuggccaagcuggucucgaacuccugaaaucaagugauccaccugccuuagccucccaaagugcugagauuacaggcaugagccaccaugcugggccagagauucuuuaauuauuauucuugguuacuauauucaucugauuucuuuuuuuuuuuuuuuuuuuugagauggagugucucucugucgcccaggcuggagugcaguggcacgaucucugcucacugcaaccuccgccucccagguucaagugauucuccugccucaaccucuugaguagcugggacuacaggcaugcaucaccacgcccagcuaauuuuuguauuuuuaguagaaacgggguuucaccauguuggccaggauggucucgaucucuugaccuugugaucugcccaccucagccuccuaaagugcugggauuacaggugugagccacugcacccagccuuauuuaucugauuucuuaagguagcuuuguaauaaguaaaaacaaaacaaaacaaaaaaaaccacacauacaaaccuagauauuuucuguaaacauuuuuaauagauuucuuauuuuaaaggacuuuucuuuuuggggaaaauuucuuccaaaguaggaauaacuuucuacaauuauucagugcuuuuauuguaauuguauaaguuaagaagcagggaagcuuaugccuguuugcuuguuuguuuugauuuacauuuaucucuuccuacuugucuuuuuauuguuuuauugaaaguugaaaccacuauuaaaugauucagacauauaagaauguauaauguauauguacaguuuaaagauuaaauauaaaaugaacaucuguguacugaacaccuguguaccuuucucucagcuuuaaauuuuuucuuuuaaaauaaaauacguaugagauaauauuuuaagaguacguguaagauauaaagacauaaugaacagccuuguaucuaauacccaguuugagaacauaauccuuuuuauuucuuuaugucccuucccacacucuaaccacuaccuuucuuaccuuugcuuuucuuuuaguuuugccagaucuaguuguaucccuauuuuguuguuuuguugguuuuugaacucuaaauggaauccuucuguaugaguuuauuuguaacuuccuguuuccccucaaccuuguuaucaggauauucuuuuuuuuuuuuuugagauggagucucgcucuguugcccaggcuggagugcaguggcgcgaucuuggcugacugcaaccgcugccuccuagguucaagcgauuuuccugcaucagccucuugaguagcugggauuacaggcaugcaccaccacguccagcuaauuuuuauauuuuuaguagagacgggguuucaccauguuggcaaggcuggucucgaucuccugaccuugugauccacccgccuuggccucccaaagugcugggauuacaggcaugagccaccaugcccggcccaggauauucuuucaccauguuguauguagcucuaacucauuuggcuacuucauguaugaauauuuuacaaccuguuuccuguuggacauuggguuucuagguauuuuuguuguuaguauacacagugcugcuaugaacaccuugaauagcauaggucuauuuguugcacuugugucucuaggauaguguuuuuuuucaaacuuuuuguuaccacucacaauaagaaacacauuuuaaauuaugacucaguauauuaucagguauacuauuccaugcuguucuguuucauuaaaacuaaaaacgcuagucaagaccuaaguuuuaugcuaaucgcuagugaguugagacuagaguguagauaguuuuggggcuuaugacuagcuagaaauagaauugcuggauuguaggagacaagacauuuucaacuuuacuaguuaguguaaauuguuuucuuuccaauauaaaugugccaguuuauuccugucaccaguguauaugugugauggcuccacauucuucccuauacaugauaauggcaaaaaccaguuagccuauugugugugaauugauacauuguaugucuugcauuucuuucuuucucucuuucuuuuuuuuuuuuuuuuuuuuuuuugagacggaauuuugcucuugucgcccaggcuggagugcaaugaugcgaucucugcucacugcaaccucugccucccagguucaagcgauucuccugccucagcugggauuacaggcaugcaccaccacaccuggcuaauuuuguauuuuuaguagagauaggguuucuccauguugcucaggcuggucucggacucccgaccucaggugauccgcccgccucggccacccaaaaugcugugauuacaggcgugagccacugcaccuggccuugcauuucugauuaaugagagaaaacauauuuucagaguuugcugggcacuaguuuccuuuucucugaaaugacuguucauuuuucuguuggguuuaucuuuuuggguggcaagauuucuucauauguucugaauacuaauuauuugccaauuauguguuauaaaugucuuccuacuuuguggcuugucuucugacuuucuuauggugucucuauuaaaaguuaaaaauuuuaauguaguugaauuuaucaguguuuuccuuuuauaauuuguacuuugugucuaguuuaagaaauucuucucuaccucacgguuaugaagauguucuugcauguugucuuaaaaaguuuuauguugucucacaguucuuucccuggaauugauuuuuguuucuuccccuuuaugcuguuuucuuuuuuccaagauuuccacugcuuaccauuucaguuuuuaagggcuaaaauguguuuauuuauagaugcuuugaaauaauacuuugacaguauggaguuguuucgaggauugcaucuacaacuuacuuuuagagucauaagaaaauaauugcaguugacccuugaacaacauggguuugaacugcacggguccacuuauacauggagcaggauggugaaaccugaguagaugggcuaugggacuugacuaugggagauuuugguguaccuguguguguccuuaaaccaauuuuuggcgcauacugagggaugacuguauguaggaguguuuugaaaaagaaacuuuggauaguuauucaauaaacuuugaagucccuccuccagucccuauuugacauccuaaguguuuuguaaauauuucacagugaugccaguguuugcaugugguuuucuuaaauuguuuugcacauauauugugaaguagaucuuugugcuugguauuuugaauauguauggacaaacuucuauguauacagcuuguacuuagaguauacuuacaguaugaggaaucaaaucuuuaauuuugaaaaauucucaccucuuuaaauauugcuucuuuuauuuucacuuuucucuuuugcuagaccugucuuggaggcuaaguuuaucccguguuuuuaauuguucuaucauuuuuuucucuuuucugugcuucauacuaggugaauucauuacugucuagcaauuuaccauuuuauuuuucuauuuugucuagaguguauuguaucuguugagucuauaugccaguaucuauaauuuucauauuuuaaauuuggaauugcuuuuucauaaucaccuguuucaauucucuuuguuuggcaacccuuuugcuacuuagaaaaccucuaucuccuucuuuaacauguucaaauuuaaaaaucuuugucagaccauuucauaaaacaucuggugugaauucguguuuuuauaugauuguuuuuucucauuaaauuucuugcuauguuuuggauuaaaaaaacugguuuuaauguuggacagacucauuauuuugacaacucuugcauucaaaucaaaacucugaaauuuaaucuuauuuuugaauuuacuaauugaucagaaauagacaccccccccccaaaaaaaaaaaaagaaaacuuguuaaacacugugaggguacuaucaacaaaauucacacugggaaacgcgcuaggacuagcugcuugguuuuuuuucccuucccaacuaaaaguucuaagaauuguaagaaacugaaaaauaaagagauagguauaguacgugaaaggagacaagaaauauaccagucaaggaauaacaaaauacuugcaaagcacuuggggaacgugaacgaacacuagcuuugcauuaaggaauuacuaauuuuuaauuugcuaugacauuggauguuuuguugucuuuuuuuuuucuccaggcuuggagcuucuguaaaguuauagcucuggauuugcagugucauuguuuuucuccccucuccuccccucucuuuuuuuaccuuuuuauuuuuuugaaaccucucuuuuuacaagcugugcaaaucuugaccccuuggugucaggcgaugaaccuuguucuguuuuguugcuguuaccuuuaggaacugaacuauccagccaucuuccugguuccuucuucccucuacugcacuuaagauauggguuacuguuuugaauuuuuauugcauuucucacccaguacgauguuuaucuuaguuuugaguuuagccauaucuuuuaaauuuccuuuuauauucgugcaaaagguuggugcaaaaguaauauuucacacuauuacuaaguauuuggaggaggauccuuauuggaagucguuaucuucauuucuaccuaucuuaggcuuacuuguuuuuugaaucccagcuuauguauccugaguaguauucacaguguauccugagugcucuaguucagugaucuguucccuuccuuugcacaaaucuuuuaaucuuguugaauauuauucagcucuacagaacacaucugauauuagcaucacacuaauuuaugauuauauaauaauuaguuagacucuuuaagcauugaaaugugauucuugcuuuugcugcuugaucucacucauccuguguuucuucguucuguuuuggaguugcuguucccacucaagcagaguagaguuuuuuuuuuuuuuuuuucauuuuugaguuuggacugguauccauuguugugugaaauauuuuugcuuguugucuccaacuugaaaaucaaauauccaauguuuugaauucauucuugaaaacccugcugcuaauuuaaaagcuauuaaaugaaagccuauuuccauuaauuuuaguagggaauuaugaugcgguauuucaucccaaacaguuuucacacguagguaaauauuaaucuaacaaugaagacaaauuuguguagguauaaacaaguugaaaguaaauacacuuuauacauaaaauauaauguaguauaaugaaggcuaauuguauuugccaaaggagaaagaagauuugauaguggaugguaguguaguugguagagugucacuuuuugggaagucuguuucuucuguacuguguuuuuucaccaauucaagcuuucuggaguucagaguuaccuugcauucagucugcacuuaaguugucugcacagaaaagcaccacuagggcaauaacaaacacaaguuguucacaacacgggaaauagaacacaugcagaaaagacggaguuguaggagcuggaagcucauugacuuucuugcucugcauauguacacgaagcauaucuagguucauccaguguacuguauguacaguauagaucuguuccauaugauuuacgcugaugggaaauaauuacguugaauaaaacauugagucugaaaucauaaauguugaaauuucacucuauagaauauuuugugugugcuuagguaaacagucacuaauaccaaaaaaggucauugcuugaaaagugguaauuuucaagagccauuuugaugaaaaccaguuaaaugaacagcucauuaugugguuaagucuguaguagacuuaguaaugugguguuccagcuuaucugaacuaguugucagaauuucugcuauucuaaccagguaacucagaguaacacaggauaauacaaaucuuacguucugaaaccuuuaauugguuugcccuuuguucucauccucauauucaacacauuuguaaacuggcaagauuaucuuuaauugauuaaaauguuaguaaggucaggcuuaguuuuuugguacauuguuaagauacuuucuaaaccauuaauugucaacuuugggauauuauuguuuaaccuuuuaaauauucuucaauuuaugccaguauucagccauguucaggauuuaucaaucuugucuccaaggauagcuuguuuacuuuauugacuguucugacaaaaucagacauuccauaauguguauuggguuuuccugauuuaguaacccuuuuauuuaaaaagguaucggagugauuuuuuuuaauagugacugguuuggcggcugggcgcgguggcucacgccuguaaucccaauacuuugggaggccgaggugggcggaucaugaggucaggagaucaagaccauccuggcuaacauggugaaaccccgucucuaccaaaaauacaaaaaaauuagcugggugugguggcaggcgccuguagucccagcuacucaggaggcugaagcaggagaauggugugaaccugggaggcggagcuuacagugagcugagaucgugccacugcacuccagcaugggcgacagagcaagacucaauagcaaaaaaaaaaaaaaaaaaaguaaaaauaaaauaaauaaaugguuuauaguggauggcuuuugaugugccuauauuuuuuaguaacauugucuggauuuaccuaaaauaaauucaucaauuuuaauuugacuacuuucuauuuuuaguacaugauauuuaauagcuuuuacuuuuuucccccuaacucuuaggcauuuucuaauagugaggaaagcagaagccuuucauggaacuugaaauguaggaucauggcagcugugucuguugaaggcaacaucugucuuugcauggcuguugaggugauuguguuguaaacauggauucuaaggaugaccauaggauaggagccucuacuuguggcuauauuuuagguucugauaacugaucaucuuucauccucuuaccucauauuucuguugucuggaaggcagucuuugcaaucacaaauuuugaagguucauggugugcuguguuuuaauuauguuaauuacauaauugacauacuuaaaccaacuuucaguuggugaaaucacaaggacuacuuuuucuuggcguuagcucccuaagguucuuaguaagaucgggucucucacuaauuuuuugcuuagguuuccuauuauugcgagugaugucaaaagaauagaaccuuuuuuuuuuuuugacaaaguuuuuuuugccacuguagacuuaaacuuuguuaauauaucaaagcuacacuuauuuccaauucaagguaauuauaucuguacuuuuugauguuuuuucugucauagacucuuuuugcagcuucaagaauagaacguuauggugaaguccauaucaugauaaaacauccuugauuuuguguuucagaguaccagugaacacaaauaggauuaguauauacuguauauaugaaggauuauuuugaaaaaaaaaauccaaagggaagaacucacaaggaccaccuauauaaaguuauuuauguucagagaaguaaauauuugacaacauugugcguuggacucuguguugggcucccagauagaugggagaacauguauuugaaaaggggaguuacucauuuggcuuacacuuuuugaguaguauaagcuaaacuuuguguaauaagugaguaaaagucuucagggaauguuuucuuaagccauaguucuuaagguacaauuucagagaaugauaaacacauaagauugugaauguauuaaagcaaaugccucuuaauuucagugaaucagaaugaacauuucuuaaguuuaucggauucuucauuuguacuuguuuuuagauuguguguaagauuuugcuguuuauucacaauuuugcuguuugcguagaugucgaaucucuuugcuguuucuuaaauagcaaugauaggaauuucccuguggaauaugaacauuaaaauugaaauguagaagggcuggcauggugguucauaccuguaaucccagcacuuugggaggccgaggcgggcagaucacuugaggucaggaguuugagaacagccuggccgacauggugaaaccccaucucuacuaaaaauacaaaaauuaacaaggcaugguggcgggcaccuguaaucucagcuacuugggaggcugaggccagagaaucauuugagcccgggagggggaggaugcagugagcugagaucgugccacugcauuccagucuaggcgacagucagacccuaucucaaaaaaaaaaaguagaaauguagguuguaggaauguagaaauuaaaauguagacuacagaauagauuguaagguuuagaaaaaaaaauucaggcuuucaccauuuaauugguguacuuaacuaucugugaaaauuuguccuaauuucauauggcuuuguauacggaagcuuggaguaauugaggggccagagagggaaaacucuuugcuagcacucuucuuugugcauuccugaaaaguuuauuagagaaaagcaaaggucagcuguaaucccuagugaaauaauaagaauauugcuuucucggcagggcgcgguggcucacgccuguaaucccagcacuuugggaggccgaagcgggcggaucacgaggucaggagauugagaccauccuggcuaacauggugaaaccccgucucuacuaaauauacaaaaaauuagccgggcguguuggcgggcgccuguagucccagcuacucuggaggcagaggcaggagaauggcgggagcccaggaggcggagcuugcagugagccgagaacccgccacugcacuccagccucggcgacagagcgagacuccaucucaaaaaaaaaaaaaaaaagaauauugguuccucaaucagucauacucugguuggaaagagguacuguucauuaaaaaaaaaaauuacauucuggauuaguaaauuucauauaaagucugaauuaauuuuuacuaauuauuuacuaauguugaucaguuuuguuuguugcagagcugacagacuuauugcuucuaaaaacuaauauuccaguguucagcagggucuagaauucuguggcaauuaauggucauuguuucuauggagauuuuauuacauuauucuuuggcuucuauugcuaaguacuauguaagucuaaauuuuucgguacucuuuucuguauugguuucaagacuuguuugaguuacacaacguuacaacaaauguuuaaauaucuuuuauucuguucaaauuuuguugccuuuccugaauuggaagauccauagcuuucaacaguuuuugaaaauucucagccacuguguuucuuuguucuuuccucuccuugaauucccauuggauuuauuggacauucucauguauccuuuaugucuguuaauuuuucuuucauauuuucccuuauguauaauuuuuugugguacauugucaguuuuuuaaucgucugucuuguuugauaauucaacuuuauauaguuaucaggccauuuagcuuuuaauugcuggguguuuguaugucuguguacauauguauguacacauaauuuauaaaauucaaguucuaauuuuucuguuuuuuuaugaguguuuucuguguuucugauuucuuuuauaacucucauggcugaaauuuuuguuuuaauagucuuucacauucuguuaucaguuuuuugggaucuacucccuguuuguaugugcuacucuuguuuauuuugacuggaaguucaccucuggcaggaguauaucugcaaauacuauacuguacggacuagauuggacagagguaguuuuuuuccagagagauuuuuccuucccaagaguuuuuccugagucccagggcuuuuguggccauugagccauuuuuuuuuucuuuuuuuugagacagagucucguucuguugcccagggcggagugcaguggcgcaaucuuggcucacugccaaccucugccgcacagaagcacagauucaaagcgauucuccugccucagccuccggaguagcugggauuaacaggcucccgccaccacgcucggcuaauuuuuuguaguuuuaguagagacgggguuucgccauguuggccaggugguucucggaacuccugaccucaggugauccgugagccauuuuuaugucaauauuugugguaggaagggggcaguagggggaauuggcagaaacuguagaugagaauuuaagguuguacaaucuuaauggagacuucuggccuuuggaaaagcaaacaagcuuucucuugugucuuuuucucuuuugugucaauacuacuuauuaaaucuauuuuuuuaacuuagugauuugaaauggcacugugauaauauaccaaacuuuuuguguguauaugggcuauuuugccuuuaauuggguguucuuggacaagaauuaaaaauucuuauuuacauaagcaaaacuuuuucaguagucauuuuugauaguauuugauguucuaauuuacauuucauguucaguuugugagauguuuuagguauuaugucucuucuggggauaagcaagaauauccccagaagagacauaauaccuaaaacaucugaucauuuuaguacuuccauuguugagugaccuaaggugauacaccuaagaguuauuuuauuaauauuuuauuaauuaacccauuauguucaacuuuaauacccuagcuaaacuuuuccaaaggaugauaaauuuuugugaaugauaaauuuugaaguaaguuuuucuauuugcugcuaaauuuaauuucauuaaguuuaagcaucaguuauuaagacuacccugugguagugggauuggacagauuuguuaugguuaggguagagcuaggaccacugggagaaguuauaggaugaugugauuuuggaucaaaacuaaaaagaacuugucuuuccaaagaauaaaagggguuuaugggagguauucaucccugcuuuucaaacauaggcuggcugccuguugagcugggucuaaucucugaguggcuaguuggauuagauggcccuuucuuacucagaaaucuuaugaaaggaaaagcaggucaagaugguagauuuuaaggggaggaaagcuucuguacaugguguagcuguuuuacgguaugaauuucauguuguaguguuaauuuuugaacaguuuugaugacauguucuuuugucuucaaaaacugauuuuaugugauuugaaaacugauuugaaagacuauuuuaaaaaguuauuacuuuuuugguauuaaagcuuucaguuugucuaauuauaaauuagauuuuuuuuuuuaccgaauaaacuuuuaaccagauuauuucccauggaaguguuuuuaaaugagcagugccuuuuccugagaaaaugggcugguuugggcaugaugaguaagcaaaagucuaaaagauacuuucagcagcuaugaccucugcaauuccuuuucaguuucuugggaaagcuguucaaauggauugaucuauucucauauuaaagggaaaaaaguuugauuaaaaaauagaagucucauuuguugugacaugauaccuaauggagaaauuaaauuucauuacucauuucuggcauuaguuguauucauuucacauuggguuagcaguacuuuagaauggauauugcugaaguaagugguguguuaauaagaugugagucauagaaauaacuguguugcaguuuaaaaggagaaauuguaccauagcuuugaaauuuuaguguggucuauaaaguuaaucuuagaaaagauacuguaaaugggauucccauguuggggaauuccaauguuuggauuuccuggauuguuuugucuuuugcuugcuuugaauguuuuuccucuuauuuuaaaagauaauuguauaauugcguugugcacuccggggccauuauacuuuugguguagugacugaguaggacaauaggaauuuagaugaguuuuugcguuuugauggccguuucaggaaaugguuaaugcuuugucuauuuuucucauugaauuuuuuguuuuuucaaaaugauuuguagagucauuuauuuuuaaaaauucuuacugcaaauggaauauacuuacaaacauuuaaacauauagaacuauguaaaaugagccuauuuucuuguguuuugaagugcuuuauauuuuuucuuuuuuucagguagauuuucguuccgucacccaggcuggagugcaguggugugaccuuggcuugcugcaacccuuugccuccuggguucaagugauucucauugccucagccuccuaaguagcugggauuacaggugcgugccaccgcacccagcuaaguuuuguauuucgguagagacaggguuuuaucauguuggccaggcuggucuuaaacuccugccucaagugauccacccgcuguggccucugaaggugcugggaguacaggugugagccaccacgcccggcccucaagugcuuuauauuuuuucuuauguuugaaacuuuauuuggauguuuuuaguugauuugaaugauacagccuucuacugauuagaaauaacuuagagcaaacuaaauuuuuguauguauuuagauuuguuuuagauuuugaguucaauuuuauuuucuuuaucacacugcaguauguugcugccuugcuauauuaguugaaaccauuuacugucucauagaauuauaugcaugucuguguaaauagagaauaagugcucuggaacuuuaggaggagaacuagcuguagacaugguacuugagcuggaagaguagaaccauauggaggcucaaguuaggauuuuugcucuaguuagguuuguagauacuauauacuuccuuucgcagugagauuauaaauucauuuaaagucggcaaauuuauuugugaacacugucaaauacccugcauucaaaaacuucaguggaagauuaaagugagugcaacuuacaaagaaugaaaacuacagcaauaauuaaaauguguuuuauaagaccuucaacacugucuuuuuuuuuuuuuugagagagggucucccucugucgcccauguuagagugcagaggugaaaucauggcuuacuauagccuugagcuucugugcucaagcgaucuuucugccuuauucuuccaagcagcugggacuacaggugcaugccaccacgucuagcuaauuuuuuauuguuuguagagacaggguucugcuauguugcccaggauggucuugaacucugggcucaagcaguccuuucuccuuggccucccagagugcuaggauuacaggcaugagccaccgugccuggccaccaucuuuuuuccacuuauucucugcuuaugacuuugcuucucauuucguaaagagaauaguagcauuaggaacagaauuuucacaaaugucuauaccgucuaccuccuuuccuguccugggucugugcuuuuauauucuuccuuuauguuucuacagaugaacuggcugugcuaccaucuaaggccagucacucuaucuacuuguccaaauucugucuuuucuugcuauuugaaaacauugccucucacuccugcaucauuguucuuucccuuuuuacuggaucauuuuuuuuuuugucagcauauuaucaugcuguaauuucucccaucuuuaaaaaccaaacuguuaaccucauauucuccuccaaguuccaucuuauuucucugcauccuuucauaggaaagcugcuucaaagaguuguccacacuugcuagaguucuucuaacuuuuaaauucauuucaaucagguuuugaucaccacuacucuacugcuuuggucaaagucaccaguaacgucuguguugcuaaauucagaagucaauuacuaguuuucauuguauuuuacuuaccaaccccauuugacaaaauugguccgucucuccuccuuaauagacuuuauucaucuggcguccgggacagcaaacuccuaguuuucuuuauagcucuccucagucucccuugagaguucuucauuuuccuguuguugaauuucagugcuucagucuugagaccuggucucuauuuauacccauuuguuugggauuuuauccaaguuuauggcuuuaaauauaguccauuugcugaauacuuccaaauuuauaucuccagccuucacuugucaugugacaacucuuauuuagcugucuccuggacaucuccacuuaccuaaaaccuaacuccuuaucuccagccuuaaccaugucccugccacuuuuccccuaucucaguaaagggcagcuccuuuguuuuuggccuagucuaaaagcuuuggaauugccuuuggcuuuguuuauucucucguaccccacauccaguccaucaacaaaucaucuuggcucuaccuuuauaaaguaucaaaaauuugaccaucucaccugcuaccaucaucucuaaauuauuucaguugucaccuaacaguucucccugauuucacuuucucccuacacccuucccuagucagaccccuccaguaguuuucccauauuacugagaguguuagccacaauccuuuuccuguaagaaacuacaugaauuguuaaccacauccccucucccuuucaaauucucuuugaccucaucaguuuauccuuuuguucauucuacccgaaccacguuguccuuacugcucuugcucauauauagcagguauguuacugucucaugaucuuugugcuugcucuucccucauucacuguauuuugcucuucacuuagauauggauagcaccauggcucuaucuuuaacuuacuucaggucuuuauugagaugucauuuuuuaaaaaugagauaaucucugaucauucuacucuaaauuuuaaccauuaggaguuugagaccagccugggcaacauggcaaaacccugucucuauauuaaauaauuaaaaaaaauuaaauaaaauuuaaugacuguccacaucuuccugugcucccuauuucucuucccuccuuaucacuauucuugcuacuuguuacccuuucauauacugcauacuaauuguuggucugucuuaccacuuaguagaauguuagcucugugagugcaggguuuguggcccuuuuacugcuguuuacucagaauguccuagagcaguccugacauauggucagugcuaaauaacaaaugaauaauaaagacuauuguggaagagaguugaaauuacauauucauagguuugauuuaagcuggguuuugaaggauagguggagauuucauacaaaggacauggcaaagauuuuuagauuugauugcagggauaaggugaagugcuuuaaauggaacuuuagaagguguuuccuuugguugccugauuuagaauccauaguagccucuuacugcugauuuuucccacuugguugacugcugaucuuuucuagcuggucgucccauauuuucuucaaaaucugaucuagaacucccagauaggaaccuauuccuauauucuuaaucuugucaagggguuuccucauuuauggaaccuuccaggcaugacauguuggaauugucuuauuaguguccucacucacuuucagauaguugcguuuucuuauuaguuguuccacccaaguauuucuguguugaaauugauuuauugucauuagaucuacuuaaacuacugaaagucauuuuaauuggucuccuugcaacuauuuuuaaccuauccauuugguuuuauuuauuuaguuaguuauuugagacggaguauugcucugucgcccaggcuggagugcaguuggagaucuaauucuuuagcucguuucugcugccucuuguucaugauggcuuaucacguguucuguuauuuugcguugugggcuuauaucuggauaauaauuuuuaaaaaccuuaaggagccuggcuuggggaaggaguccaccaaagagguuaugcauuuguuucugccacggguacucugggcaccaccagcugggggccacuuaaauuuuuuggcugacauauccaagaucaugcaaguaguuugggcccuaaagccaugugagaagaaacucauggauaaaaauuuuuaaguaagacucugagugaaggccaaauugggacuaaaagccaagacucuugccuuccauuuuacugccucauuauauugcuauucacuaaucuuaaaauaauuuacuuuugcucaggauauaucugcaauauaacacgcauacuguauuugaagguuaucaacuacaugauggcuaauauuuacuuuuagcaggaggaguucauuguaucuaaaccuuuugcagaauggaaaucuaauuaaaugauacuuggcuaccaauaguaaacuuuuuaucacuguagaguacuuaccauaaaucauuuuucuuaaaaaaagauuaacuugucuguuuaaaaaaaaauaagauaguaauguggguuuaaagaaagguaaacaugguaugaagaguguggcacguuuggaaugccaaguauuuagauucagugugaucagauuacagauaguuuuuuuuguuguuuuuuguuuuuuuuaaccuaugaacauuauuuuuacaaauaaccuauaauaauagcuuucagcuuaggccucacagcuacuucuguaauauuuuaacuguauucaaauaaugaaauaaagcucuuauaggcuacucuggaagccuguauaucuuaaagguguauucauuuaguuguccagacauugauuuauacuggaauuuuuaugaaauuaugcauuccuguguugaaaauuaccuuucccucaacuuacuguuuuuguuuuuuucaaaugugucugcuugcuuaguauguuuugugguggaaaaagauuuucacuguguucagauuucagucuugaauuuugauuuguuaaguuuuugcuaaugguuuuuuugagccaccccagcugauaaaauugugucaguugaaggacagaaauauugauaaaauuaguuuuuuugugucauuuguuuucauuguuuuuaaugugaagaaaaggauagcagaagcaagagcaacugaaacacuauaguaaaaaauauaauucaaaauuguuguauuacuugaaauuuaauaguauacuuaucaaacugccucaguuuuuucucauaauguuaacaauucuuauguuuauguauuuaagcuuuuaaaaguuuaguacugugcauucaguuugguuacuuaaauuauuguuucaaugugcaauuuuaaaaguugaacaauuaaccaaacaguaaaauguuuguaauaaucucccuucaaaaaauguaaugauucucauuuuuuagguaucaucuaugaguguauauaauacucaacacaaaacuuuuagucuuucugcuguguaauguauuuugcugcauuacaaucuuaauuauuuuaaaugguugugugaugugucuucacaugucccacacugaaacaguuucauuguuuuauuauauagacaguguggugugucuuguauauacauaaauauauuauccuuuuugguuaagcagcucuauugaaauucuaauaauugccgccagauuuuuauaucacuuaaaauuuuagguuucacuucuuuguuauauuaauauaaauugggucauugugccuucugagaaguuuguaaaauuuaacucagugaugugucucagguuuuguaugaacaaauguaaguuauaggagagcgaguaaauagaauuuuaaaacuauuugauuaguauuuguaauacguacucugacgaaacacgacuuacauauuaugcguguuaacuuauuauaauuuuuuuuuaguucuuuuaagauagggcaggaaugaaaacucucaauauagagcaggauuuuaaaccuggggcccgugcauauucuucagggaauccagaaaccuggagauuauauguaaaacuuagugaguguggauacuuuuuuucuuugagaaagcgggucaguaucuuuaucaguuucuugaaagauuuauguccgagugaaagauaaaagacaaugguguggaaugugguuuuaaaauaguuuggacuugcuuuccuauuguuccauggauauuucucuccugguucucuugacagagaaauccuauuugccaccacuggcuguuuauugcauucagauuggaaucuauuaugacuuaugugugaugagguuaaagagguaacuaauauuagaaaggguaagccaggcuaggugguacaugccuguaguguaguuccagccacuugggaggcugaagugggaagaccucuggaguuugaugcugcaaugcgcuaucauagggauugugaauagccaaugugguccagccugagcaguguauauauagagaccccauuucuuaaauguguaaaaauacuacacauuuuuugugaaaacucggguugugaguuagcaaaaaucaccaguguuauuucuuccaugugugaaagaacaacaugagcgucuacaugucuccauguuuuucaacucaacaaacauguauugaauuguauacuguggacuuagaaaauuuuaaugaccugguucuuauuacccagagcuaaauuaacuuugucucaaccucuuuacuuuuauuuuucaguuuugccucccugcuuuuaaaacuuugucuuuguucuucccugaauuuuccuguuucauucucaguuccuuuuugucuccucuuuuuuccuccucauguaauucugaugcucauggguaaaaugugaauuugagguauauuuauugguauuguaguauuuauucaauaaacacucauguuuugccuuuuuaaaauaauauuuuaugaauuuaucauaaacaaaguuuaaaacuagaguauuaaggcaaaugagacuguccccaugauucuggcacaacuccuuaguacugaacuugcauacauaaaauguuuugaucauauaauuacauaugauuuugacuuuuuagcagcauugaauugaauuuaacaaaguuuuaguguucaugguuuuaauaccuauacuuugaguugauauuugcugauugaaaucauucugauuuugaauguuuuauuucuuaguuuuuauguaauauugcugugaacuuuuuuuuuuuuuuuuugagacagagucucgcccuguugcccaggcuggagugcaguggcgcgaucucagcuuacugucacugcaaccucugccuccuggguucaagugauucuuuugcaucagccuccugaguagcugggauuacaggcgcguaccaccacgcccggcugauuuuugaauuuuuaguagagacgggguuucaccauguugaucagacugcucucgaauuccugaccucaagugauccgccugccucggccucccaaagugcugggauuacaggcaugagccaccaugcccagccugugaacaucuuucuauauguuuuuuucuugcaaauaaauuccuagggauaaagaauugggauuguuggguuaaaggaaugcaaacauuuucuucuuuuuuauucuucuaaaaaaaaaaaaacaggauacauguggagaacgugcagguuuauuacauagguauaugugugucauggugguuugcugcaccuacugacccauccuguacguucccuccucucagcccccacccgcaacaggcccugguguguguuguuccccucucuguguccauauguucucaguguuccacuccgacuuaugagugagaacaugugguguuugguguucuguuccugugguaguuugcugaggaugauggcuuccaccuucauccaugucccugccgaggacaugaucucauuccuuuuuauggcugcagcaaacauuuucuugauucuucaucucuuggugucuaguuagguuccucuaaaugcauagugagacucaggugagcucaagugaaggugaauugaauugugugaagagagacucccgugaaaauccagagacagaaagcuugauuccuucacgccuauauaugggaccugggaaaggaaacuagaaaaucauuaaaacauuugaagaaucaguguuucagaauucuuguggucucauacccucucuucuugaacauuugcuacuuuuucuuucuauacaggugaauuugcugugcuugaucauaauuucugcuuuccuaaaaccuagguuuguacagggcugcagcuuauucauuaggccuuuuugacuuuuaccccuuuuuucagcuucuauuacugcugcuaagugccuuagcgucucuucuucaccaaagcaaaaacucgaagcauuccaacucauuguuuuguguuuuuucucccucgacugcccagcuuuuguugaauaggcuguguauucuauggaugcuauguuuaaaaaaaaauucugggcucuuuuaaagcauuccugguugacgaaucacacuuaauggaggcacagugaaaugugucuaauuuuaaaaccuggauaguucauguuaauuugaauuaucagggaaacaauucuguauggaguuucuuuuaguauuuuguuagcacaugauuccuuuucccccuuaacuuguuaaaaccuugucuuaguaaaucuaggguauaacuaauacuauuaaaaaauugcuuauggaaguaugaaauguuacuucagucauauagauuaauagcaugccuguugaacaaacgacagucauuccuugguauaugcaggagauuggcuucaggaccccuguguauaccuaaaucuaagcaugcuggaaguccuggaguacuguggaaccugaguauacaaaguugacccuccauauacuuggguuucacguccagcaaauacguauuuucaguaacaauugguuaaaaaaaaaauucauguguaaguguaccugugcaguucaaacccguguuguuacaguucuggcaaagucuuauauucaauaaacucacauuuauccaauuuaaaaucagguauuuucuuagguguaaaauaauucuuagaauaaguuacccguuuagguagaauuugguuucuuuaucuaaucaugacauaucaagacucuccaaauugauaauuuaaaaacuuaaaaaauucucagauuuauuuuuacauuaaaaguguagcaauuaacuuuaauuugcuuuauccuaaacauguccugauguuuaauuauaucuguauuauauaccuugucuuuuucuacaacacauuugagaugaauaagaauacaagucacuuuuauguggcuuaugcauguuuguaaggagcaucaauaucuagaaucucaacaucagaaucauuuauacuuugagauuuaauuuuagcagaaacuacccuucacguaagugauauguauauucaaggcagauguugguagucaaauuacaucgccacccgcccccuucccgccccgggcguacuuacugaguccaucuaaaaguagggcugauguucuguugaugaggcaaagccuuuuauuuagcaauuucgguaggauguugauggcagccucgcuuuugcuguauaacuuguuuugugcaguauggggugccuuuaaaaaacugagauaaguuccuaacuuguaauuuauuucacuauuuuauuuuuuugagacagagacuugcucuguugcccaggcuuggagugcaguggcagagucacaggucacugaagccucgacuucaaaggcucaggugauccucucaccucagccugcaaguagcugggacuacaggcucacuuaacuacgcccagcuaauuuucuugucuuuuuuuuuuuuuuuuuuuguaaaggcaggguuucgccauguugcccaggguagacuggaacuccuaggcucaagugauccgucugccucagccuccuaaaguggugggauucaggcaugagccacugcgcuuggucuguaauuuauuuuaaugcaaaaugccacauccuaacauuucaauuuuaauuuuauuagauuuuuauauccuugauagaucccacugcaucaugaggcugauagucacugguguaaagaugcaagcaguuggugacuggucuuaaucuguaaauaaaccaccucuuuuugcgugugugugcauuucagaauaugacacuuuuaaugaauguccauugaguugguaauaguaccuccuuauuuucacguguaguaguuaucaacacuguacaauaaacaaaaaaguuaacuacuaauaaaguaccaaaaguggauauuucgggaaaagaaaguaaugaauauuuaaauuuuuucucuucaauuaggauauuuucacaugauuuagaaauggaaggauguuuucuacuccuucuaguuaccacuugucuuauuuuucauaguauauaugaauuguaguuggcaaauaaaucaagaaugugauuuaaagaacuaaccuguuuagauuuguaggucagguuagauuugaaaugccacuugaaagagcagcaguuuugacuuuaauuuuuaugagacugacagguucuuuuuuuuuuuuuguccccaccuucuucccuauuuagguuuuauaggaucacauugacaaaaguaccauggaguuuuaugagucagcauauuuuauuguucuuauuccuucaauaguuauuacaguaauuuuccucuucuucuggcuuuucaugaaagaaacauuauaugaugaaguucuugcaaaacagaaaagagaacaaaagcuuauuccuaccaaaacagauaaaaagaaagcagaaaagaaaaagaauaaaaagaaagaaauccagaauggaaaccuccaugaauccgacucugagaguguaccucgagacuuuaaauuaucagaugcuuuggcaguagaagaugaucaaguugcaccuguuccauugaaugucguugaaacuucaaguaguguuagggaaagaaaaaagaaggaaaagaaacaaaagccugugcuugaagagcaggucaucaaagaaagugacgcaucaaagauuccuggcaaaaaaguagaaccugucccaguuacuaaacagcccaccccucccucugaagcagcugccucgaagaagaaaccagggcagaagaagucuaaaaauggaagcgguauuguaaucuauuuaaucuauuuaauuuuauuguaugauuuggagcuuggaauugagauauucuguuagguacauacacagaauguuuaauauugaauuugaaaccaugauuauucauuucauuauguguuugcuucauuaacauuaauugcugguagaaauuaguauugaucauaaaauagcacuuuaaacuucagggccugaugcaguggcucaugccuguaauccuagcacauugggaggcugaagugggaggaccccuugagcccagguguuugagaccagccugggcaacaaagugagaccucaucucuacaagaaauuaaaagaaaaaaaaaaaaccccauacaucuuauaaauauccaacuuuggcuauuuuacuuaaaaccacuuaggaccuguaaauaucagcaguuacgaacuuucuaaaugauaugguaagaauuaaaggugaaaagcuaaaaucagauaucauuucucacccuugauugcuucauuuugcuaacauuuaucauauaucuguuuuaugcuaggcauuaugcuagguauuagggcuacagagaugaauagugcguuuucgagguagucgugugcuagcuguagacacagauaggucauuaugaaagauuuaguguaauggucuagauaugucuaaaccaguguaggaauucuaagguagaccacuuaaagcaaguaaugccagaaauuuuuaaaguuugguuaaguacuaguuagguuuuuuggguggauggggaggggagggagauuccagggaaaggggguugauagguacaauggaaaagccuugaaaauuggcguggcgaugugugaaacuguaaacaguuuguuuuauuugaaaggacuuguauguaccauuaagucauuugugugucuuaacuuguaggagguuauauuugauuuuuuuuuuuuuuuuuuugagaugggagucucacacucucacccaggcuggagugcaguggugcgaucuuggcucaguguguccucugcugcccaaguucaagugauucuccugccucagccucccgaguagcuggaauuauaggcguguauuuuuaguagagaugggguuucacaauauuggccagaguggucucgaacuccugaccucaaaugauccgccugccuuggccucacaaagugcugaaauuacaggcgugagccaccacgcuugacccgguuguauuggauuuuaaauauuugcaugucagcuaggaucaaggcauaguaagaacuacauguuuuaguuggggaaaaggacacguaagccaguaaaaaaaaugugguuuauguaggagauagagaaaguauagaggaaauauagaagcuaaagcaacuacugcuuaugcugggcugaaaggcuuuacaggggaggcaguuccugagcauugaaucgcuucaucaagcagauaguggggucucauuacucauuggcagaauaucauguaaaggcacagagcugcaagaguacaguguauuauugagccauacaacgugagguauagagagugguagggaacagagcugaaaagauagcaguggcuagaucauggugguuuuuggauacugugccagggagcuaggacuucuuagguuagccauuguugaagauuuucaagcaguuuaguuacauggucauauuucuguuuuagaaagauuuuuuuggcagagcuagcaagaacagauuucauggggcaguauuugaugccggcagacuaguuaagagguuauuuuaguuuucuaaaauuaagauguaggccugaacuaugguagugacagaagaaacaaaguugagaaguaugcaaaguaagaaugacacgaauaaccucacuauauagagguguggcagauaaaggagaagauaggauuaaagcugaucucccaaguucugaguuagguugggguuggcaaacugcaaccugugagccgcauguagcccacuuccuuuuuuuaugcccaugaaccaagaacacuuuuugcauuuuaaaugguugggaaauagaauaauauuuugagaaauguaaaaauguaaaaaaaagucaaaaucucaguacucauaaaguguuuuuauaugcagcuacauucauucacucauucauaauauguuuaugacuggcuuucaugcugcaguggcagacuugaauaguuguaccagagaccauauguccuauaaggucuaaaguuuuuacuacguggcccuuugcagaaaaaguuugccaacuugugcuuggcagaugguugguagcacuaaaauagguaauacuggagagagacuagaugugaauugagaagagaacacuuccaguuuguguuuccaaugccuguggggccaucuacguagagcaacucaggaugcaguaggguauguaaauguagaaaaguagauucagaagccuuaagcgugaagguaguagaaggcaugggaguagauagcucauccaagggaaguauuuuaauugaagccccaacccugagaacaagcaguauucaguagaagcaguucccaaaggauaccgcaaaggaauauuucaaguguaagaagagaauuaucaugggaacugauaggagauaauuuauuuuauuuauuuuuauuguggcaaauuacagcaugaaauuuacuauuuuaacaacuuuuaaguguguaguuuuguggugguaaguacauucacauucuuauauaaucaucaccacuagccaaguccagaacucuuucaucuuuuccaaaugaaacucuguacgcauuauacacuaauuccccauucugccugccucccccuuuucccccgucccucccccuucccccauaucuugacaauuacccuucuacuuucugucuuuaugaauuugacuacucugggaaugucauauaagugaaauuauacgauauuuaucuuuuugucacugccauauuuuacuuagcauaauggagaggagauaauuuuaagaaagggguagagaccaaaaguauaaaaugccaaagaguagucaaauaaggaguaaugaguauuuguagaauauggcauuugggacacugggggaucugaguuaauccuuucguggaaugaaagagauaaaaaucagguugcaauuagcugaggaaugauugguagaaaaggaacuaagaguauuuugucaauauguaaggaaauggaugugggaugcugggaauuauggugauggggaaggguuuucucuuccuucccuucccuuccuucuuuuccuuccuuuccuucccuucccuuccuucuuuuccuuccuuuccuucccuuucuuucuuccuuuucuucuuucuuucucucuuucucucucucuuuucuuucuucuuucuuuccuuuuucuuucgacagggucuugcucuguugcugaggcucgagugaauggugugaucuuggcucacugcaccuucgaccuccggggcucaagcuauccucccaccucagccccagaguagcuggaacuacaggugugcgccaccacaccuggcuaauuuuuuuuauuuuuuucguagagauggaguuuuguagagaugagguuucaccacuuugcccagguuggucuggaacuccuggguucaagugauacuccuggguucaagugauccaccugccucagccucccaaagugcugggauuacaggugugagcagcugcaccuugcuguuuauuuuuuaagaugauagagacuugaucaugccuauaggcucaguaggguugaaaauagcugaggaaugggaaaggaggaguaaguacauugaagagcugguguaguggaguaagaaagcuagaaaaaguuauuggugagagcguuauaugucagacuuuaaauuuuuagugguaaaacauucugggaauuacucagugauugcaucuuuuccguuauguucauuguuugccacaauuauuuuuuuuguuuguguuuaauaaagaugaccaggauaaaaagguggaaacucucaugguaccaucaaaaaggcaagaagcauugccccuccaccaagagacuaaacaagaaaguggaucagggaagaagaaagcuucaucaaagaaacaaaagacagaaaauggugagauguuuagauauguauuuuuauaaugcuaauucuagagaaguacaccagcacaaggacccuggaaucucacacgcucuuuagcucccaguuuaaugugugcuaaugacaacuguaauacuaaugcaggucuaaaauuaucuuuagccuuaugacuuuauagcgcuuugacagaugggcaggguguacauuugagaugaaaaaguuuauauaccauuuacaaagggcaaagcauuuauaaauauucuuaacucaguuuugaaaaaauaaauagcauacagaccauagaagaaaaacauucuugaaauuuugugcuuuuuaauaucacuuaaagguaaugcuuaaggacauuagcuagaucuggcauuagcuuacauuuccaauuaauuccuaaacagaacucacauguguauauggcaagcaucagauuauaagagauggagcaaucuuauuuguucacaguuuuccagggaaagcuuggcugugaaauuugugaagacuaaacaacuuaaaauuaugacauaucaauuagguaugagagaaauauuaccugaauauauuuguuaaaauuaaauguuaaacaauuuuaaauaaaagaagagacauauauaaguaaagaagcucuuuuugaaagguaggaaugaaaagaaaagagauuuucaucuggguguggaaguuuguaucucuaaccagcagacauuaggcuugauguucaaacucuucaaauucuucccauuaaaauuaggaacaaaauaaagaggcuuccuucuuccacuuuuaauguauuuuggaaguuuuagcaaguguagaugugccauggaaauuagaggcauaacucuucagaaaugagaagcuaucugcaaggagcacugugguuuuugcacuuagcaaguacaaagaacuuguuuaaaaauuaucaacuacaguaaguugguaaaguaccaacauaaauaaaaacuaauaguuuuccuugagcacuaauuaaguggaaauaauucuuauauuaaaacaaaaauuaaaggagacuuaaggaugcauaaaaaguuuuuagauaccauuagaggagauaugcuauacacuuuuagaugauuuaaaugauuuacuauaaaauaagacuguugagcugguacggcuucauuagaaugaguguuuugacuuguuaaaugacgaaauaggaauuuaaaaccaauuugagcuaccaguaaauguuucaaaagaacugcauuuaucauuaaauuaugcuugcaugucauuuacucuguuuuguaaaaauucuaauuaugauuuuguugaacuuaaauugcagucuucguagaugaaccccuuauucaugcaacuacuuauauuccuuugauggauaaugcugacucaaguccugugguagauaagagagagguuauugauuugcuuaaaccugaccaaguagaagggauccagaaaucugggacuaaaaaacugaagaccgaaacugacaaagguaauauaugggauuuauagucuuuguuguacuauaaaaacacauuucugaguucugauggagucauagauuucauuuucucauagaaacaaugcauuucaaaagaaucaaauccuugugguagaagacuuauugguagucuuuuaguccagccuccucaguuuuguagaucuggaacuugaauuugacuuuuuaaagguccuacagcuauuuugcuaucugaugauuauuucccagcuacuacugucuccugugagguuucuuggcuaauucauaacuguuguuuuuuuuuaauagacuguuuuuuuuagaguaguuuuagguucacagcaaaauucauuggaaaguucagaguucccacauauccccuguuuccacauaaguacacaacuaccuuuuaaaacuuauaauuuagcugaaguauuaaaagcccgaggcuccuuugagucugauggguggcagcucuuuuuaagaagagguuguuaaugccuaauacgagaaccuugggaaaauaagggugggugggucaggaggugcuugaugcauggauuuuuaaaaugucaggaugguuugcauauauuugaucuucauagaaucagauuuccuuuuuacaauuaucuuagaacuuauuuucucauguguggaauuuggcuuaauaucucucaggauuauuuuguuuuucacaguugguugucagugugcaaggauuauuaaaguucauugagauuauugugaauauaauagugcagauauuagcacauacuagacaccuaagugauuuuuuuuuaaagugaggguauauuggcauuuuaguauuuugcaguuugagcaaacuuuuagcuaauguaauuauuccguauuauagaugauaaacccuuuuuuuccucuugacuggaguauuuguuuuauuuaaccugaaguauauaucuguuuucuuucgguuauugacuuucugggccgugaauucuucaugcuuaccuuugcugaaguuauuauuuguguuuuuuaaaugccaacucuuuguuuguuuguuuuuuucaaauuaagaaaaugcugaagugaaguuuaaagauuuucuucuguccuugaagacuaugauguuuucugaagaugaggcucuuuguguuguagacuugcuaaaggagaagucugguguaauacaagaugcuuuaaagaagguaagcguguuuuuugauuaugggcauauucaugaccagucauuagaaguucaccaaacaagacuuuagccagagcaauuaauaucuacucccauccuuaacaucucagaacauacaucuggaaugccuucagaaauuacuuuauauaucguauuagucuguuuucaugccgcugauaaagagauacccgagacuggguaauuuauaaagaaaaagaguuuaaauggcucacaguucuacguggcuggggaggccucacaaucauaguggaaggugaaaggcacgucuuauaugguggcagggaagagggaaugagaaucaagcgaaagggguuuccucuuauaaaaccaucagaccuuguaaggcuuauuuacuaccacaagaauaauaugggggaaauugcccccaugauucaauuaugucccaccaggucccucccacaacacaugggaauuaugggagcuacaauucaggaugagauuuggguggggacacagccaaaccauaacauuccacuccagacccucccaaaucucauguccucacauuucaaaaccaaucaugcccuccuacuggucccccaaagucuuaacuaauuucaucauuaauucaaaaguccacaguccaaagucucauccgagacaaggcaagucccuuccgccuaugagccuguaaaaucagaagcaacuuaguuaccuccuagauacagugguaggcauuggguaaauacagccacuccaaaugggagaaauuggccaaaauaaaagggcuacaggccccauacaaaucugaaauccaguggggcagucaaaucuuaaagcuccaauaugaucuccuuugacuccaugucucacauccacgucaugcuguuucaagagguggauucccauggucuugggcagcuccgccccuguggcuuuacaggguacagccuccuuucuggcugcuuucaugggcuggcguugagggucuguggcuuuuccaggcucacaguacaagcugucaguggcucuaccauucugggaucuggaggaugguggcccucuucucacagcuccacugggcagugcuucaguggggacuuaguguguagguuucaaccucacauuucccuuccucacuacccuagcagagguucuccaugagggccccaccccuguggcaaacuucugccuggacauccagguguuuccauacauccucugaaaucuaggcagagguuucccaaaacucaaaucuugacuucugugcacccacagguucaacacuacguugaagcugcuaaggcuuggggcuuguacccucugaagccauggcccaugcuguaccuugguuucuuuuauccaugccuagaguggcuggguugcaggacaccaagucccuaggcuacauacagcaggggggcccugggcccugcucaggaaaccauuuuuucuuccuaggucuccagcccaugauaggagggcccuucugcaaaggucuuugacaugcucuggagacauuuucuccauuguuuuggugauuuacauuugguuccucauuacuuaugcaaauuucugcagcuggcuugaauuucuccucagaaagugggauuuucuuuucuauggcaucaucaggcugcaaauuuuccaaacuuuauucucuguuucccucuuaaaacugaaugcuguuaauagcacccaggucaccucuugaaugcuuugcugcuuagaaauuucuuccgccagagacccuaaaucaucucccucaagucucccucagaucucuaggacaggugcauaaugccaccagucucuuugcuaaaacauagcaagagucgccuuuacuccauuucccaacauguuccucaucuccaucugagaugaccucauccuggauuucauugcugguaucaucaucagcauuuuggucaaagcuauucagcaagucucuaggaaguucuaaacuuucccacaucuuccugucuucuucugagcccuccaaacuguuccagcucugccuguuacccaguuguaaagucacauccacauuuucggguaucuuuacagcaguuccucacuccugguaccaauuuaguguauuagucuauuuucacguugcugauaaagacauaccugagacugguaauuuauaaagaaaaagggguuuaauggacucacaguuucauguggcuggccucacaaucaugguagaaggugaaaggcaugucuuacauggcagcagggaagagggaaugagaaccaaaugaaagggauuuucccuuuuaaaacccucagaucuugugagacuuauucacgaccaggaaaacaguaugggggaaacugccuucaugauucaauuaucucccaccgagccucucccacggcacgugggaauuauaggagcuacaauucaagaugagauuuggguggguacacagccaaaccauaucauauauucacacuaaucaauucacuuauuuaaaaugucaucuguugucaucugauccuuugacagagccaauugcuuaaaauaaguaagaugauuuauauuacuuuuuuuuuuuuuuuuuuuugagacagagucuugcucuguugcccaggcuggagugcaguggcgugaucucggcucacugcaaccucugccuccuggguugaagugauucugcugccucagcuuccagaguagcugggauuacaggcaugcaccaccaugccuggcuaauuuuuguauuuuuaguagagaugggguuucaccguguuagccaggauggucucgaucuccugaccucaugauccgccugccucggccucccaaagugcugggauuacaggugugagccaccgugcccggccagauuuauauuacuuuuaaagucauuuggcccuuggcuaaacuguaccgugcuuugcucugacuagaagugcuaaagucaaagucaggugauuucuggauagcauguaugaacgguuuuugugacugaagaucacaccguucaaagaaccucaggacuauuguugugggggggauguguguguuguguuuguaauaguacucuucuaaaagaaaugauuugaauggcauaaucacugcuauggcugauguuuuaaaaaaauuguaaaauaaaaaccccaugcagccaacaucuauauucuuaugggucauauucacuauaauaucauauguacuaugucauacugggaaaggugacaaauuuucaaggguuaccuauguaaaauaaagugauauguugucugcuauucaauauuagauggugcauuuaacugucuuuauucuaaaaacacacacaugcacaccuuuccccauaaccucuugccuacuuucaaaccuucagugguuuaauuuuuucuuauacuagucuagaccaugaccuuucaccugauuaccuacaguagucuccagauugauguuucugcuuuuccucuuaguccucuaauuuuguuuuuuucccacauaacuguaaagugaccuuuaagagauaaauuguuauauuacugcuuuaaaaacccuuugguguuuuucucuuuuguaguuaaaacauaaauccagauuccuuaacaggucuauguccugccucucucugcagccucaucuaaugacauuuuuucuuauucccucaccaaauuucacccauauggagucuucucugguucuucugucauaccagacuuguuucuucugucuguccuaucuccccuuuccucccaaacccucccuuccaauuucuuucuaugcccacuuccuccuucaagucuccacuuaaaugucauuuucucauauaaggcuaaccugaauucacagucuaaauuguuugcccugcuauucuuucuuacaaccgucuggauguuuuugccacagcauuuaucauagcacuauaagucugucauacuucuguugacagugcauuuuauaaaucuguggcaauuuuacaauguaguaugcuuguuaguuuccgugugaugccagcaauggcccagaguaaaaagguaaucaguaaauaugauaaaugugacuuuaaauacaaagacagaugcuuuauugcaaggaacuuucuugauuauuuuuauuuuuguuuuuauuuuuuugagauggggucuggcccugucacccaggcuggagugcuguggcgcaaucucugcucaccguagccuucaacucucgggcucaagcgaucccuccaucucacccuccugaggaacugggaccacaggcaaugccuggcuaguuuuuguauuuuuuguagagaugggguuucacuguguugccuaugcugguuucaagguccugagcucaaucagucguccugccuuggccucccaaagugcuaggauuacaggugugagccacggcuccuagccuugauauugauuaaagaauuuguccuucgguuuauuuuauuguaauugggugaguaaauacuuaaaaaaguuguuaguuauauguggggauugggaaaagcuccuagcagggaagaaccuugcugaaguuacuauguuacuauauugcuguuuagaguuaaugcuuuuuaagauuaaaaguaauugcuuuaagugucucucuucuaaugaaagauguugcugguagcuuaugggggcaagaguaaucauuuuauugucugagacagcuuucaacucuagagucugggugguaaaucagacuacccuuuaucuauuuuaggcaggccuuggaagaaguuggaaacuauuaaagauagcauggagcaaguguuuugaaacuguucacauuuuuccccuuuuccuuggagccauuugguuuuagauuaaaaucuuauuguucuugguuucucauggggcgguucuguucucuacugaaggaacucugccuuuguaggucuccugaaucugaguaagacuagguaaguugaauuucuccuuuuuccugccagaacugaguuggucagagcuuuucacagacuguucgaagucgcagagguaauugaauccuugugcugaauaaagacgacuuuagagcaagggggaagauaaauacagggcacuggcauaggauaggauuuuuugagcaguuguauguaguggcuaaagaagaguccauggugacugcuuguuuucuuucuugaguaacuggauagauuguggugacagugguuuuugugaacacuuuguagagaguagaggauugagaaauuucagaaagcuguuuuaggcaucccuugugccauuuaaguggauauagucauuuuacaauuaacauauuucucuggaguagaagaaaggcuacaaugggagugauugaggaagauaauccacuaucaacaguacauaugguagauguauauuagaucagggaggaugugagaggugauagaaggcucaagaaugaaccccaggaaacaccaacaaugaaagggcaaggaaaaucaccaugaaagauacugaagaggagcgaaguggugggaggaacaccaggagguaguggaaucacagaaacuuugaguuugggaaguagggagcuugggggaaugaucaacaguaacaugcuuuagagaugucaaggaggauuaagauuguaaaacuggguuugauauccuuaguaaaagcaguuucauugcaguacaagacuauaaauaaguaccaaaugaaugggaaaagugacagcgaguguccgcuacgaguaagcuuaggugggaaggggaaaacagcaaaagcuagaaggguuggagcagggauguuauguugugugagugcacacaugcccuuguauucgaguuaugaggcacuugagagugugguuaagauccugagcucuggagucagacuucccaaauuccagucuggacucugccacuugcagcuuuguggccuuagauaaguuacuuagcuucagugacucaguuuucccauggcuaaaaugggaaugaucaaguuuugagaauuaaaugcuagugcauguuaggugcuauaaauagcauauaauaacugcugaaaaguguaaacuauuauuguaauuauuaguaagaaaauguuuaauuauuaauuuuuuaucauugaccuuuaaauauacuugcuucaguuauauuuuaaacuuuaaauuauuaacaauuugggccccaugcuguguagcaggaggaacuacuguuauaccacuuaaauuuuuuuccuagcuucuuucuuccaccagucucaacuuucauuaauaauaguuuuucuguuugucagauacuuguaauauuuaacaucuuuucugugauuauaauuuucauguuuuaguuuuaauuuuauaguuuaaugguggguccagaucucaauguuaguacuuuugucauagcuucuuuauucaucucuugguuagcugaaguuguuuuuccugggauuuugucaaaaaauuuucgaaauuuuggcaaguuaacaugcuuuucuuguauuuguacucaaauaauaguuuggugggguauaacauuccagaauuucauuuuuuuuuccuugaaacauuuuaugcauuuguuguuucacuguucucuuuauucauauugcugguagaggucugacgccagccugcauuuugcacccuuuucauguauuuuuguuaaacugcacucucacaauaaaacauucuuugaauaaucaaucacguguuuauuauuuacuggauuuuuuucagugucugaccuacucuacacacaucaagggauucaauuucuuuggcauucaguaauuguacuauaauauggcuugacauugacugcucuguuaaacuucccuuggacacaguaugccuuuucagucauuagauucaaguuagcuuuuauuacugggaaguuauauauaauguucuugaaauaaguaaaauaauggagaucaguuaaauacauaugggcucuccacugccuaccuucguugucuuuucauaucuuuaacaaaaaaaaaaacccuaacacauaaccaaagaaaacuuuauuucuacuuuuuauuuauuucucuucaccauugucucuauggcucuuacuguguuuacagcggcaugugcuuuucuguuugcugcuuccaacuguaguauuauuucugggaugguguugcuuuugcuuccacuuuaguuuugccagcucacguuucaucucguuuuguguuaucuuuucucugagcucuuuuauuuuccagagaugauuacuauauuagauuuuuaaccacaguuuuuuccugcugugugauaaccuuuuucuggugauuuuucuucacuuguuauuuguguuuuucuuauuuucauuuuuugguaucguguauagauccuguuuuguuuuguuuuguuuuguuucauuuuauuuacuacuacuguucuuccaaugagggguguuuuucuuggaucaucuuugugcuagagcuugguguuguugaagggucagggauggcugguguucuccuuggggacuguguauguaaaaugauuuuuuuagccuuugcugcuuuucagauaagaggcuuagggucucccuguagagaaucuuuugacugccucacuggcuaguugcucccuuugagugauguuuuuccucuugagaugugggauuuuaucugcaacuuuuuuuuucuuuuccuucuugagaccuucuuccaagaaaguuccugcuugcaaucuuugcacuuguuuguuguuucccaugucaaguuggggauggcugguuuuaccuuucaggaugugccuguuaauuucagagaacuacacaucuauggcaccucuguagccauggguauauucugacagggucguggagcaucugaauuugaucuuuacuauauuugguggucuuuccuuauaugcuuugagauuacagguuacugucauucauagcagcuuacauuuugguuucauauucucucuuuugaucuagcaggagaaggaggaaauuacugucuugacucugaguuuaaaacuggaauuccuguaguucuucguaaaaaucuguuccuugguugauauguaucuaguuggaaauuucaggauacacaacauuaaagagauuuuucugaauauuucacugaucaguauuuggcaguuauuuuacuuuuuauguaguacagaacucugcauugacccaagaacacuugauguuagauacuucauuuucauaauuuuuuuuuaaucuuagcaccuuuuauuuuuuauuuuauuuauuuauuuuucuuauacuuuaaguucugggauacaugugcagaacgugcagguuuguuacauagguauacacaugccguggugguuugcugcacccaucaaccugucaucuacauuagguauuucuccuaaugcuaucccuccccuauucccccacgccccgacaggcauguugcccuuccuguguccauguuccccuuccuguguccauguguucucauuguucaacucccacuuaugagugagaacaugcaguguuugguuuucuguucugguguucguuugcugagaaugaugguuuccagcuucauccacgucccugcaaaggacaugaacucauucuuuuuuauggcugcauaguauuccaugguguauaugugccacauuucauuuucauaauuuuuauuagcccaugguaacuauuacuaauucugcauugcuuucucaauugcagucaaguaagggagaauugacuacgcuuauacaucagcuucaagaaaaggacaaguuacucgcugcugugaaggaagaugcugcugcuacaaaggaucgguguaagcaguuaacccaggugaagacauucuuauguacgagggauauacuucccaaaucagaagcaacaaaagauuuuagaaauuguccauaaucaguaguuuaauuauuuguaauuuauguccaacaaaaguaacuuuccuuuagaguuuugggaggguagauagagcugucucucucuuuugugauauuauagccuauaguugaauuauuuaaaauaagaguacuuacagauauccuagcuucagaauaacaaaagcacucuguacagaagcaugggaauuuguuuuaauuggaucugaccuagaucuguucucaauagaaacacagaauuuggugugaucuuguuuaagucugauuaauggaauaagugugaaacucuuaacauagguaauuuauuuauggagcuucuugugauaaguauaauuuuuugucaaguucuucacaucucagaaauuuuacuuugagagguuaauaguaaaaaauaccagaaaagccaaucuuuaaaacaucaugaaacugagagaacagaauugaaacuauagaaaauaugguuuaauuauuccugaagugcuuguuucucuuucuagggauuaaaugcaguagaauacaugauguuuauuuaugagucauucaccuagccacuugaugacauuguaagagugaauggcuuuguuugaauauaaauccuuuaugugaauuugaaguaaauaaaaaaagucaauggaaaaaguuggcaagauuaauuaaaguuguuaauaaaauuagaaacuuuaacauaguuuuuugugacuauaugacuauauaaaaaauuaaaaauuaggauaacuaauuugauaauucauugagccgcauacuuaugauguguauacuucuaaguauguuauacaggaguauaacaauuuguaaagaugaaugaacaaacucaggcagccauaaauuauguaauaucucaaauuuugucauacaauugcuuuagagcaggaacaugauuaguccuaaugauaccugcagcuaacuuuaaaauugcuuggcuuucauguacuuugauaauuaauauuuguucuaggaguucauaguaccggcaaaacaaaaugaaaucccucauuuaagauuugacuuaguggccgggcgcaguggcucaugccuguaaucccagcacuuugggaggcugaggcgggugaaucaugaggucaggagaucgagaccaucuuggcuaacagggugaaaccccgucucuaauaaaaauacaaaaaaaauuagccgggcaugguggugggugccuguagucucaacuacucgggaggcugaggcaggagaauggugugaaucugggaggcggagcuuguagugagccgagaucacgccacugcucuccagccugggcgauggagugagacuccgucucaaaaaaaaaaaaaaaaaaaaaaagauuugacuuaggaagaugauaaaacuuugcuuucugaauuugcuuucccuuguuucaaacuuugacucugcuauagacaucuuaucccuauuuuuuucccuuaggaaagagaauuauuuccuucuaggccuuuuuucccugaaagagaacguguaccugggaaugauagagaaugaacuguugugcuuuaaaauguucuuucguguaaucaaguuagaauguaggauuuauucuagguucauagucuuuaacucauaauaaacuagaaagugcauuugaauuaagaguaaacaacaguggcaaaguguuuaugaagggaauuggcgugaagagcagaugagaugcagaagacuguuuuuaaaaucuuuugaccuugcuuuuuuuaagcaaguacuuaauguuuuaucauucaugauuauuuuacugauguuaaauaacaucauuguuuaucauuguugcaggcuuaugauacuuauuaaauaacaaguuuuuaaauuucugggauauucuuuuaggaaaugaugacagagaaagaaagaagcaaugugguuauaacaaggaugaaagaucgaauuggaacauuagaaaaggaacauaauguauuucaaaacaaaauacaugucaguuaucaagagacucaacagaugcagaugaagguauauuuucauucuuuggaaacaagaugaaaugguugcauucacuuuauuagcaaacuuuuaaguggcuaguauguacaaggcccuuucuugggccaucaacauacaguggcuagugaaguucacucugcguccuaaguaaaacaacuuuucuagguggggaugagguagggaggccggaugcagauaaauaugaugauagagauaaguauuggcgacuuuagagcaauggugaugggagguaaggaagaaaaggauuugauagggaagacuuuuuagaagugauaugcagacuguguuaaaucuuuuaaaucaauuaggcauuaucaaguaagagaguaaagaaaugggcacugaggauaagaguuacuuggugugauuucuuaguccaucucuggaggugauaguucaguggguauauuuugggacccaggacugagcuuuuuaaugagugcacuccagguguuaccaguacagauugucuagaguaacugcucuaugagaaauacaguaagaguugugguauuugguaaugagggcuggaaugaagaagggauauugagaaguagauagaggccccaucuuaaagggccuuguauaccugaagacuggggagccagugaaggaguuuaagcaacgcagcagucgcuggaauuauacuacuauuuuaaauuuucaccuugguagcaguggggaaaguggagcaagggauaguuggaacacuuugcuagaauucaagucaaagaacaagggccugaaauuagauguugacaaugagagaaugaguuugaguauacaaagaguuaguuagauagggcuugguguuagugugaaggggagaggugauagugaagaaugacuuccaagguuuuggccugagugauuuugucuguuguugcuuccuacccuuucaccugucuucugucagaaggcucaguuuuuacagucugucuuuuguauauauuuuccauuuucaugauucuaguuaggacuagaccagugaauuuuuuuuuucuuauuuuugaaaagauugaaauaucuuuauuacugcuaaagagguuauugaagaauauggcuugagucugcuugcuugguggucauguaauaccuuccuuaauuuaacuuucuugaccagugacuuuuugaaauuguuacuuccaucugcuggcugauccuucaauuuggaaggucugucauuaccucagauuuaauauaugucuaaaacucaccuauugauaagguugauauauauauauauauauauauauauauguauuuuuuuucaggccaaucaugagcaaugauguuuuuaauauuuugaggcauuauuaucuuuaugcuugaauccugugacuuuucucugccuggcuuaggcuacaauuuguucugaaaucuuaaagacacuuuauuucuauggcuaggugccguggcucaugucuguaaucccagccgaggugggaggaucacuugaacccaggaauuugagaacagccugggcaacauagugggaccccauucuauaaaaaaauuaaaaaguuugccaggcaugguggcaugcccauggucccaauuacucaggaggcugaggugggaggcuugagccuggaaggaugagguugcagugagccaugaucacacuauugcacugcagccugggugacagggugagacccugucucaaaaaacaaaaaacuccaaaccucuuuauuucuaguuacucuugcauucaauucuuagacaugucuuuaguuuauuauuacauacugggauaauuauggcugauauuaauagguuugucauuuucauuccgucuuguauuugguaccagauuuuuuuuugguaaaauauugcuuugauaauaucgcuagucugcuaaaaauuuuaaaauauucuuugcugcuuucagagucccaguguuuuccucugaaaugccacuaauagcaaaaaagaagugaaugaugcuguuuucauguucuuacccuauccacugcuuuuagcauuuguuuaacucauuccuucaucuucucaucccccagcaauuugaguuagugaagaacugauuuuccuagccucaagugaucuuuucuucuuaauuccuaauuccuguuaauuugaaaauuaggcagauacuuguagcagcaucuuuuguugaaggugaaagguauuuaagugauucauccuguuuuacuugauuacuuacagaggucaggauauagauuccauaugauaacuucugugaaaaauagaaauguauaccuuaauuucccuuaauaagcaacaguuucuuuugaaagaauuauuaauaagauuauuucauacaaaaacauguucuuaugagaauauaagagucagugugccuuuaucuuuagauucuuuaauccaaaauuuaaaaauuagaagaagaaaguuagagugguggucgccaggggcugcagggagaggaaugggaguuauucguuaaaagguguagaagguguuuuacacaaugaagagaguuauggagagaugaaugguggucaugauuacacagcauuauggauauauuuaauaccagugaacuguauacuugaaaaugguuagaaugguacguuuuauguuauauguauuuuauaauguaaaaacuuggaaaaaaaauuaagaggucagaauauuuuagcaagcagguuuuuguguuaucuauaugauuauggcccaauuuguaacuuaauauaaaguguaccaaacauauuuucaguuuuuaaacuuuggcuuacuaaagacuuuaagaauauugcuaauguauaauugacauaagaucaggacaagcuuaauuuuguaugaaucuauucgguaggaaagaaauccuaaaucauauuuaguucugaaacaucaucucuaagcauguuuaucuuguauuucaaauaugauagcagcuagcaucuacuuguauucuugaauguggugacaguuuguauuugauuugcauucaucacuaacaaaauauaauucuuuuaaauuuguuuauauuuauuugagaagaaugauucaaacuucauucuauugauguuuuuuauauucucauuuuaauaaaguuuauuuuaaaaguuagcuuugacagucuuuguuuucuaaguuuuauguguguaaaauaauuuuaguuucagcaaguucgugagcagauggaggcagagauagcucacuugaagcaggaaaaugguauacugagagaugcagucagcaacacuacaaaucaacuggaaagcaaguauguuuccaaauaccuuauuuuuuaauugaauggcagaguauuuucuugaaucaucaaaauauuaauagcguuugauaguaauugguuagacuuuuguguuuuuacauuuguuucuaaaaugaguuacuuuuaaaaacaauucucuuuugcuuugugaagaacuucuucaguuauacauauguaaacuauguuauauuaaugucauacuauuauauacuuauacaaauacauuaauauauaucauauauuacauauuuauauaaacauguauguguauauuguauauaaacuauguaauaaauacuaguaccaccaauggaauggucuacaagcuuaugaguuuauaaguuuuaaaccaucuguccccuuucacaguagcucccaaacuucaguguucugaagaacaccuggcauucuaauuaaaagguguauucuugaguccuccccuuaaaagauuaugauucacugacucugagguagagcccaggagucuacauauuaagacacuuucgggccggguguggugguucaugccuguaauccuggcacuuugggaggccgaggcaggcggaucaccugaggucaggaguucgagaccagccuggccaacguggugaaaccccugucucuacuaaaaauacaaaaauuagcugggcuugguggcacacaccuguaaucucagcuacucgggagacaggagaaucgcuugaaccugggagguagagguugcagugagcccagauugugccacuguacuccagccugggugacagagucacacuccgucucaaaaaaaaaagacacuuuccuugugauagugauuggcucugaggccauacuuugagaaauaguaccuuagagagacuaguaauaccgguacacaguacccugacuggcugauuuuuaauacguuuucagaagaccaguuugaaggugacacuauuuauggucauccauuuuucuugauauuuuacagugauuuuagaauuugaauaacucauuagaauuauauaggaauuauacaacuaaacuuuauuguuaguagucacuuguguucuguuucaguugggcuguaaauggaacuacuagcucagcucagcaaaacuaacaaaguauguuuuguuuauuucuuauauauauuuguaauaacggaaggcuccuaauccaguuacuguuuucaggcagucugcagaacuaaauaaacuacgccaggauuaugcuagguuggugaaugagcugacugagaaaacaggaaagcuacagcaagaggaaguccaaaagaagaaugcugagcaagcagcuacucaguugaaggugauauauucucaccuuuauuugucauuucaugaauaauauaggcguauuaguucguuuucauacugguaugaagaacugcccgagacuggguaaauuuuuaaggaaagagguuuaauugacucacgguucaacauggcuggggaggccucaggaaacuuacaaucauggcagaaggugaagaagcagcaaagcaucuucuucacgaagcagcaggaaggagaaaugccgagcgagggggaagacucccuuauaaaaccauuagaucuugugagaucucacuauuacaagaacagcaugggggaaaccaugccuaugauucaguuaccuccacguggucucucccuugacacguggagauuauggggauuacaauucgagaugagguuuggguggggacacaaugccuaaccauaucaguagguauuuaauuugaugacuuaaauguguauauagguuugaaaaauauaguuugaagcuuaaugggaccuguagucuaaaugcuaugcccugaugaaagaaaaagaagcaugugcccuauugaaagaauugaauauaggcuugaauuugaaguuaaagaccguuugaagauaugguaaaugauguuagcugauugacagauauaaauuguagaauuuuaucauauauauggggguuagggucuacaguauagggcagaaaucauguaguuaaaaauuacccuuaauaccacuuuaucacccauagcuuggauuuuucaguagguccagcagaaccuaguuuucuuucagcacuggaauagguaguuuuuccuuugcuucagcacaagacuaaguaguguuccaguggcuugcacucgacccaugauguacaaaaagucacauacuguaucuuuagacgccagagugucacuugguccagugagaugcuuauacuaugaagagaugcauggcuuugcucaggcugacugagggaggagcagauucauuuaucucauuuuauaugcauucugaagcauauguacauugaauagaaugaugaguauaauucucuauuccugcuuuuauugaagaggaaauuuguugaaaguauaguucaauuuguguaaguuaaaugcuaccucauuauaauagauuccuaccuaggucauugauagaauuguacuuugauaccaguuccagaguaggaguuaaaaaggcuucaagaguaauugaguauggaaaauaguguuuuucuuaagucuuguugggagauugauauaaguauccuuucuuuuauuuaauauugaucuugcugguggguuuacuacuggcauagauacggaagucuguucucuguggauauggauaaauaaaugacauuaaagauuauagucaugauuggaguguuguguuauaaaaauaccucaaaauaagaauuuuuagcuacuuagauuuagcaauaaagacaccauccuguccuucggaagcuuaucagcuaaaggaagguuagugggaaacagguuauugcuaaguggaucagauguauauaguaguagcuaucuugauagaaacucagcacaaauauugagucugaaauaaucuccaaacuguaaacccuguaauguuggaggauaggauggcuauggcugauaaauaaauggcuuuuagacuguguguaucugcuugucuuauugaaauguaggagacuaguugcaauaagcaguuuuaugauacaacaguaaagguagaggaugcuuuuuuucccucuuuuucaaaguagaaauucuguguuugugcuaauuuauccuuucucccuuuuaaaauaccaagguucaacuacaagaagcugagagaaggugggaagaaguucagagcuacaucaggaagagaacagcggaacaugaggcagcacagcaagguaaggggaagaaguauucauguaaacuuuguauauaauuuuggguaaaauuuccucucucuuccaucugugaagaaaguauaauuuggcauuuugguuauagcucaauaaaaauagcuuuuauacuuucagaauaucuuucuuucuuugacauuuguuaggguuuuaaaauaaguuaccuacuagcuuugccugaagcauuaaaguugcaggcaaaauuauaguacaugauagguuaaugggauccuggcuguguguguuucuuuucuguaguuauucucuuugguucuuugguuaauucuuuuuuuuuuuucccaagaaaauacucacuucuuauuuugaagagaaaaacagagcauuaccaucccagguaguuuacuuaaaacugcccauuuaauacaugcuaacguuuacucauuuacucuuaauuugauggauccaucugggagauaauggaguacguguuauguguauuguuuauuucucuacuacucccuuucucccaugaaacgcaaguauagccugcuacaggagcaugcaagaauggaagcaggagagauucaaagaagguuuucuagaggagagaaugccuacacgaaagaugaguaugaguaacuaggcaaagaaagagaccucuguaaaauguaauguuuuauuacagauuuacagaguaaauuuguggccaaagaaaaugaaguacagagucugcauaguaagcuuacagauaccuugguaucaaaacaacaguuggagcaaagacuaaugcaguuaauggaaucagagcagaaaagggugaacaaagaagagucucuacaaaugcagguucagguauuuuuucuucuuuuuuuuuuuuuaaaaaaauacagguggucacuuauuagaucugugugucuagaagagagacuaaagucuaccuuauccuaauucugaaaugaugaugaauaauuauaacuuugucuuuugagcacuugucacaauaugguguguuugaaggugugcucacccacagucuuaggcucuuuguguuagauuaggaauagcacaaacauaucuuuaacuucugucuuauaagcuaacucagauugucuaaucauuguuuaaaauaaugccuuuuggaaucuaagaaugccuuaaaaaaaaaaaagaaaaagauaaacaaauguaccuauaauacauuguguucauauacaugggguuauuuauuagcaugcuuuuucucuuuuugguugcuauuuaugaaaggauauuuuggagcagaaugaggcuuugaaagcucaaauucagcaguuccauucccagauagcagcccagguaaugaugcuuucuuauugcuuaugauuaauaacuugcagccauuuaaacacucaccugaaugucuguugagugccaauuacuggauuaauagcugggagacuagucaaugaaucaacaaaugaugauccugagugcuaaacacuugcuaauuauguacggugcugagggaaaacacuaagaaagaaauccauaccaacuaauuggaugaggggaagguuagagagcuuuuauuauacaaaaauguccccaauccugucacaaaacaaggagagagaauuggccaaauccuaucuagaauaguggcuuauguauuacagauguucauuaaauaucagcuagcucuggaaaauccuaauauaucagcagggggaacaguaugguaaccauagaucacagauuauauuugcaaaaugaucaauugaaaauuuguaccucaguuuagugacucagccuuccaaaguuuucaagugauaguguaagaccuguuauucuuugaugugacauacaugucuuuauaaauaauauaaagaaaaucaaauaaaaacaaguauugugaauuuugagcuucaguuuuucaacuugaaaauucugagaguuauuuguagcaaaaaguauuggcuuagaagucugacauuucuguauaaaaagugguuuuuaacauuaaaauuuuguuuuuaagguucggagaaguucagacucccaaagcuuugaccauauaaauauauuuuucccaguugcuuuaucuguagaaauuauagucuaaaguaauugaggaagaauuaaugcaggaaagggugcugguguggauguguauguauaugugaauuaccaacucagauugaauugugaucuuuaguuaucagcugagaaguagcucuaaaaaauuuaucaggaguuaaauacauagagaaugcuguaagaaucuuuuaaauaguaaacaugaacauggguauuacuaaacuauauuagucauggaauggauaauuuuauuauuaaaaguuguuacuaaggagaagaaacacaggaugacaaauggccuuucuggcuguuuuuccuacucauuuguugcuugucaauuauuuaguuuccaggccugucaacuuguuuuauucuaaaugucuugugauauguaauucgugacuacuggcuguuggugaucaaacuugcuuucagaaugauaguuacucuuuauugaacacuuaccaugggccagauacuuucauaacaauuuauauacauuaacuucucuuaaaauuuaaagcuguuaugauuauuguauagcuauaaagcuuucucuuaaauacuuuuauguugacacuauuuuucuuucuuagaccuccgcuucaguucuagcagaagaauuacauaaaguguaagccuaccuuuucacacucuuauaauuguguagucaccacuaacugauacuuguuagaugcgacacuuaugauuaacuuuauaccucugacgaccuguucagaaaauacucugaacuagauuuggagcaacuuuugcuuuuuuuuuuuuuuuuuccuuuuucccauuagugaguugggucccuaaacauuauauauucugcuuuuauuuauguuuuuauuauaacaagaguuggggagacuuucauuugaguguuagcaauuauguggaagagguaauuguuuagaaaguaguggaaguaaauuaguuuuugugucuuauaaguaguuguaguucuucuguguccagcucugugguaguauacccaaaacaaaguuauaugcuuuuuuugugccguauaauuuugcauggacacugaucacuugaguucggaagaucugaaaucugguuuugacauagcuagcuuuaacaaauuaaccucuuuuaucucgaguuuuaaaacaggguuauguauuuuaaggaguuauaguaaugugugugacaguuguuaguaaacugaaaggggcuauagaaauggaagguauaugagaacuacugaaguaaggaugaugcuuuuuaaggcuuuaaauccuuuugauuugugacuucugaauguuuauugaauguacaaaugucuuuccuucuaaaggauugcagaaaaggauaagcagauaaaacagacugaagauucuuuagcaagugaacgugaucguuuaacaaguaaagaagaggaacuuaagguauaguaauuuguauaaauggcugcaauauuuuacagaacugaaauuuaaauuacuuugaugcacauaaucaguaaguguauaugaaaaauggaaaauagucuagaauucauuugaaauaacuguuuuucuaaacuacaaaauucucuagcucucuacgaggaaaaauucaaagggcuucucucaugugauauaauuuacaauaauuugauaggaauaugcuaaauaacaggaauuggugguuucucuugauuauuugggaaauuuuguaaguugagacauuugcuuaacucuuuuguagaaaagaugcuuuacaaacuuuaaaaucaguuguauuaaguauuuuaaaugcuauuuuuccuuguucuaggauauacagaauaugaauuucuuauuaaaagcugaagugcagaaauuacaggcccuggcaaaugagcagguagaucuuuauugcuuuugagcauugaucucagaauuucaauuugcguauucuuauuuucauugauauugugagccccaauuugauuguguaaguaaaaaauauaaugguuuaucaucuuuggcugcaugauuugauguuacuguuuuuauguugaaauaaauguuugauccagugaauuaaucacuucaagauaucacaggaggcaguuaaaauuaucuuacuaugcugguuuguuugagucuuuuauuugagccauuuaauucaaaaaggauauaccuuuuuguuaguguauaugaagaauggaaaauagucuagaauaaaagaaguaaaaaauaucgaacagcaaaacauguuacagaaauauacaguauugcuguaacuucaaauauauggaaauacagcuuuuuaauauguaaaaauuagugaaaaaaauaguuuugagcacuuccugugaagugauaucauuuucuucucauuccacacacaggcugcugcugcacaugaauuggagaagaugcaacaaaggugacuaaaguauuguacaucuagucguucauacauuuauguuuaauuauaauuguugcagaaaauauugcugcuuauaacugauaguugugcccauaauucuuguagauuuucugaauguaugaaguauuuuaauuuuuuuuuucacccucauaguguuuauguuaaagaugauaaaauaagauugcuggaagagcaacuacaacaugaaauuucaaacaaaauggaagaauuuaaggugugugauuaagcuuguacacucagguuucuuagaacaaccuuguauacuuuucaguugagugauuccagaaauacuacguuuuguaugaagucacucugaaacaguguuucuguaguuuauuaggggacuuaugcaaaccaugaauuuuaucauagacuuucccccuagauuaucuguucuuuuaguggagcuuggagauuuauuuuuggcccccaaucuuuucucagcugauaguuucuauuugggacugucuuauuugucuccacuguugcuguaguucuaguuucuggucauggccaaccaagugcuagggugcaucucuguguccagugaaauuugaauuaugucaguguauaauucaccugucacuuugaggacugaaagcugagauaaagguuugauuguucaaaaacccauucaaaugauugcuuuauuaccuuuuuucuuaauaaaacaguaaauugagacucuuucuuccagauucuaaaugaccaaaacaaagcauuaaaaucagaaguucagaagcuacagacucuuguuucugaacagguaaggcuuuuccuaaauuacaaaguagaaauacuuguuauauaacaagaucugguucuucuuauuuagguaccaaauuacuaauugagaaauuuugcuuaagcuuagauauggcuguuauugccuuucuauucauccuguaucuaaauucaggaaauuuuuucucccugaggugaagcuaaugccaaucugcucaaaagcacauuccagaaaaauaaaaauguguaauaggaugcauaaaaauaauuuaagccauuuugauacauuugacuuucagaauaaauguccugccuuagacuuggagccucagcuuuuucuuuuagggagcauggugucuuuaaagguugaaacuuauuacuagcacuuaaaagcagugugauguugaucaaauagcuuaaccuuugugacaccucucauuccaagccuuucacauggagauuauauuauauuuacaccauaaaguuguuagauuugaaaggagaagcuuauguauggugccuagucuagugcuuuguuuaugacagguaucuaaaccuuaauucuuuucccuuagaguauuuauuuuauccaucucaucuccauccccugccaccaucacuauucauuuuauauuuauagcaagacaucaaaacuauaucagcuuugaauaagcaugguuccauaaauuagagcccagugguaucuguucucugccuauuccucagugcugccuucguacucuucuucuacgcagcucuuacaauuacaauuuauuaauaaaacacaaacucuugaugacacauuagaauaggaaguuugcguuuguuccuaauauuaaguuuuugaauuguacuuuuauuggaagccgaaauguaaagccauugcaaaugauagcacuucuuuagcaaaugcaugcguucuuucauuuauuuuaaaauucacauuuaugcagauauugagcugguguaaguagcugugccucuggaaguauuuuguuaacuugucaagaaauaauccauuuauucuaccuccccguaugauauuaagugcauuauuacauagucuuacuacuuacuuuguauuugcuuuacccuuguaaacuaaagguaauagaggagacagugcugaagggaugauauuuaguuuaaauggcauuuaaggcuuauucuuuuuuuuuuuuuucuucuugagacagagucuuccucuguugcccaggcuggaguucaguagcacuaucuuggcucacuguauccuccaccucccagguuaaagccauucucgugccucagucuccugaguagcugggacuacaggcauaugccaccaugcuccgcugauuuuuguauuuuuagcagagacgggguuuugcaauauuagccaggcuggucuugaacuccuggccuuaagugaucugccugccucggccucccaaagugcugggauuacagaugugagccacugugcccagcuaaggcuuauuuuugucuuauuuccuuuucugguauagcuuacaaaaaagauaugauaccaauuauaagauuucucuccccccacccucccuuaccaucucugaaauaagaauguaucuuguagucucugguuacaguuuaguuguuuaguuggcaacauuuuuaauuuuuacuguuaaauagcaguggugagauauaacauuggugacuuggauuagauaaaauguaauagauuuuuguguguguguucuuacuuggaaaagcagaguauaguuucuguguguuaguuaccagagauuuuugaaaugcugauaaccaguguaugaaguuuuaaacuuuaaaauuaacuucauggagguaaaacaaaugcuuagaaacuucugaaacuguccuagaauucuuauauucuaguaguauccaggugcuggcgacucuuauuuaaacagaaaacuucuguucuuugcuaaaaaugguauuuuccaucauuagauaaaaguaaaaccaccagccuuaaauuuuucuuuuccuuuaaaaucauguaauaccuugagaaaugccauuguaauaccuuauguaaaauucccaaucauauuuaugaaaguuaauauuauugcuaucuuauuaagucagccuuuuauuauaauguuucuacguacuuuuagauguuuuguuaaagugacaacuuuuaguaugagaugugcuuuuguuaugaagaauaauucacaggauaaaauuuuauagccacauuuuuugauuuauuuaaaagaauuauuugauaagggggaaacucauuuugugauacuaauuuaagaucuguuggguaauucuuagaauuguucuucugacucugaaagcuuuuuauuaauagucuagaaagcauaugacugagguuuugguuauaguugagacuucuuucaucuuggcagacaaagaaucauuucuguggcuuuuccucuagucguuuuuauuguugcugcuagugaaagaagagaaaagauugguauaaucuuaauuucugucauuuccacuuuucuuuaaccccuuucuaucccacagucagaauuccaagugacaguugagagauugaacaguuuaguuauguaaaaauuucaguccuuuuaccccauggauuuuuauucuggaggaaaagauugagcguauaaaagcagaaaccaauaauggugccaaguuguuguuucuucagguguaggaagcagaaagacaacagguaccaaguaaguuaaccuguugauacccuaaaggagggaaggcugcauuuggauuuaggcuugcagauggucagauaaugcaaauaaaucauuuacuaauauuucauuuacucagaauaagacuuuuuuuuuuuuuuuuuuugcugugggggagcacauuuugacuuuuagugaaggagcagcaugacauucuuauuccaguagauuuuuaagauucagugaucaagauuauuaagugaaaacuauaagaaguuucuucuuuuugcccuacugccuuguuaaauuguauugcagaauauauuguauaugguuuaguuuuggaaaucaucuaggggaggaaacaguaggauuggauuaaaccaauaaaguaugaaguaaaguaaaaauguuggaggagaugcaaacuaagcugagucagguuuaugcaauagaguauuugaugagcugcagaccaagaauacuuucuaaacuggaacuucauuaaaaaaaauucaucaaauacuuauuuacuaguugaguauaugcuaguugcuuaccuacaugcugagguugcagagaugaaugagacuugauucuugcccuccuaauauggagauagauauguuaaacagaaaguuauggugaaugaaguuucugaacucuauacagguuuagaggaagagauaaugcauucuauuaauauuugaaggagguggggagguaacacagggaacaacuaaaccucguuuugaaaaaugagcaugaauuugccaaagagcuaagagacaguccaggcugagggaauacaauguucaaagacaugacaguguggcaagauuggcauauucagaguauugguauauugcagaaguacaaaauacaggaaggauguaaggaguagagaaagauuugcuaagaccuaauuaugaagggcuuuguaugcugugucaggaccaugaaccugaugcagcauguggguaagccacuaaagaguguugcaaggauaaaugagcauuuagccuaacauuuuagaaagaauacucugguagguaggaguaacuaaagguacaauacaguaaaugguuaaggugcagguaacuuagacuuaauaguguuaugucuuuuugugagauggcauucauugaaaauauagauggacaaaagccaucuucaugaaugauuuaaaggcuuaaugcaugauuuguuuuucauaguauaaaccugauuuaauguacuuuugacaacuccuauuucccuucucauguuuggauuauuuuuucccauugggaaguuuuuuccugugccuccuacaaaacaauucuuaugaacuagaagcagagagaagaauuaggguauuaugauauuugagaugaguaagcugagggccaaaacuuaggcauuaaagagaaggguuuaauuucauaaauauguacagaguggaauuuuaggacuuggauagggcaguggaaaaauuaauaucauuuguaaaaaaugauuguaauaagauugggaaaaacaaaaaaaugggaaaaaaguaagaaacuagcaagauugggaaagaggugcacagaagagaauguucuaggagaaagacccuaaaucuuuuuggucaggcugcuuggcugucugaagauaagggaagauaagggaauacugagggagaaaucccacuuuggacauaagauaaauuuuaacauuggggacuuguguguguaccagaggaugccaggagaaguuucaaaggggacucaucuuacaugucauguucuaaugcuuuauaaauagaauguauuccuguugcuuuugcaauuuacaaucaguuuuaaaacauuuuauaucuugaucugguugguaguuacauaauaucuaucuaccaaaauucacugagcugugaacaggauuuaugcacuugucuacguaaauguuacaccuuaguauagaaaaaaaaucaauuaaaagagcccauguuugucugucuuucuuucuuucuuccuuuuuuuccuuucuuuccuuccuuuccuuuccuuuuccuuuuccuuuuccuuuuccuuuccuuuccuuuccuuuccuuuccuuuccuuuccuuuccuuuccuuuccuuuccuuuccuuuccuuuccuuuccuuuccuucucucuuucucucucuuucucuuucucuuuccuucucuuuucuucuuuucuuucuuuuuuuuuggacuugcgaggucuuagagucuggauucuuuguauuugaagaauugaauuaauguaaaggaagugaggcagauugucuuaagguuaucuuuucuagugauuaagauuuuuuucauaagauacuaauucauuuugccagcccauuuuacacugcuacuuuuucugugucucuuguguagauguaucucuuuguuuuguguuuucugaauuuuuuaauuaucaagucuucagauaaguuauuguccuaaauuuuguaucuauuuaauaacccuaaacaauuuucacaaaauuacauuucucaucugguuuuacuucaugcaaauuugguaaaguuaaacuuuuuuuggugauuuuuauuuuagccuaauaaggauguuguggaacaaauggaaaaaugguaagaguuuaguuuucuuuuuauauuuugaugaguuacuucuaccaaauuaacuacauuaauuagaguuuuaaaauucucuuuaaacuuuguaauggaagaaauguaguaugcuguugauuugggauuacauuaccguuuguggguuucacguguggcaguaauuuuacuuguugaggcuagcauauaagaaugaauuacuugaguacauuuuacuuguaaagaggaaguauccucagaccaugaucaaagaucccuagaagccuuucuagaauuaaaaguuuauaagaaaugauggacaaaagaguugauccauuuaaaaugauuagaaauaauaucauuaacugcugggcgugguggcucacaccuguaaucccagcacuuugggaggcugaggcggguggaucaccugaggucagggguuugaaaccagccuggccaacauggcaaacccugucuguaccaaauguacaaaauuagccaggcaugguggugcaugccuguaaucccagcuacuugggaggcugaggcaggagaaucacuugaaccugggaggcagagguugcagugagccgaaaucaugccauugcacuccagccugggcgacaagagugaaacucugccucaaaaaaaaaaaaaaaaaaaaaaaaaaagagccaggcaugguggcugaugcugguaauccccagcacuuugggaggccaaggcggguggaucaugaggucaggagaucgagaccauccuggcuaacauggugaaaccccaucucuacuaaaaauacaaaaaauuagccaggcgugguggcgggcgccuguagucccagcuacucgggagggugaggcaggagaauggcaugaacccgggaggcggagcuugcagugagcugagauugcaccacugcacuccagccugggcgacagagcgagucucugucucaaaaaaaaauaauaauuauaauaauaauaucauuaacuuugaaaaauaguuaauacauguguuacaaauuuauaauuucagcauucaagaaaaagaugagaaguuaaagacuguggaagaauuacuugaaacuggacuuauucagguggcaacuaaagaagaggagcugaauguaaagcauuuuguaguuuuguuuuccuugugauuauucagugacauaaaaggauuucucuguaauuuguguaagguuuuucccauagaucuuaaacuuaauaguaccucucacauuuauaaauuuauauaaugcuuuuuuaauuaaaguuuuuuuagaaguuaaaaaugcauaacauugacugccuuaaugagguagauacuauuguuauaguuugucaguuuccccacuugcaccaaaauuauaaccaaaugauaacuagcagacuuaauucaugaaauaguacuggaggccagagaagagauugccauucuauuuuaugguugucauuagcuuuaccuaacuugauugggaaaagguugcgggaagaaguaaguuaaaagauguauuugaauguagggagaggaguagcuuaacuaacaaguuguauacuguauauuuuugagguuguccagacaugaguggaaauauauguggauguaauugaauuaaaaauuuguuuggauagcuauagaaguuacagaauuauagacauuacagaauuauagacauggaaaaaagugagaguuuugggccuuccagaguagaaaagaagcagcuaaagaaaugagaaacuaauguauuuugaagcuagcuauauuuuucagagaguaaaaucauguuuugcuuaugugucuuugaaaaaggcaauaagaacagaaaauucaucucugacaaaagaaguucaagacuuaaaagcuaagcaaaaugaucagguaauguaaauuuuuacaacuguucuuugucucuguguuuuuuguuuguuuguuuguuguuuuuaaauuaaaagaaacggggucuugcucuuuugcccaggcuggagugcagugguacaaucauaacucaccguaaccucgaacuccugggcucaaccgauaacuccucccucagucuucuaaguagcuaagacuguaggcucaugccacaaugcucggcuuuuauuuuauuuuuuuguagagauagggucucgacauguuguccagacuggucacaaacuccuggccucaaguggugcucccaccuuagcuuccuaaaguguuggaauuauaggcaugaggcacugugcccagcccauucucuuuuaaacagugggcaaacuguugcauaaaaacaagucuguuguuucucuuccuccagguuggaauaugucaauuauaguuuuaauuuaugaaugauaaucaguaauagaggcugcaauuuaauacugauugccagguacugugacaaauacuccagauagggugccauugccucuuacuagagugauaaaaagguucuaaguauacaaauauaaaguaagacucuaguaaaagaggccgccugaaauuaggcaguuucuuaguuguguuuucucuaugguuggaauuauugauuaaauaauuuuaacauuuaucuaaugauuuuuucuuuuggcauauuuauaagugaccuuaaagcuaccuauguucaaaaugcuauuuguugucauuauuaugacauuaaaaaagucucgaaagaaugccugggcuuuucccauuuggauuuugauuguauuggaaaaucuaaggauaaugugcauuucuauuucugacccauuucuauuuugaacaaauuacuaaguaggauacuuuccuauuuccagguuucuuuugccucucuaguugaagaacuuaagaaaguguaagugauaacauuauuauaaacugguuuuucuucuuugguccauuuuuuuuuugugugugcuuagaaaucuaguuuuauugugcaguugggacagcugauguauguuuaacuuucacucuauaauuuuucuuaauggaauaagagaacuuagcugugcuuucccaaauucaguauaauuaaaaaaaaaaaaacaaaaaaaaacuauuuccagaggaugggagucaguauaguugaauggaacuugauucuccucuguauuccucaggguacaaaucuuauauuucugauguacuucugaagcacuuaacugacuucuugugugcauaggcuucagcugucuguuaggaggagcuuuauguucacccuggccauucuacaaagacauguugcuauuuuauuuaaaaugggaaaggguugauuuggagagccauuucauuauuuggugcuauuuuuauaucuuggugggucuuggugauuucuaaucaaauuauacugcauuucuuuauugaaggauccaugagaaagauggaaagaucaagucuguagaagagcuucuggaggcagaacuucucaaaguugcuaacaaggagaaaacuguucagguauugggagacagagaacuguguuuuauguuuuuguuuaucaacuuuaguuaauaucauuuaauuucguguguuuuugucugugcauugcauuuuaugucaauuucuguguuuccauuguccaaucuugucuguuuugucauugucaaggauuugaaacaggaaauaaaggcucuaaaagaagaaauaggaaauguccagcuugaaaaggcucaacagguaaaaaucccagagccauagcaugacagauuuauuaguuguguuauuuaugagcuauuugauuuuuuuucuuguuacucagaaaaaacuuaguaugcuguagguauauuggguuaugugcuuuuaauuuuauuuuuugccugauuugagaaaguauucuugauauuuuaaucuguauaucuuaaaaauuuuaacuguuaaugguuauuuucuagaacauuuuuuguguuaauguuucauuuuaguuugccaauuacaaaugaaacacgaaacaguuuggcaauuuuuuuaaucccccugcccccuucuaaaagaaaacugcauggaccaaaauguuauuugaauauacauugcucuaucucugccuuagaacaaaguacaaguuucauugggauuucagacauagaugugauuacuggaaauugaugaguuuugcugauuuuaaucugauaaggcuuucuugaaaaaauagugagauuucauugaagagaugauucauucaucucauagauucauucagcaauauuuauugucaaagcaguacuugucaaagcacuguacucgugauugguggaucacuagcuagugauuggagauaauguguugaaugaaacagguaggaugaaaagaucauacuuuucuaauauagauugagaguucaggaaagucuucuccugaggaacugacaucuaagccaagaaucugaagggccugugagaagagaguggaggauaaaagguauuaucagacuguguaugauuaagaaaaaauuaaaaaaggacaucauagaguacuguugaguaguuggccuugaaaacugggauggagaagagcucugauacaguagggagguguguggagaguuaauauucuaauuuucaguacuguagaaguaugacuggucugagugcagugguguuuacaacugauugaucacaaccaguuacagauuucuuuauuccuucuccaucccacugcuucacuugacuagccuaaagaaaaaaagcaucacauuaguuagacuuauuauucauaacuauuuuccuugucccucccccuuauuauuuuuaguuuauuaauuuuccuguuauuggagucaagaggagguaaacucaaaacacaucucauuuugucaugaaaaauucagcuaguuucuuuguaauuugaaguguacacauuauaaagacuuauaaagcuuaauaaguuaaauugaaaggauuauuaauugauuuuucuguccuuuguauuucaguuaucuaucacuuccaaaguucaggagcuucagaacuuguaaguaccauuuaucucauuuccuuuuacuauuucuuuuucaugaguuaaauagaaguauaaugaaaauuauagcuucuugauuucaagugguguuuuagaaaauacgaaaauacugauuaucucaaaacuccuaagggcccuaaguuucuuauuuggcuuuaaccuauuaaguuuuuuugugggaaggagguaggaagucuuuucaugauuuauaaucugaauauaaccucaaauugagauguugcucuuugccuauuuuaauagccaugugaaauugguaucuuccacauccagaucaauuguaguaaguuuuccaaauuuguuuguauugacuuaaacaaggugauacaggguagagguacagcuaaacuaacuuacucaugucuggauauucagugauagaaugguuuuccuuaaucauccuaugcuuccugauuugauugucuccaaaaucuuaaaugccuuuuuuuuuuuuuuuuuuuuuuugagauggaaucucgcucugucgcccaggcuggagugcaguggcaugaucucggcucacugcaaccuccaccucccggguucaagugauugucuugccucagccucccgaguagcugggacuacaggcgcguaccaccacgcccggcuaauuuuuuuguauuuuuaguagagacgggguuucaccguguuagccaggauggucuugaucuccugaccuugugauccgcccgccuuggccucccaaaguguugggauuacaggcgugagccacugcgccuggccuuguaugccuuuauacuugauaaguuuuaguuuaguucaaucagcuggucugugaguacuacccaaaauauacuuuuuucagugucuaagauuuuugcuuuuuauggucauguaacauuuucauuuagaguucugauuaauuuauuaucagauuaaaaggaaaagaggaacagaugaauaccaugaaggcuguuuuggaagagaaagagaaagaccuagccaauacagggaagugguuacaggugagaaauuaaaaacaauaaaaaauagccuuuuuauacuugacuaucaauuuaauuuacaccuauucuuuuuaaggaucuucaagaagaaaaugaaucuuuaaaagcacauguucaggaaguagcacaacauaacuugaaagagguauaguauaaacaaauuaccaacauguuacauaaggaaugauaaaucuuuguuuaaggcauuagaaaguaaagauguuaauauguucugaguuucuuugccagaaaaauuauguuguaccauaguuuuguuguuguuuaaauaaguuagcuuuuauuucuggcaagucauacuuaacugcuuaaucugucaaccugagccuacaagcauuuccuuaucucuaccuuuucaaauagacucuuaguucauccuuaacuaucuguuuaaaguauuagucuuuaaucuuuuaauaaguaugaaaaauuguuuaauaaaacucauucuguccuugcuuuauaaaugacccaaucuuaaauuuacugcauauaauuauguuuuuguuuuuauuggugggugauuccauauauauguuuuagcaccuacaacauaacauuuaaugcuaacagcauuaaaaauaugauucuguuucucaggccucuucugcaucacaguuugaagaacuugagauuguguaaguaugcuuuaagaccacauuuugaagagaaacaaacgucucauuauuuuccagggugugcuugaauauaaugaugaguuuccuguacaucauuaacuuuauuguuaaguggaaauuauaauuccagacgcaaauaggcuaagucucuguuggguaaaauaaagguuauuuaaaugcuuucagauaccuggagacuuuauccuuuccaaauccaucaaacccauuuuuucaauuauucuuucugcaaauauaggcugguuuuaaguuauuuuuuaaaacaaaauaugcaauuauuauagagauuaaacuuauuucaaaugaaaauuaguauuugaauuagauguuaguaacaucucugaauuaaccaaaagauaaucuuagccauaaucuugauaaugaauuuuaaaccuuucuguaauuuuaauuuauuuauagggaaaauggaacuugucauauuauccugugcugaauaggaaaacugaaucuagucagcauaagaggugucaguuucuguagauauuaaucuuagaaaauguuuuauucuagagagucuguugucuuaagguacagcagguuacaauggugggaaaggguaucuggaccugaucuuuuuggcccccuuuaaaauugcuuuuaacaaauuuuucuuggugauaccauuacucuuuauugauauuuguuuuaaagaagugccccguuuuaaacugucaagauauugaggauauuuauuagguuauuaucuuucuaaaagggagauuacucuguucuuggaagauuacucauuuguacaauuauuguuugucuuuuggcuaugguguaacugucgaggugcuuaucucuuauuugcuuggaaagcuuagggccucauuucuggccuguuuauaguagagauauguagaccauuaaaguagguaauuuuagguauauuucugccuuacauuuuuuuuuuuuuugccauuuucuuuuuuaaauuaauagauuuuauuuuuugugguggagaacuuuuuauauuuauaggaaaaagagaaauaccaauucucccuauuaacaucuugcauuagcaugguacauuuguuacaagugaugagccaauagcaguacauuguuaucguuguuauuaacugaaguucauaguuuccauuaggaaacuauguggguuuuaacauguauaaugacauguaucuaucauuacaguaucauacaaaacaguuuuacugccuuaaaaaucuccuguguucuaccuguguaucccucccucccuuccuccacaucccggcagcaccccccggcaaccaaugaucuuacugucuucagaguuuuaccuuuuccagaauaucguaguugaaaucauacaguauauggcuuuucugguuuggcucuuuucuuuucuuuuuuuuugggacagagucuuucucuguggcccaggcuggaguacauggagugcagggcugugaucauggcucacugcagccaggacauccugggcucaagcgauccucccaccucagccuuucgaguagcugggacuacaggcacaugccaccaugccuggcuaauuuuuuagaaacagagucucccuguguugcccaggcuggucuugaucuccugggcuugagugauccucccaccuuggccucccaaaaugcugggauuacaggcaugagccaccaugcucacccuuggauugccuucuuuuacuuagcaauaugcauuugaguuuuucccuuuuuauacauuuaucucacucuucauguaugcuguuuugucauuuuuuucauauagauuuauaagcaucuugaaauucuggaucaaggugugguaaaaauaaguguucagcucaacgaauacuugagacucuauuaugugcuuucuggcauuggggauaccgaaauggauaagauuuccuauccugaggaaacaguuaaacacaucauuuugauggugguguuaugcuagcggucuauugcuuaggaugaccagggcaauugagauucacuugggcuagauagaguaagauuuacgucagcauuggguaagggaaaaacagauuaaauuauccauagcaucucuucaguacaaagguuagacauauuuuguaauuuccagggucaacaaauuaugacuaagauucuugggggcaaaacuccuugcuuuugaagugguaauuuuugcaacaauuugauaaaauauaguuuuguucuuaguuuuuguuuuagaguuucuuccuagauaaagccacauuugcuuaagaaauguuaaguaugacugaguagaaugauccuagaaauaucuuuuuaaacaaacuucuaaguugguauaauaugggggaaaaaaagcugguauguauuguuucugccaucuuuuuucuuaggggugauauuggagucugguuuuccuuuuuuauguacuuuaguuaaugcagaucuuuguaaaaaauucuagguugaaagaaaaggaaaaugaauugaagagguuagaagccaugcuaaaagagagggagagugaucuuucuagcaaaacacagcuguuacaggugaauauggugacuuaaaauuaauuauuuuguaaauuauugucuuugcaugcuuuaaaauaauuuuuaacugcugccaaaaaauagaguacagaaugagucucccucccacccagauacuaggugucauuauuggcauguuuuuugaguaaguacccaugcauaaaauguguguauguauguauacuuguuuauuaaauacucuguugaacuauacuaacuuguauauuuugcuuucuucacaauuaacaguguuuucaagaucuuuccauauaaagcacauuucugccuuaacuuuuaauaguuuuaugauauuggaugguuauaucauuuauuuuauuuuuauuuuugagacagagucuugcuguguugcucaggcuggaguacaguggcgugaucucggcucgcugcaaccuccuccuccuggguucaagccauucuccuugccuuagccucuagaguagcugggacuacaggcaugcaccacuaugcccagcuaauuuuuguauuuuuuaguagagaugggguuucagcauguuggccagacuggucucgaacuccugaccucaggugauccucccaccucggccucccaaagugcugagauuauaggugugagccaccgcagccagcauauaucauuuauauaaccaauuccaguugauggauaccuagauuauuuagggcuguuuuuucugcacaaacagugcagcagugaauauccuugcacauguuuugaauacuuuuacuaguguuaucuguauccuagaagugaaauucuggaucaaggcuuauguagcuuuuuuguuuguuaaaagagauaguuaaauagaaaaucaauaucuuaccuucaugcaguuaguauucaacuuacuuacagaagauugauuugaagucauagcaaauguguagaugccuacauugucuuggauuaaucuugcucacauuacaugcuucaagguuugagucuaccacauuccuucucccucucauguagguucauuuuaaauuuuguuagacaaugcuagauagaccugcaaaaguguuuucacuaauugacacucucaccaacuaagggccauuucaccuucuuccuuuccaacauugacaaggauaaaaauuuuugauauuauacuugaaagaugguaagauuauuuuuaauuugcauuugacugcgagagaaguuaagcauuuuucguauguucaagccauuuuuauaugaauuguccuuuaauuuuucccacacuuuuuccacugaguugacguuuuuuuuuuuuuuacuaauuuguaagauccuuuuuauguaauaagggaaauuaaauaaccuuuuguuauuauaugaggugauuuauuuuccccauuuuuucuucugacuucauuuguguuuuuccccuuuuugggaaauuugaaacuuuuauguacucaaauauaaguaauuucuagaguuuuaagucucuggaagaaagguaucucucuacgaucauaaaaauguauucggcugggugugguaguucacaguaguaaucccagcacuuugggaggcugagacagguggaucucuugaggucagggguucgagaccaaacauggccaacguggugaaaccccgacucuacuaaaaaaauacaaaaauuagccgggcaugguggcaggugccuguagucccagauacucgggaagcugagacaggagaaucacuugaacccgggaggcagaggcugcagugaguuaagaucacaccacugcacuccagccuggguaacacagcaagacugccaucuuuaaaaaaaaaaaauuacauuuucuucuaauguguuuauaauucuuuuuguuuguuuguuuguuuagcuuauuuaguguaacuuauuucaguaagcuguaacaauaacauuguaaccauuaaaaagagaaggcuagccacauuauuaaauaauccaucauaacaguaguaauuccguuccccagggggacauuugucaauaucugaagacauuuuugguugucacagcuggggcaggcgggcuggggcaucuaguggaugggugccauggaugcuucuaaauguccagcagugcauaggauaaaacccccacaacaaagaaaaauaugaaacccaaaauguuacuagaguugagguugauuugaaaugucacuucauacuaaauucuuagagcuauuucgguauauuucuggauucuauuuuguuccauugagacaugcaaacuccgcagcuaguacuaauauaaauacucuaauuucaucauauguuuuaauaaagagcuuauuacacccuuuaaaauuauugcuauuuuggaauuuuucuagcuuguaugaucuguuucuagcuuguaugaucuaaguuuauguggaaaaaaucuguuuagauacugauguuuaauuuuuauuuaauuaggauguacaagaugaaaacaaauuguuuaagucccaaauugagcagcuuaaacaacaaaacuaccaacagguagguauuauuagaugucuugccuuucacuuacguggcaaaaaaauuauauaaccagugacauaugaguauuuuugccauuucugcauuuucauugagaaugaaguauguuuuauuuauguuuaucaaauuuuauauaaaagaaagcaacuugcuaugucauauccaaaguaaaacaaaucuauaaaguauacacaaauaauauuauugccgguauuccagcucuguuuuguauucauguguguuuucugauccuagaauucuuagcaagucaguuuaaauacuguagagguuggguuaaagauauguguacacacucuuaucuccccucuucccaaaugaaacauuaguaacuggagagaaacuaacaaauguaucauaagcaauagucuacuacuauuuaaaagagguuuucaaguuauaauucugcuugguaaaucaaaaguguguuuuuauaaaagaugcuacccaaaauagccuguaaauuaauuuaugcauguauauggauagacuugauaguauuuugagaaacaaaugaauuggaguccuugcaaacaagaagcuugagagauuauugucaccaaggaauaaauaccauauaugaagggcuguguaccuuugcauguugauguauaaauaacuuuguuaaacgugaggaaacauaacuuguccuaguuuugcuuuugauuucuguuuuuuuuuuuuuuuuuuaacuuggaagcuuaacaguuuuauguagucaaauuugaauugugcaguuugaaaauguaaggugugcuuccaugcacauagugggaaauugauaaauacuuauuaaaugaagaguucaaguacguugcgacaguagagauuggauuuagcauuccauacauuuuacagauuuguacauguuuuuauuaaaaucacuugauuaaagucaggguuacuggcauaugaaauauauacuauuuuuacuuuuguuguuuucuuaauuuauauuugagaaaagcuucaauguuuuuaagucuccugaaaaguuuuguucugaaauaacauuuaacucuuuugauaggcaucuucuuuucccccucaugaagaauuauuaaaaguguaaguaauaaguuugagucacaguuuauaaagucguaacuauuuuuaugugguaaaccauucucaaauaagcaauuuaguguaacugcaaauggcaccugauuuuuacaguucuauuuggauaucuugaauugcaguuuagaguugaguaguaccuuuggcuaagaugcuuuuuuuaugguauuuggauuugaauauuuuguugagggagauguuuguuuuuguuuuuuuaggcauucagaaaacaucaaaucaaguuaaacuauacuuugcaggguuuucuaaaucaccuucuauuaugucaguuaucuuacugggucuucuuucuucuagaugugauuguguaauugaaugaugcaaauuuugucuuagcuucauuuuuuaaagaaauuuuaggauagaugugguagcucacgccuguaaucccagcagcuggggagacugagacgggaggaucacugagcucagggguuugagaucagccugggcaacauagucagaccucgucucuacgaaaaguuuagaaauuccgggugugauggcaugcaccuguggucccagcuacucgggaggcugaagugggaggaucuuuuuagcccaggaaguucgcaccauugcacuccagccuggcaccaagaaaaaaaaaauacauacauauagucuuuaugauugucuuucuuaaggaguuuuuuuuuuuuuuuuuuuuuacugauaccuuuuucuuguuggccuguaauuuucucugugaggcuacauuuaaggucauuucacauaaguuaguguguuucaacauguuaaaaugucaaccacauuaaguauauuaauagaugauguaagugaucuaucauugggaauauuguuaauuuuuuuucuuuuaaucuaaauguuuuuccaucuugguugguuuacagaguugcuuguguacuagguuagaauuauugacuauuaaaucgagucuugaguuugacuauauagagaaaagguuggcaaauauuuucuguaaaggcccugauagcauuuuaggccugugggacccauaggucuguuuuauacauguguauauauauguguauauguguguacauguauaaauaaaacaacacuuuaaaaauguaaaaacagcucuuaguuugaggaccuacaaaaacagacuguggagugggcccauagcccuaguuugccagccucuuauauggacacugauucucagggaagagcuauuuguuauuuaacuuucuacuccagccacucucaacuauaacagaaucaaauuaugaaucuuugccauugccuucugcguuucugggaaacaguagcagaaaaaaacaugaauguugagauugguaugaaaauggcaggaaaacacugagcucauuuuaauauuauacuuuuguuguggguuagccauuuaaaguuauaacugauucauugcccucuggaaaaaaaaauauauuuaagggacugcuucuacaucaguuuuaacuccucuaaaaauagcuacuguguacugacccagguaaaacuauaaauagcuacaacaguucauaucuucauaauauguuucuuaggggaugagauuucucuuuagcacaagccugagcauaccauauuaggcauaaaaacuuauauuagaaaucauuucugaaauucauaggaugggcuuuguauggucaacaguagguagacucuuuaauguacuuuucaaggugcuaucucuugauauuuuuauuuuguaauagcaaauguugauagguagggaucuaaguuguauuacuguuuaccuaaaaucuugcuacauguauucauguucugguuuagaauuucagaaagagagaaagaaauaaguggucucuggaaugaguuagauucuuugaaggaugcaguugaacaccagaggaagaaaaacaauguaaguagaucuuuaucagaaugaagcuuuucuuuuuauuacuuuaacacugaaauaugguucaggaauuuuuuuuaaaucuacuuuuacuuuagauuucuuaaucuuuguaagaaaguacuauuuucuguguguaguuuuuucggggggcggggcauuauuggagaacaguuuuuuuuaaauaagugaaaagaugaauucuuauucuuauaaauauuuaaauguugaagcuauaauuauuauaccuuuaguuauuuuaaaaagcuaaaaaugcaauugacuuuuuguugaacuuuuauuuggaaaaacauguuuuucagcuugguauuuuaaaaucaaagauauuuccucuuagauugggcuggccuuuuuguaaacuaaaaguaaugccaguauucaaacccaguauacucaguaauggggucuuuugaaagccuucuggaaccuccuccugcccuuuuuuuuuuuuuuuuuuuaagacagggucucgcucuguugcccaggcuggagguggcuugaacuuggcucacugcaaacucggccuccuggguucaggcgauucuccugccucacccuccugaguagcuggaacuacaggcgugcaccaccauacucagcuaauguuuuuuguauuuuuaguagaggugggguuuuaccauguaggccaggcuggucucgaacuccugaucucaagugauccaccugccucggccucgcaaagugcugggauuauaggugugagccacggcaccuggccagaaccucccauuuuuaacugagaggugguucaaauuuugguaauuaaguguguuagaggcuuuagaaccugacuacauuuauacuagaaagggaagggauagugcuuucagaaauaugaacccuaauaacuuacugaauagacaaacaauuuaguggaauuucuuaacuuuucucauaccagagggcaacaccuguaaguagaguccaagcauucuugcuagagaagaaauuuuuguacacuguagugugauugcuaagacuugagcaaggauaaaauguuacugaaaucuaagggaguauugcuaguaaauggauguguguuuucuguuuuucaaaguuuguguuaaauuguuaauuuaacaaguugacauuuucuuguaccccugaguuugucaaaauuagguacaugaauugccacuucuguguugguauaacaguacuaacagcauugcuuagccacaaaacuugaggugaacuugccgauauacugcuaacaucuuaacuguguuuuauuauuggacuucugagauaaggagggcaugguaaugcagcagcagcagcagcgcuggagacauugaacccgugugaaaagagccaggacacuggaggccagcagauagcagugucagucuuuccuucuaguuuugccacuucguuuucuguguauacuuggcucaguuuccuaacuuacuugagcugugguuucccuaucuauagaaugggaauaaauaccucaugggguuguuguaacggugagaauuugugaacugccaaguacagugguuggcauauauuaaguaauaaauggugauuauuggcuuuuuauuuuucguuguugguuuuuaucuguuuagauuucucauucugaaaaaaaagacugaaauauagcagauuauauuugugaaugaaaugcuguuaaaauccagaucucucaauuuuuaauaaccucuuucgccuccaagagaaucuauuuuauagccuuccagccuuccccuuugcuuugaucaacuagcucauacaauucauguaagguuguuuuguggcaugaauguuuggccaugccaagaaagacauaggacacaguggguuacuaugggauuccuagguagauuugaaacauguuaauuguauuaaaccauagagaaaaaacguuacacugcaguggaaaguccuaugaguguuauugggccucguuuaaacaucacaugaaaagcuuuuuauaauacuucuauauuugcucugucuuuaaucuucuaauguucaauguaccugaaaucauguauguauucuugguuugugucuuuacuuuugaaugcuuucuucuuugucacaugugcauaguaauuauuuuaaaagcuggccuauuugauauauauacuaaaacauggaaagugggcgucuuuauuuucucauucaaacuucuaaacauugcuuuuuauuuuuuugcuaauaugcauauuuucccauugaaauaauuuugcaguaaccagcauuuaaaugcagugcaaaauacugaugaaguaaaaaagcaaaaaucuuucaauaauggauaaacugaaaucauucuuucuaaaaaugauuaggaccuucgggagaaaaacugggaagcaauggaagcauuggcaucaacugaaaaaaugcugcaggacaaagugaacaagacuuccaagguuguaaugcuaacuccuagaaacaauccacugaacagagaaaaucugcagcuugucuuaaaaucagacuaaagcauuuacuuuuacugcaauuuaaauauaaaaucuccuuauccauauuuaucaucucuaucaucucugcuuuuuucaucuacuccuugaagcuuuaauuuugggcaugcugauuuguugugauuaccugauuguuugggcuuuguugagcacaacuuuaagcugaagagucucagaagaccgauguuaaccucuugucagacaauaugcgccuuuuggguugguuaagauaacuuucaugaaaacuuugaaccaaagaaaucuaggugaauuaacaaacacauuugaauauguaggaugugccauaaacuacguguuuuggagggcacaccaagaugucucagauaagguagagaaaugaucaaagucuuaaauacaggaaaggcaucaacuuuggguguguugcuuggaaugguuccuuagaggugguggacugaaacuucauguauuacuggcuagcaaugacacauggcauguuuagaugaaauauuacuaucaagggauaauucucuugaccagaguauguaaaguacuccugaaauauauagcccccucugucuucagaacaauggaggacauucuccuugagcucaaguuguaccauugggugugaagauuucuaaugaauuguaauagagaaguuguuuuuaaagauugagaaaauugaaucugccaguccaguuaaguauuuugaaaauuccugucaaguguaaaugugaaacagggguauugaauuuugcagacagguaaaagaaagaaccuacaugauuaauuuuagcacuaugaaaauauuuugugugccaugguacucuauugaaucuuuaauauaagucuuagugacaccugaaggaauguuuaagcauaaaauaguucuguaaauuuuuuuuuuuuuuagcaaguauacguuuguaguuacauuuccuguagcuuaguggauuuguauuuaacuauaucccuauuuaucuagccauaauuuucaguaaagguuaaauucgagauagcugagagguauauugggaccagagaguaggaaaaucuaggucagauaggacauuucauuauuauuucacugggaguaguugcaauuguacagucauuucugucagcgaugaggguuuuagugugguuucugguuguuuauauuacuuuguuuuugaugguuaagagccaccuuuuugguuuuauuuuuuuagugggacuggguaugugggugcuaaucacaccauuccuacaagaaguuacaugcuacuugccauaggcauuuuugcauuuuaugauucuaaaagaaagaauuuuugugcauaaugccuucuugcauagcuaaagaucuacagagaauagaauugaaagucuucuauauuucaauggaauuuagacaguccuuagauagcauacguguaaagggauguugauugacccagugccauaaauuauguugugaugaaaaggaacuaugugaaacacuuuuaguauuuuaacuagaaauaaguuacggucagcuuaccuaaaauguaaagaggaugauauaugcugucuuuacaggauuauuuuuaaaggcuaaauacucuugaggagcuacugaaagaaacucuuauacauuucacuuaaagaugguaugcaaauuauaguucaguuuucaauauuagaucuuucccagauguuaaaguggaauggaaauugcugucuauaaccaaacuacugugucagaugaaaacuacuuagcuaaaauuguuaauaccaaauaaaaguaacuucccauguuuguggcucuugguuauguuagauacuuuguucuuuuaguuagucuuuuuuuuuccuuggaaaguuuucaaaaagcuguuccucagugucucuuuuccuaaccgguuuucuuuaaagauuaguacuuuggucaaaugauaagaauuaccucuuaauguccuugaaauagcauuaauuauuuuccuuauuuuaugcaguuagguguauuccugaaaauuaguggacuucauugaauuauugaaaauauccuauuaaaacaccuauuguaaaaauacugcugcugaucuuuaacagcuuuuuguguguauggaaaauggcaaaaucuguagcuguuguguaaauuuucaugugauuagauuuucuaaaauugaaguguguagaccuugaaucagugauagauuucaaauuucacauauaaauguugggggaaagauaugguugagauguuucuagcuugcuugccuucuugucaccuguugaacuuugugacuguuguuuuuagaugauuuucuuggcuugguuuagaugugcauuuuuauaggggucuuuuuuuucaagucuuguggagguaguugaaauguuacauuuuuguuuuuggugcgugauaagucauuacccuaauuuugacaaaccaugguuuugaguuuauaauugauauccauuagacuuggauuuaauaucagcacauuuagacuuagacauuuguaauauuuguaaauuuauagcagaguccauauacaagugucagaacuaguuuuuaugauguguggcauuagugaaguaauaugccaucaguugcuccuuguucuuucuuuuucccauuuaugucauccaucagauuuugaugguccuccuuguuuagcauaaauacuucacaugaccuugaaguuggaaauaagagaguuaccauuuuaaugccaugauguuauauaguccaucagugaugcauuuuuuaauagagauauaccagccaauaaagcucaguuguguuccuccaauguguauuuucuacuauagguaguuuauaaaguuuuagcuauaagaaaugcuuuuugugugucugauuuugaauuguuccuggacaggcaaaucacuugauuucuaaaugccagggaaaauguccauauugucagauauugcuaaggcauuauuugauauuuaggaugcuuuagagauuuugcagauuuuuucuuaugggagcauuuuaauaucuuaaagugggaaauuuuaauauuuguuaguauuaaaaauuuuuuuuaaacuuuuucuucccguagaauuauaaaacacuauaguuuuuuucuuuucuuuuuuuaaaaacauucugugaucuuguaaguuugauuuggcucaucuucugcuuuaggaaaggcagcaacagguggaagcuguugaguuggaggcuaaagaaguucucaaaaaauuauuuccaaaggugucugucccuucuaauuugguaagacuaauuuauuauuuuuuuaacaugaugacauuauucaagaaaggugugaauaagcaacaucauuugcacuccacuugguuucaguagagugcugauuucuugaucuuuccuauuguuaagcuggugcuuuucaguaaagauuaauaacuugguucaaaacucauuucuauuuaccugauacuauuguuucuauaaaauuuuauauaugagacauuagaggauuaaaaacaucauauuugggaaagaaauguuuuuuaaugcuaauaaaaccaauaugguaacauucuuaauggcuuuauuuaaaacuuaauuuuaagugauugcuucuuaguuuuagcaacacuuccuuaauguacuugauacuaugaacuaggcucuuuacauuuuaaaacucaagauuuuuggucaucuauuaccuucuucaagcagaaaucuuacagauaauauagaacaacuugguuuacuugagguaguacauguucuccuuuguucagagaauuaauaauuauuugagggcagagaaagucagugaaugugcaugugaguuuccuaaaauagaguguagggucuuuuuuuuuuuuucuuauuuaauggaaaacuguucaacaguagagagacgagcauaaugaggccugauguacccaacaucucuccauagcacuuaucaguacauggcacgcauauaagcaaucuucuuuuaccucccaccuugcauucccuagauuauuuugaaggaacucaaacaucagagcauuucuucuguaaauauuucaguacacauuucuaaaacauaagcauuucuuuuuaaaaagugugauauuacacuuaaaaauacauucuuaauuuuguauaguaugcauuucuccaguugucauaaauugucuguuuuauuaaauaauaacuuacuguaguuuguuuuaaucaggauccgaauaaggucaguauguaacugguuugagacaucucuuagauauuuuuuaauccucggguuccccgacucuuucucagcaacaccccaccuccuuuaaaaaaaaaacaaaaacaaaacuuagugguuuccuaugaaguuucccacaguuuggauuuaguugacugcaucccugugguguuagcauguuccucuuuucuuuauguaucuuuuauguaucaaaucuguaaucaggaaucugauuccuggucagauuaaggcucaguauuuuggggguaggguagaguaggggcaagaccacuucaugggcgguggugugcacuuucaugaggagauucguaaugucugcuugucuuccuuuggcccauuggaacuuauuuagguuuguuaccaagucguuuugacacaaugcugcuaaacuuugauagcuucuaugcuuugugguaugauaaggugcuccugauuuaucauauacauuuccugccccaaacauagaaucaacuauuucuccaaggagcucugugggugcuaggggugggguaaguaaacuuaauggcuuguucuauuuguagucugaguuaaguauagccuacauuuauuucaaguaaggagagaaaacuccuuuguuuccauuguaacuaucgaggauauguuccgaucugaucaguuuaggagaucucuaccacuuuugaguugaacugaugaaauaccuagcacugaguaaacguauagauacacuaucaguucuagugcuguuguuaaauugaaccuaagagaaaggguugcuauuaauauauucaauuuuuuuuucuuuguggcauaaccuguuuuuguuucuacuuuauauuuauggaaauaauacugggggauguauuuuuuggcaguacuuuaugagccaagagaauuaaugauugauaauuucuguucuucaaagauuguauaagaucaccagcaguaaaaauuuucuuuucuaacagcaauacuacccacucucaguaaccagaucuuuuugacacuagaaauauuuauaagucaucauaauaaauggaugauacuguuuggcuuuuguucauauacuugucaaaaguugaauauuucugcauauagucuacaagaaauguacuaaacuuucuaugugcuaacauuagagucuggcauuuuagguuuguaaagauuugaaggacaauaaacuauuuauguuauaaaauaauaaagcaauaagcuucauuaauauuaagauaagucaagauaauuaguagauauaaaaauauauaaauuuuuuuacuguuuccucuugcuguuuugcugagcagucaacauaggagagaucuaaauuauaugaccuagaaggaaauuuacaaacuuuaagcaacaaaacuaguuuuuuaucuuauuuuaauuuauguuggguaccaauaguugaaacuguuaaguaggauucugauaguguacauuuagucuugguucagauuuauaaugugagaauguuaaauaguguuuuaaaacuaauuugauauuaaagguauuguacuauggagugacucagcaucuacuuuuguuuuuuguuauuugauaguuuccagagaauccugauucugcugcauauguaacaguuuauauuauagcaguuaauaaaaauuucaugaguuuuuuucuuaaauuuaauccaaagacuuaaaagaaggaauaagaggaaauuugauuuaaaguauguaacacacagauacacuuuaucaaaguguaaaauucagauaagcaucaauaauuuagaguaauuuauucuaaaauuuagaauaaaugccaaaacuguaauacaugcauauuuacaucagcuaaccugucagcacaaauugaguuuuuguuggauuuaaacaagugaauguguaugcauaucacuucucauuaggauuuuuaaaauacugaauaauauuuccuaauuugaaugaaauaauuuuagaguccuuggagcauuuucacagaauuugaaauccuccaaauggaacaucuuuaugaacucaaaauacuucacuuucacuuuaugaacucaaaauacuucauuuuugagaacugauuuaccuggaaacaguuuugaaaaauuagucuggguuuuuuguguuuuaaagauuauuuguccuggugcuaguaagugguagaggccagauuugaacccagguuuuucuacaugcaacugcagaauucaguugaaaauacucuugguuagguauauaauauuuuauuuugaugguagguacauaggucuguuuuuagugcuuguuuuucaaaguggguuauguccaacuuaugcaguaguuacauuccucuuugaaauuuguagcaauguccuguuugucuguguagguuucuuuuauaauuaucuaauuugguuauuuuaaauguuucaccuguuuuauuuggauuuuuuuuuucuuuggaaauuaaugauuuuaacuuuucucguccacagaguuauggugaaugguugcauggauuugaaaaaaaggcaaaagaauguauggcuggaacuucagggucagaggagguuaagguuaguucagcaaaugaacuguuuguaauuuaaacauagaaaaaagaagcaaauaagauuuugucuucauaagcuuggaaaagauaaaagauaaucgaauaaggcucuuuugagaaaguguaagaaggugauuucauuuuguuuaaauuuuaguugaaauacaguaaguugucuuugcauuugauuuguuuacaaagcuaguguuugccauuccuuuaacucuguauuuuaauuguuucuaaaauugaauauuuaucccuuacuaucuuuuuagccuagguuuaaaaaguaaagauuagucgagauagguagaaucucacugguuugcugaagcauccccaaauacgucauuagagguauuuagaaacuggauugguuuuuauccuuggcuacugaaauugggggggauuuauuauuauuguuuucuuguaucucaaguggcaugaauaaaauccucuuucccauguguguagcauaggcauugugaccauacuucacaugugggucugcuuugaucuuaccaccugacuaaagacuuuaguaccaagacuauuuauuauaacauuguuuaauaaaaaugaccaaaaggguuauugaaugaacuucaucgcuacuuagaaagguugaaauguaguguuuccuuauaaaacacuuugaaaccauuuaucauaauacaguauuaaguacuaaaacaaacuugaagcauaaaacuuucugguagaauuauggaguuuuucuuuauuucguucuuugcagguucuagagcacaaguugaaagaagcugaugaaaugcacacauuguuacagcuagagugugaaaaauacaaauccguccuugcagaaacaguaggaaaugauuuuuaaucuacauuuugauuuuacuuuaaaucauuaccuucuuccuucauggccuaaauaguuuuaucuuggcauuagaacaugaauuuuucaaaacaacuaugcuuuugucuguaggaaggaauuuuacagaagcuacagagaaguguugagcaagaagaaaauaaauggaaaguuaaggucgaugaaucacacaagacuauuaaacagguauuuacaaaagaaaagcuuagagcagugguucucgauguguggggcuugaaccagcagcaucagcaucaccaugcacauucuugggccccaacccagcuaccaaauccaaaacauguaugugggguggcagcagucuguguuuucaugagcccuccagaauagucuaaugcccacccaaguuugaaaaucacugguuuuaaaguaugacuaaaggguaaucauauagaauguagaaugcuaguuacagaacuauugugugauaagguaaagaauacuggguucaaaaucaguuuuaaaguauuuaacccauaauauagaauucaagaaaaagucauucuucuauuccugggaccugaauguuauuuugcaaccuuaauuuuucucccuuuuacuucagcgugauaaagaguaccauuacucacuuauuuuuuggggccaaugugcagaauuuacaguugcugaugguacucuaaugcacuugcagaauaaauacagcugaauaucaguuaauacuaauaaaaaauuaaucacuuuuagccgagccuaauauacaaauggaguagguuuggaccacaauuuaaaucaaguucaaugugacucauuuuuaaggucuuuuaaaauucaucucuuuuaaaugagaugcauuucaaaaccuuggaagugucuuuuaauugaucagaauucuacaggauagaaacugcuauauccuuggugguuuuacuuggccauguaauuguuucacauuucagaugcagucaucauuuacaucuucagaacaagagcuagagcgauuaagaagcgaaaauaaggauauugaaaauguauguuauuugauuguuuuacuuguaaccuauggauuuguuuuuagcauuaacgguugucugaagaucuauaguuuaagauuacuuuauaguuaugcucuuaauaucuuggguaguguuugaguugauauaguuuuauauucauaagugucauaauuuugucuuguggggaaauauuaugaaaggaaauuuuaaguguguuaacuuuuccuuuguugcauugcuagcugagaagagaacgagaacauuuggaaauggaacuagaaaaggcagagauggaacgaucuaccuauguuacagaagucagagagguacuuacaacagaaucuuuucaaacuugcuucucaauucagauuaaguuuauaacagugauauuucaguauaaguuguuuguggcagagcuuccgaguagcauacaaaacaugggcuaucauaaggagaucaaucuuaaacucuaaacuucauugcagcugaaagaucuguugacugaauugcagaaaaaacuugaugauucauauucugaagcaguaagacagaaugaagagcuaaauuugguaagaagcuuguccuccacuggguaucaaguaggcacugaaaacacuuuauugacauguggagaaaccauccaggcuuuuuuuucuuugcuaacaucuuuagcuuggccuuuuuguaagucuaagauaaucuucauauuccgaugauuccuaagauuaucuuucuuuucuugacuccuaaaaugauccuucuuuucuuagcuccuaacaauggcauguuuggcuuccaacucuuuuucaaaauuuuccauguuuuauaaauccuauuuucucaaacagcagucuuuucugugaauaaagaaaugaaauaaagauuggcugaguuacgaagauuuucuucucagacuaucauaguuaauggggccuuuuauuuucuaaccugggagaagauuauauugaaagucaaagacacauauucuucauucaagggcaguaaucuaauccaguuucuaauuuuaaccuagucucucuauauauuacaaauauuaaaaagcguauaagagucuuuauuaucaacauauuauuuagaguauaguaauccuaaaagcauaggcuuugagauaaaguuagcuaaaugucuuaaaacauauaauacccuguauuccuauucucaaguuuucuaaaaacuguacugauugugacagacuuagcuauuagacaaauauggcugucuugcucucuguuucaaacagcaauuguuaugucuuccuugugaguuaaaaauuguuacagcacagggauuagauuuuuuuuuuuuaaguaccuuaauaaacucucagaagauuacaguaguaaguuuuuuccuuacccaaaguucacccugcccaguuuggaauuuucuuguuagcauuacuccauguaccaagaaaacuuuaacucauucauuugugguugguauccuauguuauggcaaacauuuaugggaaucaauuuuuagaguagagcgguaugaaauacagguugcguauucuuuaucuggaaugcuuggaaccagcaauuuuggggggggauuuuggauuauuuguauuauaugcuugcucuguaugugucccuuaucugaaaauccgaaaucugaaaugcuccagugaacauuuccuuugagugucaugucagugcuuaaaaaguuuaggauuuuggagcauuucaaaguucagauuuucagauuagggauguucauacacacagagcccuacacacacagagcccuacaccucuaauuuuuaaaucuuuguuuuauguaccaauguuuuacuuuaacugaacucauucacccugcauugugagacugguucuaugcuaugcauugcacagauuaggacugugauaugucauggcuauaaguccucacucuauguuuuuaaaaaaucauuucuaacuaguuguuagaguuuuacuuauuaacuuuggugcuuaguggcugacucaacaguuacaugguuacaucuccacuuggcuuaaugcuuuauuuugauuuuuuaucccucuacuucugucaggagaucauuuuuagugguugauacuuacuuuuuuucccuagucuugaguuugggaucuuuauuuuaauguuuguuugcucagaauaacugcugcuacuuuuuaugauaaaauagcuuuguuugccuguacgugcuuuguguauucuugggccaaaagauuaauuucucugauggagaauauuaaaacucaaaguuguguaaaggaccagaauuuauuuggguacuuacauagaauuccucagauaaaauuuccaaguggaauuucccuccgccccacugccaccccuuuuuaauucucccuccaauuuuaaaugucacugccuugucuuucccccuuugggccucuagaacuguuucaaaagugcccaugggugggaagcaaaaacaauuaccuuaugagaauaagaagaaaguuuuuugggagcaguauaguucauuuuccuugcucauauuuaauuggaaaaucagagaagcggcauuauauauucgcauuggaguuacagaacuuucuguuuugacagauuggguuauucauagguauaucguaaagcauuucuugaugguauaauacaggccaguguggucuuguacuaccccuuagugaagccuuaaacgauggucaguauuuugggaguuuuaauuugacuggauuuguagucuucuauucaguguuuuuaaaaauauuguauaauugacucuuuaauugaacuguauagauuaagaaagccuuuaaaaacuaacggguaaaguaucuauuuggcuuuuaauuugaaauaauuucagugacuguuauaaauagugauaucuuuaaaagguacuuuacuggaauuugaugguuuuguuuuugcauuugcaguuuucuacucuaaacuguaguucauuucuguggcuuuucuuauguuuagcuuuacagaugggaaccucuacugcuuagccuuucuauacaucuggugcagcauauuggcuaauccacuguacauaauaacuguuagcagucccauucauucuucaguccuagagguaucagcauaaucaaagaaugaugcaaauuaaguuaauugugguguuccuuuauuuuuacaguugaaggcacaguuaaaugaaacacucacaaaacuuagaacugaacaaaaugaaagacagaagguagcuggugauuugcauaagguaggcacuguucguccuagagauguaguaucaugagccuguguuguguguucaaucuuaagcaaacuuaugcugcuaauucuggauuuguuguuuugcaucauaauauuaaccuuuuauaaauuuaagcugcuuguuauuaguuaguauuuuggaaugaaacguuuuggcuuguuuuuccaggauucuuaauucaccucauuauuuccucacauuucuauaauuaauugcuuuauaaaguacagaguaaaauuuaguuggaguuauuaaaauuuggcugcauccauauauuuuuuaaaauugggauuuggcuguguauucauuuacaaaguauguuucucuuggucuuuuggauaaaacaaagauauaaauuucuauuuuuuuuagauguuuuuccuucauuuauuucuucauacaaauauauuuuuccuaaucucaaugcaaaugaaugauuuuuaggacugcauuucuuugcauugguuugacagguuauuuguaauucuguuuugagaucuauuuuuaauaguagaauucacauauucuuauaucaaagcuguuuuagagcuaugauaguguuuauggauauaucaucauuagcaaaacaagugucacuuuuuggaauugcaagaacaagagguacgcacuuaaauuuugauaguauaaaauggaaucccagaaacccaacaguaguaauuuauacuccucucaacaugguaugagaacauguauuucccuauacccucaccaauauuagauacugucuaacauuuaaauauuugauauucuaauagauuuuaaaaguuaucucauuuuaaaaaauaauacuccuuuuaaagaguugaaagaaauuuuuuuuugauucuauaugcuuauaguuuauaauuguuauguaaaagucuaggaauccacaaguguugucagguuauuuuaguguagacagaaugugaauuugggucuguuuuagaggacaaacuuugaugcuuaauacacuguugugguugagcagucaguuuacuuugauacgugauuuuaauuuuugaccucuggaucaaaauauaaacauggaauuuagccuagcaauguaguuucuuagaaaguacuuuaaaaauaccaaacuggugcucaaaguuauauaauagauauaccaucuuauuuacaguagcuaagauggcaaugauaggugacaguuaacugccccauaccuauacaguagaaauauugugcaacauuugauuggaaaagcacauaaauauuugacuaaaaaaaguuuauaacggcugggcaugguggcucacgccuguaaucccaguacuuugggaggccaaggugggcggaucaccugaggucaggaguucaagaccagccuggccaacauggugaaacccccgucucuacuaaaaauacaaaaauuagccgggugugguggugcgcaccugcagucucagcuacucaggaggcugaggcagaagaauugcuugaauccgggaggcagagguugcagugagccgagauuacgcuacugcacucuagccugggugacagagaaagacugucuaaaaaaaaaaaaaaaaaaaaaaguuaauaacauacuuuguaaaauagguaaguauaaagcaguauguauguuaaagcucacuuauguaauauuuucuauaagcacauaauauguagagagggaucuaaacuagggguggacaaaucccaaagcuuuuuuaggguuugugggucacauaugaucucuuuagaauauuuuugucuccuuuuuaacauaacccuuuauuuuauuauauauuuuuugagauggaguuuugcucuuauugcccaggcuggagugcaauggcaccaucuuggcucacugcaaccuccgccucccagguucaguugauucuccuuccucagccucccuaguagcugggauuacaggcaugugccaccacaccuggcuaauuuuguauuuuuaguagagaugggguuucuccauguuggucaggcuggucucgaacucccgaccucaggugauccgcccgccuuggccucccaaagugcuaggauuacaggcgugagccaccgcgcccagcaacauggcccuuuaaaaaguaaaaaauauucuuagcuuguauucuguacaaaaacaggcuuugggccagauuugacuaaccuguaaucuagacuaauacuaaccuaaauaucaacuaugguuauuucuguuuuuaaauuucuuuguauaguuucugcauuacuuaagcuuuuaaaaacagugaacauauguucuuauaaucugguggggggugaagcuauuuucauuuuggagggaaaaaccugugucgucuuuugagaggagcuuuuaucuucuacaaaaugaauaaaauuauucauuuuuuauguauuuaucaacuguauuacuuaguagcuaccauauuguuuuccuuauaggcucaacagucacuggagcuuauccagucaaaaauaguaaaagcugcuggagacacuacuguuauugaaaauagugauguuuccccagaaacgguauguauuuucuucauccccagaucucugagcuaguuaccuugugaccuguguaaagaacaaaaauguauaagguccaucuccgaaagucaucuuucuugaaaauauccugucccuaaaauguaguguuuucauugauguuugaucucauuuuugcuuauugagguauguuaauuuuaaggguuguguugagagguauggagcggggguccccaauuccuggacuguggacagguaccagucaauggcuuuuuaggaaccaggccacacagcaggagaugaguggugggugaaugaccauugccgccugagcucugccuccugucagaucaguggcagcauuagauucucauaggagugcaaacccuauugugaacugcaugcuccuuaugagaaucuaaugccugaugaucugagguggaacaguuucauccugaaaccauccccgcacucacccaucuguggaaaaauugucuuccacaaaacuggucccuggugccaaaacgguuggguauugcuggccuagaguauagacucuggagcuagacugccuauguuugaauccuggcucugccacuuaguagccaugugaauuugggcagaucuuuagccacuuugugcuuuaguugccccaucuguaaaaggcaaugauaauaguaccuauccuguaggguuuuugaaagaaguaaaugaguuaauacauaaaacacuuaaaauaguaggugguacuuacaacagugccuggcacuuacuuacuaagagcucaguauauguuaacuuuuuuuacuguuuggaauguacuuucuuuugcggggcaaauuuucuuuuucugaaagaaaaaauggauauauuucugauauucauagauucuagauuuuuuuuccuuuuguguccaagugacaacauuuauaacauaguuuucuuuggugccaacuaguuugcaccacuaguuagcaaacaguauuucucuaugugguuuuuguuauuguugauuuucaugucauuguucagauuuuuuaauguuuguguuuaaaucagcaauauaacauuuucuguuguuugguuuuacauuucuuuuccuuguguauggaguuuaucaucacuuccaucuucuuuuuaggagucuucugagaaggagacaaugucuguaagucuaaaucagacuguaacacaguuacagcaguugcuucaggcgguaaaccaacagcucacaaaggagaaagagcacuaccagguguuagguaaggacaacugaaauauugcugucuauggguaauugauguuaugugucuguguaauguguauuuacauaaauaaacucacuucacuagaggaaauauuccuucuuuaucucucagaacuuccagaugacagccuuaagcuuucuuggagcuuuaguucuauuuugugcauaucuugaaggucuuguagcuuggagggguuaucugugccuccuuugaccuuuguaucaaacagacucucuuguaacuuggcugccuggguuuuuguguguugccuuaauaccugcaacggcuucguuaauuuauucuguucuuaguuuagaguaaguaucugugaccuuuucuccccccucccuuccuuccuccuuuccucccucccaaaauaaaaugaccauaacauuuuaacugagguaagguugcuaaacuggaaguaaggucaucacagugucuuaaaauugaaagcugguuuuuauucaaguuugcuuuuguuagguaaucuaagaaauucguucauuagcuccugaagugagauuuuuacuugaggauagcuaaacccauaauuaaccaagucauguuaugagcuuuuauugucuauauuaccuuggaaggcucagauuugguagcauuuuaaaaugacuuguauuccagccggugaaugcaguuuuuguuuuucugguuguaggguuuuuuuuuuuuuuucuguugcuaccuggauuuuaccuguuuuaugaauaacuuaagucacacugccuagaguguaauuagaguauucagauaugcacugaauacuucagauauucuucuuuugaagauauuuucucuaaaacaaucaugauauccuggagacccugaggggcaacucaucacugaauuaucccuuucagaaccccugauaauacuguguugggcuauacaaggccucagggagagcuuagguauccuggaaaaguugggauggacuuccauuuugaucuuacaggagcguuuugucucacuuuagagugaucauccucuggccuaccuugacacaugcucuccuucaaaaugcuaauucaggucaguuaucucuaacaugacuuuccauauaauaagcccagcucauucuucaacauaucaacaaaaguaauuaagccucagcucaaaucuuuuauccuugguaagcugacuucuccaguuucccaauguaaaaauucugccacauuuccucgcuuuuccaaauuaggaaauaaccuugcuuccuagggaaacuuccaucgcuucuucccaggacuucagccuuauucuuuccacuggcucccucuguucagucuugaaaacaugcucagauggcuuauuuuaaccuuguacuuccuucagguuaccacccuuauuuuuuuacuuuuuuacuauuuaguauucuuaagaaaauacucucuaucuacuuauuuauuguuauugauuacuuuauacacucuagaauggcuuuucuuccugcuauuucaaugaaaucauuuuugcaaaaaucauuaaugaucccuaauugcuagauccaauauaggcccuucuuuugcaugugaucagauacugaaaguacuuaaugaaauaugucaaaaaugcugacauuagaccuuugucuuauaagggaaggguuucauuucuagagagcuuaaacaauuaaaagauugccuauuaccccuugccuuucgaccuaagcgauauucucucuuuagcaucucauagauguucuuuaauauuuuccuuuucuuccuaaauacauagucugcucauuuuaagucuugugaacuauuuuuggcuuguccauugccacauuuguuuuaauuguauuacacuugagacauaugaaucauugauaauaacacuuuuucuuuuugauuugcagaauuauaguaauuuauuaaaauaugucuguauacccucacaacgcaguuggcaggcagcuccccuccuaacugauagcacaacauucuuuugucagcugauaaacauaaguccaaguuuggcaagugggugguugacaguauuauaucaugaaugauaggcuggauuguuaugaaaauagaggcccaccaggcacucucgaacuucuucauuccuuaggcucuaccuggcauugacauugauaauucuuccuuguguacuuauguuuugguucccguagcucuucuuuauacccguuaaauguuuguguuacccucagguuuuuauccuuagcuaucauuuuugcuacauauauucucccuccuguauacucuauuuaaacugacacgagaugauuacauugaaaauacacauuucucaaucauuagaauguagguaauagcuuaauauaucuaaugucaagaaaccuuuaaaaauauacacaaguacuuaugaauuguuuaugauaaugcugcacauauucaauaaagggagaguuguuuuuaaaaacaaauaugcaagaaauaauaugcauugauguaguuuuucuaaauccugauacauaguacuuagcguuucuuagagcuguagggguagguguauuuaacugauaucuuuaauuugugaaaacuuuucuuuuggaaauuuuuuuccccauuaccuauuuuuccuccccccaucaaaaaaagaaaaggguaccauccuccgcuuuccauuuguggggagugggagauugauuaagaugccuuuuauaugaauugacaguauuggcauuuuauaauauacuuuuuuguucccagauaucuacucuuuauguuucacauuugccugguuucuaaguuuucuagguguauuucuaaccaaaucagaaaacuuuauuaucccagguuaccuuaucuuggaaccaguuuauagaauccuguugagggaggaugauaauuuaaauagcugauacuucaugaguaugccuguuagcauaagcaugcuuccaacauguggcaacuccuuuaaucuucacaaccacccuguguguuagguagguagguauuauuauuaccauguuacaacagacccaaagagauucuauaacuuguccaaggucauacggcuaauaaaugggcgagcugggguuuaaaucaagguaauuuggguacagggcuuguguucuuaaucagugcuuuucuucucccuaauucaggcacuguguucacugaucccuuuugucacuguuuucuuuucuccucauuuugucuuuuuauuuuuuuuuggccagccucuuagaaguuuugucaaucaauucugacuuuuuccuaaaguugauauuugguuugucaguagcguauuggagaggcuuacaguaguauccagaagaaauggaggugaagcucuguguguacucucuguacucccuuuaacaaauagauucuuaaguguuucugaaagaaaaaguccuuuuguagggcuccugaaguacaagaguuaaugcucuggagaaaaacuuaucuuauuucuacacugaaccuuagcuaucauauggaucagguuuucauuuucuguguuuacauagcacuuuagaguuuaauguacuagugaucuuuuuagacuuuccgaucaacuguuaauagccagugauaacuuugcuuuuuaauuuuccaauugcuucuuuccucuaaacuuuuuauuucaacacauaaaguugaaagaauaguacaacacccguaaacccuccaccugcuucaucucuuucuauaugucuacauauuuuguuguuaaacuaauugaaaguaacuuuuagucauuaugacauuuuaucucuaaguacuuuagcacacaucuccgaaaacaagacauuguuuuaccaaucagugguaccauuauuacaaccaaaaagacaaaauaguaguuauguacuauccaauauuaaacguuuauucacauuuugucaauuguacccaaaauagcuuuuuaacuauuuuccccaaaccagaauccaaggcaaaauuuaacauguuguguuuuguuaaguccucuuagucucucuaauggcuuuugaaguuuaauuucuuuagucaucuuaucugacuuagaaaacuucauaugaccuaaaaaaaaaaaaaaaaaucuauuucugcucuuuuaaauuauuuauucacugggguaagguuguauucaaccccuuuucagugcuacucacucacuuuagcuuuacauucucuugaguaggacuaauaaaaauggauuaccaguguuguuguuuuaaauguuuucuaacagaauuuggcucacauuuaaaaguaucuaccuaaaagcuuguuuccuuugaauccugagauuuuucucaguuugauuaccauuagugugaauugcuuugagucuauuugaaagggccaugcuagaucaaauggaauauguacuuuugguguuugacaaaugucuucugauugccuucuguugcuuuguuuuaaagugaaauucauucuuucugaucuuuuacagagugaaguaauugggaaacuguucauuugaggauaaaaaaggcauuguauuauauuuugccaaauuaaagccuuauuuauguuuucacccuuucuacuuugucagaaacacugaacagaguuuugucuuuucuaauccuuguuagacuacugauuuaaagaaggaaaaaaaaaagccaacucuguagacaccuucagaguuuaguuuuauaauaaaaacuguuugaauaauuagaccuuuacauuccugaagauaaacauguaaucuuuuaucuuauuuugcucaauaaaauuguucagaagaucaaagugguaaagacaauguaaaauuuaacauuuuaauacugauguuguacacuguuuuacuuaacauuuugggaaguaacugccucugacuucaacucaagaaaacacuuuuuuguugcuaauguaaucgguuuuuguaauggcgucagcaaauaaaaggaugcuuauuauucaaacuugacuuguucuaauuuuuauugagcuuuaacagauuucauuaguaguacagaucauuguaauuuagaauacagcuauuaauuggcaaccauucaacaagauagguuuauguagccucuguaaccuuucuaacugaugcucuggguccucuucaguuugguccaauguaaagugccccaggagugcugggguuucagaaaggacagagcaagcauuuaggauuucagacuaaacacccacacuucagguagaggagcucuauuuuuaccauuacuauuuuuuuuugaaguaauaauaauuaacuguuaguuuucuuuuucaggcacgguuacacaguuuacauguguuaucuuuuuuguuguuguuguuguuguuacuguuuuuuugauacagagucucacucuguuguccacgcaggagugcauuggcacuaucugggcuuacugcaaccuccaccucccgguucaagcaauucucauguagcugggauuacaggcgccugccgccaugccuggcuaauuuuuguauuuuuaguagaaagaguuuuucaccuuguuggccaggcuggucucgaacugcugaccucaagugauccacccaucccaaagugcucggauuaccggugugagccacugugcccagccaaugaaaguuuuuuuaauaauuuguuaaaaacacuucagaugcuaaauaaccacugagaaauaucuugugccauugaguacuaaaguacccauuaggcugcacuguggucaucuuguuauuuuugugcacauaacagucaugcuucugucauggggccucugcauuuucuguucucugggcuuggaac

SEQ ID NO: 17538 - RNA, 2587 nt, Homo sapiens
ucuccucuggugugucagcuuuggcuugcuccuucacuauguugaaaucugcuuaaaugucacccuucuaauuaagucuuuccugacuguccgcuauccuucugcccucccuauucugccuuauugucugucauacuugauuucuacucuccuuguucccaccaguaaguaagcuccacaaggacaagaaacaucucuuugguucuuugcuguaucuguagccugagacagugccugauacuucauugugcucaacuauuuaaaugagugaauggauaaaauucauuuuuggagguugaagauuaucuaaaguggugcuuccuuaccuuuucacuucacugcacauauaguauuucuaaggcauauagaaaucaacugaagugacuucuuauggccagugaggacugguguggggauucaagcuaccuuuuucuaccuuugcugcuuucagcaaauccuugggaaauugaucugaaggccagauacuacaucaucagccucuuuccuuuguccuuucccauugccuaaaggugcucauguugcugccaccuguaacgaacaaauucugccuuccaaguuacagugucuucuugcuacucuuucucucuucagagcuaaguuccucagaauaauuguguaauucuauuauuuuuucaaccuuucuguauguuugaauuaaaaaaaauaaauuucaaaggacucuggggacacaguccagucuccugucaguuuguaucccuucccucaacaucucaaccuuacagucauucaucuuuugccucugaaguagcaggaaguucauaacauugccuuuucuaacuugacagcuguaacuguuaaugguucuucuaugacauuauuaaaaguugugucccugauacuugcaucaaucuguccuuucucacuacagaaucacauaggaaaaucuuaucacacucucagugauuguucagauaugcaaagauaauucugugcucuacguucauuccccuuacaguuaaauauucgcagcuccuuaguugcacugagugauuaaaggccaaacuagccuccuugccucaauccccgacuguccaccuucucccaguauauuacaaaccuaucuccaggagaggaagggagcaucagaagagaaggaauucugugucaucaaacucaaauggcucuccuugccaccaucacagucaacugaggcagaaagccccaagaaaauuacacauugaaggaagcuuacaggaagagaauaaagaauagucaggggcagacuucuugaucccccaaaagagaagagagagacguggaagggaggaguggggaugccugugaagccggccauacccuuggguuuggcguaggaaaacuaauucauuuccuggagguagugauauuguguaaagcaucgaggcuugagcugccuugcaugcguuucacucuagcugcaagaggcuaugugguguauagcugugggcaauagcuguguugcucacagaguuagagcuagauuuuucaugugucuugcaucccgggacagagacugcauaugggcaccugccacuuguggaaucugcccaggaugagauguagggagaagcaguuaccaccagaaggaggcugcaguuauacccucguuuguuaagacacguuugucccuugaccucauucauuuggguccccagaaaaggaagggcaaaggaagaaugaaagaaaagacgauuccuuguugacauuauuaaagccagggggcagaugggagauggguuauuacacuggguuggacuggacuuguauuaaccgaaguuacagaacagcuuuugggucugcuuaggaugugcagaagagggagacuccgcaaagcagaguugaagacuaugguugggaaaggacacuaacuuguuaggcuguucugcaaccugggugguagauuuuuuuuucuugacuacauuuuugucauuuuuauuuuccuagaaaaucuggccauuucauauuuguuggcagaguucuacaaggcagccaacauaccacuuguacaaccuaucacaugccagauguuuuuuaagcaguuacguuaguucauuuaaucuucccuagaauuuaacuggccaggggguugugcuuucaucaucuucauuuuauagauaaggaaacugaggcacagggaggauaauuaaauuaaggucucacagcuacuaaguagaggaaccagguuuccaaccuccaaccuaagcugucuggcuugauugccuuauuuauacucauaaaaaaaauuuuuuuuauauauguaugcauuuauaaaugugaguguaauuauauaaauuacuggaguaauuuuuaaaauuagacuauacauagucugauaauuuuuaaauuuacucauuuuuuucccuccauuuguuccuguuguuaaggugccuucucucauuuugucuugauucuacuuugcaagggauugccuaccuuugugguucucaaaaguaugguuugcaguccacugggaaucuccaagacccuuucuaggaguuugcaaggucaaacuuaauuuucauaauaagacguuauuugccuuuuucaccauauugaaucugcgcug

SEQ ID NO: 17539 - RNA, 669 nt, Homo sapiens
ugaguuguuuuuugucuccucggguuguugaucauucuagugagcacaauuucagccuuuuugaugaguuauuccaaacauuaaguacuguacgguuugaaaaucuuagcuaacaaaagcauuuuuggaguggcuuuauaauuuauaagucaucugcaagucuuuuugcauuuguuaaucuccaauauuaucugaaauuuguugagagcguggcaguugaagaauagccuagcuuacugagaaccaugcuucuggcagacuggaacauaagcagcuuucacccaggagagcuaaugcaugacacagauuuucaagcuuuuaaaggucaccugacaugaaauaacagaacuaacagagauucgaguaggugggguaaucuauacaagcauccugcagguacaggaugguggaaggaccagaagaauguuuuaacacugcauuugggugguuaaaggacaggaugaagagcucauuuauauugguuguaccugucugugacugucggcaguaagaagguaguacaguuccugaaauacuuuaugucuccuccacaccauggagaacaguucuguguuggugagaagcaagccaaggcagaagauggcucuuguguggugcaguuuacaaaagagagacaaaauuugauagcagccacugcugccagccacc

SEQ ID NO: 17540 - RNA, 9889 nt, Homo sapiens
cucccccuguuguguguuuuuauuauuuucccucuggcuuagaugugucaaucauucucucccugccauugguuggagaguuugcgucaaaaaguugccagagaggcgcuuucucagcaaaucucccugagagcgggaccggccucagcuccaacacagccuccacugugauuaaaaauaaaaauugcuagagcagcccucacucgccacaucuacuuuguauguauugcagaggggcccacgcguguuuagaacucuagccgccuuccucauuuucguucuuuaaaaaaaauuuuuuuugguuguguuugacuuuucauggaagggugaagacugcaagguuucuaacucaauacucuugauuucuuuuaggauagcuggcuauuuggaauuuaaaggauauuugacuuuuucuaaccucccaugaggcuguaagguaaguguccgucugucuugucuauauccauaucuacguguccccgugucugucggccaucaccccaguaccuccaauagaccgaccgaugccccucugcgaacguggaguucuguaggcggauguauuuuuucucuuacaaauuuugagguguaauaacgaucguugcaaaaagaaaaaugugaucuagagaugagagcgguagugggagagaggcagagagcgugcuccugggggucgucgcuucugcaaaacgucgucgaaacgcugcgaauguaaucugggguguuuuggaagguuuuguuugugguuuuguuuuuaugucaacgccguucugggcuucucccgcgaucuuugcguuuuggcccccagauuugguuggggucguuuggauggaucccagggaccuuuuuagaguccgagacaaaaagaugcagauguaacuagauggauggauugaaacaacaauaauaaaaagccaggcgccuccuugggcccgcgcgccggaagcucgguucgcuugcgggucggccugggccgggggccgccgcucgagccccugucggccccuguugaacgugagcggaaaccggagcggauaaccgaggaggcugggagcgcuggcuucucguccgccccggcgcucacugcucgcucucuuuggccuccucucccucagccuagcacagcucgguugucuguuucucccaaaagcuuccagaucuccuuuuuguuuuuaaauauccaccaccccccaaaauccaaaccacccuggguuguaauuacgcagccucccaacccccgguugucgugguccccgacccuggucaccaggccgagcgaacgugaagaguguuuuuucaacaugacuuugccgggucgcggcccgccccacguagcccuccgcgcgcaccuggggcgggcagaaguggcagcuaguggccccugcuccgcccaaggccgcggccgggccagggaccggaauccucccgcugggaccgcggccccucagcuguucucuggcggggagaggcagggcucgcccgcgcgcucgcgcacccccuucccaggcuccaggacaaugaggugucguggcucggggccgggcgggggccgagggguucgccgaggcccagccugugccauggaucggcccaguaagaaccauccgaaggucccugccagcgccgggcgcgggcgacgggucgcucugcaaacucccaagaagucuucgcguuguugcguucaagugacucuugaaaucgaugcccgauuucgggacauauuuuuggaaacccaaguccccugucaggauuccaccgaguuggcuuuugcuuccuucacagauagaacuggugcgcggggagcgaaggccgagcggcgccgacccugcggugguggauugcuuggggaggggacggggaagucgcuccuagaaauucuccccuccauccuagagcuucggggucaggauuucuccugcucagcucgggacuuuuuacaggcaccaaaaguuauuagcaacagaggggaguaggagagggaacuccuccccccagaguaagguagacacccagaccucagcgcuaacaccggggcuuucucccaacgauaauuaauagucaaggccaacccuuuuggcacguuucuuccucccucccucgcggguggcagaguuauuugauuccccgaggccagaaacuuucacucgaguucgccggagagaggccagcgccggccguuuuccgcggugcccacacgucuccuuuuucuuucuuuccuccucuucgucgucuucccagccgcaggccagucgccaguccgcguaguuuuguuuccuuuccaucaugcagaaaauuaaucagcccggacgagaagcagagaggagcauggcggccuguaauuaagggacgugugccccucggauuaucucguuaguuuaucaagaaaacauuuauuauaauuaauucucggacgagguaauuauuguugagcgaggacacagcaacugguagaugggcuucuuggaagaaaaaaaaaacaaggcgugggggagggagaagcgacagauugcacgaauugaccguuagauauaaggcugcgcggggggcgcgggcaguggagcgggaccucgggcgccaggccugcggggcugcggggcugcggggcugcggggcugcggggcugccgggcaggaacgcgggacccaggcacucgcgcccggaggugcggucgccgaccggcugccggaacucgccgcgcgaccgcggucagcuucuagguaugaguucuccagaggccaccucgugagcagucauagugaggcguggauuuuucaaaaguuauuucuuuuccccguucuggacccugcuucgagaggaaaagagcuuugaaaguuagauugaagggcccaugccuucuaugcagagugcauaccuaggccgguuguggagagaaucucuuaguuuuggguuuugguuuuccucuuuuccuuuuaaagguggauccaggagcaaaagugaaaauagucuauuuugagaauuuuagccauuuugcaaugguaagggcaaaggagccccuggaaggaucucggcccuggugcuuucuguguguuacuggcuuuuuauguuggaaugugcuacuuuauuguaugaugugucaggcauuucuaauugggugagagcucuacauguaagaacauuuccauauuucucaaggguacaucugauaugauuuuacgauucucuauagcacuguaguucagaauuuugcaagguaguacgauuaaacaaaaaaucuccaaucuccaguuuagaggcuguuuaaacacauauacaacuguauuuuaaagcugucgcauauguguuuaaacagccucuaagcuggagauuuuuguuuauuuucgcagccuccaaagaacagcauuuugaaaagaaaagacaauacaaaaacauaaagucuguauuguaggggcaacuaaauuaguuguacugaggauaauacaaacuccuccaagaaagacauuuauaaaauuauauuaaguuagaucuuaggguagaaaagcaugacuuuugugcucugaauuuaaaucagaaagaaguugcaguuacuaaguuucauuuauggacuuuugugccuugcugucuuaagcaacguaaauaugaaaacccggaguccuuuaaagucagugagaccuuuaucuuguauccgccauuuugaagcaaucucucauggugucaaaguuucaaaguagagauccuugcauauaagugccacauuuuaggaaaauaaaggccagacuugcaaacugccagucuauauuaacaucuacuuugaaucucuuugcugggguggaggcggggagcucagcugaagaaaguaaauaacuuuucuuuuucuuccuuucuuuucccccuugagcucuuuuucuuauaggauuguaggaaacuugaaagguagggagaaauucuacuaguuucacaacuuuggguguuuguguaucuacuuucuucaaaacuaaaaugugcaaaaggcaguuagaguuaacaggaaacucugcugcagcugccgaggacccaaaugucugaaaauuugccucccgcaggaucugcagccuccacacaucaaaaucaacauggaagcagcuugcacuacaaauguggggucccgucauuaucugauuggugggauucuaacuuuacuucacaauuucuggcaagcccugugccaaucuugaagacuuuuuuggaauaugcuuaaauauuugaugggugucuauuaaaaguuaaauacuuguuuguuuagcuuucguuccuuagacacauauaaucaagauucuccaaaacccuaauaaaucuguuacuuaccucgaaaucuaauuacccagacuacuaauuaggugaaaaugauuaccggaaaugacuucaaauguggaauaauagugguugagcgguuuuuccaaguuugugguuuagugaguugguauuuuagauguuaaacgcacugacauuuuagguucgcagcaguugaaagugguaaaaagcuaagauaauuaaaaucucugccauggaaaggcaacagucuggggagagguagauuucuugaauuguuucuuuguuucucaccaaugggcuuuguuaucagcauuauuuauuuagccaaagaguucuuugucucugcaaauggccccaaucaaguuuuguuugagacaauuagcuagugccagccaaugaguccuaugcaaauguagggauaggaaugcaaugugugcauuugaaggcacggguuuuuguucuuggggaaggcagauuguaauugcuuucuucggguacuuuuuuuuuuuuuuuaaguuuaggguggggguggggaagacagguuuaucuggucuccuuccauccccucuaguuccagagcagcuggggguggggguggggauggggguggggggagugucugcaaguccuuuaaaagccucugccucgccuaguccgugcucuuuuuaaguuagugcuggaacguggaagagcugcugccuccgaagcaguaaaccagccccucuguuuguuuguuugcuuugcccuuaguuccacugcuccaaacccacccaccaaggacucugaaccuguccaccccgggcgcaucaagaucuuccagcuggguacccccgauuugggccgacuuugcaccuccaaacaaccuuagcaugaugucuuaucuuaagcaaccgccuuacgcagucaaugggcugagucugaccacuucggguauggacuugcugcaccccuccgugggcuacccggguaagugagcccugcugcacucccgcaccccucuuccccaugcccacccuccggggaugcaacacccuguucccauggaacacggggguuggcagucacacuguccccacccagcuucaggcuuggucuccucuagguuugccuucugaggaagcagucccagggcauuuacugaccaagcagagaacagggguugggaaaagugaguaggugggucugcaaccguuacaaucacaucacuuuauucuuaauucgaguaaauaaggauuggcaucagagugggaugaggaagguuacuguccuugucauuugggcaaaagaccccuacccauaucucaaugaccaauuccucagaaguguccucuuggagaagcugaguuuucccuccguaaguccuuagcacucucgggcuucgcaguuguucccuccaugcccaggccuuccccuaugaccuccagagccugcuuuaaucccaagaggcgugacuuccuccaaaugcgggugcuuuccuuuccaaucagauauguuuaaaaauccucccaggaguaugaacuauguccccauuuuaaagauggaggaacaaaggcccauggugugcuaaaaaccaugggaacaggauccagauuucccccaucaauucgagcugccagucuguccucggagauccuuugacuucuuggaauagccuuuuuguguugugguuuggggguugaucuuggagaacuuuuuugugugucuuuuaaaaaauguuucauuuguuaacuuuccaagugaugcucugauuggagcaaucucaacaccaagaagaguagggaaagaagcagcguguguccuggguccccggggagcaaggcuggggagacgguggggagagcauugguaggcucccggcugaagggcugugaggaacgggggacugcugcgggguggagggcaggggcgucggagaacccgcggaaacgccuaugacugagaaacugcucccccacccuaaagggcccugggcuucuugucccgcagccaccccccggaaacagcgccgggagaggacgacguucacucgggcgcagcuagaugugcuggaagcacuguuugccaagacccgguacccagacaucuucaugcgagaggagguggcacugaaaaucaacuugcccgagucgagggugcagguagggcagaugcaggcagaaccauccuuccugaucaugccacccuucccgaguaugggacuguggagagccccaggucuuucagaggacugaaggaaggcuugaaauucuccuucacucacuaaggggccaggaaacuauucuccuucugcccuuuuuugccugcccgucaccacuuaaucccguaagcaagggucuucaaggcccggguugcugguggagagagacccauccuugagcagguuucaagaguagucacgugguguuguaacccuucccuuccucuguauagaaauccucuccuauucucauggacuuguacgugugaaagcagcuuagcucuuggacaguccaaguauuuuuacagaugaaaaaauagaguaaaugacuugcucaaggucauaacuaaguuugguggcagagucaggguauagacgcagcuggugcuuuuaccaaauaaaucaacacaaaaagaauguauuuuccuugacuucuuagggauugaagagaauuuucuaguucugagccauuuaacagauaaaauaucuacauaaugucucuagugacaccccucuuguuuuaguuccccuaaacuugaccuuaaacuggagagggaaggucaacuccagcuugccuugugagugagcccuguacagaauucucugcaaaguguuuagcacauaaaccacauacacaccugggccucuccuucggcuagaauauguuuaugaaagcgacagacaucagugucagcugcaaauugggaaaggggcuuuuucaaaguagguuagaggaaguuuuagcacuugcaaggcuugaaccaaaguccucacuaggagaaaacaaauggcuccaaaugguugguggucuugagcuuggccuugguggccucacuuuuaccacaguuacggcacccauacagagagcucauucaaaaguucagcuaaggauuuguccuccagaaaaugccaguaguuccucuucuaagcccccucguacaccaaucauagcuccuucauugcagaacaugaacagggcugguaaagagaauugucaagauugcagcaggggguugaagugguaagucaguaaacacagcacaggagacugagucuaugugcugaguggcacuacucuaacaacacagacucgagucccagagacuagcaggucugugcuccagcucaaagcagagugcauguaagucacuccuuuuaccacaaagaagcuuuuagcaaauaguggcuuucagaccucuuucuucaacaagaucaugucuuccccuuggagcuuuguucugugagucuuucuaagagagacagaagggugauggaaccaaccaaccucuauauuagcaguugcuuccuggaagaugaacuguaaaugaauuuaggcuguuccuguuagccuguaacaacagaauugcuuucucucacuucucauguauuucccuccaaaagacagagauacauucuauuccucugugagaguguuccaaaauauagcugggucuauguguauguguguguuagaggcgaaauaagauaggaaagugauguggagaguuuuuagcuauaugauuugggggauuaucuuaaauguuauucugggcaagaaauaagacagugucaaguguuuuuagacagagccuccccaacuuucuuacaaguccaggaguuuauaugagaguaccacauaauaggucuucaguggcaggggaaauuguguguuuagcugaucugcccauguaggauagauuuauaauacgggagccauucuuguccuuaaggaacuaucaaaaccgaguuaaagaauuuucuuucccuuccaagguaugguuuaagaaucgaagagcuaagugccgccaacaacagcaacaacagcagaauggaggucaaaacaaagugagaccugccaaaaagaagacaucuccagcucgggaagugaguucagagaguggaacaaguggccaauucacuccccccucuagcaccucagucccgaccauugccagcagcagugcuccugugucuaucuggagcccagcuuccaucuccccacugucagaucccuuguccaccuccucuuccugcaugcagagguccuaucccaugaccuauacucaggcuucagguuauagucaaggauaugcuggcucaacuuccuacuuugggggcauggacuguggaucauauuugaccccuaugcaucaccagcuucccggaccaggggccacacucagucccauggguaccaaugcagucaccagccaucucaaucaguccccagcuucucuuuccacccagggauauggagcuucaagcuuggguuuuaacucaaccacugauugcuuggauuauaaggaccaaacugccuccuggaagcuuaacuucaaugcugacugcuuggauuauaaagaucagacauccucguggaaauuccagguuuugugaagaccuguagaaccucuuuuugugggugauuuuuaaauauacugggcuggacauuccaguuuuagccaggcauugguuaaaagaguuagaugggaugaugcucagacucaucugaucaaaguuccgagaggcauagaaggaaaaacgaagggccuuagaggggccuacaaaccagcaacaugaaauggacaaaccaaucugcuuaagauccugucauaguuuuagaucauugguuauccugauuugcaaagugaucaaaagcauucuagccaugugcaaccaaacaccaccaaaaauaaaaucaaacaaaacuaaguugugaaggaagggagggaaggucauagccuucuuaagcagagguguuccauuguuuuagccaauccuugguugaaucuuaggaaugaacagugucucaagcucauucacguuucaugaccaacugguaguuggcacugaaaaaacuuuucagggcugugugaauugugugacugauuguccuagaugcacuacuuuauuuaaaaaauaauguucauaaggagucaauauguaguuuaagagacaaucagugugugucuuauaaaugguacaucugugguuuuuaaucugugcuagacuucaaaacugugaucuccuguuauuguaugcaaccuugaacuccaccucugcagggguucuucugugauuaaauagguuauaauuauaagcaaaauucagagcaacugaguacugaucuaaaaagauuaccuuuggcuggaggugagcugcacugaaacuuuacgacaaaaugucucuggacaaagagagucagagaagagaagcaaaaggacacuaauucaucuguaauuuacuguugguaagccuagcaguaaagagacauuggucaauugcucugacccugaugaauuauuaaacugagaucauugucguuuaugcuugcagauguuaaauggaaaaguuauauaugcauaaaccuuuucuuccuggauuuggcagauauguauaauuauauuaaaaugguucuagcacaac

SEQ ID NO: 17541 - RNA, 1986 nt, Homo sapiens
aaaaguaagugauuguucuuuuacagugcgauguaugauguauggcuuuggggaugaccagaauccuuauacugagucaguggauauucuugaagaucuugucauagaguuuaucacugaaaugguaagauucuuuccuaacuggucuuaguuaauugaagaauagauuugaaauauuaaacuuuagguaagacuagaacuuauggcaucccuuugaaauaagcuauccauuugagugcuuguuugcagaaguuauugguuacuauuuaucauugaggauggagguuauacauguauauucuauccccccuucuuccuuuuguuuuuuuuuuuuuuugagauggaguuucguucuuguugcccagacuggagugcaauggcacgaucuuggcucacugcaaccuccgucucccggauucaagggauucuccugccucagccuccgaggagcugggauuacaggcaugcaucaccacacccagcuaauuuuguauuuuuaguagagacaggguuucuccauguuggucaggcuggucucaaacucccaaccucaggugauccgccagccucggccucccaaagugcugggauuacaagcgugagccaacgcgcccagccucuugcauuuuuuauaaggacauaauuauaaaauccuugaauaaaauaaaaauauuauccauaauaccauuauccaacauagguuuuuuuuuuuccccuccuuuuccaguauuuaaagauacgcaauuuuuugugugugugugucugugugugugacaggaucucacucuguugcccaggcuggagugcaguggcaugaucauugcucacugcagcugagaccuuccggacucaagugguccucccaccucagccucccaaauaccugggacuacaggcacaugccaccaugcuuugcugauuuuugaauuuuuuguagagacagggucucacuauguugcccagguuggucuugaacugcuggguucaagcaaucuacccccucagccucccaaagugcuggauuacaggcaugagccacugugucuggcucaaugccguauuauuaaguauuuagcuucuauuuuuuaaucauuagaaauaaugcugugauaggucuuugauuuugcacaggugaguauauaaugacaggaugagauagaguuauuugauuuuuagaaaacccaccaauauuuauuggguauuaagauagaggaggacacaaagcauaaaugaaauggguggguacacaaaauuauaaaauuauuuuauauaaaugaagacaaaaucuacauauaucaaaaaacaaaaaaggaacaauaaaguugacagcuuucauguccuuaagauuuuuuuuaaagugccugugaagcauaaaggagaacauugcuaauaauccaguagaaaauagacaaaggacaugaguagaaagauaauucacaaaugaauagccauaauaauaauaauaagagaaaaucuucuaccucacuugcaauuaauaaaugcaaauuaaaacaguaaaauauuagauuuaaaaaaguuaaauguaauauguuucuuuguaauagacucacaaggcaaugucaauuggaagacaaggucgaguacaaguugaagauaucgucuucuugauucgaaaggacccaaggaaguuugccaggguuaaagacuugcuuacuaugaaugaagaauugaaacgagcuagaaaagcauuugaugaagcaaauuauggaucuugacacuuuuuguaguuuccgaaaauuaccaucuggggaaaccauauauaauaauuguauauuuucuaaaguaagauucugauaucuagccauguaaaugaaagauggagaaacacaaaguuuucagccuuuauuuuuaugccuuugauuuuagggugauauuggugcauguaauugccugccuuuauauuaccauacuugaauuacuuacuggguuuuaaugaccacacauaagucaaaguaccuugcaaac

SEQ ID NO: 17542 - RNA, 23072 nt, Homo sapiens
ucucuaacccuuccccaggugugcuagcaauugcccaacaccugucagucacuuuugccuccaauuuuacugggugcgaggagcagaguaaggagggagaggaagagggcugacucccuugccucaaaguggcaagggccagcugaacuuaauucacacugcaaaccaccacguuucgacagccauccccauauuuucacagcucaaaucuuccuuucuuuuucggucggcuucucugauuugcuccauuuuuaaucgcuccucccccauccuccuugccccuggucagggcaaacauuaaacgcugugcagcuuuaaaagggcauuuuuaggugacuuguaaacggcuuguuccacaggccccgaauuggcgagauucgcuacagcucggagugcgcgguagacuuuaagcagggagcgccugcccgguccaucccuccccggccccgcguggcaagcaccgcagguugaggcgcccccaaaccgaggaagaggguuugggagccugugacuccaaagcccucugcaacuucccggccccacagccccacccacuagcacgcggccuuccccgcagcccgcaggagacaccuuuguccccgccccuccacaggucaccucccuccacgccccucucucuuggcccgggcagccggcaggcagggaagugucguaaagccaggcccaggaaacuuuacccggccuaacagcugaggcgcuuuacggcgacggcggcugagugagaaccuuggcggcuguggaggcugccgcggcugcgaaggaggcggcggcgguggcggaggaagaggaguggcggcagcggcggcggggacccgugcggggugagccgugaggaggggccgcgagugacagggcuggcgggugggcccgggcggacggggacgguggccggcugagcagcugggcggcgcugaagagcggggggguggcggggaauuggggggcagcuccgugagggacgguuucugccuuuguuccccccaccucggccgccccccauccgucgcccccuguucuccgcgcuccucggccggguuucauggccuccccucucggucugugucgcuucuaggauggcggagguaccgccugggccuagcagccuccucccaccaccagcaccuccggccccggcggcggucgagccccgcugucccuucccggcgggggccgcccucgccugcugcagcgaggacgaggaggacgacgaagagcacgaaggcggcggcagcaggagcccggcgggcggagagucggcgacgguggcggccaaggggcauccgugccuccgcugcccucagccgccgcaggagcagcagcagcucaacggauugauuagccccgaacugcggcaccuccgggcggccgccucccucaagagcaagguccugagcguagcagagguggccgcgaccacagccaccccugacggaggccccagagcgacugcaacaaaaggagccgggguacacucgggcgagaggcccccucacucccucucuaguaaugcaagaacugcgguccccagcccgguggaggcagcggcggcgagcgaucccgcggcggcccgcaauggacuggccgagggcaccgagcaggaggaggaggaggaagacgagcaggugcggcugcugucuucgucccugaccgccgacugcagcuuaagaagcccuucgggcagggagguugagccuggggaggaucggacgauacgauauguccgauaugaauccgagcuacaaaugcccgauaucaugagacugaucaccaaagaucuguccgaacccuacuccauuuauaccuauagauauuuuauccacaacuggccacagcugugcuucuugguaaguggauagaauaaaaagagggugaacccagcagugaucgagacugugcggggcagggagugagggcccagaauguggcaguggauaucuccugcugcguaucauaguacguuauaugaugucaagugcuguacacauuccuaguuauuuaaugaaauuguuuugaagguaagacuucaugauucggguuaacgugauacuaguguaacugcagcaagccuguaugguggcguguuucacuggggugggggucuugugucuuguuuacauuagauuauaaucguguuuaaccgucuuuaauuacccgcccgcauccucaaacacuuuacagucauuuaauuugaacaugguucuguucagauacaggccuuauuagucucucgauuacaaccauaaucagggaagaguguaugcauaaacauguuguggugaacauggaugucagcaaacuugguguggucauauuggagaauuaaaucuuacaagcauuuucgguaauuauggagauguuucucuuuacuucaacuggacaauuaacaguuguagccagccugcuuucugguacuccauuccagaaagcgcuacuaacacuucugguggcugaaagacuccugaaacuugaacaaaauacccuuuuguggaauguagaaaacuugugugaaauuguuaccgaucugauuuuuuuuuuuuuaauuuaagaaacugguuguagauguggccaaacacuaguaacacuggcuuguguagaguauaauugacaauaauauuacacguaagugaaagacuuuuggacgguuuuuaaaaauuaacauaguauuggcaguaccaguaauuucuucacaauaauauugacccauuucagucuguaugaacccuuuaacuuaaacguugacugcagguguaugcuuuguaucaugugcucacaagcauauuguuucuguugaauuuuacuacagaaagaugacauccuuuuaaggaauauuuuuuaauaugugaagggaaaagccaccauuacuuaauguuuuagcauuggcuuaguuucacuugguaauucccugcaagauauuuugacaauacuuaucuuuuugauucucuagcuuggugauaauuugaaaauguaaccuggguauuguagauaaugguaguucuauuuucugucuuaacuugcuuaaacuucaauucaguacauuuguuaaaacuguggguacuacuuuauauucuugaaaacugcucuuucaguauucuaagcauuguaucagaauaguucuaagacaugucugugucaaugaauaugagaaaaugauuuauagcacuauuauaaaugucauaucaaaugccacuguaauugcuaaaaauuguagauuuaguuguaaguuaacccacagaaguagaugauugagucacauuucaaguugaaauagauguuuuucugucaauuccaggaaauaguuguguauaugauauuuagucaacuuugaguccugauaguuaccuaagccucucucaacuuguuugcuauuuuagacucuggucaacaauauuaguaaacuuuagauuugauuuuauguagaacccucccaauucaccagcuaauguguauguuagccuuuaguagcucaaguuuguuuaauauucugaguaucuagaauugcgauaugcacaagugguugaccuauaagauuuacuggugcaaguaugaaucaggagguauuaaacaauaauaaaacaguaaaaaaacaaccaggccauuuaaaacugaagccuuuaucuuggcauacuuuuaaauuuaaguuucccauaggaacuauuuuuuuaaaaauacagaugcguaaaugucuguuuauuuuaaaucauauccuuuuagaacugaaagccauccuagagauaaucuagcccaacuuagguuuuguucuguuuuguuuuuugauugaaaaaaaguuaagaaccaaagugacuuaaaauguuucaaucuccagauauuuacugacagagggguagguuuuguuuuguuuuuugauugaaaagaaguuaagaaccaaagugacuuaaaauguuucaaucuccagauauuuaccgucggaaggguaaagcuagaacccaguucuccuggccucucauuaugguaacaaacaagaaccugaaaaaugacauacccuugauccauucagugaagauuauugugucaccaaguuaucuucaccaagggacaguugcccuuacaucaaucucaagagauuaaaaaccuccaaaauguuccguuuuccguggauaaccuguaaugggucaauggaguauaugggguugaaccuuacaaaauugccaauacuugauuaauaaaaaugauagcuuauuaugauucuuccuaauuguaaaagauguaaaaaaaaaaaaaaaaaaggacaaaugugagacacuuucaguuacucuguacuuaaccauuuuaucuuuaccuguuuucauaguaacauuuucaguuguugguaucuuuuugaaguucuuaaacuuacucucagcaaauguaacauaguacuuccauuuauuuguucuaaauuuaacuuuuuggcuuccuccaguuuucuauuuguaguguucuagaauuugggaaucucucacuuuauuuuuuucauaguuuuauagacugacaacccuuuggccuuguaguguuaagucuuaaucuugccggggauuuuucaguucccauccuugaaaaaauacauuuaauagcgugaauuccaaauguauaugcagagcuuuuauuuggaaaaauugacaagcaauuuagugauuccuguaaauguaccacauauucaugaguaguuuaucaggaaaaaaaaaugcagcauuggucuucacuacuaaugucaucguaaugguguaugauauauugggcuuuuuagaugauguauacagcuugauuuuugcuccuauagauucuaaauuaggaagaaaucaggucuuaagaaugaacuaauuuaauauuuuguuugcuuauuccaugcucaaaggacaaagauuuguuugaaauuccuguucagauugaaaguacuguccaguuguauuguguuuaaugguuuuaauuuuuccucauuuuuggauaguuuuauauaagguguagcuauucugagguuuguaucaucaaucuaauacagguuuucauuucaccugagccuggcuuaugaggucaggccaaaauuuuuucuggcccuuuuaaauauaccauuuggucugugauaauuuuauguauguguauguauuuauacgugucuguauauacgcacauauauuugaagugaguuucaaaucagaaaaagcuuucagaguuggucgaggcgauuuuugugcauacuucaggucuuuguuuaaaaaauuuuuuuaaaagauugauguauugugagggaaaaaauuagaaauaacaauuucagagguuuauugacccaaaauaguuuuggaaugugugauaaaccagaaaugaauuagcguggguuguugaauuucauauuccuucaaaaggauuuuuccgaccuaguuuagguuugcaugaaauggauuagaauuaucuugcugaaaagauuucuccacaguuaaaaaaaggccuuuuaaucaauuuacagaaugacagacuaaaaaagucacaaauuuaaaauauguauuaauuauaaauuggacauuacuuauuaguuuuuugacucauuucugcuuuuguugaaauaguuucuucuggaaaguuaauuuauggaaaacagacuucuuacugacacauuauuuaaacaguuggagauacugcccuauuuauauuuaccagaaauacuguguuacuagaacuuuuuaucagcauuggaauuuuugaaaaacauuuucaaugguaacacuagaaaucuuaaugaaaaugggggaugauuagaauuuaacauguagcuuuuaauacucuggaaagcuguacguuuuuauuaaaauagaaauuucuguaaaauuaaagcuuuuaacauaaagcuuugauuuugaacuauaaauauucugagagcuuuaugacaguuauccacacuaucaggaguauccuaaaaaugagacuaugcuacacuuacauauauuaacaaaaaccucuuggguauggucuaagcaauaccuuauaaacugugcuuuuucugaaaauuuuuaauuuuuuuuuccugaucgaaaucuaccauucagguguaaauauguauuauaucuggcuuucacuaaaacuuuauuauuaaauuuauuuucauuuuuuucuuuuauugagauggggucucacucugucaccuaggcuggagugcaguggcacgaucucagcucacuguagccucucccuuccuggcucaagccauucuccuaucucagcuuuccaaguagcuggaacuacaggugcaugccaccacaccuggcuaauuuaaguaauuuugguggagacaggguuuugccauguugcccacgcugaucucaaaccccugagcucaagcaaucugccugcgccugccucccaaagugcuggguuuacaggcaugagccacagcaccuggccauuauuacuaaauuuaacugaauauauuuaaauuuacauucugcugaugggcaaguuuuacaauauuuuauguccuaaugaauagacuuuuucuuuauaaucauuuuuuuuuugcauauuuccccuuccagaaccuuaggucuuuguugcaaauaauugugauuuuaagcaccucauauguaaucuuauaaaguacuugaauguuuaccuuguggaaucuugucuuuuuucccuaggcuuuaauaguaagcauaaaaaauucauguucuaaagaauauugagaaauuuuaacacuggaacauuuaaaggaguuaggggauuuagauuucugaaacuucugugacugcugucuugcaagaguucccauuaucuucccccgucgaaaaugcuuaccaaugguugguuguuguuuucucuggauaauugugcaguaccugauggcaauguauucuucauaacuguuuguuuauuuuuaaggccaugguaggggaggaguguguaggugccaucguuugcaaguuggauaugcacaaaaagauguuccgcagagguuauauagccauguuagccguggauuccaaauacaggagaaauggcauugguaagaaaaauauuauuuuauggaaagaaugccuaagcuauuuucauuuuuguuguguuuugaaauaaaagacuuaaauguaaguauguagaaaugaaagaaacuaagggaagaaaauuaaggcggguuuuaauuuuuaauuucaaaaugguauuuuuaaaaaguucuuaaaaugaauuuuuucuuuauuaauguuuuguuugacaguuuuucguuuuaacaaguagccgaucaucagcuuucaccugcagauuuuuuuaaucacauucaaaaugcuuugcauuaugcuaaguaccacaagaaauacugcaauuuauaauuacauuaugaugguccuucaugccagccuucaagcacuugucuguauuuggguuaaguggaccucaaucaagccaaaauuauggacaaauuguuaccauuacuuggugcuagucaucaacuauauauugcaauucaggaaagaucaggagaugagaauugauuguuucuuguaauucccaaacuuaauuuuuuguugggucuacuuuuccugacauguuuaguuaaucuuaacacucaugauuuauaaugaucauuagaaucaugugggugguuuaaaaacauguauuugggccccucacccugagacucuuguuugucuugucagagguggggcugaagcuucccuaggugacugugauguaagccugauuaagaaccacucuucuauggcuggguuagauaacuuuugucauuuaaauaacgccauaaaacucaauaggccaccaggugccgggugcgguggcucacgccuauaaucccagcauuuugggaggccaaggcaggugagucacuaggucaggaguucaagaccagccugggcaagauggcgaaacccugucucuacuaaaaauacaaaaauuagcugggagugguggugggcaccugucaucccagcuacucaggaggcugaggcaggagaauugauugaaccugggagguggagguugcagugagcgugccacugcacucuagccugggugacagagcaagacuccguuucaaaaaaccacucuucuauucucuaggaccuaguggcucuuuguucacaguggagaauuggguagacaagcauuugucuaagcaugucaaauuuugugaugugcuuuagcugaguauucauaaaaaaaaguuuaauaccuguaccaguauuuaaucauuaguuuuuucacuuucauguuuuuuaaaaacuauuaaguguuauuguccaaccuaagacucacacacgguccuagguaucaugagaaguaacuauaaauagguuuacuuaauauguuagguuuagccaacuuuauugcaguguuacagcuuuccacuaagauuuuuaaugaauugggcuuguuuuauggacuaaguuugagccuuugaugcauuaaaaagcacugauaaggacucaugauaaauuauagccaauuguuuggcuaguuuggagggcagaaaccaguggcuuuuggguugcauccuggccuucagacauacuuuguuugggccauaaaaugcgugcauacuuguaugcauggcuugaaaauuaagaguuuuuaauuuaauuuuauuauuuuuugagacagagcuucgcuguauugcccaggcuggagugcaguggugugaucccggcucacugcaaccucuagcaccuagauucaagcaauucuugugccucagccucccaagcaccugggacuacaggcacacaccaccacacccagcugauuuauuuuuuuuauuauuauuuuuuuuugagauagucucacucugucgcccagguuggagcgcaguggcaugaucucgacucacugcaaccuccgccuccuguguucaagugauuuuccugccuccgccucccaaguagcugggauuacaggcacccuccaccuguaaugccuggcuaauuuuuuauuuuuuaguagagaugggguuucgucauguuggccaggcuggucuugaacuccugaccuccggugauccgcccaccuuggccucccaaagugcugggauuauaggcugagccacugcacccagccaguuuuuuguauuuuuaguagagaugggguuuugccaugaccucagccuccaaaaugcugggauuacaggcgugagccaccacgccuggccaauuuuuuguauuuuuaauagagacgggguuucaccauguuggccaggcuggucuugaacucuuggccucaagugauccaccugccuuggcuucccaaagugcugggauuacaggcgugaaccacugcgcccagccuaagaguuuuuaaauaaaauuugucugucugcucuuaaaaucagauuuggcaaauuuuuucccuuuuaauauaccaauuauauuugacccuaaacuaggauacauuuugcuagacauguacagacacaccacugacaucauugggagugccagacuugccagacuucaucgugcucacuguaaaguuuauaggaaccuacuguggguaacagcaguucugaugagguugucuugucccuuguguccaggggaguuugaaggaucuuuggugagaucagcuuggguuaugcaguaaguucuggccaacucacggggaguuccugcguuguucuggccauaccauaucuugucuuuuucucuuucgcuuuccuacugcuuucaaacacaauagaacaaacuccugcuuguggcaaauaauuaugucugagaaaaaggaguauauugggagauaggucuuucaagaggaaacauacuguuauguauagguucuguuggcuucucuuagcuuauagcuaaaauuuuucccauuuaauuugagguaauccguguaucuggauucaagauagaaacuagcauuugacauuucugugcuuacgaauauuauaauuuagguuaucuuuaagaaauacauuuuuccuucauuaauacucagaucuauauucuagguacuaacuugguuaagaaagcuauauaugccaugguugagggagacugugaugagguaagucuuuaaaaauguuuaauauuuuuuaucugggcauuauucuuucuggguauuuuuaauaaauauuuuauaauuuauugcagauuucauugcaguguuacuauacaaaugcagcuuguggggaaaauuauauuccauuuaaaaacacaugaauuuuugaccuagaacaaauuuuaaaauggagcuaaaauuucuucaaaauguguggggggaaucuuagacauuuucaguacacaauuuugguauucagaggcuuuaucaucaguuauuuaagguagcucuuauuacagacucuguuauaauuugcuuacauauuggccuuaguuucugacaaugggaaacugucagucuauauggaggacauuucacacuugaaaauaaucuuuucagaauuaaauaaugacaauguuggcuagggggaagacaaccacuuuuaaagaguagagcuaucugcgcauuaacauaagagcauuuucucucuucagcuuguuuguaaggucugauggcagauauuucuuuguauccuacugcacgguguuucuacauauaguaggugcaugauaaauauuggugaugauugggaauguuaacauuuacuguugcacaguguggaagggaacaaguauaaacuagagaaguauagaugucuuuaacauagcaguggugacuaaggaggagcaaaguuguacuaguacuuuuaugaguaauagaaguagcaauugucuuuauuauuagaggucagaugugccuuagagaauucucaaaauaugugaaauuggguaaguuuuuuuaaaagguugaccuuaauaaauaauuuguuuagugacuuaaaagaaauggaguguuuugguacaaaauuuauacacagucagcauauaugauauauguaugcauguguuuuuguuaacaaagucccuucuaccauucucaugcuuuucaacucuuuauccaucuuuccauugauagcuacuguuuuuuguuguuguuuguuguugugggguuuuuuuuuguuuuuuuuuuguuuuuguagagaugggagucuugcuauguuguccagcuggagaccacuccagcuccuggccucaggugauccuuccaccucagccucucaaguguugugauuacaggcaugagccguugcuccuggccuguugcuacuguuaacuguuugaaaugcuuucucucauuuuuuaaacacaccuaugugcaaauauauaguuuuuaaaaauacaaaugaaguaauucuuauucaauaauuauuagcaauaauaauugcuuuuuucuuuuaacaauaucucaugaaugcauuuccguguuagaauacagagauuuacugcugagcauucucaggcuccuuguucacauuaggcucuauucugacagauccauucuaaguggugguuauaugagaaggccuacagacauaguggguggcacagugaagucauccugggauuuaaaaauaucuaauuuuacuccaaagaaauaauucacagguguugaaggaucucacauuguucacagcuuuuaauauuauaaugcaaaaggugcagucgccaaagcuuuacaugacugguaacugaaauuucgaggagagaauuggaucagauauguucaugaguauagguccauguuuggaccauagccacacugcuugucagcucaucgagaaaagucagguuucacaaaaguugcuuaacagcuuggagaaaucuucgggauaauagaucauguuuugaucuucugcagauccagugaacagggguguuaagagcagagaguauuauguucccuaugauuaaaccuuuucugaguuauccuacuugcuauccuaaguuacuacuugugaggcaggcuaugugcuuuuguuuaacuguucaaagguuuggauaguguuggcuuuucauguaaagaugucaggaaugauaugaagauuuuuauuguuuuggucucaagguuaaauucuaaauuaaugauauauuuuaugguagaaaaacuucauuuccagccuaaaaagcuaaugcugauucauucauuuuuucuuuugaaacaaugaauguuacuuaaucuuuaggcugacaucagggauagcuuugugaacuuucuccuuuuguaugauuaugguuuugcaguuugugaauaccucugucucuggauuagauaacuuugucuugguauaaaaauuuugcuuaucuguguccaguguuauucagaucgaauaauuugccauacgaacucuuguuuacucuuuagaagauaugguagcuauuugguuuuccuuugcuuguuaaaauacuuuagucuuuaagacccaauucaaauaccaacaacuccuuuaaguuuuucuugauccuucuggacagaauccauuucacuuuucuguuauuuuugcuacucuuuuuguaauuauugcacuuaauuucacuuguucagugccuuagcacaauguaggacagagaugccuucucuuguuuguugcuguauucuuagugcuuagugugacauuugugauagaguaccugcuuuguaaauauuuuuugaaugaucaguucugugcuuccagcaugauguuuguaaucccucucucucuuguuuaaguacuuuuaaauuuugacuuguauuguuauuaacuugucuuucucucugaacuuucugugugcuuucuaaaaacaccaauugucuuauuuuuguucauaguaggauuuuuuuuaaaaaaaggcaucuuuaggguuaaccaaguuguuaaaaugccuuugaaaugauaaaucuccaaaaauacagcgauuaaugaaaaggcaaauaaacaugugcuuucacuuucauuaauuuagaccaaccuuccuuucuuuuaaaggguuuagaaauuuugacaaauuaucugaaaaucugugaaagacauuucagaaggguuuuaaauuagauuuucuacuacuuagguuauucugcuauuuuuaaaauucuuacaaagagagagauuuuaaaaucugugaaccuuuuaauagagguacauuuggccaggcacuguggcucacgccuguaaucccagcacuuugggaguccaaggcuggcggaucacuugaggucaggaguuggagaucagccuggccgacauggugaaaccccgucucuacuaaaaauacgaaaauuagcugggcguggugccacacgccuauagucccagcuacucgggaggcugaggcaggagaaucgcuugaacccgagagguggaaguugcagugagccaagauugcaccgcugcuuuccagccugggagacagagugagacucucauaaagaaagagauacauuuggaaaucuccgugaaaccuuacugugcuccguggccggaaaaaaaaaaaaaaaaagauacauuggaaaucucugugaaaccuuacugugcacaucaaacaauuuuuacuuucuauucuguauacagaauuugugaccuugagucauguuuauauuguucuuuguuguuacuagucauuuuaagcucagaguauucagccaguuauuaguaaucacagaauugaaagguagauguuuuucuccaaauaaugcugcacuguuccuagucuaauugauguuuucauuuugucuuacuguaaguuucccaacuuuucauaucagaauuagacauauguuaaaacaguauagcuaaaaaauuuuuucauuuucuauguauuuggagcugacuaaaaaauuauaguaucaaaacaagaaacaaguggauuuguuacuugaugaguaagaaauauauuaccaguaugcugaucuggcuuaaauuuguuuacacccccugcacgcucuggcugccagauguguaguggcuaggacaaguaucucagguucauguuucacaauagaagaaagaauaagauaaauacauauagaaugaaugaguuuucuaugauguagauuuuaaaauaggaucuguguaccuaaaaucaaccuacuugguggccauuuacauuuauguacuuuuuuuccugaaguaaauuagaauaugggcaggugauugaucaguaucaguaugaugaauagugccucgauuuuuaagccauugauauccuuaaaaucuuaaucucugaaaacuucaagguuguuuuuguuuuguuuuguuuuguuuguuuguuuuguuuuuagaguuuuaggcugagcacggugucucacgccuguaaucccagcacuuugggaggccaagguggguggaucacgaggucaggaguucgagaccagccuggccaauauggugaaaccccgucucuacuaaaaauauacaaaaauuagccaggugugguggugcgugccuguaaucccagcuacuggggaggcugaggcaggagaaucacuugaacccaggagguggagguugcagugagccgagaucgcgccauugcacuccagccugggggccagagcaagacuccaucacacacacacacacaaaaagaguuuuuaggucgauuacugugaauaugaauagccagagauaacugaucagaauacaguggaauuaggauuucuuaauggaauuuauaguaucuuaaaauauuuuuaguugaaaaucacgucaucuaauuuuugcuuauuuauauuaaagacauuuuuuccauugaaaaaccguaaugaacauuacagaaaacuugggaaacagaagaagaaaguucacuaccuaccuuucuagcacguuguauuaguccguuuucacauugcugauaaagacauaccugagacugggcaguuuacaaaagaaagaguaccacguuggauuuacaguuccacauggcuggggaagccucaaaaucauggcagaaggcaaggaggagcaagucgcaucuuacguggaugguggcaggcaaagagaagagagcuugugcaggggaauuccucuuuuuaaaaccaucggaucucgugagacuuaauucacucacgagaacagcacgggaacgacuugccccaugauuuagagacucccaccaagucccucccacagcacauggggauucaggaugagauuuggguggagacacagccaaacaguaucacacauccaauuugguguuuucuuuccauucuuuuuuuguugcguacauuuauuuuuacuagacaguuucuucuguaaauaguaugccauguaacuugcggcagacuguuuacaaucugcuauucaaacccaugacuuucccugcaaccugauuugcuugaccuacuuaaugcuacuuauuucuagcaauauaaagguaaugcaaaagacauuuugguaaauuuuagauaauauaguagcugacucuauuuuguacaauuaaaagaauaaaauagaucacauuagcacuaaugaguaaauuagauuauuaggagccaagaagaucuaaguuauuuuuugaaauaacuuauacuuuucuaaauuagaaaaguccaacuuagaaaagguacagucauucuuuuucccccauuauaaaagguuacuuuuuaucuuuuuaauuagacuauauuuauuguguuuauuauguauuuacuaauaauauauauguguauauauauauauauaaaacaucuuuaguuucacuggaaacauuaugcuaugugauagagccugcaagguaaagaacagaauacagugggguuaguuaagcugcaaggauuuugggugaguaguuuggccuaauaacugauuaugagacaccugguuuccauauuuaucuucugucacuuggcaguugugugauuguaggcaggccauuuaacuuuuucuggucucucucuuugucuaugcaacaugauguuaauucugaucuuaaagauacguugugaagagcaguacuguuuguuguucauucaggaaauagcaguggaagggcuucuaggugccagacagugugguagugcuaaaguucuagcagugaacaagccugcucuccaggagcuuccagccuacaguauuaaaaaauacuaucuuaagcaguaauguuuuguaaugguuuggcuuauccugauaaugaucuguuacuguugcuaagaggaucgguggaauuucacuguaauuuuuuuuucuguuagguagaauucaacucugucaaguuucuuuaggaccaaaauaacuucauuuuauggugaauuucuaauauaaauucagauauucuuuuaauauguuuauaagaauuuaagaauuaaaaauuaguuacuuuauccuggcauuuuucuguugugucaaauaauuuucuaaagaaagaaucucuuuguuuagaaaauaugagugugccaggagaaucuuuacauuuugacuagauuagacauugguguaacuuuuuucuauguaauugagcuucauuucauuaauauauuaggaugcaaacaaacuugaacucaguucuuaaccacacuuuaaguguguauuuguguaguggugguagccucagauguguuuggaauauuuuagauugcuaaauauugaugguggacuuaaaauccauuucaucuugucuuaaguagguuagauuucccagucacugcuuugcuuuacuuugggaaaugagggggagguacaguagaguaguuacuauuaagcuuuaguucauaauuggacucuguucuguccuugcucuguugguggccuugaguuuuauucaucuguaaaauggauaaccacaucaauuucauaggguuauugugaaaauaaaacuacauaauacauauagaaugcuuuacauugcacauaguacagcuccaauaaauauuagcugucauauuuuaaaauugucacuuuuuauuuacgugaaaucaauuccaaguuuugaguuguugugacuuuaguguuucucauauuaaauugcuuugauucaacauuuuagcuauaauuaggugcuggaccucauaacaauugcaggaauuacccaagagaauuguuaaaaacuaaaaacuuguauugaccagacugugguguuacagacucuaguaugacauacguuacuagaaauuuaauuaugucuguguguguaugugugaguauuuuaauuuguuuuuugagacagagucucgcucugucacccaggcuagagugcaguggugcacucacagcucacugcagccucaacccccucggcucaagugauccucccaccucugccccuccaaguagcugagacuauaggcacacaccaccacaccuggcuaauuuuuaagguuuuuuagacaugggcuuucaccacguugccuagccuggucccaaacuccugggcucaagugaucugccuugaccucccaaagugcugggauuauagacaugagccaccaaaccuggccaaauuguguuuuuuuuaagugcagagagaaauugacguuuacuuaaaccaauuuguuugcuguacaacuuguauuuuagguuuucuuaggagcguguuuucuugauccugaacuguuaauuacuucauuuuagaucuuuuaaagguuuagauuuagcauuggucccugcuguuguugggcuuaccagcuaggagagaugacauaccacucaucaaauguugaauaagaaugugucauaggaacggugcagaauguugcugggugauauaaaaggaaaggggcacuguacccaauccagaagugacaagguagggccaaaagagaggaggauaggaagagcauucuucuagacagaaaacaguuuauuugaauguucuaaggugggaaagaucaugguggguuccagaaacugaaaauucaguguugagcauggaaagcaagaagagagagaccuaaagcaaagcugaggccaauauauugauggacuuuuuaugucucuugauauuauuuuuagauuguggacuuucucuugaggacaagagggaaucaguaaacgguuuuaaguagagaauuaacaagagcaucacccuaacucuagagagaaugggagaccucuugaguuaggaggcucuuguaauuauagugagaguugauggcagcuuggacugugguauaucgagcauagaaagaagaggaccacuuagagauuuaagagggagaauugacaauaaucagugcuuggaugcauauaggugguuggagaggaaugagguucaaagaugacuccuggguuucagguuugaggcauuggugugguggggggugauccuguuuacugagauauggaauugaggaggaagagcagauuaugaguucaauuuuggauauaaguugagguacugucuuuauuauuugcaucaguuguuugcauucuugucagacuuuuugauagcuugagaaagaacaggaagagacuuaugcuucacuugggccuuuguuuaauuauacuuugccauuucccccccacccacuccaaacacuugaggguuaugacacccaauaguaacuguggcucacuguguugauaguucucaaugaaauaaguugagaaacaauugaaaaggcaaauagagcuacguguguaaaaguugggaagaugggguagaggguguuagagggagguaaaaauaaaaucgcaguuuucaaaaauaccaguuauucauugucagggccacuggcucaguaauauuucaaaagacuuaaaugaaaguuaauacuauguguuccucuguuaagcuuugcuauauagaccagugguucucaaaauguggucccuugaccgcagcaacaucaucaucuagcaauuuaaaaauauuaaaaaugcagauucuuguguccuacugcaaacguacucauaaacucugaggguggggcucagcaaucuauuuuaacagacccuucaggugauuaugauacacuguaacauuuugaauaccucuugucuggauucagcaaacuuucuugguaaaaggcccacuaguaauuauuuuaggcuuuguggaccauaggucuuuguggcaacugcucagcucugcccuuguauugagaaagccaccacagacaucauguaaacaaauaaacauggcuguuugacuaaaacuuuauuuacaaaacagcaggcacauuuggcccaaagucuauaguuugcagacucuggucgagacuccagacaaauaugguaguuauugccagaauaaaugacauauuaaugaaaauacagaaguuggaagucaaucugaauagcugcuuauaauaauauagcuuauuauuuuaaggaaauaaaccagcacuuuugauuguugauuuuauuuucaucuguagucauuuuaccuuuccccacagggaaauaauuaaucuuuguuuuaguauaaaacauacucucauugcuaaacauuucaaacuacacaaaucaguagaacagaagauaaaucugcagugguccuccaagcccuugacccaaauauaauauuacaaucuugaugacuguuuuugaguucuuucuguauauuauuuauuguuuucacuaucaauuuuuaaaauaauguaugauuuuuuaaaaaauuguuuaguugguaaauuauuuuuuaaauuguguaauuauaacuuaguuuuuuucucauuucuuugaagguuguuuuggaaaccgaaauaacaaauaaguccgcuuugaaacuuuaugaaaaucuugguuuuguucgagauaagaggcuguucagauacuauuuaaauggaguugaugcacugcgacuuaaacuguggcugcguugagaaacugacaucaaggaacaacuaucauccgcacagaaucgaccuuugcaugcaaugcaauuuguacagaauugcuuugcagguggauuuaguaauuuccaugcagcucuuaccugucagugucucauugagugucgcacaauauuuguugcacuuuggcauggcacauuuguucugaauuaaaagauuguuuuaaacuucaggaguucuuuugguaccaacaagaugugccaguugauagccaagauuuauguguucauuugcaaagucugcugacaauguuauuuacacagugaucauuuuaucacagaaccaguaaguggaacauaauuuuuguuccuuaaaaaagccaauguggauuguaaaagucuuuaaguauacuaacauuucacacaaaaccugcccuaguuuucugaagugggugagggagacgcuucaguuuuagguuuuauuuuuucaauauuaaauuuuccauucuugaauauugguaccucagugauuagugaaugaaaaaaauguaggguggguaugucuuacaaugaguaaagguaacaauuaaauuuugucugccagugccuguguagauaaguauauuugucuucaucucuaguuuuugaaugcaugcuaucuuuuccuuuucuuuaaggccuuugcaagcaaacuuuuguuuuuauuuaaauucuaaauuugauaaauuauuucagauuuuuauaauuuggauacuuuuuucaggugaaugaaagaaugguuuacuuuagaagucccuuuuuccuuacaguaacaaguugaaucuacuuggaaaauugagaaauggcucaaaagagauaagaaaaguugauggagccgggaauugcugggguuuagaugcacuuuuucuuuugagaguaagggaaguuuuggaaaagaauagaaaauuaguguaaguugauaugauuuuauuuaaucaaaauuacugcuacgcugcgaagaacagcuuuuacaaaguagcugaauuuguuuuucccacuugauuuggauucacauugcuuucauuucuuaaaaugcuucacuucagguucuuggucuuggaaauaaauuucaaggugcauuguauccauuuuaagcugcuuuauuuuauuuucacuuguaugagcaaauucuugggggagcuuugcuuuucuucugccagaaaaacaaaagggggaaaugaaaaucuuuuuuggaaugaguucuguggguuuucuuaacagccaccauguuuauuaguuacauuguguuuuggccaaucagugcaauguaacaaauuuuacaguuaauugcuuucaauugagucaguaaaccugugauagauaauuuauuuaacuggaaaaccuagguacccauaagaaaaaagauucauucucugugaaaacuguaggaaucuguuguuguuuucauuugaauaugcucuacuucugcucuaguauuugguuuggaauauauuuuguggcucuaauuacuguauuuuuaaaaacccuaccuccauuaacaguugguaaaggccccuuuucaggaaaguuuguugcuuuuuuuuuuuuuuuaaaggaaagcugcucuuugcucaguauaguguuuugaaagugaacauaguaacaaauacuuuaaaaauaaagauacacaauuuauauuugaaaauaaaaacuuucugcuggugggauuauuuauaguucuuuauuuuuaaagaaaauguuuuccuuuuuauauugcucuugaaaguuuaaugagcagaauacaauacugguuauaauaaaaauaugguaaccacacaguacucagccuuucaauauguuuuuggucaaacuucauuuaggcacuagcauuuagaagaauaccaaucacagugaugcuuuuguuauuuaauaugaaggaaauggaacuaaaacauuuaugucaucaaauuuuauuucacuucuuuauauuugacuugcugguugauacauaaugguugaugaacauauauuugcuuaaaucacuaauagggaugguuguaaaguagauagaucauugguucaaccauuuuaguguuuuugccagauugucaaugaaaccaucauacugaccuuuuccuccaaaauugccaaauugacugaacugguuggguguuuguaaagaugacguuaacugugugacuaaaaagucagaugguugccauauuguuuggaauauguugaaugucaguguaugccuuaugucuuuaauuggguaugcaaaaaaauuuuuacuuaaguagauuaaaauuuuaaccucuagcaugaaaacccagcaccaacacugaaagacuccauucagguugaaguagccucaaacaguaauuuacuuuuugauaauaggcuguuguuuuucuuaaauaagcuuaaaacaauucuaucugaaauugguagcauggguucacuuggcuacaacugagcaaaauagaugcaacuuucuuuuaauggggugcugccucuuuaggacugacuguacuauccacugacacugguuuggcaguugguacugcugaacauuuuuauacaugcuaccaugaagcuauauauguuaguauugaagaagcuaacggguauacuaucauuuuugaugugugggcugauuauaauuuccuguauuuccuguacauugggaugaaacuacuuuagcaaaguccacagaucagaaaccagacgguaguuuuugaaguugaaaccagcaaaauaagaaaaaauaaaaaaucgauuuuaauauuuucugccucuuucccaaauuacccuucccacuugcucgacaaaucuauguaaagcaguuuguuuuuucauguuuuaacuuuaccuugcccuguguuaugguacuggcugacaugucuaagacuggauguguauauuuauuauggugucuaaaaaucaugaaguucaucacuuuucaggaguauagauaaaaucaaauugguaguacaucagaguuacuuuucagugcaccaugacaucacuaaaaugagugcuguaauguuacagggcuuucagguuuguaaaaacauaaccauaaauuauauugacgucagauaugaguugaguaucuauaaaauaucacguguaucucaaaauauuggacugcuguuugacuggauauugcugcauaauuuucuucuauugucccauauccuuuuggagagagauuuaaugggauuugaaaugugcaagcugucuaaauaagaugcagucaaauaaaguaugguuaaguuguguuugcauuuuucuuuuagauacagcugugugcauuuuaugauuggguuguuuugcuuuuaccuacuaaguaaaacagcaacaaacaauauauuguuucccgcuuccugccuuucaucuaagaguuacggggaagaaguauuacauaauugucaucacuguuguguguucugacaaaguaaauuugaa

SEQ ID NO: 17543 - RNA, 985 nt, Homo sapiens
auuauaucucacaaaggagaucucuauucauugcaugaagaaucacggagcaguuuucccaagacugaaauacugaauauucaguuucuucuucauugcugucuucacuuccugguuucucaaaguauagauaaguggauucagaaagggagugaagaugguauagaaaacagagagaauuuugucuaccaggaaguuuguggaaggccacacauaaaugaaaauacagggcccaaagaacauuaacacaacaauaaaaugugcuguacagguagaaagagccuuggaggauccuguggaggaguagucccugacaguaauaagaacaaugauguaggaggugagcaaaagcagaaaacuuauaagagcaaucacaccacugguugaaaucaugaagaucccaagaacauaaauauccauacaagcuagcuggaugaccaaaggaagaucacagaaaaaacucuacaacauugggaccacagaagggcaaauagaggguaaaagcuaauuggcucauuguaugcagaaagcccacuguccaagaaacggccacaagcucaacacacacucuuuggcucauaauuguugaauaauggagagguuuacauauggcaauauaccugucaaaagacauggagaucagcagcacaaucucagucccggugaagaggugcaaaaaaagaucugagaaaugcagccuucaaaagagauggucuuacgcagagcaaaaaaguccauaaucaucuuugguguggcaaaggaggacaggcacaugucaaugagagacagguugcugagcaggaaguacaugggagagugaaggugugagguggauagcacagugagcaaaaucaggcaguugcccaacauggucauuaaauagaagacagaaaauaccacaaaaaagaaucucuggaguucaggagaaucaguaaguccaaguaacaugaauucagauacucuggaacaguugaaccccuccauu

SEQ ID NO: 17544 - RNA, 947 nt, Homo sapiens
uucaugaucucuggauaauucucauuccacagaagacaugauggagggcauauuucauguccuuguugcguaggcuguagaugaggggguuuaagacagguguuaccacagaauauaucagugugaugagcuuaugcauagcaacugaguugccaggugugggacucacauacaucagcauuauggcuccauagaacagagacacaacaaccaagugugacccacagguagagauggccuuuugccauccagcugaagaaggaaccuaaagcacaguucugagcaccaagguauaggacccaaggauguacaccauggugagguugaugaaaagagagcucacagaauggaacacaugcccuaugaugugaguaggggcagaggacaaugccaucagugggucuacaucacacagaaaaugaucaaugauguugggaccacagaaagguaguugaaaaaugaagaaaauggaaauugaauguccaaggaaaccaaugagccaacaaagagacaccaagaugccacagagcuggccagucauaauggagggauagugcaguggguggcagauggccagguaccgaucauaagccaugacacagaggaagaagcauucaguugugcccagggaaaagaagaaguggaacugagugaaacauccagagaaugauauggucuuaguuuuggagaaaaaauuuaccagcauguuggggacugugcaggucacauaccagaucucuaggaaggagaaguuggcuaggagcacguacauagggguauggagucgauggucccaccucacugcacagaugauggccauauucccagucagagugaagauguagaccaacaaaaucauugagaaaaagaugaucugaauuuuccagggaccaggaaaccccaacaacacaaacugcgucacaguagauaucugugaguuauucaug

SEQ ID NO: 17545 - RNA, 927 nt, Homo sapiens
ucauuccaaacaggacauuucucagagcgaguuucauguccuuauuacgaagaguauagaucagaggauuaaaaagaggagucguuacugaauauaccagugugaggaucuucugcaauaaaguugggaucccauauguaggacuuacauacauuaccaugacugucccauagaaaagagauaccacaaccaaaugagaaccacagguagagaaggcuuuucuccgaccagcugcagaagggaccugaaaaacagcuguuaguaacaggauauaggaucgaagaauguacauacuagugaaaaagaggacaagggagcucugaguauagaaaauacauucaguuaugggagcuggggcacaggauagagccaucaauggguccaugucacacaggaagugaucaaugauauuaggaccacagaaggggaguugggagauguagaaaaugggaauuggguauccaaggaauccaauaagccaacagaaagacaccagcuuaccacagaaccuuacagucaugauggcaggguacugcaguggguggcagauggccagguaucgaucauaagccauuacugccagaaagagacauucaguuguucccagugaaaagaagaaauagaacuggaggaagcacccagaaaaugagauggccuuggucuuggagagaauguugacuagcauguuaggaauaguggaggacacauaccagaucucaaggaaggcaaaauuucccagcagaaaguacauggggguguguaguaguggguugcaucucacugcauagaugauggcuccauuucccagcaaggucaagacauaaaucaccaaaaacaaugagaagaggaaaaucugaaucuuccagcaaccagggaaucccaggagaauaaacucugucacgauguguguugcugaccuguucaugg

SEQ ID NO: 17546 - RNA, 341 nt, Homo sapiens
augggcggaggagaguagucugaauuggguuaugagguccccugcgggguaccucaccucagccauugaacucacuucgcuggccgugagucuguuccaagcuccggcaaaggaggcauccgccgggccccuccccgaagggcgggguccacggcaucuccugcccagucugaccucgcgcggagccccguucucugggaacucaccuccccgaagcucagggagagcccuguuagggccgccucuggcccuagucucagaccuucccaagggacaugggaguggagugacaggacgcacucagcucguggccccacugaugagcuucccuccgcccuaug

SEQ ID NO: 17547 - RNA, 2569 nt, Homo sapiens
cugaaacuauggcucuuuauuuucauguggauaauucaaacaaagucauuaguagucuuuguucaauuuuuuuuuaaaaaacaaaaaacccucaaauaaaaaaucuugggcuuaaaagaacucuaucacaggagccugguuggaggauuccuaguuuuauacaugagaaauagaaugcagauuucucugaagaguguuuaaagaaggaaugguaguugagggggcuuauuucccaggcucaaagugauuuagggguggugucacagugcuagguauagggugauaggacagugaucacugccgagggccuuggaacggaucuugcugucacacaaugcagguaacagagagugggacaacaaaaaguaaucaaggcgccaaccaacauucuuggaucgagcauucaucauauaaguccaaaagguguaggcauaggguguguugggguagaggugccuaaagcugucagccaguggcacagccugcaguaauuccccgaagccuuggcgcucuuguggcgugaagccagcauucuuuuuguuccccuugggguugcgaaggucaauuucuucaugugccacauugaggucuccacacagcacaaggggcuuucgggaagccaggcccuucaggaacuugcgaaaggcuucaucccagcgcugccgguacuccagucguaccagaccucggccugcauuagguacauaugcuguuaccagcacaaacgagucaaauucagccacaaucacccggccuuccugaucaugcuccucaucgccuauagaaaugaaacagaauuagcauaaaaaacuauaagaaaagggaaagcaaucaagagguggggcagagauagagaauuagcaauugguuuugaagaguucaggcauuaggcaucaauagggucucaccuaugccguaagaaacuuugagugggcacuggcgggaaagcaggcccacgccacuguacccuuccuuguccgaaggagcugaccaguauugaugagagaguccaggcagcuccugaaguucagcugguaguuuguucucugaacauuuggucucuugaaggcacaguauaucuggggcuucuuccuuuacccacuguaagugaaaagaaagguggaaaacguauuaucaauucagcagaacauuuauugaauaaucuauaugcuaagucauagauacgcacggguuaaacagucucuuggccuaaggaguucgagucaagcagcacaauauucaaacaauucuaagcuagauaaaugaaaacaaauauagagagguaagaaagucuuacaugcuaugccaaggagauguguuuuuucuauaggcaguggauagcaagcuaagauuuuuaagcuaugguuaauggaauggaggacaugcuucauauggaaugcaaugcaggaagauaaaauggaggaaguauagugaagagguuuuugcaacauucugggaagaggagagaacacuaaaaaagaaaauggcaauggaagugaaggaacagacauuuaggaaauacaacuggcaagacuggggaagccccacagaaaacuacgggcaggagaaaaauaaaacagccugaaggcuaaacggagaaaaggggugacuaaacccuaagaccauucaauacuaaaaaaugucucuuucccucaaauuccacucacaucuaauccuuucuucuuaauccaggcucgaagcccauccacauuccaagagcagaucuugaguguggcagguuugccacugggugagguuuucugaucugggggguccucauacagggcugggcccucuccugcugccucuuugucauuuuucuuugcggccgucuuacucuucuuggccucuggcucuauaaaaugaguaauauauacugacaaaaagcuggugguuuccaacugcgauccggcguuaacuauagacccaacgaaagccuacgguuccugcgacuucuucacaaaccccugcaaaaaugagucggcccguacuuaccguacaucaagggaaugacaaacacccccgccgcagcuucuaggaagaagggcugauuucauucccuuaccuguccugagcucauccccgucuuccgccaccgcucccuuuuucccacgcuucggcauucccguuacgaacgcccuugggcagcuguaccgcgucacccaccgaagcaauauuuuuaccgcguugccuacagacgcaaagaaaucaugaaaccagcuaaggcuggggagaagacuccucccaagagcguccccgcaccaggucccgccuuucaaaccacguuaucucuaaauccuuuccccgccuccgugcaucauaggcccuucagccccucacccacgaaacuagaucauuucauagugccuuguacccuacucgcgagaucugcccuccagccaauugaggaucuuaauuaaggguccugacucaagcuugccguucagacugccagcgaagccccucuuaugagcaaaagagcaaccccguaucugcaccggcccgauggcagccuagcuccuccuaacccgagcacaaagaagggugcacgcugagcccccacgugggu

SEQ ID NO: 17548 - RNA, 771 nt, Homo sapiens
guuuauuucuagagauuaaaaaaaguucaaauacauauguacagacaaaggcacauucagagaguuguugcuggcucuccucacugccccuccccaagaacagcagagaccacgcaggagacaagaaggugacuucacuggaaauuucagacauuagggagcagggagucacugcucagaagccaaacuggaggugacagcaacccagcccccaucucugcccaagaccauccaccuacaggacauuccuaaugggagcaagacagagacagggcacacuucaguugucacaggccucuuguucagugguggcuuccccuguagagacuaggcugucauuugggccuuuuagccucccacggaucagcucggcaauggcccuccaagucuuuuuguuuaguuucuccagguucuugcccgcaucucucuuaggucccaaucaggcuucuagaguacaagguuggccagguccgucuccucaaugacaggcugugccuuggcugccuacagcuucuccuucaucuucuccuccacugcaacugguuuggccuggaaacccuccuccuuuucagguccucauccucugggacaugguucugcagccugaauucccugagcuucuugcuuuccuccuccucuucucugagcugcuuggucuuuggcuccccauuuuccuugucucuguaccugguuuucucuagggccuucagcuguucuuuugccacagagugucuucuagccaguccagguccacagccgccuucugcugcc

SEQ ID NO: 17549 - RNA, 771 nt, Homo sapiens
ggcagcagaaggcggcuguggaccuggacuggcuagaagacacucuguggcaaaagaacagcugaaggcccuagagaaaaccagguacagagacaaggaaaauggggagccaaagaccaagcagcucagagaagaggaggaggaaagcaagaagcucagggaauucaggcugcagaaccaugucccagaggaugaggaccugaaaaggaggaggguuuccaggccaaaccaguugcaguggaggagaagaugaaggagaagcuguaggcagccaaggcacagccugucauugaggagacggaccuggccaaccuuguacucuagaagccugauugggaccuaagagagaugcgggcaagaaccuggagaaacuaaacaaaaagacuuggagggccauugccgagcugauccgugggaggcuaaaaggcccaaaugacagccuagucucuacaggggaagccaccacugaacaagaggccugugacaacugaagugugcccugucucugucuugcucccauuaggaauguccuguagguggauggucuugggcagagaugggggcuggguugcugucaccuccaguuuggcuucugagcagugacucccugcucccuaaugucugaaauuuccagugaagucaccuucuugucuccugcguggucucugcuguucuuggggaggggcagugaggagagccagcaacaacucucugaaugugccuuugucuguacauauguauuugaacuuuuuuuaaucucuagaaauaaac

SEQ ID NO: 17550 - RNA, 1532 nt, Homo sapiens
ucaggacuguaagcagaggaccugcucuuaccaggaucauguuuuuguuguuggacaggugaaaaagacaaugaguccugaugggaaccacaguagugauccaacagaguucguccuggcagggcucccaaaucucaacagcgcaagaguggaauuauuuucuguguuucuucuugucuaucuccugaaucugacaggcaauguguugauugugggggugguaagggcugauacucgacuacagaccccuauguacuucuuucuggguaaccuguccugccuagagauacugcucacuucugucaucauuccaaagaugcugagcaauuuccucucaaggcaacacacuauuuccuuugcugcauguaucacccaauucuauuucuacuucuuucucggggccuccgaguucuuacuguuggcugucaugucugcggaucgcuaccuggccaucugucauccucugcgcuaccccuugcucaugaguggggcugugugcuuucguguggccuuggccugcuggguggggggacucgucccugugcuuggucccacaguggcuguggccuugcuuccuuucuguaagcagggugcugugguacagcacuucuucugcgacaguggcccacugcuccgccuggcuugcaccaacaccaagaagcuggaggagacugacuuuguccuggccucccucgucauuguaucuuccuugcugaucacugcuguguccuacggccucauugugcuggcaguccugagcauccccucugcuucaggccgucagaaggccuucucuaccuguaccucccacuugauaguggugacccucuucuauggaagugccauuuuucucuaugugcggccaucgcagagugguucuguggacacuaacugggcagugacaguaauaacgacauuugugacaccacuguugaauccauucaucuaugccuuacguaaugagcaagucaaggaagcuuugaaggacauguuuaggaagguaguggcaggcguuuuagggaaucuuuuacuugauaaaugucucagugagaaagcaguaaaguaaaagugaagagucuaguaacuagucuuuuuuuuuuuuuuuuuuuuuuuuuuuugagagagagagagagaaagucucacucugucgcccaggcuggagugcaguggcgcgaucucagcucacugcaaccuccaccuccuggguuuaagcaauucuccugccucagccuccugaguagcugggauuacaugugcccaccaccacaccuggcuaauuuuuguauuuuuaguagagaugggguuucacucgaugaccaggcuagucucaaacuccuggcaucaagugauccacccaccucagccucccgaagugcugggauuacaggugugagccaccacaccuggucuuguugucauuuuuaaaaaucauauuuuaaaauccaaauauucucauuaucaugcuccuuuccgucuucauuauggauaucaccaaaagacugaauucuggaacuacuaaugaauucucaggu

SEQ ID NO: 17551 - RNA, 9308 nt, Homo sapiens
uggaaaagagccaguuucuauguggucauauuuugugaagugccuaugccacaaaggcccucucccaggguuuauaucacuuugagaagagaauaugagacguggacagggagaagauaggaagaggagcaugaugcaggcacaccuagacaaagaauaauaacgguacucagauuccucuacaguuuauuguuauagcagaaguugugggagacgggagggcacccuccacacauacuacaguguggucagagccccaggguagcccuuuccacccuaugccaagccccaagcagcccagcccaagcuuagcucccuccccagucccacucuagaugcacacugagcuaccaaaguuagugcagccaaacggccccaggccccuuccuguugccccagcaccaauccuuccccacacucguucacugcccgccaacucccauuccaacuuccuuuuuacacuggauguuucuaucacauccugaggaccacuaacccaccagcaagucucccccugacacacauucacguagguccauacccuucagaguccuaaaggguuaaugagaagccaccucagcuuuggugaauggagccccagccccaaauccccuccccuugcaaauaugggacaaguagggagagucugauggaggcaccaggacaacuacaacaaccucuuaccccucagcuauagacaccuagaucaggacagaggaugcauaugcccucuccaccuuaacaucaaaaugggggaggaggagaauuuaggggucugggucccuaagagauauuaggacaucucuuccaggagcuggggggaaucacggguuaaaggucaagguuaggguagcaaucaaagaucaaggucaucuccccgcaugaucugcccuuuuucccuugcuuacgguggcccaaugccccuucagcaccucccagguuagcucugggggaggugagggcugggucccacucuagggcaacaagggccauucaacaggagaccuccauggugugccccgggggccccgaagaaagaguuccagacucgcugcucugggacagggugcgagagcgggaccgguugccaucaacggaugcugcacuggucagagaggcuguacgagaccgggacaggcgagucaugcaggaugaggccacuguggagacagcacgaugcacaagcagucagagaggaaguggggaaggggggcuggcgacucagggugugguccuuggauuauggacuaguuauaacuaagccaggggaucaacgagcucgauugggcagauagcggugaguccaggcauucaccuaaaacgguuccaccccgucagugccuaucucuccucuagugcagcaagcucuugucccgauacucacuguagcccaugccuugcaggaaguacuugaaggccucggucagcuugccuggcugcggaaguaagaagaggcgagggagacggugagaugagguuagaggaagagcuggagccugaggcugcggcacuguggggccggguguguggcaaagggcagagcccagugccaccgguauccuaugucccuuccccaucccauggacggcagcggcacucaccugagucagcuggggcugaccuccggagucagccaucuguucaggagagcaccacccagaaaaagugaaacacacauaaaugagccaugcagagagguggaaagggucucucuucccuagcuucuucacucuagccccuuuguuuuguucuucguucaccccauuugcucccaugccgggcccuggaggcuuagcagcugcauguagagaggauauaugacuguggacgggggcccaggaacagguuacugaccuugaggaacgaggucugggugggguccaguuuugaguuacauuccaccuggaguaagcaggaggcugaaugaaugaggucacgcccacuguggcgccucccccguaagggacccaggaacccagaccccagucccuuuucuaucagcucccuacccaguuccuccuuaccaggaaucaaauucuuagugccccaaaguugaucucccugugccaaacaggacauccccuuggcaagauacucuucugaccaccacuuuaggaccccaacccuccucccucacucaccccaaaauucccuacuaaccacugcaucuucaugaggugcuuggucuccuaccaccagcaucacaggacaccuaaagacacaguguuggggagaaggcagugagccccuggcacucccucacuggccucugccuaggagugcagcuggaaaaauaucuggcuccaaagaggaaagacacuucugugucucccugcugaugccaccaagaggauucaaagggggaagaccuagagggaagugauuuaccaaauaggauggggugggacaugacaaggaaguucccuggcaaaagauucuccuucuucuaagggacacaagcuccuagggaagauccagggagacaggcaaugcauuaucucuuaaagucuuaccugagggugauaucaccuccacgcucaaaguucaggucucggcggcuagaaagggguuaaaagaguaggaauuuuaggugggcaaugcuaucuaaccagauauaagcuaucucucccaugauggaacuaucuuugucuaaaaauuacggucaaaucuugguuauuaaagguggaaaccaaaggagaaaggggcaggcaggccccaagcacagccccuauagucacuugugcccuagaucccuggucagagggcaacaaaaggggaggaaggacacaggacacaagaucaucuuacuucugggaguccaauaauccaaaggagguaaacaagagaagggggacagccccuugcaauccuucccacugacucuguccugaagcugcccccauugcacacuaaaugcugcauuccuugcacauugcacacuacccagacuucccucuccuccucugugccucccccaugacgcccaauuacugcuucugcauuucucucacaugcauacacacacagcccacccacuuguuguagcuguuccaguacaauucaauguuauccagguugggugcauguguaaugauauuucuguacuuuuguaucaacucagaauuuccagagagcucuuccugaaggagagaacaaggagaaaaauuagggauggaaagagaaaacaacaauuacuggaggaaaagagguaagccuucuuccuuccccaaauccugucccagcuaaggaaguuagcccaagcauucaaguucccugcugcucccgucgacucuucuacaucuccuacacccacuuaccuggcugaaaagauguccaaggaucaucuccggaauggaagaggugaggccuguuagcuaugaggagaaggcaggugagaaaguucaggguauuggccaggcacaguggcucacgucuguaaucccagcacuuugggaggccgaggcggguggaucacgaggucaggaguucaagaccacccuggccaagauggugaaaccccaucucuacuaauaauacaaauauuagccaggcgugguggcgggugccuguaaucccagcuacuugggaggcugaggcaggagaaucacuugaacccaggaagcagagguugcagugagccaagaucaagccacugcacuccagccuuggcaacagagugagacaccaucucaaaaaaaaaaaaaaaaagaaaaagaaaaagaaaguucaggauauuauaagagacucaggcaaagugacagcuucacuuuccugccccuuuacucccuccuugaaguucagaguccauccaguuaggcuaucuaccagagccuaacuggauccauacgaggggauccccaaccguaggucucagcacacaggccccuccaaaccuugugggcugcccaauccauccaacccuuggcauugggaucaauguugaugaggacaagaccuucaacaguguccgggugguuaagcugagggacagcagaaggaaggaaaugagaaacagggcauggccuuauccccuccccgcuaagcucgacccacuccuggacucccacagggccugacuccccaccuagugcccacuuccucccccaaacagcacuaauaaacaguauucuccuaaucagucuggacccuccuuucccuccucugggcuuuuuauuucuuacagcauaucucgccaggauguaggcuccagcuccaacaccaacuccaauuauuguagagaaacugugaaagggaaagaaauauacgccucaugggaucugcuguccaaaaccugccacagcccaucucuucaaacucuucacccucccuccugaguccacgggcacaaagaaaggcagacacggaccuuucuuuggaggacgcgaaaaagaagggcccaagaagccaaagguuggcacggguagucaggguagauaccugaagucuauccccagcuuucugcuggagagcuagugucuuaaaaacaaacacccauccaccagccaaccaacacacuguuuucccauauagauagcucuuuguccauucucaauuuucaagagccaguucaacuuguucugcuuuaguuccugguuccucuagaggaacgggaagaauggaacuuaaagcaaaugugaaaacagacacaauuuuagugaacaauggagagaaugaggaaaagaguggcaaaguggugaaccagagcugcugagcccuggugccuaggagaagcuuagcuaagaacagcacccaggggccagcaccucccucugaauaccaaagacacuuggucugguguucucuuccuuccccaacucucucucacccgcagagcuccccauccaccaggugugggcaugaaggagaggggagugggagagaaagagacaggucuaucugguuccucagggauuaugucacccccuuucauuccucccugacuuucugaucagagaaggcccuccuuagccugaggcagggccaagcauagacccuuuuccuucccuccacccauuagggcuauucuguugacucuggccaauuuuccaaacccaccaccuuuucucaauaaucaaggcgggagcaugaaggaagaagauauauugaguucagaagcugaaacuggcucaggaaccacggugaaccuggaaguucuaagggucuccuugugcuggaaagagaacucugguuuggagggguucccaggccucucacuuuagguacugcaggacgcaagggaucaugucugcaagcugguccagagauggguacugauaucuggaaaagagaggcauguuaaggaagauaccaaccugcccucacaccccccaccucaggauguccuacucauucucucccagaauaaccacugcccucccuuuccuccuccccagucgaaccuuucccgcaccuguccuguuccucacagucuggugaagcaguaacgaccuaacucuuaccccaaagggaacacaggggcucccucuuccauuccaggggcauccacaugaacccgcacaaaguucugaaugauuuccugcauguccucgaacugaaacaguggcuggaagcaagauuuaucuaaagagaacccacaucaccucaacaauagaaucagacagggacucgugucccccagucagaacucacccuuccuuucaugccacagucagaccaggagagaacuucuccuucccacacugaccccuccccucccucuggguuucauuucuacccuucccccacagccucuucccagacaggagugggagaugaaugaagguccuuacaguugagucccacaucgugguagguaaggaucgcugggcguuuggguuugggggugccauagacagugaaagugacagagccguauggugucuccacagagugagucugcaggaaaacagggcaccaagagcuaggcucagaggagacgaggccagaaaaggagcaacaccaaggucagggagcugggagugggugggcaagagggaaaagggaacaaagaauuaaaaacaggaucagcaagaauugaggaaaacaugauaccggaagaugaguuugaggauaagaaagaauaaugaagauuagagagagaagaggaggggaaggaaggagaggggagagauagggaagggaaaggacuagaauagaaggaaagaaagcaaagagagaagagagggccaagcagaggccauccuucuacuggggaagaggacagccccuccucccaccuugggacugcccccacacuguuaccugucccugguccaggaggauucgggcagcuaacucagccuccuggagagacacacacggauucacacagaaacacaugaccauguggcgucccagauggagagacaaacagacaaagagaggcaaguaaagacagaccaacaaaugaccaaagacagaaagagauugacaaagagagacacggaaaggaugaagguuaguguagugacgagacaagggccugacucccaauuauaguguauggggagagagacuaggguaguggugaagcaguggugugaguuagaauaagaucaguacgcuugggaaguuagaaggcaagggggaugcuuagaggucuggaauuugggcaugggagucaaacggucucuaauaaccuuggccgccucaggcgucuguccuggcaacaguggcuucuccucugugaucugcaccuccugcagcuccgccaugguggccuggcaggaugaggaaaugagacugggaaguugucucuacauccccacaucgccucaaacaccaggcuuccucucucagcacaggaagaugcagggaacagagggacccagggguugaagacuacucuagaacacacagagggccuuuccugcccccagcuccguuuccaggcugaucgguggaagcuuuggaagaggaaucaggacagcccuucucuugauacucaccauccccacugccacccucaacaccacaccuccagaccccucccuccucugcccuggaccaaaauaccaggguggggcagaaguguagcucagauuucucgggcuauauuuaggggccaccccacacucucagguagggagugaaacuuguagcucagugacugaguauucuaaaggacaggguaccaaaagacgggacugugagaguucacaauugaccaugaccuucaauuaaagccccaaagucggcagcucaaagggggcuaaaaaugaccaaagcaacaugaccaaugggggagguggggaaaacaacauaaaagggacaucuguccaaccaacccaaugccucccuuccucccaagacccuuccucccaacucugaauaaacuccgcaaguucaacauuagugggugaggagcagagcaccuggacagaccugcacaggaaggagccugcagccugcgggguggggucacuuacugggcuccuauuggcuggaugcagugggauuaggggucaggguucucacuccuucugacucuggggucugagaaaacacagcaacgaggugaaugacaugggagacagaccuggggucuuucagggacggaaagccucagccaagacccagacucccagggucaucaaccuccucgggucacuaacccuccccagugucugucuaccccuaaguccagagaacacguccucucuaggcucgagccggaaucaauauaggcuacaagggcaucaguucaggcugcgcggaggagagaaggaagugcugauguggagguaagaggguggcccugucagaaccuccggauucgaaucccggcucugccacucccagugugaccuugccccaguuaguuacuacauuuggccucaauuuucuaucugcagggggacuaaacgcgggggaauaggggauccccaaaauuuuugacagcucuccaguaagaggaggguagcagagcauggcuguuucccuccacaauuuaaaaacaaacacaaagauuggugccgucgcuucucuccucuacucagucuccguguaggucccacgaguggagaaagggagaggagagcggucccacaaucuucucccguucucccccgacggcccgcgaaggcaagcgccaucgggaagggauggguaggacagaggagaccggccgggcccagcacccggaacccgucccuacgagucccuacgcagcccguccgcguggagacugacacccuugcguggccggugccaagcgccccggaccuugcacacaaccucgcgcgcaccccaaacacgcccugcagcucuuggagccucagccuuugugcgcagcaaccgagcgcccgcuccgugcuggcccuuucccccgagccuccagcuccaggggacgcggaucaaucacaccgcccgccggcccggcuggcgccuuccaggcccuacggccccucgccugccccucccccuaccugcugccgccgcggccgcuuccaccuucacuugccuuugacucgggcccgccccggcucgggcuucccgcagacccgcccccggcccgccccagcccgcccacgggcgcuaggcuccccgcagacccgccccagacccccaguaaacacgcccccccuuucaccccgcccagacugccgcucaggaaaggguugugcuggggccggggggcgaggggcgggcggcuggacgcuuccaggcucugcucggcucaccaaaacauuccaccacccccuccccgcauuggggcgguguggggagugcggggaucccucagcccugagagggaucccucggcugcccucagcaccgccccauccacgaccuggaucugcaauugcacucuggcuccuuccuucgcccccagacucaguggugggaaccgguaguggggagacgaacccgggauacugacaccccacgaguucgacuccccccgcccgaacacagagaacuagauuaagaaaggaggaggugggcgggaccgccgcugaggaggcgggggucucgccggcuggcaggggcaggugugcuggcgccgaaagggggcacgggggaacgucgagggcgcaggaguuccgacucccucgugcccagaguccugguaccucuccucucuuugcugcgucccgacgccugcucuccggcugcuccgggagaaguuggacaacaaggcggggaggugggggcggggaaugcggggggccgcuauaaauagagggcgaucgcgggcaggcgggggguggggagaggauggccaacagggacucuggggucaaugccucaaggggcgcgggggaggggccggggacccccagaggcucugacuccuggguaaacag

SEQ ID NO: 17552 - RNA, 9308 nt, Homo sapiens
cuguuuacccaggagucagagccucuggggguccccggccccucccccgcgccccuugaggcauugaccccagagucccuguuggccauccucuccccaccccccgccugcccgcgaucgcccucuauuuauagcggccccccgcauuccccgcccccaccuccccgccuuguuguccaacuucucccggagcagccggagagcaggcgucgggacgcagcaaagagaggagagguaccaggacucugggcacgagggagucggaacuccugcgcccucgacguucccccgugcccccuuucggcgccagcacaccugccccugccagccggcgagacccccgccuccucagcggcggucccgcccaccuccuccuuucuuaaucuaguucucuguguucgggcggggggagucgaacucguggggugucaguaucccggguucgucuccccacuaccgguucccaccacugagucugggggcgaaggaaggagccagagugcaauugcagauccaggucguggauggggcggugcugagggcagccgagggaucccucucagggcugagggauccccgcacuccccacaccgccccaaugcggggagggggugguggaauguuuuggugagccgagcagagccuggaagcguccagccgcccgccccucgccccccggccccagcacaacccuuuccugagcggcagucugggcggggugaaagggggggcguguuuacugggggucuggggcgggucugcggggagccuagcgcccgugggcgggcuggggcgggccgggggcgggucugcgggaagcccgagccggggcgggcccgagucaaaggcaagugaagguggaagcggccgcggcggcagcagguagggggaggggcaggcgaggggccguagggccuggaaggcgccagccgggccggcgggcggugugauugauccgcguccccuggagcuggaggcucgggggaaagggccagcacggagcgggcgcucgguugcugcgcacaaaggcugaggcuccaagagcugcagggcguguuuggggugcgcgcgagguugugugcaagguccggggcgcuuggcaccggccacgcaagggugucagucuccacgcggacgggcugcguagggacucguagggacggguuccgggugcugggcccggccggucuccucuguccuacccaucccuucccgauggcgcuugccuucgcgggccgucgggggagaacgggagaagauugugggaccgcucuccucucccuuucuccacucgugggaccuacacggagacugaguagaggagagaagcgacggcaccaaucuuuguguuuguuuuuaaauuguggagggaaacagccaugcucugcuacccuccucuuacuggagagcugucaaaaauuuuggggauccccuauucccccgcguuuagucccccugcagauagaaaauugaggccaaauguaguaacuaacuggggcaaggucacacugggaguggcagagccgggauucgaauccggagguucugacagggccacccucuuaccuccacaucagcacuuccuucucuccuccgcgcagccugaacugaugcccuuguagccuauauugauuccggcucgagccuagagaggacguguucucuggacuuagggguagacagacacuggggaggguuagugacccgaggagguugaugacccugggagucugggucuuggcugaggcuuuccgucccugaaagaccccaggucugucucccaugucauucaccucguugcuguguuuucucagaccccagagucagaaggagugagaacccugaccccuaaucccacugcauccagccaauaggagcccaguaagugaccccaccccgcaggcugcaggcuccuuccugugcaggucuguccaggugcucugcuccucacccacuaauguugaacuugcggaguuuauucagaguugggaggaagggucuugggaggaagggaggcauuggguugguuggacagaugucccuuuuauguuguuuuccccaccucccccauuggucauguugcuuuggucauuuuuagcccccuuugagcugccgacuuuggggcuuuaauugaaggucauggucaauugugaacucucacagucccgucuuuugguacccuguccuuuagaauacucagucacugagcuacaaguuucacucccuaccugagagugugggguggccccuaaauauagcccgagaaaucugagcuacacuucugccccacccugguauuuugguccagggcagaggagggaggggucuggaggugugguguugaggguggcaguggggauggugaguaucaagagaagggcuguccugauuccucuuccaaagcuuccaccgaucagccuggaaacggagcugggggcaggaaaggcccucuguguguucuagaguagucuucaaccccugggucccucuguucccugcaucuuccugugcugagagaggaagccugguguuugaggcgauguggggauguagagacaacuucccagucucauuuccucauccugccaggccaccauggcggagcugcaggaggugcagaucacagaggagaagccacuguugccaggacagacgccugaggcggccaagguuauuagagaccguuugacucccaugcccaaauuccagaccucuaagcaucccccuugccuucuaacuucccaagcguacugaucuuauucuaacucacaccacugcuucaccacuacccuagucucucuccccauacacuauaauugggagucaggcccuugucucgucacuacacuaaccuucauccuuuccgugucucucuuugucaaucucuuucugucuuuggucauuuguuggucugucuuuacuugccucucuuugucuguuugucucuccaucugggacgccacauggucauguguuucugugugaauccgugugugucucuccaggaggcugaguuagcugcccgaauccuccuggaccagggacagguaacagugugggggcagucccaaggugggaggaggggcuguccucuuccccaguagaaggauggccucugcuuggcccucucuucucucuuugcuuucuuuccuucuauucuaguccuuucccuucccuaucucuccccucuccuuccuuccccuccucuucucucucuaaucuucauuauucuuucuuauccucaaacucaucuuccgguaucauguuuuccucaauucuugcugauccuguuuuuaauucuuuguucccuuuucccucuugcccacccacucccagcucccugaccuugguguugcuccuuuucuggccucgucuccucugagccuagcucuuggugcccuguuuuccugcagacucacucuguggagacaccauacggcucugucacuuucacugucuauggcacccccaaacccaaacgcccagcgauccuuaccuaccacgaugugggacucaacuguaaggaccuucauucaucucccacuccugucugggaagaggcugugggggaaggguagaaaugaaacccagagggaggggaggggucagugugggaaggagaaguucucuccuggucugacuguggcaugaaaggaagggugaguucugacugggggacacgagucccugucugauucuauuguugaggugauguggguucucuuuagauaaaucuugcuuccagccacuguuucaguucgaggacaugcaggaaaucauucagaacuuugugcggguucauguggaugccccuggaauggaagagggagccccuguguucccuuugggguaagaguuaggucguuacugcuucaccagacugugaggaacaggacaggugcgggaaagguucgacuggggaggaggaaagggagggcagugguuauucugggagagaaugaguaggacauccugagguggggggugugagggcagguugguaucuuccuuaacaugccucucuuuuccagauaucaguacccaucucuggaccagcuugcagacaugaucccuugcguccugcaguaccuaaagugagaggccugggaaccccuccaaaccagaguucucuuuccagcacaaggagacccuuagaacuuccagguucaccgugguuccugagccaguuucagcuucugaacucaauauaucuucuuccuucaugcucccgccuugauuauugagaaaaggugguggguuuggaaaauuggccagagucaacagaauagcccuaauggguggagggaaggaaaagggucuaugcuuggcccugccucaggcuaaggagggccuucucugaucagaaagucagggaggaaugaaagggggugacauaaucccugaggaaccagauagaccugucucuuucucucccacuccccucuccuucaugcccacaccugguggauggggagcucugcgggugagagagaguuggggaaggaagagaacaccagaccaagugucuuugguauucagagggaggugcuggccccugggugcuguucuuagcuaagcuucuccuaggcaccagggcucagcagcucugguucaccacuuugccacucuuuuccucauucucuccauuguucacuaaaauugugucuguuuucacauuugcuuuaaguuccauucuucccguuccucuagaggaaccaggaacuaaagcagaacaaguugaacuggcucuugaaaauugagaauggacaaagagcuaucuauaugggaaaacaguguguugguuggcugguggauggguguuuguuuuuaagacacuagcucuccagcagaaagcuggggauagacuucagguaucuacccugacuacccgugccaaccuuuggcuucuugggcccuucuuuuucgcguccuccaaagaaagguccgugucugccuuucuuugugcccguggacucaggagggagggugaagaguuugaagagaugggcuguggcagguuuuggacagcagaucccaugaggcguauauuucuuucccuuucacaguuucucuacaauaauuggaguugguguuggagcuggagccuacauccuggcgagauaugcuguaagaaauaaaaagcccagaggagggaaaggaggguccagacugauuaggagaauacuguuuauuagugcuguuugggggaggaagugggcacuagguggggagucaggcccugugggaguccaggagugggucgagcuuagcggggaggggauaaggccaugcccuguuucucauuuccuuccuucugcugucccucagcuuaaccacccggacacuguugaaggucuuguccucaucaacauugaucccaaugccaaggguuggauggauugggcagcccacaagguuuggaggggccugugugcugagaccuacgguuggggauccccucguauggauccaguuaggcucugguagauagccuaacuggauggacucugaacuucaaggagggaguaaaggggcaggaaagugaagcugucacuuugccugagucucuuauaauauccugaacuuucuuuuucuuuuucuuuuuuuuuuuuuuuuugagauggugucucacucuguugccaaggcuggagugcaguggcuugaucuuggcucacugcaaccucugcuuccuggguucaagugauucuccugccucagccucccaaguagcugggauuacaggcacccgccaccacgccuggcuaauauuuguauuauuaguagagaugggguuucaccaucuuggccaggguggucuugaacuccugaccucgugauccacccgccucggccucccaaagugcugggauuacagacgugagccacugugccuggccaauacccugaacuuucucaccugccuucuccucauagcuaacaggccucaccucuuccauuccggagaugauccuuggacaucuuuucagccagguaaguggguguaggagauguagaagagucgacgggagcagcagggaacuugaaugcuugggcuaacuuccuuagcugggacaggauuuggggaaggaagaaggcuuaccucuuuuccuccaguaauuguuguuuucucuuuccaucccuaauuuuucuccuuguucucuccuucaggaagagcucucuggaaauucugaguugauacaaaaguacagaaauaucauuacacaugcacccaaccuggauaacauugaauuguacuggaacagcuacaacaagugggugggcuguguguguaugcaugugagagaaaugcagaagcaguaauugggcgucaugggggaggcacagaggaggagagggaagucuggguagugugcaaugugcaaggaaugcagcauuuagugugcaaugggggcagcuucaggacagagucagugggaaggauugcaaggggcugucccccuucucuuguuuaccuccuuuggauuauuggacucccagaaguaagaugaucuuguguccuguguccuuccuccccuuuuguugcccucugaccagggaucuagggcacaagugacuauaggggcugugcuuggggccugccugccccuuucuccuuugguuuccaccuuuaauaaccaagauuugaccguaauuuuuagacaaagauaguuccaucaugggagagauagcuuauaucugguuagauagcauugcccaccuaaaauuccuacucuuuuaaccccuuucuagccgccgagaccugaacuuugagcguggaggugauaucacccucagguaagacuuuaagagauaaugcauugccugucucccuggaucuucccuaggagcuugugucccuuagaagaaggagaaucuuuugccagggaacuuccuugucaugucccaccccauccuauuugguaaaucacuucccucuaggucuucccccuuugaauccucuugguggcaucagcagggagacacagaagugucuuuccucuuuggagccagauauuuuuccagcugcacuccuaggcagaggccagugagggagugccaggggcucacugccuucuccccaacacugugucuuuagguguccugugaugcuggugguaggagaccaagcaccucaugaagaugcagugguuaguagggaauuuuggggugagugagggaggaggguugggguccuaaagugguggucagaagaguaucuugccaaggggauguccuguuuggcacagggagaucaacuuuggggcacuaagaauuugauuccugguaaggaggaacuggguagggagcugauagaaaagggacuggggucuggguuccugggucccuuacgggggaggcgccacagugggcgugaccucauucauucagccuccugcuuacuccagguggaauguaacucaaaacuggaccccacccagaccucguuccucaaggucaguaaccuguuccugggcccccguccacagucauauauccucucuacaugcagcugcuaagccuccagggcccggcaugggagcaaauggggugaacgaagaacaaaacaaaggggcuagagugaagaagcuagggaagagagacccuuuccaccucucugcauggcucauuuauguguguuucacuuuuucuggguggugcucuccugaacagauggcugacuccggaggucagccccagcugacucaggugagugccgcugccguccaugggauggggaagggacauaggauaccgguggcacugggcucugcccuuugccacacacccggccccacagugccgcagccucaggcuccagcucuuccucuaaccucaucucaccgucucccucgccucuucuuacuuccgcagccaggcaagcugaccgaggccuucaaguacuuccugcaaggcaugggcuacagugaguaucgggacaagagcuugcugcacuagaggagagauaggcacugacgggguggaaccguuuuaggugaaugccuggacucaccgcuaucugcccaaucgagcucguugauccccuggcuuaguuauaacuaguccauaauccaaggaccacacccugagucgccagccccccuuccccacuuccucucugacugcuugugcaucgugcugucuccacaguggccucauccugcaugacucgccugucccggucucguacagccucucugaccagugcagcauccguugauggcaaccggucccgcucucgcacccugucccagagcagcgagucuggaacucuuucuucggggcccccggggcacaccauggaggucuccuguugaauggcccuuguugcccuagagugggacccagcccucaccucccccagagcuaaccugggaggugcugaaggggcauugggccaccguaagcaagggaaaaagggcagaucaugcggggagaugaccuugaucuuugauugcuacccuaaccuugaccuuuaacccgugauuccccccagcuccuggaagagauguccuaauaucucuuagggacccagaccccuaaauucuccuccucccccauuuugauguuaagguggagagggcauaugcauccucuguccugaucuaggugucuauagcugagggguaagagguuguuguaguuguccuggugccuccaucagacucucccuacuugucccauauuugcaaggggaggggauuuggggcuggggcuccauucaccaaagcugagguggcuucucauuaacccuuuaggacucugaaggguauggaccuacgugaaugugugucagggggagacuugcugguggguuagugguccucaggaugugauagaaacauccaguguaaaaaggaaguuggaaugggaguuggcgggcagugaacgaguguggggaaggauuggugcuggggcaacaggaaggggccuggggccguuuggcugcacuaacuuugguagcucagugugcaucuagagugggacuggggagggagcuaagcuugggcugggcugcuuggggcuuggcauaggguggaaagggcuacccuggggcucugaccacacuguaguauguguggagggugcccucccgucucccacaacuucugcuauaacaauaaacuguagaggaaucugaguaccguuauuauucuuugucuaggugugccugcaucaugcuccucuuccuaucuucucccuguccacgucucauauucucuucucaaagugauauaaacccugggagagggccuuuguggcauaggcacuucacaaaauaugaccacauagaaacuggcucuuuucca

SEQ ID NO: 17553 - RNA, 520 nt, Homo sapiens
uccccuccccuugcaaauaugggacaaguagggagagucugauggaggcaccaggacaacuacaacaaccucuuaccccucagcuauagacaccuagaucaggacagaggaugcauaugcccucuccaccuuaacaucaaaaugggggaggaggagaauuuaggggucugggucccuaagagauauuaggacaucucuuccaggagcuggggggaaucacggguuaaaggucaagguuaggguagcaaucaaagaucaaggucaucuccccgcaugaucugcccuuuuucccuugcuuacgguggcccaaugccccuucagcaccucccagguuagcucugggggaggugagggcugggucccacucuagggcaacaagggccauucaacaggagaccuccauggugugccccgggggccccgaagaaagaguuccagacucgcugcucugggacagggugcgagagcgggaccgguugccaucaacggaugcugcacuggucagagaggcuguacgaga

SEQ ID NO: 17554 - RNA, 520 nt, Homo sapiens
ucucguacagccucucugaccagugcagcauccguugauggcaaccggucccgcucucgcacccugucccagagcagcgagucuggaacucuuucuucggggcccccggggcacaccauggaggucuccuguugaauggcccuuguugcccuagagugggacccagcccucaccucccccagagcuaaccugggaggugcugaaggggcauugggccaccguaagcaagggaaaaagggcagaucaugcggggagaugaccuugaucuuugauugcuacccuaaccuugaccuuuaacccgugauuccccccagcuccuggaagagauguccuaauaucucuuagggacccagaccccuaaauucuccuccucccccauuuugauguuaagguggagagggcauaugcauccucuguccugaucuaggugucuauagcugagggguaagagguuguuguaguuguccuggugccuccaucagacucucccuacuugucccauauuugcaaggggagggga

SEQ ID NO: 17555 - RNA, 609 nt, Homo sapiens
auggagacagcuggccuguggugguagagguuggggaguggcucaggaauuaaauucccgaauagagaccagcgauaccuauuggaucagcuucauacuugcgggagcagaguagguagagcuucugguugguuagggugcuauuguaguagcagcuaguggguggcuguugguggcucagggagcagaccgugauggggagggaauccugggugagugugcaguauucauuguaauucucacagaagcugucacuauacuugcagaacuucuggauggccuuccaaggggcauguaucacauaauggaucuuugggcaaucugaauuuugcaucuugccucgcauauaggacaucagaccauuacaauagccccggaaacccuuuggguaguuaacccugggauagucaaugcuuaagguauagaaguuccugcugccaaucugcaucuugauguccaugaccagaguuggccccagaacaagcuggaggaaaaggagccgggucacagcuggugccauuccuccugcugguagaguuaaggugguugggggcagcagugggccugaaguggcugucugccacaucccagagccuccagcauucccaa

SEQ ID NO: 17556 - RNA, 6560 nt, Homo sapiens
aggcaauuuauuuuuaaccccugaagugguuuauaguuuuaaaguacuuuuccuugugugauuuuauuuuagccuugauacuccaguaagguagacagaauaaauauuaccauaaccuccaagugcacaaaauguaguucagagagguuugacuugcccaagcaacaaaauuagaaucuagguuuccugagucccaguccuauuauuuuuuugaggaaaaauuucuaguaagaacuuagggguucaugaaaccaaaccaaagaaguagguaugggcauaacugcuggaacagauaaauuucaacugcuaagcuguucaaaaaucaucacaaauuauuaauuccauuucuuuuuuucuuuuugagacagagucucgcuuugucucccaggcuggagugcaguggugcgaucuuggcucacugcaaccucugccuccuggguucaagcaauucuccugccucaaacucccgaguagcugggauuacgggcacccaccaccaugccggccuaauuuuugcauuuuuaauagacacggccaccauguuggucaagcuggucucgaacuccugaccucaggugauccacccgucuuggucucccaaagugcugggauuacaggccugaaccaccgagcccgcccaacuauguuucuuuuaaugaaguauuucugcuuccccucuccuugcaggcauugcccuucuggccuuccuuaaguuggguguggcuauaugacuugcuuuggccauugaauggguggaagugacaugaauguaucacuucagggcagcauuuaagaguccaugaacaauucuucaugcuuacuucacauucugaggcggggggcgcggggcggguaaccuuaaccuucauagggacaggguaggaucucaaaaugguggcgcuccaugagcuugggaggaaacauuugcaaugaacagaaucccuugccagccuacuuuggacacguaguaugagaaauaaaccuuuguggucuuaagccacugugauuuggcauuuaccacagcagagccuagcuuaaucugacugauagagguuaauuuccauggucaucaagcuucucuggaacuagaaugcaauaucuaaucugaucacaucacuaaaaccuggaaaacagaacaaauuguuaauuuucuucccucagcuuccucaucuaccaccaccuucugacuuucaagaaaaauauuguuucaucggcccugcagacaugagcucuccauuauucuggcaauuagacugggggagaggaagaaaugcagaaggccuagaucuuuucuccauuccagagccugaucccagaacuguccccacccacuaguacucacacuuaaccuugucauaggaagauuauuaccacucuuccaaggugucacaaacagaaaagagcugcagcggacgccacugcaaugucaaggcaaggcagccaggcugcgcucuauccucacuggugccuggcccuggcuaggccgggagaagcagcauucucuagggaaagaagccuucucaagugggaacaaaaaugagugugaggcgaacagccaucccgggcacuaugugaauuuggggugaguucucuugguacuccagcuguggucaauuucuaguuucuagcggccagcaagcugcccagcugcugcugcuagugggacucccaguucucccgggcuuuucccaagcccaagcgagccuguuaucuuugcacacuugcaaaggucguaaacggugggggugaacgcagccagaacuucagcaacccgaccgcagccgagaucaaaggucggcgggucagcccagaggccaagccugcgcagucccgcucccgcguuggagauaaaggguggcggcagcgcaggcucguuacaccggcgugcucgcaagaggcgggaaagcguuagggagagacgcgggucgcagggucccucccucugccugcccuaucuacccgccugcccagcgagccuguccaucuucagcgcccaggcccuaggggaggggacgagaaaggccccgcgcuucugacucaucaucuccaaccccuuucucgcgcgcgcuccaagucucaggacuucggaccugggcccuccugcgagggggugcggcgacagcaucugggaagccccagcucugccaagcgucagcuccgagcccucgccagucucugaagcugccagcgcagggcuggggacccagauccagcucucuauugcaguggcugggggagcggcacgccagugcaggaccgcccgcccggcuccuccccgaacgcggggccaguggucgcguccgagaaagcgccaggcuaggccccgacuuccccgccucgcgucacucagcacauccaacagcgccccuaccgcggagagaaggcucuuuauuuccuagccggucacgggcuagcggggcauccugggacuuguagucuccgcuacaguagaaaggagauggaucgaaaggggaacuggggcacuccugaauuggauucagggaguuggcgugugcaggguccgggauuuggaguggaugggauuaugaaagguggacagaaaagaaaagugcgaugaggcaaaugugaagcuguauggggaggugacaggaagagaggauauggaugcaagggagaaagcagcuuuucaggguggugaggugaggauauauucucguccagguguaucuuccccuaacagggaaggaacgaaaaaagggccugcuuugagugaaaacugaaggcacucccggacuuccuauuggacucgaaggaucccagcaagcuucugaguuugguggggugggaugcaggaaugucuggagagcauucucucaggguggaaggagagcagcacgugucuguucccgcugucccacccucucauuugcuccugugcuggccaccgugggaccauucuccaaaccaggaaccucuuccaacucagagaagcccugaaaaccagagacaggugugagcaaauuguagaggugagaaaggagaaaccccagacagaaacaacugcuuccuccugcccaauuuucuauccuguuucccauaguccugccaauauuuaggcagcuuccuaaugcuuucccacucuuuuaaccucaaucauuuggauucccaguuuccucuuacccaccauuaggggagaaauguucaaagccagagaaagccaaucaguuucauucuaggaccucuucuuuucucuccugccccauuauuuucccuuaagugccacugaccaggauaggcaguggaaaaauuaguuggcagcuagcuauucgugcuuucuucccugcccccauaccuccugcagcucuugauagugcagacucuggcuccugcagcauccugguuuccucuggcucagcaagaauagggcgugcacugagaccagcacucccccuagggugaaggccucagcacugaguuccagcaccagcaagccagcaugcugcagguagacagggcugagaaugcagggaccccgcaccuguuugccccugcccuuuucccuucccaccuccucuugccuccuuauccucccaccuucuccuucauugaccaguaccugggaggaggcaguuggggcaggccccaaggcugucuucaucaccucgaccaccaccacuaugaaacccaagaucaaguugaagguguugaauaucaucauggcccgcaccugccagugagccagcucagcccugcccagccuaggggagucauuccaaccucaauccccacuugcagccuagcugaagacaaaacucagcuucugcuucucagccuccaaacagggccauaagcccucuuaacuuuuuugcuuuccuccucagugauugaggccagucaguggugacagcugagagaaugagucaacacuuagccacuuacuuccuaggcugaggguuguaggugucuguuuuagggagugggaggacagugcugcguuuucuucccucucaccuuccaaaggcggggugcucugcgaagcuccagagugacagucccagugaggagacccugaauggugagaagggcaaguguugagcucuggucccguuaggaaggggcccugggaccuuccacccucccuuguggugggucuuacugaggcuccaggcccaagaggcagcgcuguggccaugugacaaucagaguucaggcaggcgacugagacagcaaggggcaccacaaccacugccagccauagcuggcucaccuggggguaaggguaggguaauuggggaggaacugucagggauucccucccuucucguaacuccuaccucuuuagagaucaggaaaugggauugaaugcaggguggaggaaagcagucaacccagagcaaggacgugaucauuaaaaauuaaguaucauuuaauuuuuucugccucauauuguaguuuaguuacuuaccuguauguuuucccccacaagauggaagcuacuugggagauuaagggucuugccuuguuuauuucuauguuuuccucuacccuccucccauucagaaccuagcucaguuucuggcacaugguaggugcucacuuaacauggauggauggauggauggaauugaauuggguagaaguggacaugcugagaccugggaugggguagccuggccucaccgcuagcaccaagaggugcccacucugccugugccuugcccaguguuguagcuuuuccagacgaaggcugugucucuccugcucuugcucaccagcucuaucuuccauggcuccuuugcccacaagaauuaggugcuuccuaggcugggaaaaaugcguuauagguucugucuauuaggagacaggacaugcaacaacguaucuuucagcuacaccucugcccacucccaauauccagggauuugagguccagguccucacaccuaccuagucugaagcagcuacuccaaagggaugggacccagcuggguccuaggucuccuaaggggcuugauagcucagagcagacgacaaacuuguccuggcagaggaaggcugucagggauggggugugguggggcaaagguuucuaugaaggccuaaggaucuagggaguggcccuggguagauaccggccucaguucacuccacaagaugucuagcccgaccucacucuguucccauuucucauuacccucauuucugcccauccuggguuccuuuucugguuucacuuaccucauccccauggacacuaucacucuggaccucaauucccccucauuuccauaugaucuuacuccuuucuuuggcuuccuccucaaauuaugugcccuucccuagagauccuacuuucugucuggauugguccccugucauuacuacuugcagcuuugcccccagaccagguaagguugaauuccaggggcuuucuugccucucacuuucuggacagucucccuuccuucuuucuugaagguuuuacucugaacugaacacugacucaauggaugggggggacccuguuuaugguggggauuguuuuugauucaaugauaaccugcaacuggacauuaucuaucuaucuaucuaucuaucucaugguccucaaauagugagucuugggaaggaugcuauugcaacaauuaauauuuuugagagagaaggugccucauagccagacagaccugagcuggaaucuuagcucugcugcuucuccaucugugugaucuuggauacauuauuauuauuauuauuauuauauuauugagacaggggcucacugucacccaggcuggagugcaguggcaugaucauggcucacuguagccaacaccuucugggcacaaauaaucauccugccucagucucccaaguagcugggaucacaggcacaugccaccaugccuggcuaauuuuuaaauuuuuuguagagacagggucgucucacaauguugccuaagcuggucucaaacuccugggcucaagccauccucccugcuuggccucccaaacugcugggauuacaggugugggccacugugucuguccugauagauauguuuuucuaccuauucgcaccucaguuuauucacugauaaaagggggcuaacaauaugacugugaagaguuguugauucaggguggguguuuaauaacuauuaguggugcugaugaggucacaccgauaagucugaugcccauacacuaaaaguguuauucagaaggaagcuggggacacauuucuacagucggaagcagaaccagcugggcccaaauauacucuauagaucaaaacaaaucccagaucuaccuaggugcccuuggcaaguugcuuaaucucucuguucccuuaucuauaaaaggaaguuaauaauaccagucucaagggguugcuuucagcauggaagagagcuuagcccaguaccugguacacaagugcucaauguuaguggcuaugaucaucaucacuauuauuauuucuuguuguugacgauaagaggagacugcgccagaagacucuagaaguuaguacgaggagggaggcaggguccugggaggcaagugaucuuuuguaagccacuccugccccaucagug

SEQ ID NO: 17557 - RNA, 1225 nt, Homo sapiens
gaaaggaaaggaaauacacuaacugggaaaaaugaaugaagcaucucaacauggauuacuaaaucuugccaacagguugaauuaugcaacaagcagacacacccuucucacuucuuagucucuaggacaccaucauuucuucuguggcagguagaugcagaagcaccugcagaccagagggcaugcccaauauucacaggggugggcaugggaaugugcucagggugacaccaccuaagguaaaaguucccuugacuuucuaaagauaugugguaaugcauugagaaaucauuccauuguuuuccuaccccaaaccuuuauuaaagcuuucuucacauccuuguuucucaaagaguacaugaggggguucagcacugggaucaccacuguguagaugacagcaacugugcgguccugggucaaggaguagcuggaccuggggcgcagguacauaaaaaguguugugccaaagaagaggcagauggcagugaggugggaugcacagguggaaaaugccuuaaaccugcccugggccgagcucauuuucaggaugguguugagaauuaagaaguaggagaucaagauggugagggugcagcucaaaagguugaaaccagcaaaaaugaagagcaggaucucacacagugaggugucuacacaagacaaggacaggauggguggcccaucacagaagaagugagugacgacaugagcaccgcagaauuucagacuaaagauacagccaguguggauaagagaauugaggaauccugcacuguaggagcccacaaucagcgaggcacagaccucaggagacaugaugguugaguagagcaggggguuacaaauagcggcauagcggucauaggccauggcagcgaugagauagcacucacugguggcaaaacccgcauagaagaacaucugagucaugcagccaaaauaagagaucacuuuccucuuggccaagaaguucaccagggucuggggcacaaccguggaggaguagcagaaauccaagaaggagaggcucuucaggagggaguacaugggugugugcaggguggcacucacauggaucaggaggaacaugaccagguuccccagcagaguggcuguguacaugcccaggaacaccacgaagagcagccucuggagcugggggucaguggugaggcccaagagcucaaacuccaucccuuggcucagguuugccccuuucauc

SEQ ID NO: 17558 - RNA, 610 nt, Homo sapiens
uuuuuuuuuccuuuuaauuacauuuauuuuaaugcugaauuuacucccgugccauaaguuuuuguuucuucaguuucuucugggauauccuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuuaaguucagcauuacucucuguguuuuuaagcaugugcagcaaaaauucagcacucuuuuugggccaccgaccuuguguccagccccacugcuuggccugcgcacaccugccaacuccaccauuguaacgucggaaugguacacacuguuucuguaaagugacaucuuucagauacuucguggcuuuucguauaugcauacccuugauggccugagcaguuucacgaguguucuuaaagugaacacgaagauuggaaccucuugauuugcaugauuccgugggguucuccgggucaagugaauagcgaaccauuuucacagauuaccu

SEQ ID NO: 17559 - RNA, 14029 nt, Homo sapiens
caacaccuaacguggcucuuuauagcuuccaagaaagcgcgacaccggaaaugacuuuucugucuugcucagcuccaggggucauuuuccgguuagccuucgggguguccgcgugagaauuggcuauauccuggagcgagugcugggaggugcuaguccgccgcgccuuauucgagaggugucagggcugggagacuaggaugucggacacguggagcucuauccaggcccacaagaagcagcuggacucucugcgggagaggcugcagcggaggcggaagcaggacucggggcacuugggugaggcacugggcuguuggggccgaggcucaaccggggaggacgggcgggaucccuagagaaaaagcuccagagucacugcccuuuaccaaacggccauuucuauaaagccucguacauugguacucccucuccaccuucagcagcagacguucgcccuucugcaaguaguucgcgguuccuccucacgcugggccucgguucuuccagcucacuuuuaccggacggacgcuugagccccacccucguccgccuugcccacuccucuucagacugcgaggacgucgccuuugugaggcugcucagcccccuaucccgcgaagcagcaagaaccccuuuuuguugcugcuuuggcgcuuuguucccucaguuauaacgacucuuuuguaguggucauuucuuggcagcuguggguacaguaagcgaggaaugaaccuuuauauccgcagugcccaauuuaguggcccguacagaguggcacuggguguuucugaaugaguaccccuaccggcauugacuuagccauuuacauaccuagcaggaaucugaaaacauuuguguuugguuuccaaacuuuuucucuucuccuguugcccccgugucacgaucauaaaacuugaaggaaauuuaaaagauuaaauucacuguuauccacucccuacccucaggacaaacucugaauuauuuaaggcaaacuaguaacaaagcucugcaaaaauagugacucaguaucaccuuugugguagauuguuccaauauuugucaguaucuucaacugcaucucuaaaucuugucuagaucauguuagguucaugugcucguauucuggccccuagaaauagaagaugcacuggcaggauccucccaccuaauuaauuaccuuucuugaguaucuacaguguucaugggucuaauuagacaaaaauaaggaagaaauugccccuguccucaagaaguuuaaaaagcauaggauucaaggggagacgcuuacaaaaagugaggaauaugauaagauauauguacgaaaccaaaugaaugaaucuacagucuguacaaugaagagaaguaacaagagcugguguagguagugaagccaucaaaaccaucauaguggaauuggcacuugaauuuggccuuuauggcuauauaggaccuagauaauuaaagagguaagaggggaggauaguggaguaagaagugcaagucauauggucaggcaauaauuaguagucaagucucagaguaguuccugaauuaccuaagagggagaauuuuuuuucccuugcucuagaaacuucauugauuuauuuauagauacaauuuuuuguuuuguuauguuuuuuccccuauucuuugguuuccuguuuugaaacuuuuuaaaaaugugcauaaaugaugccaacgacuuuuuuugcuuuuguuuuugagauagcgucucucaccguugcccaggcuggaguguagcaguccucccggcucauccuccugaguagcuaggacuacaggugcaugccaccaugccuggcuaauuuuuaacuuuuuaauagagauauggucucauuauguugcccaaauuugucuugaacaccugggcucaagcuguccucuugccuaagccucccaaaguguuugaauuacaggugagagccaccauauccagccuauuuaauuuuccuguggagucuuuucccauucagcaauggcaguugcaaaaggggaccugaggaucagguaguuguuuguuucaacaaagugaucugcaaaauuauuuaguuaguuaguuagagacagggucucccucugucacccaggcuggagugcuguggcaugaucauggcucacugcugccuugacuucccgggcuccagcgauccucccacuucagccucucaaguagcuggggccacaggcgugugcuaccaugcccagcuauuuuuuguauuuuugguagagaagggguuucaccauguugcccaggcugaucucuaacuccugagcucaagcaauccacucacguuggccucccaaagugcugggauuacaggcgugagccaccaugccuggccuacaaaauuaacuuuuaaaaagccgcuauauugguguacuacaucauugacuacuuuguguucaccuuucugucguuuuugugacaggccauccucuaucuguggugguguuuguuguuucuugguuuuaauuguuccucaucauacuuauuuauuuauuuuugagauggaguuucgcucuuguugcccaggcuagagugcaauggcgcgaucuuggcucaccgcaaccuccgccucccagguucaagugauucuccugccucagcuuccugaguagcugggauuacaggcaugugccaccacuccuggcuaauuuuguauuuuuaguagagacgggguuucuccauguuggucaggcuggucucaaacucccaaccucugcugaucugcccgccucaguuucccaaagugcugggauuacaggugugagccacugugcccggcaucauacuucuuuauacuuuuccauuucuaaauucauacucuuucaaugaaugauucuaauugcucuuggucauuuuaaguuucauuucauuuuucuaugacauuaacuacauuuugguauuaaccaaacuuucugcuguaugcagaccuaacuacuagagccuugauacuuugauccagguccuugcuaaacauguuuaauauuuuugacaauaagacuguauucucccugcauguacauauccuuuuuuauuuuuauuuauuuuuucuuuuuuagauaugaauaucucuugauuuguauauuuagcuaguaauauagcuaagacccuuuucuguguguguguguguguaagacaagaaucucguucuguuacccaggcuggaauucaguggcgugaacacagcuuacugcagucucgaccucagggcucaagugauccuccugccucagccuccuccugaguggcuagcaccacagguguacccuaccaugccugccuacuuuuuaauuuuuauuucuuuguagaaacagggccuugccauguugcccaggcuggucuuggacucuugggcucaagcuauccucccacccuggccucccaaagugcugggauuacagauguaaucccagucuaguuaagacucuuauaaaaguauuuuugggguuguaauuaaauguaucuugucuucugaccgagagcuugaucugacccaucauuugguacugugguaauagguaaagaugaaacauacaaauuaaaccagaaugucacuguucuuucuguguuauuuugauuauuucaaagaauguauuuuguugagcuuuaggauucuuaggaaacccuugugaaacacuguauuguaaguuuaugaaucauguugucauguaagauauaacucaagacuugauaaaaguucagauuauuccauucguuucucaccggaaauaaaaauuugccuaccacaucuguugcccaggcuggaaugcaguggcgcgaucucggcucacugcaagcuccgacugccagguucacgccauucuccugccucagccucccaaguagcugggacuaaaggugcccaccaccaugccuggcugauuuuuuuguaucguuuuuaguagagacgggguuucacaguguuagccaggauggucucgaucuccugaccucgugauccgcccaucucggccucucaaauugcugggauuacaggugugagccaccgcgcccggccacaccuuguuuuuuacagcauuacugaaaucugauaauuaccgacuacugaacugagugucaaaagacaaggauauaaaaugaacuaaaauguacccaccacaucguuaauaguggaaaauaauaugggcaaaauauugggagaccuuuguuagauuggcauuuuuauuauuuauuuauuuauuuauuuauuuuuugagacagaguuucgcucuuguugcccaggcuggagugcaguggugccaucucaccucacugcaaccucugccuccuggguucaagcaauucuccugccucagccucccgaguaguugugacuacagguguccacagccuuuggaaggcuaaggcggguggaucaccugaggucaggaguucaagaccagccuggccaacauggugaaacucugucucuacuaaaaauauaaaaauuagccaggugugguggcaggugcuuguuguauguacuacaggcacauacaaccuugccuggcuaauuuuuaguauuuuuugggcaaaacgcccaacaggguuuugccauguugcuuagguuggucuuggacuccugagcucaagugauccuccauccucagccucccaaagugcugggauuacaggcauaagccuccaugccuggccuccuuccuuuugaaggauaaauaauauuccacuguauguauauaacacauuuuguucauucauccaugggugggcguuuggguuacuucuaccuuuuggcuauuguaaauaaugcugcuaugaaccuggguguaugaauaucucuuugagacccugcuuuaauucuuuuuuguuuuguuuuuucuugagacggagucucgcucugucacccaggcuggagugcaguagcgcgaucucggcucacugcaagcuccaccuccuggguucaccccauucuccugccuuagccuccugaguagcugggacuacaggugccugccaccacguccggcuaauuuuuuuguauuuuuaguagagacgggguuucaccguguuagccaggauggucucgaucuccugaccucgugaucugcccgccucugccucccaaagugcuaggauuacaggugugagccaaccacgcccgaccgagaccccgcuuuaaugcuuuugggcauauacccaaaaguggaauugcuagaucauaugguaauucuauuuuugauuuuugaggaagcgccauccuaauggguguuauauaucucauguugguaaaguauauuuuuuuaaaaagaaaaauauuacuuaaaaaaaucuuuauuuuggccuuggcaacagagcaagacuccgucucaaaaaaaaaaacuuuauuuuaauggaaacaaacuauauuuggccagguuuagcacauaguaaauaugugaagugcuccaguauauuucuugagauugaagaugugcauauagauguugacacguuuaaggauucagcaaauuuguaaucagaccauauuaauuucagugguucucuuaauuaaagggugaaucaaguguuauguauuauuuugcuaaaccgaacacauuauuuucguuagauuagaagcagaaugucaguguaguugcagcagagcggaggcauugaguaaauguguugaauaaauaaaugaauaaauaccuuaugaaggauuuggaacccagggauucuuaucauuuucuggacaguaaccgguuuuagggaugauaaaacuuuuccccaaaugucuguauacauacaaaacuuugcacgugaaaaguuuagggaauuucaccugaauaacaauuguauuaaccagcaguuaaguuuuauccaccacauuaaacauaagcucccuccuccugauaaccuuaaaaaagguauuuucagcucuaauauucugaauguaauguuggggaaaaaaaaccucccaggagguguuauuaauacaaggauucauaaccagaauuacaucaccagauauuggaaugagcaguauuaaaucagucagauuaccaaugagaaaagucaauaccaacuuguaaggacugaaauauuuauguuaacaugguucuuuuuauagauuucucacuuaaaaauuuucucacucacuuaauuacucaaagaacaucuucaguuacuaacuggagaaacugaaaaugaaagaagaaaugggugagaguggaauccucccaccucagccuccccagcagcugggacuacaggcacaggccaccuuguguggcuaauuuuuaaaaaaauuuucuuuagagacacuggguucaccauguuccccuggcuggucuggaacuccugggcucaagugauccucccaccuuggccucucacagugcugggauuacagagauaaggcaccacaccaagcccugagucagauuuuaauaaauucaguuuccauuagaguggaaaauuuucaaauuaaugaauuauuuauuuauauauuuuuugagacagagucuugcucugucgcccagucuggagugcaguggcaugauguuggcucacugcagccucugccucguggguucaagcaauucuccuccuucagccuccccaguagcugggauuauaaccuugcaucaccacccccagcuaaauuuuuuuuuuuuuuguauuuuaguagagaugggguuucaccauguuggccaggcuggucucgaacuccucaccucaagugauccacccaccuuggccucccagagugcugggauuacaggcgugagccccagugccuuaccagaauggaaauauuuaaguaaacaaaauauuucuaaauguaaacuaauggccuacuuauuuagcaauuucaguucaguucuuaggaguuuaauauuucaucuauauuuuaauuaaccacagauauuaggcuuucucaaagauaacauuuuguccuaauuuuaguuucucaaaucguuauuaagguuaugauggcaacccagcuugugaaguaauagaugauaauaauauagucaggaaauaucauuugguaaccaaggcuucagcaaaguauuaagauuuuuguguuugugaguguuauagguaacacuguuggcccccaacauugucauuuuguacacuuuguugaucaguggccugaauucauuaaaauucacacuacaugccucaaaaagaauauuggaucccagccuagguuguugaguauauuccuguccuuuauuaaaauguagguugauagaaaggugguagggauauuuaaaucuaucaugcuaauuuacuuucuuuguaucacagcaaggauagggaauuaggaaaagauuacucacucaauagagaaaagguagauagaaaauccaguauuaucuugacaaagcagugaauguuuuaguaugauugaggauagguaaucuagugcuaaaguuggucacagaauuuccugcacaaaaugaaagaucuguguaugggaaugcuagagaauuugacuucucagaaauauauagaccaacagugguugccuuuuuucauuuucacuucucuucauucuuagaucuacggaauccagaggcagcauugucuccaaccuuccguagugacagcccagugccuacugcacccaccucugguggcccuaagcccagcacagcuucagcaguuccugaauuagcuacagauccugaguuagagaagaaguugcuacaccaccucucugaucuggccuuaacauugcccacugaugcuguguccaucugucuugccaucuccacgguaaugaccugacagaguuaggauuuaccacuuauuuucaguucacggucagugucuuauugcccauaccuccccucguucucuagccagaugcuccugccacucaagaugggguagaaagccuccugcagaaguuugcagcucaggaguugauugagguaaagcgaggucuccuacaagaugaugcacauccuacucuuguaaccuaugcugaccauuccaagcucucugccaugaugggugcuguggcagaaaagaagggcccuggggagguagcagggacugucacagggcagaagcggcgugcagaacaggacucgacuacaguagcugccuuugccaguucguuagucucuggucugaacucuucagcaucggaaccagcaaaggagccagccaagaaaucaaggaaacaugcugccucagauguugaucuggagauagagagccuucugaaccaacaguccacuaaggaacaacagagcaagaagguaggggucaugugaaaauacucucacaauaugcucuuaauuauagcuuuguuugacagggauuuaccccuagggcaaggaacuguuuacagcagugguucucaacuggggaugauucccuacugcccaacucccaggggaucugguaauguccggagacauuuuuauugucacacacaugggggagugcuauuggcaucuaguggggguagaggccagggauguugucaaacauccuacagugcauagugggacaaacccccacaacaaacaguugucugucccaaagugucaacaaugccaaugucgacaaauucuuauuuagauaaucugucacugaaucugaaagaauuggaucaagagaagaggaauccaaauauauagaaauauagggagaugaauggagaggaauacuagaccaauuauggaaauugacuaaauaaugugaauugguucugaguauaaguauuggccugacaugaguucuuaucuguuugguacuucuagugcgugaguuugaacaaguuaauuaacuucucuugagccuuagucuucucaucuguaacaugaagauaauaccagcguauccugccuuauagaauugaauagacucugagcuaaaaaguaaaguguuuagcacuauacuuuuuaguucagcacccaguaaauauguuuuuuguagaaggaaugccuuccuggggaggggauguuaacauaaugcuuagcgguaggaaccaggccucuuccauuuuaauuucaucccaaaugcauauuugugaggaaggacugaaccccuaacaaaucucuuaucugaaggcuccaauuuuccaauauuaaguuagcuaauuuaggucuaggcacaauggcucauuccuguaaucucaacacuuugggaggccaaggcgugaggaucaccugaggcgaggaguucaagacuggccugggcaacauagacccuaucccuauagaaaguaaaguaauuaaaacauuagcuggcauggugucacgcaccuauauucccagcuacaauugaaggcugagcugggaggaucacuugagccugggaguucagugggagaaacagugaguuaugauuacacaacuacacucuggccugggugacagcaagaucccaucucuuaaaaaaaaaaaaaaaaaaaaguugauuuaucucuuagaagacauuaaugucaaaaagaauuugcggaguuggucuaagagccaguuugaucuauaagacauuuuaaguccaaggcuacuucugucacaggucagucaggagauccuagagcuauuaaauacuacaacagccaaggaacaauccauuguugaaaaauuucgcucucgaggucgggcccaagugcaagaauucugugacuauggaaccaaggaggagugcaugaaagccagugaugcugaucgacccugucgcaagcugcacuucaggucucuuggaagggaaugaggugggauggguuugucagaagcagccauuccuuuucagcauauuccuuccagucauugggguucugucuguaaucuuauuuaguuuaugguuuguguaaguccuccagacccugaagguguacuuucagaagugcauugugugggaagaauacaggcuguacucccaaauaacugaguuuuuuuuuuuaaaagcucccucccucuuagaauagcaaaguaugucugucucugagccacagugaaaguuaaaguacucugaaaggaggauaaucuuaggagaaaaggaaccuaaacucuuaggucaguguuuuauucuguucuacccaagucuccugcacugcuugccuuccagugguaaaacaggaaaccaagucuuuacucagagaggaauuacaauuguucuguaguaugaauuauggauuuccaugcuaccugccucccuuaaaacucuugaaggaagcucuaaugauagaauuaggggaggguaauaaaauagacauuuugaaaucauuuggaauuugaacuguuggaucuacaucuggagcaccaucuugauucucccuuuuuauuuucccagacgaauuaucaauaaacacacugaugagucuuuaggugacugcucuuuccuuaauacauguuuccacauggauaccugcaaguauguucacuaugaaauugaugcuugcauggauucugaggccccuggcagcaaagaccacacgccaagccaggagcuugcucuuacacagagugucggaggugauuccagugcagaccgacucuucccaccucagguaccugucugcucagaaaacucgucucaacuuacggacuuauguuugauagggcagccauacacguuaagaaagcagagcauaauucagcaaucuugucuugcuuauugggaauggagggggauagauaagcuuuuaagggaauaggaaaaaucaaauggaaaagagggacucgggccaugaaucucagaguuaaaguagggaagaugaccaaauaccacuuuaugcaguggaucuguugugauauccgcuaccuggacgucaguaucuugggcaaguuugcaguugugauggcugacccacccugggauauucacauggaacugcccuaugggacccugacagaugaugagaugcgcaggcucaacauacccguacuacaggaugauggcuuucucuuccucugggucacaggcagguaaugcaauucaguuauguagguauggacagauacaguacaagagugaauacugaaugggagauaaaauccuggguuuuccuagccccacuauuaaauguaugacugauuuagucuuuuuuucuuuuuuugagagagucucacuguguugcuuaggcuggagugcaguagugugaucucagcucacugcaaccuccaccucccagguucaagcaauucuccugccucagccuccugaguagcugggauuacaggcacgugccaccagcccagcuaauuuuuucuuuuuguauuuuuaguagagacuggauuucaccauguuagccaggauggucucuaucuccugaccuugugauccacucaccucgagcuccuaaagugcugggauuacaggcgugagcuaccaugcccagccagucuuuuuuucuacugaguccuaaugccuguuuacaaugcaaauuuuaccccgaauauauauuuaacucuacauuuguucuuugagaaagguaagguuguugagcauaguuuuaucuuuucguucuuagauccaccaugcuuuugguggugugcauguaaauguucacugagcgucuacugaaaaaguguuuauaguguuuuuaacacaucacauauuuugaagggaaaaaaaauaugggcauacaaauaguuguuuaacucauuucuuucuagggccauggaguuggggagagaaugucuaaaucucuggggguaaguagugguuguguugcuuucuuuugaggguaauacuguuacagugagauacauguucucuucucccagacuauucugugauuccuugcuucuauaaaugguacuaccccuaaacuguaaaaguuuggcuaaaauucuaguucuuuuuuaugccccacagguaugaacggguagaugaaauuauuugggugaagacaaaucaacugcaacgcaucauucggacaggccguacaggucacugguugaaccaugggaaggaacacugcuuggugagcagcaguggggcccaauucaauagguggagcacaaagaagaaucauuugauuucuuacugagaaaaaguucaaaggugugguuucauaagguaaucuguuaucuguggugagcagguuggugucaaaggaaauccccaaggcuucaaccagggucuggauugugaugugaucguagcugagguaugugcuucccaggccuccaaagcuuccacauuuuuguugguaucaguuauucauguuggguguauucucaucccagauuuuucucauuuagaucauaaacauaauagaaagggcuagaauugcaaucuuguguaacuuaaaaagcagcuaguuuuuauuuccuagguucguuccaccagucauaaaccagaugaaaucuauggcaugauugaaagacuaucuccuggcacucgcaagauugaguuauuuggacgaccacacaaugugcaacccaacugguaaggugaccagagaacaggcuaguccucaaggggcuauuauuuaugauuaaggacagaacuuaguagagcuucacauuguuuuacacuaguccauaaaugagcuucacaggauucauaagccacuuaagcuuguauuuaaacuguuuuaugagauucuacaaauauucauuagaaacucaacagguucuaggacccaaaagcacugcucccuaggguuucuacucucuucacaacccaaggaucuuccucagccauucugugauguauugaaucugcccccuggugguuacgaaguuaucuauuuaaucugucaauaauuacaucuuucaccccuuaacagagcuuaaaacacaugcugcuagcauuuugcuuauccaaagaauacucccugguagcaacucugugaagcaggccuggcuaagcauuaguuacuaacccucagauaauacagauccagucuauuuuaacaccagaaucuaugccaauucugaacuaguaauucuaccauauacuauucuaauguuaagcucuuuuuagaauuggcauauuugauaugaugauaggcagucuucauuugguaugcauuuuuuaacaauauuaaacccucuaauuccaggauuucugguuugccccuccuuuuacacuguuucaggaucacccuuggaaaccaacuggaugggauccaccuacuagacccagaugugguugcacgguucaagcaaagguacccagaugguaucaucucuaaaccuaagaauuuauagaagcacuuccuuacagagcuaagaauccauagccauggcucuguaagcuaaaccugaagagugauauuuguacaauagcuuucuucuuuauuuaaauaaacauuuguauuguaguugggauucugaaguccauucuggcucugcuacuuaacaguguauaaucuugugcaacucaucucucaguauuauaugugaaaugggaguauuaccucauuggguugcugugaagguucaaacuaaaugagugcaugggaaacauuaaaaugaucauuauaggcuaggcacaguggcucacaccuguaauccgagcacuuugggaagccgagguaggaggguaacuguagcccaggaguucaagacuagacugggcaacauagugagaccccaucucuacugcuacccuccaaaaccauuaaaaaaacaggaaugcaggcugggugcgguggcucaugccuguaaucccagcacuuugggaggucaaggcgggcggaucaugaggucaggaguucgagaccagccuggccaacauggugaaacccugucucuacuaaaaauaccacaaauuagcugggcguaguggcgggcgccuguaauccuagcuacucgggaggcugaugcaggagaaucgcuugaacccgggaggcagagguuucagugagcugaggucgcaccacugcacuccagccugggugacagagcgagacucugucucaaaaaaaaaaaacaaaaaacacagaaaacaggaaugcauaggauaaaacuauguacguagcugguugaggaggagguucucuaggacagcauuccugucuacaaacaguaaaaauuugaguuuuauuuaaaguuaucaccacuuggacuauca

SEQ ID NO: 17560 - RNA, 936 nt, Homo sapiens
ucacucggaguucuugggcuucugagcauucuuuucagggccagcuucaccucuugguuccgcagaguguagauaaggggguugaggaaaggagugauggccguggggacuagggcagcugccccauccagggggcuguugguuucaggccucagguagaugaaggcacagggcacauaguacacggugaccacgguuacaugggcuccacaaguugaaaaagcccggcgccgcccaucagcuguguggauucucaggauggccugaaugaucuguauguaggagaggaggaucagggagaagcaacuggcaaccaccaccccaaugucuacaaacgucaccagcucguugacuguugugucagcacaggccagucucaacacugcagggaugucacagaagaaguaauccaccugauugggcccacaguagggcaggcggaagguuaggauggccuggagagccccauggauggauccugccauccaggcuccagccacaagcaaggcgcucagcuuagcagucaugagcacaggguagcgcaggggcugacauauugccagguaccugucauaggccauuaggguguagaggaagcacugggugcugcccaggaagugauagaaauagaguugagcaacacagccaccaaaugggauggguuugacaccuaaagugaaguucaucaugaggcgagggacaaugauggaggagaugcucauaucaaugacugagagaacaccaagaaagauguacauggggcgggcauggagccuugggucugcccagacagugauuaaaauaagcagguuucccagcugagucaggauguagauuagaaaaaagaacacaaaaaagaguguccuuagccugaguggauacggaauuccugucaggauaaacgcagucaacagugugcuguugauucuuuccaua

SEQ ID NO: 17561 - RNA, 946 nt, Homo sapiens
cuuucaaaccucacucggaguucuugggcuucugagcauucuuuucagggccagcuucaccucuugguuccgcagaguguagauaaggggguugaggaaaggagugauggccguggggacuagggcagcugccccauccagggggcuguugguuucaggccucagguagaugaaggcacagggcacauaguacacggugaccacgguuacaugggcuccacaaguugaaaaagcccggcgccgcccaucagcuguguggauucucaggauggccugaaugaucuguauguaggagaggaggaucagggagaagcaacuggcaaccaccaccccaaugucuacaaacgucaccagcucguugacuguugugucagcacaggccagucucaacacugcagggaugucacagaagaaguaauccaccugauugggcccacaguagggcaggcggaagguuaggauggccuggagagccccauggauggauccugccauccaggcuccagccacaagcaaggcgcucagcuuagcagucaugagcacaggguagcgcaggggcugacauauugccagguaccugucauaggccauuaggguguagaggaagcacugggugcugcccaggaagugauagaaauagaguugagcaacacagccaccaaaugggauggguuugacaccuaaagugaaguucaucaugaggcgagggacaaugauggaggagaugcucauaucaaugacugagagaacaccaagaaagauguacauggggcgggcauggagccuugggucugcccagacagugauuaaaauaagcagguuucccagcugagucaggauguagauuagaaaaaagaacacaaaaaagaguguccuuagccugaguggauacggaauuccugucaggauaaacgcagucaacagugugcuguugauucuuuccaua

SEQ ID NO: 17562 - RNA, 6197 nt, Homo sapiens
uaguuacuuauuuucauucaguccuucaaccugcuguuauccucuucagggcagacuucacuuccugguuccucaguguauagaugaggggguucaguaauggagugacaacaguguaaaacacagccgcugccccauccagggggucuuuggagccagcccuaagguagaugaaaauacaggggacauaguagacugugaccacgauuaggugggagccacagguggagaaggcccggcgccucccaucagcggugcguaucuucaggauggcauggacuauguuggcauaggagagcagaauuaacaugaagcaacuggcggccacuacccugacguccacaaaggucacaagcucauugacaguugugucagcacaggccagucucaauacugcgcggaugucacagauaaaguaauccaccugauugggcccacaguagggcaggcggaaggucaagguggccuggauagacccaugcauggagccggcgacccaagcuccagccacaaggacugugcauaaccucccauucaugagcacuggguagugcaggggcugacauauugcuagguaccugucauaggccaucaagguguagaggaagcacugggugcugcccaggaagugaaagaaauacaguugagccacacagccaccaaacgggauagccuugauggaaggaguaaaauccaaaauaagccgaggaacggugacugaggagagccacauguccaggaaugagagcacucccagaagaauguacauggggcgagcacagagcuucgggucagcccacauggugagcagaaugagcagguuccccagcugagugaggauguaaaugaugaagaagaccaggaagaggaggcuucuuagauuuggggggugagacaaacccagaagaaugaaaucugucaccacggcauccagcgauguguuuuuggucuuucccaugucuuuuuguagucugcuaagaugaauggugacguuugacaagagaaacacagcacaaugauguuguaagugaaugcuuuugucggaugauugaugccuaggaauuaugagauaaacaagauagagucaaauuguuuuuuaaaagaggagguggugucaccauuaguuauuuagguuuacuuaaaaggagaaguccuccagaggcugguuaguuuccuagaugggaggaaacucuuguccauugagagauacugaaagccaggauuugccagaugaaggaagagggacacaugagagugauagagaaguaccgaaaauuccaaccaaaaagugaguucgccaaggaggggcuaaaguugaugcagagcaguguggaacaaacacccuauaaugaccacaucuacuuuuucuucaccuacuaucauuguccccuuuuuccucagcuaaaaucucaucuccuuaacauagcaugcaaaaauauuccucaucuggcccuuauuuauaucgcuauuguaccacuuguaauuccuucuuauuguugggaggcaugacacucuucaagcuucucacaguagugugcucuaacuugggacuuaugcacacacuaucuuuucugcucccuucacauagguagugcccacuuuuccuucaggauucaguucgagugucuucaccuucaagaaggcuuuccggaucccugaggacaaugcuuauacuuuucugagcacguacauuauguugcauugucuaauuucuguuuuucucucuuaauaaucauccugucuagcaugcuaaaagugauaaauaccguaauuauuuucugaaugacugagauagauagaauggauguugccaaaucccccugacugaauacauuguuucucuugaucuuuuuugucugaccccugugcucacauggcugggacuuuuaggucaagggaccaccucauucaccauguaauauggguauaauuucauuauaaaaaacuccaagaaacauuuaugccuguuuuugcuccaggauaucauuuagauuuauuuguugauuuauaugguucauuggauugggauuggguuuuuuuuuugguaugaggucacagaggaauuuuuauuguuuguuauaaaaucauugauuaaugcaggacuugaucuuuagugugcuuguguguaauaucuauguauugcagucuaucaaacagcaacucucucuaaagacauuuacagauuuucaaguaucugaacaagaugauaaaauagagggauggaauguguuuguuucacucuuuuuguuaaauagguugcuugauaaagacuuuucgcucuauauaugguuugagaugcauuuaucuuucauuuaacuacaaaauaucuuuguaaugcaaaugacuacuuucauaaagcaauuaaaaugacaauagauuauuauaaauaacaugugaauauuaauaaguuuaacuaaucucuaucggaaauucuccaaagagauuuuaucuuaaguauucugugaaauaacuuaauucauauguuaacauucaagaguuauuaguaguaauaauaauaauacugaauauaucuggcucuucgaagucuggaaaauguuaaacuuguccuuugcccaccaagaacgaagaaauaucagauuuuuauugccugaguuucaggaggacacuuugauuuauuugaaaauggaugggaaaacuaaaucuuauuuuugugguuagaauauagagaaaagaggcugggcgugguggcucacgucuguaaucccagcacuuugggaggccgaggcaggcagaucaugaggucaagagauggagaccacccugaccaacauggugaaacccugucucuacuaaaaauacaaaaaaauuagcuggguguggugucgggcgccuguagucccagcuacucgggaggcugaggcaggagaaucucuugaacccgggaggcggaaguugcagugaguggagaucgcaccacugcacuccagccuggugacagagagagacucugucucaaaaagaaaaaaaaaaaugaauauagagcaaagauagaaagaguugagauuaaaauggugcauaaaauacuaauuauggccaggcgcgguggcucaugccuguaaucccagcacuuugggaggccaagguggguggaucacgaggucaggagauugagaccauccuggcuaacacggugaaaccccgucucuacuaaaaauacaaaaauuagcugggugugguggugggcgccuguagucccagcuacucgggaugcugaggcaggagaauggcgugaacccgggaggcggagguugcagugagccgagauugcgccacugcacuccagccugggucacagagcgagacuccaucucuuaaaaaaauauauauacauauacauauauauauauauauauauauauauauauauauauauauacacacauauacauauauauauauauauauauacacauauauauauauauacuuauuaugagcuaaaaguaauuuucuuuucuuucuuuuuuuuugugugauugagucuugcucuguugcccaggcuggaguacaguggccugaucucggcucacugcaaccucugcaucccagauucaagugauucuccugccucagccucccaaguagcugcgacuacaggugcgcgccaccacgcccagcuaauuuuuguauuuuugguagagagggaguuucaccauauuggccaggcuggucuugaacuccugaccucaugauccacccaccuuggccucccaaagugcugggauuauaggcgugagcaccgcgcccagcugagcuaaaguaauuuucuuugccaauacaggaauauaaacuaguaggcuucuacuuaggcaaauaauauauucaugaaauguuuuaugaaaauccauuuuuauauuuaaaaucagauagaacuguaccacuggggcaauuauuugaaggacuuccaugaugcauacuuucguauagugaaaaguuuaucccuaauuuaucuacuuugccggucugauuuucccccuuuuguugugccuaagucugguuucauuucucccagccucccuguugaaagaaagcucuuuuuaccccucuagguucuggguucccugccugggaggaggcaggaaacugagauggguuauagcuggucgguuugaggacaggauaccuuuccaggcagacuugguaaagaacagugguuuuagcuugguguuugguauucagaggcugcagaggaagauagcuuagacuuccagaagguagauuuuuggagaaacaaagaguguguuuacagaaggauuggcuuucuuggcaagagaggugaacagucugggaccaccuuagaggagacaaaagaaaggccgggcaugguggcucaugccuguaaucccagcacuuugggaggaugaggcuggagaaucgcuugggcccagaaguuugagaccagccuaggcaacauagugggacccugucuguaaaaaaaauuuuaaaaauuagccagguauaauggugggcaccuguaguccuaauuucucaggaggcugagacaggaggaucacuggagccuggaaggucaaggcugcagugagccaugauggugccacuguacuccuuccugggugacagguugagaccuugucuaaaaaaaaaaaaaaaaagacaaauguagaggccguauuuguguauccucuuuucccccucccuuaucuuccagauuugugucauuuuauuuuaggucuguuccucuuuuuuagcuuuugaaacuuaugauauuuaagauaaggaaaguuaaauacaauuuuaguauaucuacccuagcuaauuagauaaccaaaauauucuaaaauuccccaaguuuuagacuguauuggauauucuccaauuggauaggucagaauuuaaauaaucaaaacacaugaaaauaacaaaaaguuaaaguucaauauaaaaagcaucugaaaauaagagcccagugacaucagagaauaaacagcauauuuuuacaaagcaauuauccuggaaacucuaagaagagacuuugggaauggggugaaagaguagcacugagaagguaaggacagggagggucaagaacaccuucaagggaccucuauggcauuaugggaucacaggauaagcugcuuucuaugccccuacucugccccaaaucaagcuaguuugauaugugaacacauuucuugcaguguauuuagagaggugccgaggagggcaagccucuauccagcaauuugaaacuagauuucuacagugaccuuugggaucuggacuacuaugcaacgguuaugaaaucuugaagaugaggagugaaggcugguccagcauugcguuggacacauuaugaucaaaggacuccuguuuacccuugugacaaaacucaacccaaucugcuuccaaaaagaaguuucaccuucugucauccuuuauucagaguuagacauccugguagagcuagggcagaguagaggaaauggauagaauuugagguggccuagacauauuuuaucgaauucacaagaguacauucuuuccuauuaccggggguuaaaaaaaacgaacuugcuuuagaaaaaguacuuagugcccucuucauuggagaaggggaagguuaugaauccagccuuucuuuguguuugcacaaucacugaagaauauucuucaagaccccuaugacuuuaucacugcccaacucugcccuuuaucacugcccuaauaaaaagagaauaugaaaagaaaauaguguuguaaugcuuuuuuuugagucauuuucucaacacaaaaagaguuuccccaaguuugaaaacaaggaacuuaauucuagcccguuugggaaagaguugaggaaacgcauggagaaaagagacggauuaaauuaacacucggacaaaauaacagaaagucuuaaaguuccaaaauuagucugcagccuuauuuugaacauagcuggugucaggccugcuuuuuccauccuuuuagacucacuuguauagagcugcacaauuguggaggaggcuggcuguccuugagugcaacgguccagcggauggagagauggucuucagagauucagucuagccuacuauaaagggcucccacaucuguuucggaaagccuuuauaauuuuuuuuuaaggaguuuggcccagcaaauaaguguucagaaucuuugagaacgccugucuuugggguucuuggacaagugug

SEQ ID NO: 17563 - RNA, 2593 nt, Homo sapiens
uaaggcuucuuuuuaaauaccaucugaaugauuuuucuucccacuuugguucacauaauaauugcguucuuacucuuaaauuucaggcaguuccuuuuagucuugacaguguugcaaauuccauucacuccuuauuuucugaggaaacuccuguuguuuugcaguuggcucccagugaggaaguaagugauaaggguuuuauucaagacauuuuaaaaaauaagcuuuuauuauuugaaaauuaugaaauguaauuuuauuaugaaaauauaaaacuaauuuaugaacaauguugucauaccucuggguauuggaacuaaucuguagaauuugagcaacuuaaaauuuucuauucuucuuacagagaguguauaugguagggaaggcaaacucaguguuugaagaccuuucagucaccuugcgccagcuccguaaucgccuguuucaagaaaacucuguucucaguucacucccccucaauucucugaguaggaacaaugaaguaagugcaguuauucaaugaauacaugaauaucauuaauuuccgucuuuuuaaaaaauagagacagggucucacucuguuguccaggcuggucuugaacuccuggccucaagcaauccugucuuggccucccaaagugcugggaucacaggcuugagccacugcaucuggccucccauuccuuauacuacuugaaauuuuggaaauuuugcuauuuuagaaaaugaaagauugugcacauuuacugcugggguagauucuucuuuaguguaauuuucuuaugacucucaugaauaaacugauccuuuuugugaguugagcugugguaaauaacaucacauuuuagcacgaggguugccaccuauuaauucaaacaagccagaggucauagaucuacuuggugacugguggagcuguguggaucugguaacuuggaagccauuguucacugccucugcugauuuguugccacauuuuucucauucauucuggacauugcaguggagggagccaccucuacuuuugacuccuguccuucaguuucuccaucugcucaugcgcccucuuaaccauguggcaugccacuuucgugguggccuccccuuuuuauuugcuguggaugaccagggccaucauccuuuauucucugauguggaaacuauucaagggaagugagcaaacugggccaaugguaggaugucauugcagagugccaggauauccugaugcuuugaaggaaaaccacuggagaacuuggaugcuuuaucaugguuuugccaaaaauauagcuauugaguggcagucacugugcuagggaauggccaucaccuuuuuguuaggaaauaauguuuuauaugcauuuucaauugaagcaaacauaccaaauggaagauaauuauauaaauucacuuauaugaucaacauuuguaauauccugugccuugcuugguaaauggcaaauaaagaucucuggugcacauuuaaaagaaugcucuuuuuuuuugggcucucugaagguugaccugcucuuucuuucugaacugcaagugcuacaugauauuucaagcuugguaaguaggcugcucuaauuuuuuaauuccauuuauuuugguuucuagagaauccuugaauaauaguaaaggcaguugaaaaguuugauuaaguaugcccuagauuuaugaucccaugaaaauugaaaaauuaguggcaauauugggaauuuugaacacauccauguuauagucaaauuauuuugcauuucugcuuuuuagggagagacaacauaucuuccaagaacacaagccugggcguaagaacacccuggccauaguccuaacuuggcuguugauuucuugugagacuuaauuccuaucuauaucuuugggccuaaaauagaaauaauaguuuggacuaauaaugcugucagucaagucaagaagggacgaaauccgucugaaggguauuuuuuuggugaaugauuuuuuaaaaaucauccuuguuacugaaauagaaauucuuaucuguuugcuaccuucugaaguuguuuuccaaacuuuuucaacagguguugguucggggagucuggaaguguagugcauuccugggaucaaacugguccagccaucuguucuuucauacguuggcccauaccugaguuuuuaaaacugaggaauuuuguugaaagcuuuuauuaaauauccaaggagucuuguacugcuccuaaacaugagauucguguuggauuuaucagaaacgcuuauucaaaccaguuucuuuugccaccauuuuagacuauuugcauguugugguacacugguaugguuuaguuuagccuaguuuaguuaggcauaaaacuuuaacuggcuguguuugacgucuuucaucuuacuuuauccgcuaccuuuuuuuguuuguuuguucuccuaagcugucucgucauaagcaucuagccaaggaucauucuccugauuuauauucacuggagcuggcagguuuggaugaaauugggaagcguuauggggaagacucugaacaauucagagaugcuucuaagauccuuguugacgcucugcaaaagguaaauaucaaugc

SEQ ID NO: 17564 - RNA, 663 nt, Homo sapiens
aaaaucuuucagaggcaguuauucucccuagcaccuuaggaaguuuguguucagcucccuuugcagucccagacacuguggcauucacggcacagaaguacucagcugugucacuccacugcacagaggguuuccucagauuaaaggagaauuuacucuuuauaaauucagccucaaagcccuugaugccuuuaaccaguggauccccugaaaaguacuugaggagaagcugaagguguugaccaggguacuggacauaccagaagagauuaacaguuccaccauaggaauaguugcaucccaacuccagugaggcugcuucagagagaauuacguggugguuaugcuggcucacagacugggcucuggcaucuccugaaaaaaucaauguuguaucagugaaaauagugcagacuugucuaugaaaaguauuucuacuaagauuugaaucagaaaacaguuacuucuguggaacuagagaccauaauagaauguuacucacucagggcaaaaaucauccccagcacugguaugagcaacaggagcauggcugagcuguggaaacacugcaggcgucucuuuggaaauucuccucggggccaguaggaaaguggcuggaacccaggucuugagaauagcgagcgugaggaagguugggcuagg

SEQ ID NO: 17565 - RNA, 1787 nt, Homo sapiens
acgacuggcuccuggggugcagagaggggccacagucucugcggcugugucacgcuccccugcaguccccuccauguucccuggcaccacuacuccccuuccuaaggccgccgcuuaccccagggucuauggaaguaaugaaggaccccucaaccuggcucaucaacagagcagaugagcagaccguuuauuagcuguaggcaaauacgaagaggcuauuucuugucacaaaaaggcugcagcguaucuuucugaagcuaugaagcugacacagucugagcaggcucaucuuucacuggaauugcaaagggauagccauaugaaacagcuccuccucauccaagagagauggaaaagggcccagggugaagcaagauugaaagcccagcagaacacagacaaggauguagcugcccaucuucaggcaucucacaaacccucuguagaggaugcagagggccagaguccccuuucucagaaguacagcccuuccacagagaaaugucugccugagauucaggggaucuuugacagggauccagacacacuacuauauuuacuucagcaaaagagugagccagcagagccauguauuggaaguaaagccccaaaagacgauaaaacaauuauagaggagcaggcaaccaaaauugcagauuugaagaggcauguggaauuccuuguggcagagaauuaaagauuaagggaagaaaauaacaacuaaaggcugaaaaggccagacuucuaaaagguccaauagaaaaggagcuggauguagaugcugauuuuguagaaacaucagaguuauggagcuugccaccacauucagaaacugcuacagccuccucaaccuggcagaaguuugcagcaaauacugggaaagccaaggacauuccugucuuccgcccuuggauuuuccaucuacagaacuuccucuuauggagcucucugaggauauucugaaaggauuuaugaauaauugaaauagaaggccaccaaaaggggaaaagaggaaauaauacaguaaucguuaauccagcaaaaagaaaagggaaaaccacauagaagggucaucccggaaaugcuucaucugguggacugugggagcagaggcauugccaggacuugggaaacagucacugugaaaugcgcagcauaucucauucacucacuugagcuaaugauucugacuuggcagacgcuaaacucauggagguucaguuucuccugauccaaaccaaauggcuaccuggaauaauuucuuccaagcaacaguuauuuuucuuaucuucagguuuaaaauguauaaaaguuauguguaauuaaucuauaaugccauaaaugauaaugcaaaaccuaaauaauaugguggccggaggggcugcuuuauauuugaaacaugcuuucuaucaugcauuaacuguaugcacuuuguuaaugcacauuuuguuuguuuaagguaagauccacacccuucuagaugaaacuauaugugccacacuuugcacuacucauaaugauaaccucaagacuaucagaagaaauauuuaaauuuccauuuuaugaagaaaggaaccaaauuauuaugcuuuuuuaaacaaauuaccaguuuacauaauuaaucagggugcguuucaaguucuaacuuuguuuauuguauaaugcaucauuugaaaauaccaaggaggaaauacccuuuguuuuuaaugaugcaagaguggaaguaaugcuaguuggugguauuugauuguaagaaaucaauaaaguaauuauguuuuuaaaaaaau

SEQ ID NO: 17566 - RNA, 1309 nt, Homo sapiens
aaguacagcccuuccacagagaaaugucugccugagauucaggggaucuuugacagggauccagacacacuacuauauuuacuucagcaaaagagugagccagcagagccauguauuggaaguaaagccccaaaagacgauaaaacaauuauagaggagcaggcaaccaaaauugcagauuugaagaggcauguggaauuccuuguggcagagaauuaaagauuaagggaagaaaauaacaacuaaaggcugaaaaggccagacuucuaaaagguccaauagaaaaggagcuggauguagaugcugauuuuguagaaacaucagaguuauggagcuugccaccacauucagaaacugcuacagccuccucaaccuggcagaaguuugcagcaaauacugggaaagccaaggacauuccugucuuccgcccuuggauuuuccaucuacagaacuuccucuuauggagcucucugaggauauucugaaaggauuuaugaauaauugaaauagaaggccaccaaaaggggaaaagaggaaauaauacaguaaucguuaauccagcaaaaagaaaagggaaaaccacauagaagggucaucccggaaaugcuucaucugguggacugugggagcagaggcauugccaggacuugggaaacagucacugugaaaugcgcagcauaucucauucacucacuugagcuaaugauucugacuuggcagacgcuaaacucauggagguucaguuucuccugauccaaaccaaauggcuaccuggaauaauuucuuccaagcaacaguuauuuuucuuaucuucagguuuaaaauguauaaaaguuauguguaauuaaucuauaaugccauaaaugauaaugcaaaaccuaaauaauaugguggccggaggggcugcuuuauauuugaaacaugcuuucuaucaugcauuaacuguaugcacuuuguuaaugcacauuuuguuuguuuaagguaagauccacacccuucuagaugaaacuauaugugccacacuuugcacuacucauaaugauaaccucaagacuaucagaagaaauauuuaaauuuccauuuuaugaagaaaggaaccaaauuauuaugcuuuuuuaaacaaauuaccaguuuacauaauuaaucagggugcguuucaaguucuaacuuuguuuauuguauaaugcaucauuugaaaauaccaaggaggaaauacccuuuguuuuuaaugaugcaagaguggaaguaaugcuaguuggugguauuugauuguaagaaaucaauaaaguaauuauguuuuuaaaaaaau

SEQ ID NO: 17567 - RNA, 24557 nt, Homo sapiens
cgagcugacgggcggaaacagaacagaaagaguacacguccccagcucauugauagggccauugcgcagacgcauuaacuuuucugaguuguaguugagucuguugaugcaguccgcgucugcgcauuaguuguuacgcgcccuggccggccucagcgccugcgcaaauuggcacaccggggagggcggaguuaggucacgagggugcgcaugcgcaaacagcacauccgguguggucgacggguccuccaagaguuuggggcgcggacuggaguaccuugcgugcaguuaugucggcgucgguagugucugucauuucgcgguucuuagaagaguacuugagcuccacuccgcagcgucugaaguugcuggacgcguaccugcuguauauacugcugaccggggcgcugcaguucgguuacugucuccucguggggaccuuccccuucaacucuuuucucucgggcuucaucucuuguguggggaguuucauccuagcggguaaugguucuauaagugaucauaauaauaauguguuacuuuggugugcugcuuuuguuuucauaguacucuauaucagaccaccgccccuugaaguuaugagaagagccugcauugcccuuuuguugugaauggggaaauugaggcucagaaagcuuagauuauaugccuaauaccaaacggcuccguaggaguuggacuuaaaagucuaaagaaaccaccuucgugccgcuacuccacuuggugauccacuucacuuaauauugguccggggaaaacccuauuccaacuuuaacuuagguuuaacacaacucuaaaauuaguagacuuuucaaaugaaaaacccaaccuugaaucaucucugucaucuuggccuaaucauuaccaaucuccggugaaacguuucaaugaaagugcaaagaauauaaauacuggugcuuuucuuguugaaucauccuuuacuugauuuugccuuuuagcugcuacuacuuuuuuucuuguugaggaagcuguuauuucacuguccugaacccaauuuuuguucacauaacucuauuuuagccuuauuuuuccuuuugauuccaggauuugguaaccuuguagacugcuauauuuagcgagaacagucuccaucaauuuuuguuaaaaucugacuuuucuugcccaacggggauucagugaauacugaaaacaggcguggccucuaucacugguaucaccugcuacuuugacuuugaaaacaugccagcauucaugguuucuuuucagugugaucaucagucaggucaucaguuguauuuucaguccaauaugaggcauuaugguaaaagcuuuggcacauguucuuuauccguaaagaguuuauggucuaguugggguacagacaaaauacagcauuggaauugucuggaggccuggcacaguggcucaugccuguaaucccaguacuuugggaggccgagguaggcagaucacuugaggucaggaguucaagaccagccuggccaacauggugaaaccccaucucuacugaaaauacauaaauuagccaggcaugguggcacacaccuguaaucccagcuacucgggaggcugaggcagaaucgcuugaacccgggagguggagguuguagugagccgagaucgugccauugcacuucagcuugggugagagugaggcucagccucaaaaaaaaaaaaaaaaagucuggugacaguggugcugugcuuaaaguuacagaccuauagaaugcuuauuguacauuuacauuguucugacacaccagagauauuucuuagaauuuaaaacaggucugaggaucuaaugacuuguguacugaaguugcagauuagccuuuugauuggauauuuaguuaccaucuuugacuuuuguccuagaugaccaagaccuaguugucugugguggcguccuugccuucaggauguguuaaccaucauccgaccagauacacuaccccuuugcucuaaguauucuccaccacccacccaccgcccucugccacgguacuauauguuuuuauuagccagcccggagaaggaaccuugaugagaacuuuugauuuaauuuuguuugauguuuuuguuuccaggucuggaagaguaggagcaaggcagggucugaaagcugauuuuaaaaaagaugccuucuccauguagaagucacccugccuucauaagccucuagggucuagaaugauuuuucauggaugcuuugaagaaugugguuugcugaagagugggcauggacuagaguuauagauuaucaguguaauaaagccagaagguuuuuuugagcaaaugacuuucacuuaugccaagaccuguuuuugagcccguuguggcugaaauugaauuggcagacuggacugccuuucuccucuccagugggaacuagguggcuugucauugaagaaaaaccuaguaaaagggcauauuaguaauggggccaauaagggggauuaggauuuccagaucuguuagauaacagauaauagagcuauagaaaugaaagcaacuucaagaaaagaagggauucaugauaauucuuaguugccacagaaggguaugauuuacccuucuuuugacagcauugacuuuccuaaauccugccucuucugccauuuguuagccuagaucaucaacuggagacugguuuuaaugggaaauuuggacgcuuauccuuuguuuugauuguuggcaaagguagccuuguuccuuuuuauggugcugggguuucuaacuuuccuguggaauuuccuguugcaagagaauggaggaguccagugagcugggagagggaaauguaggcgauacuguugaaggauuagguagugcugggugcuagauguuugaaugccaggccaaggaauuuggacuuuuuuugagauggaguuuugcucuuuuuucucaggcuggagugcaauggcgaucucgguucacugcaaccucugucucccagguuuaagcaauucuccugccucagccuccgaaguagcugggauuacaggcaugugccaccacgcccggcgaauuuuguauuuuuaguggagacggaguuucuccauguuggucaggcuggucucaaacuccugaccucaggugauccgccugccucugccucccaaagugcugggauuacaggugugagucacugugcccggccaggaauuuggacuuuauccuguagguaauaguaaagcuucugaagaugcuuuuuuuuuuuuuuuugagacggagucucgcucugucccccaggcuggagugcgccaucucggcucacugcaagcuccgccuccugcguucacgccauucuccugccucagccuccugaguagcugggacugcaggcgccugccaccacguccagcuaaguuuuuguauuuuuaguggagacaggguuucaucguguuagccaggauggucuugaucuccugaccucgugauucgcccgccucggccuccuaaaguguugggauuacaggcgugagccaccacacccggcacugagggugcuuuuuuaaagaaaggaaaagauuuaaaauugguguuagcauguaggaugaauuggagggaaauguucuuuaaucuucucuauuuuuuuuuggcagucuauucucuucuauucccucugcauguguuaguuuagcauaugcucuuuggaaauugaccaguacauuuuaaaccaauucagaacgcuaccaaaccuuuaaaaaaccuguuguuauugggccugaugguaugaaaauagucuguuuucuucuauucccucauagcugagagacuuaaccaugguuucaagaaggaaccagagguagaaaguugucauugagagaucuuuuuuuguguguguuuuggaucaucagaguauaauauauuggcuuuaaaaggaccucagagguagaauauuuuucuauuugagacagauuucaaacauccaguagcugacuguuuaucuuguaguuagauaucucuagaagaggacaucugucccuuuuuuagaguuauauuccaguguuggcaacccuuuaguuuccuuuuuugcccaacugaaagcugugcucauuuaaagugcuauuuaggagggauaaguagaaaacauuaagacuguccucaaaauaagucuuuggucuugaaacaaguuuuaauucauuucccaacuuucaucuguucuguucucuaaucuauaugagguaauuuugucuuaaaaaauaguuuuguuuuuccuaguuuacaaauucaaaaccaguuugaaucuguaaggcaaggaggccuaguccagaguuuucugucucacgggagcuauuaggcuguuguggacugggguccagcauuucuuuuggaauuauccaucagaucuguggauccuaauauuaucucucauaacuguuauccgagagauuagaaguuugccacccaugugccugauagucuuguuucuaaauaucuuucauaucauugcuacuuuuucauccucuguuuuagccucucaauaucucuuaugaagacuacuguaauccuccuuacuggccuuccggccucugguuuccaguccaucuucuacuguguuugcaggcuugauuugacuugcaaaucugauugugucacucccauguacaauuuguguuucccaaaguaaaauuaaaacuuuuuuuuugacauacaggcucuuucaugaucuggcuuccucgcugucugcagcuucaucucuugccucugccuccucuauacucugcuccaacaguauugagcuacuugucauucucugaacacucucaugugucaaacuauuugccuuugcuugacugccuucaaaauuccuucacuuuuuagacuucucagcucaagugcaauuuccuuuuuuuuuuguuacuguuuuuaaagagaacaaggucuugcuauguugcccaggcuggccucaaacuccuuggcucaagcaguccugccucagccuccugaguagcuaggacuauaggcacacagcacuaugccuggcuuauugcccuuuggaacccuucccugacucuccagcagauugaggucuuuccucuguauuccuuuuucaccuuguaugugugugugugagagagauauggcauugugcuguauuugggugucugccuucucucuggaaggugagcccuugagggcaggggcugucuucucaucucuccauccucagugcugaacacuguauauguuaaauggugagcaggccuauagucaugucaggaauagugagcaaugaugugcuagguucucugccaaggugcugggaauucaacugugaagcacacagacguggcuucuacucucacagaguuuguaauuagugggaaauacagacaaguaaauauggauauggugcugauggagaauuauuggugagaaugggaacacaaugugcauccaacccugccuagugguccugcaauaauauuucucuuauacauucgccuuccuaaaguaggcuucauaaaucacucuauuuuuccucuuuuccuuuauucuuaguuggugaucuugcuuuuauuuuuucacuaaaaaaaagaaguagauaagaauuccuucaucuuuucaccacugaaucauaacagaucaccuacuuuuauacccauacucucugacuucucaugguggaugaugugucucuuuccugugaaagcucugcuugugcagaggauccagucuucccuugcucacucagggacuccgcuucugcaauuauuccucuguuccgugucauuaauuucuguuucucuccuggaucauucccaucauacaaacauguucuaauauugucuauuuaaaaaaaauccguuugaccacagauaaucuucuagcuaccaucccauuuccuuuccaucauuacagaauuucuugaaagaauaauuaauguuccuacuuccucccuuaacuauucauuccuuaacccacucuugguauuggucuguccucgcuacuucacugaauuacuucacugaaacuacucuugccauguugcaacguuuagcauuuaauguagguauuggcuucuguguaaaaggaaaguuuuuucuugaauacaacacucuccugcuuguucugucucaccucacugcuuuuuccuuucugcuguuuugugcugggcgcuucucugacugagagcaugguuguagauaccuucacuuuguauuuuuuuuuaaauagauaaacuuaaauaacaccuguauaccuacaacuacuccuuuauauuuuuaguuuugaacugucccccgaauuccaaauuaguaaauccaguugccaacuugaugucuucacuugaugucugauauguaccuugaacuuaacauguccaagaucaaaccugcucauccagccaucugccucuucaccaguuaguacguggugucaauguugguugugguuuuuuuuuuuuuuuuuuuugagacauagucucacucugucacccaggcuggagugcaguggcacaaucucggcucacugcaaccuccaucucccggguuuaagcaauucuccugccucagccuccugaguagcugggauuacaggcacgcucccccaugcccggcuaauuuuuguauuuuuaguagagacgagguuucgccauguuggccaggcuggucacgaacuccugaccucaggugauucacccaccucggccucccaaagugcugggauuacaggcgugagccgccaugcccggccgguuguguuuuuaaaugaagaaauuuaaguuuccggggucccuugauuucucuuaucuccugcaucuguuucaucagcaagcucugucuucuccaaaauauagccuguaugucuuuauuucuguccauuuuuacuaccauuccccugagcucuuuggguccuaaguaauucuucugcuucuuuuuauuuuuuauauuuuugagacggagucucgcucuguugcccaggcuggagugcaguggcgcgauuucggcucacugcaagcuccgccucccggguucacgccauucuccugccucagccucccgaguagcugggacuacaggcacccgccacaaugaccggcuaauuuuuuuuuuuuuuuuguauuuuuuaguggagaugggucucaccauguuagccaggauggucucgaucuccugaccuugugauccgcccgccuuggcuucccaaagugcugggauuacaggugugagccacugcgccuggccuauuuuuauuuuuauuuuuauuuuuuugagacgcagucucacugugucgccaggcuggagugcaguggcgcgaucucagcucacugcaaccuccgcccuuggaguucaagcgauucuucugccucagccucccuaguagcugggauuccaggagccugccacugcacccggcuaauuuuuuguauuuuauuuuuaguagagaugggguuucaccuucuugaccaggcuggucuugaauuccugaccuugugauccacccaccucggccucccaaagugcugggauuacaggcgugagccacugcgcccggccuucugccucuuuuuaaccuugcgaaccauuauacuguuccaccgcucuuauaacugaauccauacuguuuucugaggcuuaccaugccccucaggauuuggcccuuguguccuuccccuugaucacuauagucuuguuggucuguccuugauuuuuuuuuuuuuuuuuuuuuuuuuuugagauggaguuuugcucuuguugcccaggcuggagugcaauggcacgaucucggcuuacugcaacuuccgccucccggguucaagcgguucuucugccucagccuccugaguagcugggauugcaggcaugcaccaccaagccuggcuaauuguuuuguauuuuuaguagagacgggguuucuccauguuggucaggcuggucucgaacucccgaccucagguuauccacccgccucgaccucccaaagugcugggauuacgggugugagccaccaugccuggcgucuguccuuguguuuauaacaugucaagauuguucuuacugucuagaaugcucugcccccagauuuuuacaugguugguuccuuaucuuucaaauauuggucuuaaauagcaagcucuuaaagagaccuucuguuaugauugaauuuaagaaaagcuucccagucacucuuuauuauccuguuuuauuuucuucauaguacauaucucuaccuaguaguuccugguuuauuuguuaacuuauugauuauauguuucucuccauaggaguguaaguuccuugagagccagacuguuuuguucugugccauauuccuagcaccugaaaugaugcuugucauguaguagauguuuaguaaauauuuuauggaauaaauggacauuuaaggggauagaguaaaucagaauugcuaaaauggaacagacugcuugaagagguaguaaauuuccaucuuuggaagugcccagggagagacugaaggaucauugguaguggagcauuuugaacaggcuuuuuuuuuugccuuuuuuguuuccaaugcaucugagagaugugauauccuuaucaguaacacaggcucuggaaaguugauaauucuccaucuggagguggcuuaccagauucuguaaguggugaguauacuuuggaaagcuucccacgugauuaguacgccuccccaagcauggccacccccuaccaccucuugggcauuguauacaucaaaugggguguugguguuuaugaccucugagguccuuuccaacuuugugggacucugauucauauguuuucauugaaauaaucugguuaccaugaucacaauaauaauaacaucaauuuauuaccuuauccaccuucauggauaauuuuucuuuuuuucccucauauuuccucaaaacucaacaccguguucuuuacuccaaugaccacuauuaauaguuuucuauuucuucagauuuuuuucuagauucuaacugaaaugacaagauaauuauguauaucauuauauguaaauaaaauauuuuacuuuuuuuuugagacggucuugauuugucucccaggccagagugcgguggcaugacuguggcucacugcagccugcaaccucuaccuccugggcucaagcaaucuucccaucucagccucccgaguagcuggggccauaggugugugcuaccacaccuggcuaauuaaaacauuuuuuuuguagagacagggucucccuaucuuucccaggcuggucucaagcucuugggcucaagcgauccucccaccuugguuucacaacaugcugggguuacaguugugagccaccaugcccuggccaagugaaauuaggaaugggcugggugugggggcucaugucuguaaucccuacccuuaggcaagcagaggcgggaggauugcugggcaacauagggagaccuugucuuuaccaaaaacaaacaaaaaaauuagcuaggcaugguggugcaugacuguugucucagcuacucagggggcugaggugggaggauuguuugagcccaggaggucgaggcugcagggagccaugauugcaccacugcacuccagccugggcgauggagugagacccugucucaaaaaaaaaaaaaaaaaaaggauuggcuuuuuuucacuuaauaagucuuagauauguuugcugucaauguacagagaauuuaccuuauucuuuugaauaauugcaugggauuucauugcaugucaguuguauaguuuaauccccuugauguuuagacuguuuuaauuuuuuuuucaacuuuacaaacauacuuucagaaugucuuuguucuguaagauaaauuccuuugucaaaagguaaaaucauuuuaaauauuaauggauauugcuaguugcucucccaaguggaugaaugaaucuguacuuucuacagcagggguuuacacugguuacccuugcuucagucauugucuuuaauauuuuuaagggucuggauaccugaaaggaucaauggugcuuccaugguguuuacauguuuaagcauaaugaaaacuguugccauggugacaggcucuggagaacuagucugauaguuuucuggccuuuggauuagauuuguuuguugcuuuuucuuaguuaaugaugggaugaugcuagccugaagcgaguuuagguuuucuuaagcaauguaauaauuuaucacaggcauaaagauacuucggaagaguguauuccuggaacugccuguuuuuuuuuuuuugucaauggugacuguuagaaucuucaaggggauggaguguggcaguggagaguucucaugaauuaucucucuuaggucuucugccuuuuuugagacaaauaagcagcugcuagaacuucgagaucaaagauaguuuaucgagaacugugagguucucaagaaugagcgugcuaucuuuauaaacucugcuacccauuaaaugaauauucuauuagaaaauaauucacauuuuuauaacuuuuuaucauucagcccggacccuuuguuguugccucaagugcauccccaucuagguauaauuagaaaccuuuaaaucagcagauaagagagcuuuguggguuuuuugguuauauauuuuuuucucugagaaagccucuagguuucaguguaacucugagaaguaauauuuuuuuuccuuuaacagagugcgaaauuuaauuguacaacuugauaaauuuuuaaauguaccugucuaaccacuauccagaucaagaugcaggacauuaccagcaccauagaugccuccuugcaucuucccaguuauccucucccugugaaagauaaaaaccacuaucuugccauagauugguuuuaccaaguuuuaagcuuuuuguacauggaaucauauagcauauacuuuuuuguuuuguuuuguuuugagacggagucucucuugcccaggcuggagugcaguggcgcaaucucggcucacugcaaccuccaccuccugaguuuaagcaaauucuccugccucagccuccugaguagcugggauuacaggugcgugccaccaugcccagcuaauuucuguaguuuuuauuagagaugggguuuccccauguuggccaggcuggucuugaacuccugaccuuaggugauccacccaccuuggccucccaaagugcggggauuacaggagugagccaccgugccuggcccuuguuuuauuuuuuaauuuuuuuuuuuuuagauggaguuucgcucuuguugcccaugcuagagugcaauggcacgaucuuggcucaccuccaccuccaccuccaccaauucuccugccucauugccucagccugccaagcaacugggaucacaggcaugcgccaccaugcccggcuaauuuuguauuuuuaguagacaagggguuucuccauguuggucaggcuggucuugaacucccgaccucaggugauccgccugccucggccucccaaagugcugggauuacaggcgugagccaccgugcccggccuuuuuuuuguuuguuuuuggucaagauaaaacaugacaaaauuuaccauuuuaaccauuuuuaaguguauaguucuguggcauuaaguacauguacauuguuguaaaaucaucaucacuauccauauccagaacuuuuuugucuuccgcaacugaaauucaguucccauuaaacaguaacuccucauccuccucucugucagucccuggcaucuaccauuccacuuucuguuucuaggaguuugacuacucuugaugucauauaagugaaaccacaugguauuugucccuuugucauggcuuaugucacuuaaaauaauguccucaagauucagccauguuguagcagguaucagaauuuccuuccuuuuaaggcugaguauuccauuguauguauacaucacacuuugcuuauccguucuucugcugacacuugggcugcucucaccuuuuggcuauugugacuaaugcugcuaugaacauggguaugcaaauauugcuugagagccugguuccaucccccacccucccaaccucccagauggaguuucucucuugucaccuaggcuggagugggacggagugaugucggcucacugcagccuccaccuccuggguucaagcgauucuucugccucagcuucccuaguagcugggauuacaggcgccuaccaccacgcccagcuaauuuuuguauuuuuaguagagacgggguuucaccauguuggccaggcuggucucgaacuccugaccucgggugauccgccugguucagccucccaaagugcugggauugcaggugugaaccacugugccuggccgagauccugcuuucacuucuuuuggauauguacccagaaguggaauugcuggauuauaugauauggcaauucuguuuuuaauuuuuuugaggaaacgcaguacuguuuuucacacuggcuacccuauuugauuuucccacuuguuagugcacaaggguuucaguuucucugcauucuugccaacucuuguuuuuuugauacuagacauccuaauagaugugaggugauaucucguuguaauuuugauuuguauugcccuagugauuaaugauguugagcaucuuuucauaugcuuguuggccauuccuauaucuucuuuggggaaaugucuauucaaguccuuugcccauuuuaaaaucugguuauuauuuuguuguuaauugcauuguagggguacuuuaauauauucugauauuaacccuuuaucagauaagugauuugcaaauauuuuuccccauuccguaggugccuuuucacuguugugcccuuuauuguaccuuuaucacagaaguuuuaaacuuugauauaguccaauuuaucuauuuuuacuuuguugacuauacuuuuggugucauauccaauaaaucauugcuaaauccaaugccauaaaacuuuugcucuguuuucuucuaagaguuuuuuaguuuuuggucuuuauccauuucggauuuaggucuuugauccguuucgaguuaauuuuuguaguauaugguauaagguaaggguccagcuucauucuuuugccuauggauauccaguuuucccagcaucguugguugagaagacuguuuccccauugagugguuuugucaguuugguugaaaaucauuugauuuuguauacgaggguuuuuguguguuucuuaaaaaacaaagcaauuaaauugauucauuuuuuaacuguaguaaauguauuuuuaaaauaaacuuauaauggaaaaccugaaucauuaucccuaaauagaaggucacacuaaaaauaccauggagcuaggcagauguguucacccgugccuguggucccagcugcucaggaggcugaggugggaggaucgcuuggguuccaguccggccugggcagcaccaccagacccugucuccugccgaguucucaguggcucuguguggcugcaucccagaauauuccucaucuaauugaggggguacauuuguucccccagcauauacacuuaggcucugcccuguggucucugugugggagcugggcuuuuuugucuuuggcuuccucuggguaccugccagguuccagcugguuuggccagccaguguguauuuuuuaaguuuuguccgggcacgguggcucaugccuguaaucccagcacuuugggaagccgaggcagguggaucacaaggucaggaguucgagaccagccuggucagcauggugaaaccccgucucuacuaaaaauacaaaaaauuagccgggcaugguggcgcaugccuguagucccggcuacuugggaggcugaggcaggagaauugcuugaacccagcagguggagauugcagugagccgagaucaugccacugcauuccagccugggugacggagcgagacucuguccccgacuccccaaaaaauaaaguuuuugauuguguugcccaacuuacuugugcaauucauccauuuuuguguauagcagaaguucuuuuucauugcaguauaauauucuauuguuuguauaugcuauaauuuauccauuuuacuguugauagacauuagauuguuuccaguuuggggcuaucuggguaucauuucuguguaugcccuuugauguauauaugcauucauuucuguuagaguagaauuguuggguccucggguaugucuguguucauuagcauauuuauuuuauacuucuauauaaucauuuuuuuguguuuugcuucuugugcaguuugccugagaauacagaucaacccacagaacaaagcggauuuccaaggcaucuccccagagcgagccuuugcugauuuucucuuugccagcaccauccugcaccuuguugucaugaacuuuguuggcugacucauucucauuuacuuaauugaggaguaggagacuaaaagaauguaagugaugaucauaguccuuguccuauaauguugauuuuaggaagagaaauuggaugggacugguuuugaucaugguuggccaggcucccauacugcuauugacauuugcagaauuuuccauuggucugcaaaguaugcauuaauaucaucauaauucaucagugcuacugcucuuggucauugccuugucuuucuguucuucaaaucauuaagguaauagaaaauuaauguuuguagcuaguacaauaauuucuguaccaauaacuccacgaaaauaacucggagauuuuggaagagacauaaaugguagguuuugccuuuagauuuguuaguuaauuuuuuucugauuuugaucucagaugacuuuuaaugcuggaccauuguuuucauagcacuuaaauuugauagcauccaguguauguugaaugaaugacugugggcauuugcuaauaugugccuuaaaguagaaauaaauggggaaauuggguuaacuugggagaagacuuuaaaauauaagaugggaugcugcuugguucauuugccauuuucacuuuuuuagcaguagaguucuuucucccuucucccaaacaaacucuuacaaaaagaaucuugguauauaaagcagaaguagaauuggaguuuuuuuugauggacagaaauugaaaagcccucucugcuuggccuucaucacauaugguacgcccuccccuaaaucgcucccucccaagcagaguucuaaagcuuuaauaaauauauggcuguuuuccauaccguaugucaacacuguuacuuuauauaugagacaacagaggccuagaacaauccauuggccuucccuggccacauaguuaaguguuugcagugaagugcccuagucuagcgguguucuuggccccguacuccuuccgguaucccauguagcuuacugaugaaugcaugcaaucuuugccuuugcauugcaaaauguaauguucugggugguagagaaaagagaaccuuaggagaucucauccuauuugggggaaggauauccuaggaccaaccucuuccugucaccacuuggaaagcugucauuuuuauacuaaccagcagaaaucuaguauaagaguuagagcaucuaugugcaaaguggaugcaauaauguggaagugacuauacuuccuuuucugacaugaauuagucauuuacuuauaauauguuaccuaaauccuuuccuuugauacugccucaaaaacaguucuguuaguucagguaagguaucauuuugguagugguaaguugacagugagguuuauuucagugaaaaacuuuuuuuuuuucuuuucuguuuuuuuuuuuuuuuuuuugagauggagucucgcucuguuacccaggcuggagugcaguggugcgaucucggcucacugcagacuccgccucccgaguucaugccauucuccugccucagccucccgaguagcugggacuacaggcgcccgccaccacgcccggcuaauuuuuuguauuuuuaguagagacggaguuucaccguguuaggaugaucucgaucuccugaccuggugauccgcccgccuuggccucccaacagugaaaaacuuuuaagaaccacuuuguucuguuauuuuaauacaauuuaacucauuagacaccugauuaagacuugaguuauccucuuccucccuuccucccuccccuucuaugugccagccaaugucuuguuguugggaauauaaacaauauuguuggcugggcguggugguucaugccuauaaucccagcacuuucggaaggcgaggugggcgauugcuugagcucaagaauuugagaccagcaugggcaacauagcaagacccuaucucaauuaaaaaaaaaaacccaaaaguguggcuucugccuucaagacauguacagucuaguaggggagaauacguaaacauaacaguuaaaauacagcccauuuagggccucgcuauagguuugaacaaagugcugcaaaaauccagagaagagagcagcuguaccaucugggagcagggacagcagaugaguuaucugagcaauggauaacagcuauugcuaguuaaaaugaacuguuaccaguggauaaccuugaaugcagguagaaaacugacccaccaacauugaccuucucacgcuugcaaauaugaguaacccuugggcuuccugauagagccuucuggaaaggucaugucuucugauugcuuacucuagauuucugaaguucuuuuuuucuagaugagucaugguguguacuuaggaaggggacacagcaaacauuccaaggauguuuucuaggcucagggagauaccaaaucauggaaaauuauuucuuagggcugucaugauuggaggaggacucuacugcagagagcuuaguauuucaaaauuaugacaaaagcaaagacaaaaaagcagucucagcagaaacuguguacugcagaccauauuaacaaccuaggaccaccugcucagcugggaauuaugggcccaaagcauagcaaaauccucaaucccagauugcaguguuaaaucuuucuauggagaguauguucauagaaaaaucuuucucucugggggauugcccagauuguuuuucauagagauccuucauuugaauuauacuauacuguccugcucucaguuuuuaaaaauauacauuuauuugcuccuuuuaugugcuucuaacucagcuauaugugcacugugccacagcacuuuaaaaauaguuccaaguaaauucucaauauuuauaccagcucagaagguagaacaaaacagauugaaugucuuuauauuuuccaacuaaguugagaguuugauauuaaaaaaaaaauucuguaauauagcugaucuuacaugaauuugggggugacaaacucuaaccuacucugaaagaggcaggucaaaagaaaauggcauuggguuaaaaaaauaaacaauucaaggggaaguaaggaaguuaacagauaaugagugcucagugugugcuaugcuuuaaguacuucuuguucuauaucauuuuauuuucagaauaauuucacgaggauaggcuugcuguucucauuuacagaugaggaacugaaguugagagagccuggcuaggauggcugagcacgguggcugaugccuguaaucccagcauuuugggaggccgagguggguggaucaccugaggucaggaguucgagaccagccuggccaacauggugaaaccucgucucuacuaaaaagacaaaaauuagcugggcgugguggccggugccuguaaucccagcuacucgggaggcuaaggcaggagaaucguuugaacccaugaggcggagguugcagugagcccgaauugcaccauugcacuccagccuggcaagaguaagacucuguuuucuaaaaaaaaaaaaaaaaaaaaaaaagagccccuugcuagaaaucuuacaacuaauguaucuauccaggugaucaagaaagacucaauauuuuuuauuuuuuagacuauacaaaugaaaauacaaaagcaaaaauucucccagugagcuucugacccccagaaauccaugcacaccugaaaugaucaguuuuugguguguagguggcggcauauuuuugaaugaauccaugacagaaagaagcucaguggauuucaguauuuaaaaauguauauacuuuaguuuuuuccauguuuguucuucuguguuucuuugugaaauucuuuuuuuuuuuuuuuuugagacagagucuuacugucuugcccaggcuagagugcaguggugcagucuuggcucacugcaacccugccucccggguucaagcaauucuccugccgcagccuccccgaguagcugggacuacaggcacuugcccggcuaguuuuuguauuuuuaguagagaugggguuucacucuguuggcuaggcugguguugaacuccuguccucgugauccacucgccuuggccucccaaagugcugggauuacaggcgugagccacugcaccuggccugugaaacucuuuuuuaaaaaaaaaaaaaaaaaaucucaguccaucucagguguucugaaggguaaugaggaaaagaaggacagaacuguauuggaucacaguuugagaauuaaaguuccugaugaauugggcccugggucagaaggaagggugaacugggcccaaagggacaaaaccuugcuugaaaaugugcucagcucccagggagauaguugccaaaugccugugccuuguuagcauuguuuuguuuuuauaauggagaccauucucucacaagucuuaaaaaauucaguguuugauccuagcuggaacaagggggcuacaggguugggcagaacauuuuaaacucugacuggcagcacuguuuacaaacaugaaauuauguuggcuuuucgaauucaguuaaaguauaguaaucuagaaaauuaccucgggaaggggaacuugauguuauucugugggcuuugcugccaccuaguggaugguauguuucauguguugagcggcuacuacaaaacaugaggaguugaguuugggggaagaagcuacugauaccuguguuaaaaaaccuaguuucuuuccagucauuggggggcagcagagguccagguggguuuagaugcuggguuggggguugcuuuacauucuggccagaagugggcaaugucgaguuaggaacaaaagggcauagaacccuaaaguggcccuagauuuuguugugugggggaagaccaagacugugcacauagacccgcagguuucccguuugauuucuuuuuuucaccuccuuaguuugagagcuucuuuuuuugguuuguucuacgucuuuuauucucaauggugaccucccacgcaauaaucuuuaauuuuuuguugguggaggggcccauuuaguuuuuauuucauuuucucuuugauauuuccaccuuauauugaauuagguccugccgccaaauaagcucucucagagggaacuguccuacauuuguaggaaaucugagguagucacaucauaacuuuuuucaacucauuuuucucuguuuagaaggugagauuaauuauauauuuuuuuaugugcuggggucucgcuauguugcccaagcuaggaacucccuggggucaagugauccuccugccugaggcuucuguguagcuggaccuacaggugugucacagugccuggcucugagauuaguucuuuaccuuucauucuuaaaacuuugaaucuacuuauuuuauuugcuaaaaagugcuaauugaugacuuuacuuguuuauugaacucuauuuuauauuugguguauuuaaggcuaccaaagaaaaaagaauaucgaaauagauuuauauuuaugaauuucauugcugcccuaacuuacugccuuauuuucuccauccucccagcuuggaugacuccuauuccaagucauucccaccccucagguugcauaggagcccuuagucuacugcauuccuccagugcugcacuuaucacauuguuaugaaacuauucauucacuuucuucucucucccacuggacucaauugugaacaguaacaguguguguuuguugaaugaguguaugaaugaauaaaccuuuuuuuuuuuuuugagacggagucucgcuuuguuguccaggcuguagugcaguggcaugaucuuggcucacuauaaccuccgccuccuggguuuaagcaguucuccugccucagccucuugaguagcugggacuacaagugugugcucccacgccuggcuaauuuuuguauuuaggagagacaugguuucaccauguuggccaguauggucucuaucuuuugacuuugugaucugccuaccuuagccucccaaagugcuggaauuacaggcaugagccacugugcccggccaaauaaacacuuuuuaacugcaagaaaaaguuauguuauuaaguuacuuggaugcuaaaacauggaaagugguacgaaagaaaaaaagccaaggcaaagauucauaggagaggcugugggguggggaagagcaugagacaagaagucagaggaggggcuggugcgguggcuuaggccuguaaucccagcacuuggggaggccaaggugggaggaucgcuugagcccaggaguuugagaccagcaugggugauauagcaagaccuugucucuaccaaaaaucaaaagaauuagaggggcgugguggcgugugccuguggucccagcuacucagaaggcugagguggaaggauugcuugagcgugggaggucacggcugcagugaacugugaucaugccacuugcacuccagccugagugacagagugagaaccugucucaaaaaaaaaaaaaaaaaaucagaagacuuguauuguaggcuuugcucuguuaacuaguugaauggacaaauaaacuuaccucugagccucaguuucucugucuguguugugagaggauuggucuggauguucaucaaagucucuugccacuguuaaugccucucagcaugauucuugaugguucuuuuguguuugaggaggauuguacuguuuuuguggauccucauuugggcuuugcuuucuguuuucuccuuaaucguugcuuuuuauucauauuuucagauucccauuauccauuuauaggaggcagaaaguuaaaugauuauaacaagaugcacauauuuguaugaagccuuuuacaaaaaguaaacauuuguaaaaugucuucuaguucccacguuaacaggcuuguaggauucacauacauuccacauauacuuuuacauacaucagcucaugugauccuuccuuccuacccagugauguggagacagacaaauaguaguauuccuauuuuacacuugagguaauuacaccuuggugaaacuuuaguugauguauccaggcccuggaacuaauaagugacugagggggaacuggauaacagacauuuggacucuaaaccuuuauauuccuuccuguuauguuuaggacucucagaugauggcuuuauauauaugucauguuagaggguuuucauuaaaaauauuaaacuuuucuuuuuaagaaauuuuuauuuauuuuaaauuuucaucagagccaucagacuggauucuuuucuuuuuuaaaugggaaaaauuuggcagagauugauaggaaaggaugaaggccggcuaucucaaauguuucugcauaguuggccauacuuaauaugguccaggagaaauggaggagaaugcaggucaggagaccugacuuuggcuagggagggugauccuggaccagcacuguccaacagagcuuuuugcaguggggaaacauucagggucugcaccgcccauuaugguaaccacuagccacaugugguuauugaacauuugaaauguggcuaacagacugaagaacugaauuuuuaauuuaacuuugacuaaguuuaaauagucaccugugucuaguggcugugguguuggacagcacagcucuggacagauuugucaacacuaucagguuacaguuuucucaucucuguaaugaaaggauuaaagaagcugaucucuaaagcuccuuucauuuuuuagaaauacacagucugugccuucuaaaacuggugauucaaauugagcuguaaaccuagaauuucugcagaauggucuuugauucacauuauuucuaauuucaguuuuaauugggugacuagaauccaggaugagaugaauuugaaggaaaaucaguauuugaacauaucugcccagugcuagugucugaauagagauauugcuggagaagaauacagauuccaaauagaaaugacccuggcuggcauuaucuuuucuaucucuacagcgucauuuuuaacaguucuuuguguuaugccuugcuuucuuuuuagaugauuagaacaaacugauuaaauggcacugucuucugcccaggugaaauagacugaagucacgcuaacuuuucucaguaggugucuucauuuugcaugucuugauaucaggggaggagauuuuauuagucaguuuccugaaaccuuuaugcccugguuaauaguugaaaccauucuucuuagcuguugaguagucaauugugugagcuaauauuucaaagaauccuagaaccucugcuuuuagaauagugucugguaaauagaucugcuuuaaaagaggggaagcagaucuuuguaaacagaauuuucugaaaaccacuaucaaagagacuuacucucaugagucaauuuuugccuuucacguggacuggccucagcaucuuagauuuaaauguuuuaauauaauaaaaucuuuaaacuuugauuuuguacuaaacuaggauuucuuuuauauuucuaaaagugucaaggcuuuguucacugaaaauggcauuaugaucuaguccucucucaccuuggccauuagaaauguaauguagccaggcaugguggccugugaucccagcacuuugggaggcuggggcggguggaucaccugaggucaggaguucgagaccagccugaccaacauggugaaaccccaucucuacuaaaaaugcaaaaauuagcugggugugguggcacacgccuguaaucccagcuacucagcagguugaagcagagaaucgccugaacccgggaggcggagguugcggugacccgagaucacgccauugcacuccagccuggacaacaagcacaaaacucugucuugaaaaaaaaaaaaagcuguaauguuauauuggcugauagucuauugccagagaguuugcuuuaagaaauuugauggaaugaauaggugaguuugaauaggucuguuugguuuuguuuggcacugugaacaccuuuugcuuccuguuauugcucuuucuuuuauacauuucuuauaauaccacugauucaggaauguucugcaauuauguagcauuucuguaaauaccaguguuagugaaauaaaagcauucuggcugaaaguccaaaaucucuccuuuaaguucugaugccagaaucuccagguuacuuacuugacccaauauaccaaauaagguagugcccuuuuuccuccuggggcagcccgguucuucugaaagguaguauuucccagccucuuuugagucaugguacacguaggagauugcaguauuuuuauggcacacugggaaaaucaguugcuuauagcuggagacauuggagccccuaaggcuggaggucacuuuccaaccagagcugugcuggaguccaguaggugggaggcugugcuuugagggacuaaaggaagccuguaucuuguggugaggguuccaccucacaaguuacagaucucaguuccauuuggcucuagcagcaauguggccacuucuguugcgguuacucuuucuucaccuuuuucuugccaaaaauaaacuuaucuuuaaaugaaaacuaaauuauuucuuauauuuugguccuuuguuauagcugagauugggaauuuuucuuucuuucuugaauccuuacuucccuacccugccuccccaccaauggaaaucugugcuucauaagcauuuuagauuccagaaagcucuuuagguuaaacuacaacccucucaccucaaagaauuugugggccagggaagucagugacuuaugugaagucuugcggcuaauuaaugguagagcuggaguuaggacacaugucucacaguuccuaguucguuuugcuuugaugugcuugaaauucaguuuugacauuaauuuuucuggauacuacucccauaaaauguucuuugaaaaauacuugcuucuuucuaguuuuucucgccugguuuaaauauuguccugagugugggaaccccauaacugucuuguggguuagaauuuagauggaaggauuuggggcccugucucuaguaucauaagacauuuaaccuugcugcuuuuuucuucuagguucacucuuugaauuuccuggauaagaguucuggagauggcagcuuauuggacacauggauuuucuucagauuugcacuuacugcuagcucugcuuuuuaugcaggagaaaagcccagaguucacugugugucagaacaacuuucuaacaaacauuuauuaauccagccucugccuuucauuaaauguaaccuuuugccuuccaaauuaaagaacuccaugccacuccuccauaugccuc

SEQ ID NO: 17568 - RNA, 441 nt, Homo sapiens
cacacaagagaugaagcccgagagaaaagaguugaaggggaagguccccacgaggagacaguaaccgaacugcagcgccccggucagcaguauauacagcagguacgcguccagcaacuucagacgcugcggaguggagcucaaguacucuucuaagaaccgcgaaaugacagacacuaccgacgccgacauaacugcacgcaagguacuccaguccgcgccccaaacucuuggaggacccgucgaccacaccggaugugcuguuugcgcaugcgcacccucgugaccuaacuccgcccuccccggugugccaauuugcgcaggcgcugaggccggccagggcgcguaacaacuaaugcgcagacgcggacugcaucaacagacucaacuacaacucagaaaaguuaaugcgucugcgcaauggcccuaucaaugagcugg

SEQ ID NO: 17569 - RNA, 441 nt, Homo sapiens
ccagcucauugauagggccauugcgcagacgcauuaacuuuucugaguuguaguugagucuguugaugcaguccgcgucugcgcauuaguuguuacgcgcccuggccggccucagcgccugcgcaaauuggcacaccggggagggcggaguuaggucacgagggugcgcaugcgcaaacagcacauccgguguggucgacggguccuccaagaguuuggggcgcggacuggaguaccuugcgugcaguuaugucggcgucgguagugucugucauuucgcgguucuuagaagaguacuugagcuccacuccgcagcgucugaaguugcuggacgcguaccugcuguauauacugcugaccggggcgcugcaguucgguuacugucuccucguggggaccuuccccuucaacucuuuucucucgggcuucaucucuugugug

SEQ ID NO: 17570 - RNA, 5465 nt, Homo sapiens
ugauugucuguuuuuuuuuuuuuaguuggaguuucacucuucuugcccagacuggaguacaauggcgcaaucuuggaucaccacaaccucugccucccggguucaagcaauucuccugccucagccucccgaguagcugggauuacaggcaugugccaccaugccuggcuaauuuuguauuuuuaguagagacaggguuucuccauguuggucaggcuggucucgaacucccaaccucaggugauccgccagccucagccucccaaagugcugggauuacaagugugagccacugcaccuggccugucuuguuucuuuuauaccgagagcucuaucaggauauugaugucugguuuuguucuccauaaaaucuacgccuaauacagcacuuaucacacagaauuuuuuuugagacaaggucucgcucuguuacccagacuggagugcaguggcaugaucucugcuuacugcagccuucggccucccaggcucaagccauccucccaccucagccucccaaguagcugggaccacaggcaugcgccaccacacccagcuaauuuuucauuuuuuuguagagagggaguuucgccauguugcccaggcuggcccaauuuccgauuaacucuagauuugauuacuuuucuuagucuaggaaaacuguguuacagugaugcgaggaucuguagaaugacguggauguuaccccugagaucaaaguuacuauuaauaucaauuucaaugaacuagagaccgcuguagggagguugugggaacuguucagaacggcuuaaucugggaggacacgacuuccacugagaaugcaugcgcugaacgacaauucguuuucaccucaaaaaccuguacugcaguuuugucucuccuuccguacgaugacccaagauggcggagccgugauugaaaacccagauucaagauggcgacuuccugcuuccccgauagcgucgcgcguggccaccgaggccacgccuacuuccggcuaccccggcuacuccugcucagcauggcugcuuuagggacuguucucuucagugaguggguauagauagggaccguggacucgggggcccuuuggggacgggcacaggaccccugauccggcugcgcggccucucccccaacucugcucuguucucccagcagguguccggaggcugcacugcagcguagccgcuugggcgggcggccaguggcgacuacagugaguccugggaugagggcaccugggggaccagaagcugggcuagguccucacagaucuguuuuucuccacacaggcagggacuggcugccaaccccuccggcuacgggccccuuaccgagcucccagacuggucauaugcggguaagcgcugaucuggcaguuaacuccacuggggagauuuucaccuagagggaacgccccuggacggggagcuggggguaucaaggugggggcguguaaaaguguuuaacuuuuuauuuggaaaacggaauuuggggaaagaaacccucuuguuuauuuuguagauugcauuucgacuaaggaagguaaagcuaaacaggaucuuggcuuguggagauaagcagaagauaauucugacuuggggccgccaggguggaagggggugacaagacuucugcguuuuucaaagggggacauuuuuuuuuaaccaagaaccacuuuucucugugguuagugaauuuucaguauuugguaccaaaugcagggagagcucuuugaaaagcugcagaaauaagcgucucagagggguagaaggaugaagacuauggauggcaggcucccuucagaaaauucuuuuaccuuuacuuacaaaagagagagggagggagaauaaauauuagcccuagaagggagaaccuuagagaaguugaagcuacuccccauucuccuuaugagacuccaguguacaaguaggaaauuugaggccuacagaagugaauugcacaugaucauacagcuagguaguagcaaauccaggacuagaacauaggccaguccuccuugacaacacagagaucugaauauuuaauacccuauuguugcucucuagggguaugauccugcuuaauuggauaauuggugacugaggaagauggugaagauuuuuucuacuuguuauuuacuguaagaagccuggcaucuccuuguaguaguauggacuauuggaaagacucuggaauuacauaugacugcuuuuuuuuuuuuuuuuuuuuuuuugagauggggucuugcccugucacccaggcugaagugcaguggcaugaucaucgcucacugcagccuugaucuccugggcucaagcaguccucccaccucagccccccaaguaggugggaccacaggcacacaccaccauuccuggcuaauuuuuuuuuuuaacuuuuaguagagacaggcucuugcuauguugcccaagcuggucuuguacuccuuagcucaagugauccacuucagccucccaaagugcugggauuacaggcaugagccaccacgcccagccuauggaccuuauucuuaauccaggcuucccuucucgcuaaguuuguggucuuggacaaauuacuuaauuuuaucuuagucucaguuuccauaucuguaaaagaauaccuaucucaugugguucuuuuaaggauaaaaugaaacaaccaauguaaagcauguggcauacacaauauugguuccccuuccugguaaauaacaccucuucucugucuugccuucaaacuuuugggcagaguuuucacucuguuucuuucuuugcggaaaguaaacuacuuggguuagauacugcaucuuuucagcaagucagcagguauuuauggauuuuuauuaacaugcuuaugugucuacacuauacugugaauagcaaaagcuagcaacacagucccugacccaaagaacuuaaagucuaacugggacaaagcauggacuuuuuaaaaauuaaguaauaguauucagggccaugcaucuacaguuccagauacucgggaggcugaggcaggagaaucgcuuaagcccaggaggcagagguuguaauaaucugagaucaugccauugcacuccagccugggcgacggagcgagaccuugucucaaaaauaauaauaaauaauauuucaauacucugcgccuuuccaaaaggaccugagguagcuaaauaacacuuaaaaaaauaaaacagaagaguacaguaaaugucccaaggcaaauaggugaauauuaaauauucaguacuucuuucagaagagaaggcugauggacuugaagagaugagcguuucugggaaaguuaggguuugaguggaccuaaggaugaagauuuggcuggaagaaaaggaaaagagggcauuucauuguggagugggauggaauuuagcaaagguacauagaacaacagugaucacauugcuuaagaguuucugguuuuuuuuguuuuuuguuuuuuuugagauggagucaggcucugucgcccaggcuggagugcaguggugcgaucuuggcucacugcaagcucagccucccggguucaggccauucucaugccucagccucccuaguaguugagacuacaggcgcccaccaccacgcccggcuaauuuuuuguauuuuuaguagagacaggguuucaccguguuagccaggauggucucaaucuccugaccucgugauccgccugccucagccucccaaagugcugggaucacaggugugagccaccacgccuggccaagaguuucugaagacaaaacaguagauucagcauugcagaggaccucaaauacaaggcuagugagaguucagugaaauagaguaguaaauuagccgggugugguggugcgcaccuguaaucccaguuacucgggaggcugaggcaggagaauugcuugaaccugggaggcggaaguugcggugagcugagaucaugccauugcacuccagccugggcaacaagagcaaaagucugucucaaaauaaaaaauaaaaaaggccgagcacgguggcucaugcuuguaaucccagcacuuugggaggccgaggcagguggaucacgaggucaagagaucgagacuauccuggccaacuuggugaaaucccgucucuacuaaaaauacaaaaauuagccagggaugguggcacguguuuguagucccagcuacucgggagucugaggcaggauaaucucuugaacccgggaggcagagguugcagugagcugagauugcaccacugcacuccuaccuggcaacagagcgagacugucucaaaaaauaauaaauaaaugaaauaaaaugaaauagaguaguaauaugucuaggagcuuauucuggguuaucguaccucacccuugaagaugauggacauauuuuaggauaauuaagcuacaauguauaugaaauggaagagaggagcuagagauugguucuucccuuauuccuaucacaguauuugcacaaggugaugcaguccaucucuaacacuugacuuuucucucacuucuacuuguagauggccgcccugcucccccaaugaaaggccagcuucgaagaaaagcugaaagggagacguuugcagugagugguuagagcaacagccagggcuaccuggaaggagaacauuuaaaucauaauuugucuugagcuguguugcaccuaagcaaacauguaccccucauacagagguuuuauuaauaacagccaaagguuuuuuuuguuuuuguuuuuguuuuuugugagacggaguuucgcucuugaugcccaggcuggagugcaauggcgcuaucucagcucacuucaaccuacucccggguucaagcgauucuccagccucagccuccugaguagcugggauuacacacgugugccaccacacccagcuaacuuuguauuuuuaguagagacaggguuuuucuauguuggucagacuggucuugaacuccccaccucaggugauccgccugccucagccucccaaagugcugggauuacaggugugggccaccaugccuggccccagccaaagguuuuaauagcacugugagaagggaggaagagaguggggcacucccaggacaggaaccaguaguagacauccugcugcacauuuugcugucucccucugcuucccaagccagaacucgcucccacuggggagucagcagcgucauuuuccagaugaaaccucugaauuuguaaguggaaggauauauaguauagcgcugaagucccagauguuauccacacuguuuuccugucuguuucagagacgaguuguacugcugucacaggaaauggacgcuggauuacaagcauggcagcucaggcagcagaaguugcaggaagaacaaaggaagcaggaaaaugcucuuaaacccaaaggggcuucacugaagagcccacuuccaagucaauaaaaagcaacuccugccucccuuccucacccugu

SEQ ID NO: 17571 - RNA, 14374 nt, Homo sapiens
uucuugguuguaauuggauucaggcuaaaacaaccacguccccaaccaggaaaggagggcacuggggcggggacggaggagaggcugugggagaagggagggaccagaggagagagcgagagagggaaccagaccccaguucgccgacuaagcagaagaaagaucaaaaaccggaaaagaggagaagagcaaacaggcacuuugaggaacaauccccuuuaacuccaagccgacagcggucuaggaauucaaguucagugccuaccgaagacaaaggcgccccgagggaguggcggugcgaccccagggcgugggcccggccgcggagcccacacugcccggcugacccgguggucucggaccaugucucccgccccaagacccccccguugucuccugcucccccugcucacgcucggcaccgcgcucgccucccucggcucggcccaaagcagcagcuucagccccgaaguaagugagcuucccggcccuucccggagucgcgcccgccgggaggcgagcccgggggucuccuaggggacagccucuauucggagaggagggcuuuugggaucuccgcugcucaggccugcaggauucccccucccuuucuuuuuccucuucgucuccaaacuuccagaucgauccaacuuuugcccgcuuccaaccagcugcccccacccccugcgccgccgacucuccuucccauuccuucuuuuuucccaguccuuggaagaacuuuacaacuggggcgaacucccccuuccccgauucccuugggcucugcucucagcucuggaaccgccugauaaacauuuggacuccgcucaaaccccgcgcugucccggcuccucgucaugcgcgagaguuuguuguuucuucgacuucccagcucuccagcgcucucccgccggcgcgcccuccgaugggcgcuucggccuccccggguggcccaggccuucagcggacgagucugcggccaggugggggucgaggguggacggccgagcguccagggccacagcccccgucuccccgagaggaccccgcugugucccuacccgcaucccuggcgucgagggucgcagcgccggcgcgcuggccgcguuuccguacacacaaagcucuccuugugagccgggcgaucggccgggucgcugccucccccuauccccacccgcgucggcgccuucaggcccuuuuuguuguuaauaguuuuucuguguuaauugcagggagccugggggcgucgcuuggggaauggggagagggucugguccggggugcccucacgucggggcuggcucgggcgccccccacccucaccccggcccagacgguggcccaccgggccccagaggaagcugcgugggaguugucugaggagguuuuuccucucucucucuuauuuuggggugaaggugggagacggauuuaaugagcuucuuauuuugggccaucucaacccacucagccuggcaagggccugggugcgguugggaggggccaggaagggcccuagaagggggaugggauauggguuuggcuucuccuccuuggucccaccccggagaaaacucuuuggaaagaauacugucuucucucugcgucccugaaagggucuggggccgacuggaaaaguauggccccaggaaucgggguggaagacgaaacguggagugcucagagaccagggagaguaaaaaccugcccuggugcuggaggcugagccugacuguccgggaggagucguccucuucccaggccuagaguccucugagaccugaaagggagcgccccuaacaaaacgagccugagcaucuggggagcugccgaccgccaacuucacugccuuaccuuuuuucccuccccugcuuugcugggucccccaggggaggggcggcugcccuggcuccguuuuaauugggucaugggcggucccagugccagaaccaccauuugcuucugggcccaggaagggagggaggagcagccccagaggcuaggauccagggccuacugcagagcuggagguccccccacccuccccuggaccccuaagccaaggugggagguguuccguugacuuucuccuaggggauaccuugcaucucucucauucgcaaagacaaagccagccgacuggguucuuugacccaacauaguugcuuuuuucuccaggccaauguggagggaaagcugggguggugcaggccucaugcagcugggucccuccuaccaggccuccagaguccugcaccagcuccaggacagcccucuccuccccauggccugucuggcgcugggcccuuccucccacccagccgcagacacaagaguccucucuucugugguuucgaccucauagucucugugaggagagaaacuugccuaggccuggggggaggagagggaugggggcacuuccuuuccaggccuugcggcucucuugacuccagggaaguccuucauuugacugagccuucauuuuucucccgaggguaugggguggagguuguaggugugaauauuuagaccccccuagcuucuugaacgacuccagaggggauuucccccagagcuccuggauguggauucuccccaucucuucugucccgucuuccuucugucguucugucuucuccccaucuuccuucugucguucugcucuaggcaaauucucucagcuuugcucucugaggguugacggggccuggccucaguccuccugccuuccagcgucaguagaccagucccauccuuccccaaguccugaagcagcugcuccucaaccaagggucauaagcccgggguguguuuauccugcagguaugcuaggggcaaaagacauuuccugcauaguuaggcacaggccacagcaggccuccccaggcacuggcuguggcaucagccagaacaggucagggcaagccugcagcucccugagagcagccccggacugguguggacugcuuggcucccucugguauaccaaagguuaaaugucacuccuuccucuaccccugaggaggggcucucagagccucagagcuagguggugcuaggguuguucuagccaagacuguuggcugggaaaaggcuggguuguuuacaucucggguucuagcucgcaucagccuuggggggggaucacuucccagaaccauguugcaauucuugccccugugggcucagguccccagucagcugcucuugagucacccccaguccccaugcaagacuacugccccaucaccaggaccugagcccagaggugaaggaccauguggcaauccaauccugaugaccuuggcuaggagauacagcacccaacagcagccucccccaucuccccuccaagaucccauccugggcaaccuacagccgcuuccugaacucccuaagaaagcaaagcuggagcagggacuagagcuaucuggguggugucuucuccccauaaaagaauccaagcaucuucauauuucauauauaacuuggcuuguuuuacuuuuuuuuuuuuuuuuuuuuuuuugagacagagucucgcucugucacccaggcugagugcaguggcgggaucuuggcuaacugcaaccuuggccucccagguucagcaauucuccuaccacagcuuccugaguagcugggauuacaggugcccaccaccacgugcagcuaauuuuuguauuuuuaguagagacaggguuucacccuguuggcuaggcuggucucgaacuccugaccucaggugaucugcccgccuuggccucccaaacugucgggauuacaggcgucagccaccacgcccagccuggcuuguuuuacuuugaggcuuuaagaaaauacuccauuguucuuacaauaaaggcugacuuucuccucaacagggcuuugcaguguguguaccuuuuaaucaaacaccaaaaaccuaacauuaauuuaauuuaaggcaauaugccagccuuuauauuaugaccaauucacaacauaccugaaauaaaauacagucaccaagucuccuccuccaccccuaugucccacuuccucuguugagaaucuuuuuuuuuuuuuugagacggagucuugcuuugucucccaggcuggagugcaguggcgcaaucucagcucgcugcaagcuccgccuccugcguucacaccauucuucugccucagccuccugaguagcugggacuacaagcgcccgccaccgugcccggcuaauauuuuuuguauuuuuaguagagacaggguuucaccguguuagccaggauggucucgaucuccugaccucgugaucagccugccucggccucccaaagugcugggauuacaggugugagccaccgcgcccggccacugcugagaaucuuaaauaggccuuuagguuccaagccauaggucagaugcugcuuggauaaggacagcggcaggauccuggcuucagcuggaucacaccucuuaccacauuccaaguuccuaguuuccccucguagcagccagccuuagcucuagcucuuuuuucugcccuccuuucuaaaaagaucucagcugugaggguccuggggacauggcacucccaucccaggagggccucaggucaagcccaauaguagagcucacucagccugucaacaccccuccccacacaucaugggcauagcccagucccagguggaacaugcuauauuuguaagaacacugacaugggggagaaaagugcuagaaggaaucacagcucugagaagacaucucagaaccccauuaaaccaccagggcucucucucauuuucaagagagcuacagccaaaagccuguuugggcccauagccccgaggggacaagcuauagccccgaggggccugggccagagaucaggucuagccugggaguuccuccagaccugcugccggagccaagcugggaacccacugcccuuuccuugccaagccaaggcuguaugcugggcauugucggggagguagaggcacccuaugggccagguggggacacucuaagccauaccccuuucccuacaggccuggcuacagcaauauggcuaccugccucccggggaccuacguacccacacacagcgcucaccccagucacucucagcggccaucgcugccaugcagaaguuuuacggcuugcaaguaacaggcaaagcugaugcagacaccaugaaguaagugcuagacccuggcaggaguucugccuagcauccacugacaaugccagcgccagagauguuccuaccugaaugccuggcuugugcaccccacucccccauaucucauccccacgugcugauccugacccucucauauucacccugaccucauaaccuuggccuuuccccacauugacacacagcaagucuuacccaacacugaucguggagaccuuucucuuucauacacugcacugaucccaauccucgcacccaaacccacuccagggccaugaggcgcccccgaugugguguuccagacaaguuuggggcugagaucaaggccaauguucgaaggaagcgcuacgccauccagggucucaaauggcaacauaaugaaaucacuuucuggugaguccaacaggcaagcaaccuuucucacaucugguuauuauuuccuacccauugugcuuaugcagggacucagagacccccugccccacuccccucaguuccugggaagcauccgugggaguggggaggaaaauggcucucauccuugagagagguguagccaucaagggugcaccccagugccagagagccagagccugaggaucccuuguucuugagacagaggcguugcgcaugagguagcaggaagagcugggucaggcagagguggcugggccgcgcagucagaccugggagagugcagggaaggagaauguugccccucuuuauccuaacacaccccauccucuccccacguggcuggaccucagcauccagaauuacacccccaaggugggcgaguaugccacauacgaggccauucgcaaggcguuccgcgugugggagagugccacaccacugcgcuuccgcgaggugcccuaugccuacauccgugagggccaugagaagcaggccgacaucaugaucuucuuugccgagggcuuccauggcgacagcacgcccuucgauggugagggcggcuuccuggcccaugccuacuucccaggccccaacauuggaggagacacccacuuugacucugccgagccuuggacugucaggaaugaggaucugaauggugagccaaguaucccugggacuuacucuggaaaaagccaacagucauuuguaggggugguuccccucccuccuuccaaaaucuccgggcuagaagggaccacagagaccuucugaucuaacuucugacaaaagcaggaguccuguuugagcuauuuacaucugguccccccucucacccacugacuggcuuuccagucaaagacuucaaagcauccuuauugcccacuuuuccagaccgaugucaugucucgcucccgggagaaacuggggacuagagagagccuuggcuucccuuaccacaggucuucccgggaucgggguccugcuuccaagcacucucucaccuccacccagaggagcuugcugacuggcuuugugcuuaaauaccagauaaaaagcuagaccucagaauuuggccacuuuggauugaaaacaugggcagcaggcuuggaggugaaaccaaagcugcugguggggaagcagggaggcugagggaagggacucaggcugcuaucgucacuguccccauccuuccaggaaaugacaucuuccugguggcugugcacgagcugggccaugcccuggggcucgagcauuccagugaccccucggccaucauggcacccuuuuaccaguggauggacacggagaauuuugugcugcccgaugaugaccgccggggcauccagcaacuuuauggcgaguagucuacacccacgccugcucccuccucugcugcuuguucccuccuggucuacgcauuuccccucuuuuaugccuugcagucuccgcaccgcccccugccaaccugccccugccucuaucagcuccacuuuugagcccaucuuuugugucgccucccaguugguugcuucagccuccccuagaagcccauccacaccuuuccaaggguauugucugcccaucugucuguccuuccguccccgccuccuccuaagucugaaaugccccucguguuuucugccccagggggugagucaggguuccccaccaagaugcccccucaacccaggacuaccucccggccuucuguuccugauaaacccaaaaaccccaccuaugggcccaacaucugugacgggaacuuugacaccguggccaugcuccgaggggagauguuugucuucaaggugagaagaagugggcugguuugaaagacaaaagggcccuaugggcugggcaugguggcucaugccuguaauccuagcacuuugagaggccaaggcagguggaucaccugaggucuggaguucgagagcaggcuggccaacauagugaaaccccgucucuacuaaaaauacaaaaaauuagccaagugugguggugggcgccuaugaucccagcuaccugggaggcugaggcaggagaaucacgugaaccugggagguggagguugcagugagccgagauagggccauugcacuccagccuggacaacagugugagacuccaucucaaaaaaaaaaaaggcggggggguacucugugguagggcggcuggguggaagugacaacagcuggacuaaaaacuaaaacugaggaacaaacagcagugcgggagcuuuggggacugaaccagagaccuaggccgcaagacauaauggacuuuuccugcauugaccggcuuccaggagcgcugguucuggcgggugaggaauaaccaagugauggauggauacccaaugcccauuggccaguucuggcggggccugccugcguccaucaacacugccuacgagaggaaggauggcaaauucgucuucuucaaagguaaccaggcacuccacuuuagucuuugggagugaggcgggucucccuagaggagcugauuuccucuaaagucccuagagccuaaguugaacccagacguugcccuccuguccuccccaggagacaagcauuggguguuugaugaggcgucccuggaaccuggcuaccccaagcacauuaaggagcugggccgagggcugccuaccgacaagauugaugcugcucucuucuggaugcccaauggaaagaccuacuucuuccguggaaacaaguaagaccucaaccccuuaaccccaggccucccucagaaaccaccaccaccccaaauucccucaguucuggagaaagacccacuuuacccccaacaugcuucccuggagaaggagcuggcugagccucugcuguugccuagaaaugggcagccuccuuugggcaccgugugagugggaugugaccgggucauuccagaccuggucauuuggcgccuccugcccccagcacugcgccuccaccccagcagccaggcacugucauuagggcuacugguggcuccuugcagccugggcccucccuuccacccccaccuuccgccgcuuucagcagcagguccucauuacucaaaaccccuguccccacccuguccacagcuauccuuugcccacugguggauucgguccgggucuugcgccuccugaggacaugcccaguguccgccacugcccuuccuuuccccuuccccagguacuaccguuucaacgaagagcucagggcaguggauagcgaguaccccaagaacaucaaagucugggaagggaucccugagucucccagagggucauucaugggcagcgaugaaggugagaggggcaagggaaggugucgcugagagaaggaugggaauagggaguugaggaagagcgggagggaagccugagggagugcuguguggaaaacaacggcgaugauaauaccacauaccaggcgcugggcuaggugcuuccacacguggugcccauucauccccaccaccuuccaaccugguacuauaagcacccccauuuuacagcugaggaagcugaugcucacgaagguggagggaagcucagcugcccucacauuaacagagcuucccucgcuccucuccucuccucucuuugggucuucccuuccuuaccaccuucugauucacucccugcagucuucacuuacuucuacaaggggaacaaauacuggaaauucaacaaccagaagcugaagguagaaccgggcuaccccaagucagcccugagggacuggaugggcugcccaucgggaggccggccggaugaggggacugaggaggagacggaggugaucaucauugagguggacgaggagggcggcggggcggugagcgcggcugccguggugcugcccgugcugcugcugcuccuggugcuggcggugggccuugcagucuucuucuucagacgccaugggacccccaggcgacugcucuacugccagcguucccugcuggacaaggucugacgcccaccgccggcccgcccacuccuaccacaaggacuuugccucugaaggccaguggcagcaggugguggugggugggcuguucccaucgucccgagcccccuccccgcagccuccuugcuucucucuguccccuggcuggccuccuucacccugaccgccucccucccuccugccccggcauugcaucuucccuagauagguccccugagggcugagugggagggcggcccuuuccagccucugccccucaggggaacccuguagcuuugugucuguccagccccaucugaauguguugggggcucugcacuugaaggcaggacccucagaccucgcugguaaaggucaaauggggucaucugcuccuuuuccauccccugacauaccuuaaccucugaacucugaccucaggaggcucugggcacuccagcccugaaagccccagguguacccaauuggcagccucucacuacucuuucuggcuaaaaggaaucuaaucuuguugaggguagagacccugagacagugugaggggguggggacugccaagccacccuaagaccuugggaggaaaacucagagagggucuucguugcucagucagucaaguuccucggagaucugccucugccucaccuaccccagggaacuuccaaggaaggagccugagccacuggggacuaagugggcagaagaaacccuuggcagcccugugccucucgaauguuagccuuggauggggcuuucacaguuagaagagcugaaaccaggggugcagcugucagguaggguggggccggugggagaggcccgggucagagcccugggggugagccugaaggccacagagaaagaaccuugcccaaacucaggcagcuggggcugaggcccaaaggcagaacagccagagggggcaggaggggaccaaaaaggaaaaugaggacgugcagcagcauuggaaggcuggggccgggcaggccaggccaagccaagcagggggccacagggugggcuguggagcucucaggaagggcccugaggaaggcacacuugcuccuguuggucccuguccuugcugcccaggcagcguggaggggaaggguagggcagccagagaaaggagcagagaaggcacacaaacgaggaaugaggggcuucacgagaggccacagggccuggcuggccacgcugucccggccugcucaccaucucagugaggggcaggagcuggggcucgcuuaggcuggguccacgcuucccuggugccagcaccccucaagccugucucaccaguggccugcccucucgcucccccacccagcccacccauugaagucuccuugggccaccaaaggugguggccaugguaccggggacuugggagagugagacccaguggagggagcaagaggagagggaugucggggggguggggcacgggguaggggaaauggggugaacggugcuggcaguucggcuagauuucugucuuguuuguuuuuuuguuuuguuuaauguauauuuuuauuauaauuauuauauaugaauuccauucaaaucguuccuuuuuguuaacaaggggcauggggaggggugggggugggggggcagaggcgucugaccccaggaaccugcagggcggggcugggucggugcccucuaaggacaauuuugaccuuguucaaccuuuccacaaagaauaaauuguguuucacauuccuuguguggcugagcucuguagagggugacgggcugugggugagaggagcuggaugaggggcgggcacacaucauaagcagcguuuuccaugagguggggcuuuggcauuuuucauaaaggaguauguuuauucuuaguggacuaaagggauucaggggccagaguuggggagcagggcauacccauagggggcagcgggguggcugacagagcucagcugcucucccaccaccuggcuuaaaaggcugccuugagacccaaggcucagagacaagaggaaguggucaagcugaugccacuuggaaaaucuuccuaaauugcauuaccguguccugugauccacccgcagacccucaguuuccucaugccucucugccugaggcagggggauucccaugaucauauucgaccuugggcucacuggcuuuauccgagcccucaggaccuaagaagccucuuccaggccuggggcucugcugcuaagacagaaggagacgagggagaaagagaaagaggugucgcugcggggccugcuaggagcagcccgucucuggccaaacagagaucucaucccaauugcccggaagaaccaggauggucagguuggaagggcagaauaacaaggcuuugcuuccucuuuccuuagaaacuccugccccagacaggguucccaggcuuccucugaaaccagccuggagggaggaaucaguucagugcugagucagcuccgcuggaggagagcagccccuuuuucucaccccccuucccuuccugccuccacccagcccacccugggcuccagcccaaacucccuccgccgccugccuugcagaguccuggccccaucuaugccagucagucuauccagcugcuauucagggcugguuagugugauugcuuuggcagaagggguacuccaccuuccugccugccaggaacccugacccuacgccuggccuccugcgccucccccugccaacagcuguuuggcagucugugugucucgguggaauuggacaccaccucaccaccacccuuaccggaggggauggggaccuugauaagguggcaggggaagucaggggcaucugagggugguagggucugugcggguggcaaggaacucaaagaugagcucauggccccuuuguguuuuugugguccacaucuggaggcaauuacagauguuauccagugggaguuuugcaaaacacagcuggagccaguggaggagccuggggaggggggacugccagagagaagaggagggggagccuagggcucccgcgcuggagugcgguuuccccaucacgaggaaauuguuuggcccugauucuggaaucacaagaugcucucuggagccaagggggagaaaugggaauggaggaccagagacaaaggggaaagagguggaagaugggcuuauaaaaccccccacugcuaaauuugacugguuuaaaaaaauaaaauaaaaauuaaaacaagcuucacaagcggagagaauuucaggguggaggcggcagggucccgugcuucugacgugccugggccugccugauccaccccagugaggcugcccggggacccugggaggugccuuagugaucacaaguucccgcugagugaaccgccaggucaggcuggggugaggggagagcagagggcucuguggcuuccgaaagaccugcaaacucggcuuucacuggcccuaccccgaucuguccauugggccugacccaguuucuaugguuccaaguuccuuuauucgaaagcagcacaugugaguuggagcagccaggagggagccaaggggaaucuucaaggagguuugggcagaacccaggaaaguuggugcuaaggagacgcuggacggggggcaagggccgaggaggagcagcacucugcccacgacugcaccccacacaucuggaggggggccacggacucccuugucaucaccuccccuucuccagggcuccuggcaccagcugggcccaugacuccagggcugccggccaggcgcugggucagcgggaagggaagggaagaucuaagaggagcuagguccucuagaggagagaggacugggcagagagacacccccacaccccuccagaccccaaaacauaaucuggcuagcucugccaguccuucacugucccucccccagggccccuucuccccacaaucugacagacuuuccaguggucucuuuccacucuguaucccuccuucccuuccagcaauggugaaacuaacauuugcugagguccuuacaacacacagugacacaggcacuaauauuguccccauuuaacaaauaagggaacugaggcccagaaagauaaauaacuuggucaaggucacagguuguuaguccaaauuuaaaacccagaucuuuccaauuuauuuauuuauuuuucuauacuggcagauccuggcaaucucuuggugucucuuccagcauggacccuggguagcugggcguuuucauggcaguguguguucuggggaucugucagcacauauguauuugcuuauuauggcuuuuguuguuguuguuguuuugagacagagucucacucuuguugcccaggcuggagugcaauggcacgaucucagcucaccgcaaccgccaccuccuggguucaagcgauucuccugacucagccucccaaguagcugggauuacaggcaugugccaccacgcccggcuaauuuuguauuuuuaguagagacaggguuucuccauguuggucaggcuugucucgaacucccaaccucaggugauccgccugccucggccucccaaaguguugggauuacaggcgugagcacccggcuguauuugcuuauugugcagcaauauuaugggggauaggagugcagagggaaaaggaccccacuuugccagcccaucgccucccuuccuggggacaggagccguacucugaaggaaggaagguggcaccaagacucagaagccaaagggauggaaugagacaauggcagcagcuaagggaagggugggauuggugaauguuucugugcaagggcauggggggg

SEQ ID NO: 17572 - RNA, 14374 nt, Homo sapiens
cccccccaugcccuugcacagaaacauucaccaaucccacccuucccuuagcugcugccauugucucauuccaucccuuuggcuucugagucuuggugccaccuuccuuccuucagaguacggcuccuguccccaggaagggaggcgaugggcuggcaaagugggguccuuuucccucugcacuccuaucccccauaauauugcugcacaauaagcaaauacagccgggugcucacgccuguaaucccaacacuuugggaggccgaggcaggcggaucaccugagguugggaguucgagacaagccugaccaacauggagaaacccugucucuacuaaaaauacaaaauuagccgggcgugguggcacaugccuguaaucccagcuacuugggaggcugagucaggagaaucgcuugaacccaggagguggcgguugcggugagcugagaucgugccauugcacuccagccugggcaacaagagugagacucugucucaaaacaacaacaacaacaaaagccauaauaagcaaauacauaugugcugacagauccccagaacacacacugccaugaaaacgcccagcuacccaggguccaugcuggaagagacaccaagagauugccaggaucugccaguauagaaaaauaaauaaauaaauuggaaagaucuggguuuuaaauuuggacuaacaaccugugaccuugaccaaguuauuuaucuuucugggccucaguucccuuauuuguuaaauggggacaauauuagugccugugucacuguguguuguaaggaccucagcaaauguuaguuucaccauugcuggaagggaaggagggauacagaguggaaagagaccacuggaaagucugucagauuguggggagaaggggcccugggggagggacagugaaggacuggcagagcuagccagauuauguuuuggggucuggaggggugugggggugucucucugcccaguccucucuccucuagaggaccuagcuccucuuagaucuucccuucccuucccgcugacccagcgccuggccggcagcccuggagucaugggcccagcuggugccaggagcccuggagaaggggaggugaugacaagggaguccguggccccccuccagauguguggggugcagucgugggcagagugcugcuccuccucggcccuugccccccguccagcgucuccuuagcaccaacuuuccuggguucugcccaaaccuccuugaagauuccccuuggcucccuccuggcugcuccaacucacaugugcugcuuucgaauaaaggaacuuggaaccauagaaacugggucaggcccaauggacagaucgggguagggccagugaaagccgaguuugcaggucuuucggaagccacagagcccucugcucuccccucaccccagccugaccuggcgguucacucagcgggaacuugugaucacuaaggcaccucccaggguccccgggcagccucacugggguggaucaggcaggcccaggcacgucagaagcacgggacccugccgccuccacccugaaauucucuccgcuugugaagcuuguuuuaauuuuuauuuuauuuuuuuaaaccagucaaauuuagcagugggggguuuuauaagcccaucuuccaccucuuuccccuuugucucugguccuccauucccauuucucccccuuggcuccagagagcaucuugugauuccagaaucagggccaaacaauuuccucgugauggggaaaccgcacuccagcgcgggagcccuaggcucccccuccucuucucucuggcaguccccccuccccaggcuccuccacuggcuccagcuguguuuugcaaaacucccacuggauaacaucuguaauugccuccagauguggaccacaaaaacacaaaggggccaugagcucaucuuugaguuccuugccacccgcacagacccuaccacccucagaugccccugacuuccccugccaccuuaucaagguccccauccccuccgguaagggugguggugaggugguguccaauuccaccgagacacacagacugccaaacagcuguuggcagggggaggcgcaggaggccaggcguagggucaggguuccuggcaggcaggaagguggaguaccccuucugccaaagcaaucacacuaaccagcccugaauagcagcuggauagacugacuggcauagauggggccaggacucugcaaggcaggcggcggagggaguuugggcuggagcccagggugggcuggguggaggcaggaagggaaggggggugagaaaaaggggcugcucuccuccagcggagcugacucagcacugaacugauuccucccuccaggcugguuucagaggaagccugggaacccugucuggggcaggaguuucuaaggaaagaggaagcaaagccuuguuauucugcccuuccaaccugaccauccugguucuuccgggcaauugggaugagaucucuguuuggccagagacgggcugcuccuagcaggccccgcagcgacaccucuuucucuuucucccucgucuccuucugucuuagcagcagagccccaggccuggaagaggcuucuuagguccugagggcucggauaaagccagugagcccaaggucgaauaugaucaugggaaucccccugccucaggcagagaggcaugaggaaacugagggucugcggguggaucacaggacacgguaaugcaauuuaggaagauuuuccaaguggcaucagcuugaccacuuccucuugucucugagccuugggucucaaggcagccuuuuaagccagguggugggagagcagcugagcucugucagccaccccgcugcccccuauggguaugcccugcuccccaacucuggccccugaaucccuuuaguccacuaagaauaaacauacuccuuuaugaaaaaugccaaagccccaccucauggaaaacgcugcuuaugaugugugcccgccccucauccagcuccucucacccacagcccgucacccucuacagagcucagccacacaaggaaugugaaacacaauuuauucuuuguggaaagguugaacaaggucaaaauuguccuuagagggcaccgacccagccccgcccugcagguuccuggggucagacgccucugcccccccacccccaccccuccccaugccccuuguuaacaaaaaggaacgauuugaauggaauucauauauaauaauuauaauaaaaauauacauuaaacaaaacaaaaaaacaaacaagacagaaaucuagccgaacugccagcaccguucaccccauuuccccuaccccgugccccacccccccgacaucccucuccucuugcucccuccacugggucucacucucccaaguccccgguaccauggccaccaccuuugguggcccaaggagacuucaaugggugggcugggugggggagcgagagggcaggccacuggugagacaggcuugaggggugcuggcaccagggaagcguggacccagccuaagcgagccccagcuccugccccucacugagauggugagcaggccgggacagcguggccagccaggcccuguggccucucgugaagccccucauuccucguuugugugccuucucugcuccuuucucuggcugcccuacccuuccccuccacgcugccugggcagcaaggacagggaccaacaggagcaagugugccuuccucagggcccuuccugagagcuccacagcccacccuguggcccccugcuuggcuuggccuggccugcccggccccagccuuccaaugcugcugcacguccucauuuuccuuuuugguccccuccugcccccucuggcuguucugccuuugggccucagccccagcugccugaguuugggcaagguucuuucucuguggccuucaggcucacccccagggcucugacccgggccucucccaccggccccacccuaccugacagcugcaccccugguuucagcucuucuaacugugaaagccccauccaaggcuaacauucgagaggcacagggcugccaaggguuucuucugcccacuuaguccccaguggcucaggcuccuuccuuggaaguucccugggguaggugaggcagaggcagaucuccgaggaacuugacugacugagcaacgaagacccucucugaguuuuccucccaaggucuuaggguggcuuggcaguccccacccccucacacugucucagggucucuacccucaacaagauuagauuccuuuuagccagaaagaguagugagaggcugccaauuggguacaccuggggcuuucagggcuggagugcccagagccuccugaggucagaguucagagguuaagguaugucaggggauggaaaaggagcagaugaccccauuugaccuuuaccagcgaggucugaggguccugccuucaagugcagagcccccaacacauucagauggggcuggacagacacaaagcuacaggguuccccugaggggcagaggcuggaaagggccgcccucccacucagcccucaggggaccuaucuagggaagaugcaaugccggggcaggagggagggaggcggucagggugaaggaggccagccaggggacagagagaagcaaggaggcugcggggagggggcucgggacgaugggaacagcccacccaccaccaccugcugccacuggccuucagaggcaaaguccuugugguaggagugggcgggccggcggugggcgucagaccuuguccagcagggaacgcuggcaguagagcagucgccugggggucccauggcgucugaagaagaagacugcaaggcccaccgccagcaccaggagcagcagcagcacgggcagcaccacggcagccgcgcucaccgccccgccgcccuccucguccaccucaaugaugaucaccuccgucuccuccucaguccccucauccggccggccucccgaugggcagcccauccagucccucagggcugacuugggguagcccgguucuaccuucagcuucugguuguugaauuuccaguauuuguuccccuuguagaaguaagugaagacugcagggagugaaucagaaggugguaaggaagggaagacccaaagagaggagaggagaggagcgagggaagcucuguuaaugugagggcagcugagcuucccuccaccuucgugagcaucagcuuccucagcuguaaaaugggggugcuuauaguaccagguuggaaggugguggggaugaaugggcaccacguguggaagcaccuagcccagcgccugguaugugguauuaucaucgccguuguuuuccacacagcacucccucaggcuucccucccgcucuuccucaacucccuauucccauccuucucucagcgacaccuucccuugccccucucaccuucaucgcugcccaugaaugacccucugggagacucagggaucccuucccagacuuugauguucuugggguacucgcuauccacugcccugagcucuucguugaaacgguaguaccuggggaaggggaaaggaagggcaguggcggacacugggcauguccucaggaggcgcaagacccggaccgaauccaccagugggcaaaggauagcuguggacaggguggggacagggguuuugaguaaugaggaccugcugcugaaagcggcggaagguggggguggaagggagggcccaggcugcaaggagccaccaguagcccuaaugacagugccuggcugcugggguggaggcgcagugcugggggcaggaggcgccaaaugaccaggucuggaaugacccggucacaucccacucacacggugcccaaaggaggcugcccauuucuaggcaacagcagaggcucagccagcuccuucuccagggaagcauguuggggguaaagugggucuuucuccagaacugagggaauuuggggugguggugguuucugagggaggccugggguuaagggguugaggucuuacuuguuuccacggaagaaguaggucuuuccauugggcauccagaagagagcagcaucaaucuugucgguaggcagcccucggcccagcuccuuaaugugcuugggguagccagguuccagggacgccucaucaaacacccaaugcuugucuccuggggaggacaggagggcaacgucuggguucaacuuaggcucuagggacuuuagaggaaaucagcuccucuagggagacccgccucacucccaaagacuaaaguggagugccugguuaccuuugaagaagacgaauuugccauccuuccucucguaggcaguguugauggacgcaggcaggccccgccagaacuggccaaugggcauuggguauccauccaucacuugguuauuccucacccgccagaaccagcgcuccuggaagccggucaaugcaggaaaaguccauuaugucuugcggccuaggucucugguucaguccccaaagcucccgcacugcuguuuguuccucaguuuuaguuuuuaguccagcuguugucacuuccacccagccgcccuaccacagaguacccccccgccuuuuuuuuuuuugagauggagucucacacuguuguccaggcuggagugcaauggcccuaucucggcucacugcaaccuccaccucccagguucacgugauucuccugccucagccucccagguagcugggaucauaggcgcccaccaccacacuuggcuaauuuuuuguauuuuuaguagagacgggguuucacuauguuggccagccugcucucgaacuccagaccucaggugauccaccugccuuggccucucaaagugcuaggauuacaggcaugagccaccaugcccagcccauagggcccuuuugucuuucaaaccagcccacuucuucucaccuugaagacaaacaucuccccucggagcauggccacggugucaaaguucccgucacagauguugggcccauaggugggguuuuuggguuuaucaggaacagaaggccgggagguaguccuggguugagggggcaucuugguggggaacccugacucacccccuggggcagaaaacacgaggggcauuucagacuuaggaggaggcggggacggaaggacagacagaugggcagacaauacccuuggaaagguguggaugggcuucuaggggaggcugaagcaaccaacugggaggcgacacaaaagaugggcucaaaaguggagcugauagaggcaggggcagguuggcagggggcggugcggagacugcaaggcauaaaagaggggaaaugcguagaccaggagggaacaagcagcagaggagggagcaggcguggguguagacuacucgccauaaaguugcuggaugccccggcggucaucaucgggcagcacaaaauucuccguguccauccacugguaaaagggugccaugauggccgaggggucacuggaaugcucgagccccagggcauggcccagcucgugcacagccaccaggaagaugucauuuccuggaaggauggggacagugacgauagcagccugagucccuucccucagccucccugcuuccccaccagcagcuuugguuucaccuccaagccugcugcccauguuuucaauccaaaguggccaaauucugaggucuagcuuuuuaucugguauuuaagcacaaagccagucagcaagcuccucuggguggaggugagagagugcuuggaagcaggaccccgaucccgggaagaccugugguaagggaagccaaggcucucucuaguccccaguuucucccgggagcgagacaugacaucggucuggaaaagugggcaauaaggaugcuuugaagucuuugacuggaaagccagucagugggugagaggggggaccagauguaaauagcucaaacaggacuccugcuuuugucagaaguuagaucagaaggucucuguggucccuucuagcccggagauuuuggaaggagggaggggaaccaccccuacaaaugacuguuggcuuuuuccagaguaagucccagggauacuuggcucaccauucagauccucauuccugacaguccaaggcucggcagagucaaagugggugucuccuccaauguuggggccugggaaguaggcaugggccaggaagccgcccucaccaucgaagggcgugcugucgccauggaagcccucggcaaagaagaucaugaugucggccugcuucucauggcccucacggauguaggcauagggcaccucgcggaagcgcagugguguggcacucucccacacgcggaacgccuugcgaauggccucguauguggcauacucgcccaccuuggggguguaauucuggaugcugagguccagccacguggggagaggaugggguguguuaggauaaagaggggcaacauucuccuucccugcacucucccaggucugacugcgcggcccagccaccucugccugacccagcucuuccugcuaccucaugcgcaacgccucugucucaagaacaagggauccucaggcucuggcucucuggcacuggggugcacccuugauggcuacaccucucucaaggaugagagccauuuuccuccccacucccacggaugcuucccaggaacugaggggaguggggcagggggucucugagucccugcauaagcacaauggguaggaaauaauaaccagaugugagaaagguugcuugccuguuggacucaccagaaagugauuucauuauguugccauuugagacccuggauggcguagcgcuuccuucgaacauuggccuugaucucagccccaaacuugucuggaacaccacaucgggggcgccucauggcccuggaguggguuugggugcgaggauugggaucagugcaguguaugaaagagaaaggucuccacgaucaguguuggguaagacuugcugugugucaauguggggaaaggccaagguuaugaggucagggugaauaugagagggucaggaucagcacguggggaugagauaugggggaguggggugcacaagccaggcauucagguaggaacaucucuggcgcuggcauugucaguggaugcuaggcagaacuccugccagggucuagcacuuacuucauggugucugcaucagcuuugccuguuacuugcaagccguaaaacuucugcauggcagcgauggccgcugagagugacuggggugagcgcuguguguggguacguagguccccgggaggcagguagccauauugcuguagccaggccuguagggaaagggguauggcuuagaguguccccaccuggcccauagggugccucuaccuccccgacaaugcccagcauacagccuuggcuuggcaaggaaagggcaguggguucccagcuuggcuccggcagcaggucuggaggaacucccaggcuagaccugaucucuggcccaggccccucggggcuauagcuuguccccucggggcuaugggcccaaacaggcuuuuggcuguagcucucuugaaaaugagagagagcccuggugguuuaaugggguucugagaugucuucucagagcugugauuccuucuagcacuuuucucccccaugucaguguucuuacaaauauagcauguuccaccugggacugggcuaugcccaugauguguggggagggguguugacaggcugagugagcucuacuauugggcuugaccugaggcccuccugggaugggagugccauguccccaggacccucacagcugagaucuuuuuagaaaggagggcagaaaaaagagcuagagcuaaggcuggcugcuacgaggggaaacuaggaacuuggaaugugguaagaggugugauccagcugaagccaggauccugccgcuguccuuauccaagcagcaucugaccuauggcuuggaaccuaaaggccuauuuaagauucucagcaguggccgggcgcgguggcucacaccuguaaucccagcacuuugggaggccgaggcaggcugaucacgaggucaggagaucgagaccauccuggcuaacacggugaaacccugucucuacuaaaaauacaaaaaauauuagccgggcacgguggcgggcgcuuguagucccagcuacucaggaggcugaggcagaagaauggugugaacgcaggaggcggagcuugcagcgagcugagauugcgccacugcacuccagccugggagacaaagcaagacuccgucucaaaaaaaaaaaaaagauucucaacagaggaagugggacauagggguggaggaggagacuuggugacuguauuuuauuucagguauguugugaauuggucauaauauaaaggcuggcauauugccuuaaauuaaauuaauguuagguuuuugguguuugauuaaaagguacacacacugcaaagcccuguugaggagaaagucagccuuuauuguaagaacaauggaguauuuucuuaaagccucaaaguaaaacaagccaggcugggcgugguggcugacgccuguaaucccgacaguuugggaggccaaggcgggcagaucaccugaggucaggaguucgagaccagccuagccaacagggugaaacccugucucuacuaaaaauacaaaaauuagcugcacgugguggugggcaccuguaaucccagcuacucaggaagcugugguaggagaauugcugaaccugggaggccaagguugcaguuagccaagaucccgccacugcacucagccugggugacagagcgagacucugucucaaaaaaaaaaaaaaaaaaaaaaaaguaaaacaagccaaguuauauaugaaauaugaagaugcuuggauucuuuuauggggagaagacaccacccagauagcucuagucccugcuccagcuuugcuuucuuagggaguucaggaagcggcuguagguugcccaggaugggaucuuggaggggagaugggggaggcugcuguugggugcuguaucuccuagccaaggucaucaggauuggauugccacaugguccuucaccucugggcucagguccuggugauggggcaguagucuugcauggggacugggggugacucaagagcagcugacuggggaccugagcccacaggggcaagaauugcaacaugguucugggaagugauccccccccaaggcugaugcgagcuagaacccgagauguaaacaacccagccuuuucccagccaacagucuuggcuagaacaacccuagcaccaccuagcucugaggcucugagagccccuccucagggguagaggaaggagugacauuuaaccuuugguauaccagagggagccaagcaguccacaccaguccggggcugcucucagggagcugcaggcuugcccugaccuguucuggcugaugccacagccagugccuggggaggccugcuguggccugugccuaacuaugcaggaaaugucuuuugccccuagcauaccugcaggauaaacacaccccgggcuuaugacccuugguugaggagcagcugcuucaggacuuggggaaggaugggacuggucuacugacgcuggaaggcaggaggacugaggccaggccccgucaacccucagagagcaaagcugagagaauuugccuagagcagaacgacagaaggaagauggggagaagacagaacgacagaaggaagacgggacagaagagauggggagaauccacauccaggagcucugggggaaauccccucuggagucguucaagaagcuaggggggucuaaauauucacaccuacaaccuccaccccauacccucgggagaaaaaugaaggcucagucaaaugaaggacuucccuggagucaagagagccgcaaggccuggaaaggaagugcccccaucccucuccuccccccaggccuaggcaaguuucucuccucacagagacuaugaggucgaaaccacagaagagaggacucuugugucugcggcugggugggaggaagggcccagcgccagacaggccauggggaggagagggcuguccuggagcuggugcaggacucuggaggccugguaggagggacccagcugcaugaggccugcaccaccccagcuuucccuccacauuggccuggagaaaaaagcaacuauguugggucaaagaacccagucggcuggcuuugucuuugcgaaugagagagaugcaagguauccccuaggagaaagucaacggaacaccucccaccuuggcuuagggguccaggggaggguggggggaccuccagcucugcaguaggcccuggauccuagccucuggggcugcuccucccucccuuccugggcccagaagcaaauggugguucuggcacugggaccgcccaugacccaauuaaaacggagccagggcagccgccccuccccugggggacccagcaaagcaggggagggaaaaaagguaaggcagugaaguuggcggucggcagcuccccagaugcucaggcucguuuuguuaggggcgcucccuuucaggucucagaggacucuaggccugggaagaggacgacuccucccggacagucaggcucagccuccagcaccagggcagguuuuuacucucccuggucucugagcacuccacguuucgucuuccaccccgauuccuggggccauacuuuuccagucggccccagacccuuucagggacgcagagagaagacaguauucuuuccaaagaguuuucuccggggugggaccaaggaggagaagccaaacccauaucccaucccccuucuagggcccuuccuggccccucccaaccgcacccaggcccuugccaggcugaguggguugagauggcccaaaauaagaagcucauuaaauccgucucccaccuucaccccaaaauaagagagagagaggaaaaaccuccucagacaacucccacgcagcuuccucuggggcccggugggccaccgucugggccggggugaggguggggggcgcccgagccagccccgacgugagggcaccccggaccagacccucuccccauuccccaagcgacgcccccaggcucccugcaauuaacacagaaaaacuauuaacaacaaaaagggccugaaggcgccgacgcggguggggauagggggaggcagcgacccggccgaucgcccggcucacaaggagagcuuuguguguacggaaacgcggccagcgcgccggcgcugcgacccucgacgccagggaugcggguagggacacagcgggguccucucggggagacgggggcuguggcccuggacgcucggccguccacccucgacccccaccuggccgcagacucguccgcugaaggccugggccacccggggaggccgaagcgcccaucggagggcgcgccggcgggagagcgcuggagagcugggaagucgaagaaacaacaaacucucgcgcaugacgaggagccgggacagcgcgggguuugagcggaguccaaauguuuaucaggcgguuccagagcugagagcagagcccaagggaaucggggaagggggaguucgccccaguuguaaaguucuuccaaggacugggaaaaaagaaggaaugggaaggagagucggcggcgcagggggugggggcagcugguuggaagcgggcaaaaguuggaucgaucuggaaguuuggagacgaagaggaaaaagaaagggagggggaauccugcaggccugagcagcggagaucccaaaagcccuccucuccgaauagaggcuguccccuaggagacccccgggcucgccucccggcgggcgcgacuccgggaagggccgggaagcucacuuacuucggggcugaagcugcugcuuugggccgagccgagggaggcgagcgcggugccgagcgugagcagggggagcaggagacaacgggggggucuuggggcgggagacaugguccgagaccaccgggucagccgggcagugugggcuccgcggccgggcccacgcccuggggucgcaccgccacucccucggggcgccuuugucuucgguaggcacugaacuugaauuccuagaccgcugucggcuuggaguuaaaggggauuguuccucaaagugccuguuugcucuucuccucuuuuccgguuuuugaucuuucuucugcuuagucggcgaacuggggucugguucccucucucgcucucuccucuggucccucccuucucccacagccucuccuccguccccgccccagugcccuccuuuccugguuggggacgugguuguuuuagccugaauccaauuacaaccaagaa

SEQ ID NO: 17573 - RNA, 8125 nt, Homo sapiens
ugauuggcaggggugggaccgggcuugucacccgccccggcuacuccaaccccugggcgggcggggguaccgccugggcaagggccggggcgccgggccgagccaccucuuccccucccccgcuucccugucgcgcuccgcuggcuggacgcgcuggaggaguggagcagcacccggccggcccugggggcugacagucggcaaaguuuggcccgaagaggaaguggucucaaaccccggcagguggcgaccaggccagaccaggggcgcucgcugccugcgggcgggcuguaggcgagggcgcgccccagugccgagacccggggcuucaggagccggccccgggagagaagagugcggcggcggacggagaaaacaacuccaaaguuggcgaaaggcaccgccccuacucccgggcugccgccgccuccccgcccccagcccuggcauccagaguacgggucgagcccgggccauggagccccccuggggaggcggcaccagggagccugggcgcccggggcuccgccgcgaccccaucggguagaccacagaagcuccgggacccuuccggcaccucuggacagcccaggaugcuguuggccacccuccuccuccuccuccuugguaagaaccgaaacgauaccaacccccagccuucugucaccgggccagcagcucuaacucccuccagugcggccccgcacucuauccugccugcccauuccccccagccccugccgccagccccagcacugccggccccaacccccaggaagucuucagcugcuccgcugggcccugguccucucuccggcuuccccuagaucaccccaccaaccccacaaggcccugcugccggaccuuccuuccauggaagucccacgccgcagcccucucccgccccccacucccucuuccgauuaacugcccggaagucccggauggcucccuugaguugcucaggugaagaagaaaacuccuaaggagugucucacgcuccugcccuuucucguuccuccucuaggaggcgcucuggcccauccagaccggauuauuuuuccaaaucauggugaguugagggaaccucuggggcuccgugggcuugggaaugagggagcagucgagaaggacucucuguucccugaauuccaugggaccuaccaaaguuuuagaggggagauaauuuagccuuuauuuauagauaaggaagcugaggcucgguguggaccuucaucugguaguugcuauguacuauuuuauuuuuucugggaauaucuaugcuugaucguccuaaccaggauguagucucccugaggguagaggcaguauuuccugcuccuccugguucaguggcuggcacaaagcagacgucagaauuguucgugauauuaguauuuacuggugaagcuaugaagaauguggagagaaagagcgaagcuagaaggcuguaacucuaggcugugugugggcaggggcagauacucugcuccuccuugcagagcccagacuuuuggaaaccucaagccuccaagcggaaggggaagggugggaugcaaaggggcugucuacuacccguguccuaccuuccucucuccagcuugugaggaccccccagcagugcucuuagaagugcagggcaccuuacagaggccccugguccgggacagccgcaccuccccugccaacugcaccuggcucauccugggcagcaaggaacagacugucaccaucaggugagaagcagaacaagagcaagaacccauucuucuccccugccccuuccccuccauuggaagucuucagggaucacuucuuuuuuuuuuuuuuugagacggaguuucacucuugucacccgggcuggagugcaauggcgcgaucucagcucacugcaaccaccaccucccggguucaagugauucuccugucuuggccucccgaguagcugggauugcaggugcccgccaccaugcccagcuaacuuuuuuguauuuuuaguagagacaggguuucaccacguuggccaggcuggucuugaacuccucaccucaagugauccacccgccugggccucccaaagugcugggauuaaaggcaugagccacugggccuggcccauucagggaucacuucucuauggaauuuccauccuugucaacagguaaagaguagaauuugauuuggccuagugugcccuaaaagucugacuuuuucugggucagacucagugaauugagguggagcugggcuggaguggacaucuagcuugaguccugcgcaucuccaaaggacagaggccccucugcaaacgguccucagcucagauagaacuguucugaagaguccuuccauucauugcauguccugccugagauucagaacuacuccuuaaucagcuuagaacaucccucagccucucuggaucuuuuaaacauuccaagucaccccaggcuccccugaccuuggucauuguuuggggaucauauuaaguaccuggcuguuugccucacauaguucauuuuccaugaauuuacccagaaagggguaggcaaagagagagggcaaucuguggagaggcugguggggcaaagggaucagaaugccauggagaaccaauccaggucucacaucuggcacaguggggugggauaagauggugaguucugguuaauugaacuguaugguaaucaccaguuacugcugguaccauacuugggugacagugcuacaacaacuggaaugcagugcaccucuucuuaacucagucccagaacacaagucaauuuuuccaaagggcucuaggauauauuuuauggucucauggcgauaccaugagguauuccuaccauguuaggaagauccccauugacuacauugacuuaaaaauaauuuggcugccgggcaugguggcucacgccaguaaucccagcacuuugggagaccaaggcggguggaucaccugaggccaggaguucgagaccagccugaccaacauggugaaaccccaucucuauuaaaaauacaaaauuagccaggugugguggcgggcaccuguaauccuagcuacuugggaggcugaggcaggagacucacuugaacccaagagguggagguugcagugauccaagaucacaccauugcacuccagccugggugacaagagugaaacucugucucuaaauaaauaaauaaauaggcuaacugaguuuucauuuggccauuuagaucauggauaagcagauguuuaugcuuccugggacacaaggggccugguggcaccaggggaggagaaagccagcagcagucaagaguaucucauguccugcucuccucuacucccauagguuccagaagcuacaccuggccuguggcucagagcgcuuaacccuacgcuccccucuccagccacugaucucccugugugaggcaccucccagcccucugcagcugcccgggggcaacgucaccaucacuuacagcuaugcuggggccagagcacccaugggccagggcuuccugcucuccuacagccaagguaggcuggacagggaugucugaggagcaggcagugaaagccccaggcagaaggggaggauccugaggguucuggugcuucacagccccucuccauggugccucugcagauuggcugaugugccugcaggaagaguuucagugccugaaccaccgcuguguaucugcuguccagcgcugugaugggguugaugccuguggcgauggcucugaugaagcagguugcagcucagaccccuucccuggccugaccccaagacccguccccucccugccuugcaaugucaccuuggaggacuucuauggggucuucuccucuccuggauauacacaccuagccucagucucccacccccaguccugccauuggcugcuggacccccaugauggccggcggcuggccgugcgcuucacagcccuggacuugggcuuuggagaugcagugcauguguaugacggcccugggcccccugagagcucccgacuacugcguagucucacccacuucagcaauggcaaggcugucacuguggagacacugucuggccaggcuguuguguccuaccacacaguugcuuggagcaauggucguggcuucaaugccaccuaccaugugcggggcuauugcuugccuugggacagacccuguggcuuaggcucuggccugggagcuggcgaaggccuaggugagcgcugcuacagugaggcacagcgcugugacggcucaugggacugugcugacggcacagaugaggaggacugcccaggcugcccaccuggacacuuccccuguggggcugcuggcaccucuggugccacagccugcuaccugccugcugaccgcugcaacuaccagacuuucugugcugauggagcagaugagagacgcugucggcauugccagccuggcaauuuccgaugccgggacgagaagugcguguaugagacgugggugugcgaugggcagccagacugugcggacggcagugaugagugggacugcuccuauguucugccccgcaaggucauuacagcugcagucauuggcagccuagugugcggccugcuccuggucaucgcccugggcugcaccugcaagcucuaugccauucgcacccaggaguacaggucagugggaguggggcuggcaguagaagaguagacccugagggugaggcugggcugugcagcuacaggagaccacgaaagugcccaccuuggggagaggcucccaugaucagcuugucaguuguguccuguaagggacagguccagauccugaaagcaguuucaagggaggagggaccucagaugaccuuugggaaagccauggcacagcuccagcuggccuggcccggguguggaagugggaggacuguccaggcugagguggucuacucuggccgagaacuaccagugacugagcaguccucauuccuucuagcaucuuugccccccucucccggauggaggcugagauugugcagcagcaggcacccccuuccuacgggcagcucauugcccagggugccaucccaccuguagaagacuuuccuacagagaauccuaaugauguaagucacuccccacaacccuagcaccuccuggucccaguucugcuguggccccgccccuguacccuccuucauucagccuuuggcccucugacucugaggccuccucauuuccuugcagaacucagugcugggcaaccugcguucucugcuacagaucuuacgccaggauaugacuccaggagguggcccaggugcccgccgucgucagcggggccgcuugaugcgacgccugguacgccgucuccgccgcuggggcuugcucccucgaaccaacaccccggcucgggccucugaggccagaucccaggucacaccuucugcugcuccccuugaggcccuagaugguggcacagguccagcccgugagggcggggcagugggugggcaagauggggagcaggcacccccacugcccaucaaggcuccccucccaucugcuagcacgucuccagcccccacuacugucccugaagccccagggccacugcccucacugccccuagagccaucacuauugucuggaguggugcaggcccugcgaggccgccuguugcccagccuggggcccccaggaccaacccggagccccccuggaccccacacagcaguccuggcccuggaagaugaggacgaugugcuacuggugccacuggcugagccggggguguggguagcugaggcagaggaugagccacugcuuaccugaggggaccugggggcucuacugaggccucuccccugggggcucuacucauaguggcacaaccuuuuagaggugggucagccuccccuccaccacuuccuucccugucccuggauuucagggacuuggugggccucccguugacccuauguagcugcuauaaaguuaagugucccucaggcagggagagggcucacagagucuccucuguacguggccauggccagacaccccagucccuucaccaccaccugcuccccacgccaccaccauuuggguggcuguuuuuaaaaaguaaaguucuuagaggaucauaggucuggacacuccauccuugccaaaccucuacccaaaaguggccuuaagcaccggaaugccaauuaacuagagacccuccagcccccaaggggaggauuugggcagaaccugagguuuugccauccacaaucccuccuacagggccuggcucacaaaaagagugcaacaaaugcuucuauuccauagcuacggcauugcucaguaaguugaggucaaaaauaaaggaaucauacaucucaaaauuuugcaaauuagcugcgagccugagccccgccucugcccaucucagucuaugcucaccucaucccacuccucccuguggagcccuuugcuuggcccucuaccuccugcccucuuccuguucaucucccaaccacugcacucuugauuuuuauaccacacagaagguaagaaaauucuaggaacccuaaggaucaauccucuccauuuucacucaaaugccuggggcccagcucugcaaugacugacuccagggccucuuuccucacugccagcauagaagucaggggagccagcugggcccugcggucaggaagguucucauuuuuggagcauacccugagcccagaucauaggagcagcugucccuggugggacacaggagucaugacuccuacccuccacccuccacacccaccaggcauuuagcagucuguccuaugcaagacagaugaauucucagccaggauaccucaaggcaggcaaaggugaguggagggagaauucacaaacauucaggguguguggugcuggcaucaccauggccaaauccaagaggucuuccuggaagagggcccaaacuggaaccaaaagaaugcugucagcaguuggaauagagcugugaauucuagacagggggaguguccccagaacaagcaaacggaggagacaagagggcaaggguuauaggaaagacccugggccugagagcacaagcagcggccagagcugcagcgcuggggugggugauggagggaaugauucgcaagcaguguuggaacccagccccuagugagcaaagugacagaagcugccccagaguuuggaaggaagaucgaggcagaagauguagaaggaagcugugggggugggagugaugccucaggaacaaaacugaggaauucccuaacggacccagucccuggggaaagaggcuccccucaggcucuccuugucuagccccacaccuggcagagccugucacccagccuagccccacgccuggcagagcccaucacccagccuagccccacaccugguggagaggcccuguugauuacacccugucagccuccucaaacccagcacuaauugcacaauuuuccucucuucuagugagcaagagccugaggaaguagcagagaggggugugggcccaugugcaguucugggacccuggcaccuuggcucagggaagacccgagcuccuuucacugcagacccucuccagagacuggggagagggcucuggagaaccugguucuugcuuacuguucucccuuugggcccuccuucccaaacgcaaacaauccaggauccacucagcgucaggcccaauggaaauagugaagcagugauuuucccuccccugccucuccauagccuggucuuuugcccucuccuuugcucuucucuucccccauagccaccucaaauaccugcagccugauaucuucaucccuucauccagaccuuuucucuccuagugguauugcaaacugaaaguggacaaagacuuaagguaaaccugcuccucaugguggaaugcuuccaaaugcuggaaggaggacuuuagggcagaguucacuaaggaggcuugugcuuauagaucagugggccugaaagaaguuucucuagguucugguugugugcuguacgagguguagguaguaauaauacucuugucagccacagugaagccccaagcuagccgggauaggggacugaccuuguacaggcagcauggagaaac

SEQ ID NO: 17574 - RNA, 8125 nt, Homo sapiens
guuucuccaugcugccuguacaaggucaguccccuaucccggcuagcuuggggcuucacuguggcugacaagaguauuauuacuaccuacaccucguacagcacacaaccagaaccuagagaaacuucuuucaggcccacugaucuauaagcacaagccuccuuagugaacucugcccuaaaguccuccuuccagcauuuggaagcauuccaccaugaggagcagguuuaccuuaagucuuuguccacuuucaguuugcaauaccacuaggagagaaaaggucuggaugaagggaugaagauaucaggcugcagguauuugagguggcuaugggggaagagaagagcaaaggagagggcaaaagaccaggcuauggagaggcaggggagggaaaaucacugcuucacuauuuccauugggccugacgcugaguggauccuggauuguuugcguuugggaaggagggcccaaagggagaacaguaagcaagaaccagguucuccagagcccucuccccagucucuggagagggucugcagugaaaggagcucgggucuucccugagccaaggugccagggucccagaacugcacaugggcccacaccccucucugcuacuuccucaggcucuugcucacuagaagagaggaaaauugugcaauuagugcuggguuugaggaggcugacaggguguaaucaacagggccucuccaccagguguggggcuaggcugggugaugggcucugccaggcguggggcuaggcugggugacaggcucugccagguguggggcuagacaaggagagccugaggggagccucuuuccccagggacuggguccguuagggaauuccucaguuuuguuccugaggcaucacucccacccccacagcuuccuucuacaucuucugccucgaucuuccuuccaaacucuggggcagcuucugucacuuugcucacuaggggcuggguuccaacacugcuugcgaaucauucccuccaucacccaccccagcgcugcagcucuggccgcugcuugugcucucaggcccagggucuuuccuauaacccuugcccucuugucuccuccguuugcuuguucuggggacacucccccugucuagaauucacagcucuauuccaacugcugacagcauucuuuugguuccaguuugggcccucuuccaggaagaccucuuggauuuggccauggugaugccagcaccacacacccugaauguuugugaauucucccuccacucaccuuugccugccuugagguauccuggcugagaauucaucugucuugcauaggacagacugcuaaaugccugguggguguggaggguggaggguaggagucaugacuccugugucccaccagggacagcugcuccuaugaucugggcucaggguaugcuccaaaaaugagaaccuuccugaccgcagggcccagcuggcuccccugacuucuaugcuggcagugaggaaagaggcccuggagucagucauugcagagcugggccccaggcauuugagugaaaauggagaggauugauccuuaggguuccuagaauuuucuuaccuucugugugguauaaaaaucaagagugcagugguugggagaugaacaggaagagggcaggagguagagggccaagcaaagggcuccacagggaggagugggaugaggugagcauagacugagaugggcagaggcggggcucaggcucgcagcuaauuugcaaaauuuugagauguaugauuccuuuauuuuugaccucaacuuacugagcaaugccguagcuauggaauagaagcauuuguugcacucuuuuugugagccaggcccuguaggagggauuguggauggcaaaaccucagguucugcccaaauccuccccuugggggcuggagggucucuaguuaauuggcauuccggugcuuaaggccacuuuuggguagagguuuggcaaggauggaguguccagaccuaugauccucuaagaacuuuacuuuuuaaaaacagccacccaaauggugguggcguggggagcaggugguggugaagggacuggggugucuggccauggccacguacagaggagacucugugagcccucucccugccugagggacacuuaacuuuauagcagcuacauagggucaacgggaggcccaccaagucccugaaauccagggacagggaaggaagugguggaggggaggcugacccaccucuaaaagguugugccacuaugaguagagcccccaggggagaggccucaguagagcccccagguccccucagguaagcaguggcucauccucugccucagcuacccacacccccggcucagccaguggcaccaguagcacaucguccucaucuuccagggccaggacugcugugugggguccaggggggcuccggguugguccugggggccccaggcugggcaacaggcggccucgcagggccugcaccacuccagacaauagugauggcucuaggggcagugagggcaguggcccuggggcuucagggacaguagugggggcuggagacgugcuagcagaugggaggggagccuugaugggcagugggggugccugcuccccaucuugcccacccacugccccgcccucacgggcuggaccugugccaccaucuagggccucaaggggagcagcagaaggugugaccugggaucuggccucagaggcccgagccgggguguugguucgagggagcaagccccagcggcggagacggcguaccaggcgucgcaucaagcggccccgcugacgacggcgggcaccugggccaccuccuggagucauauccuggcguaagaucuguagcagagaacgcagguugcccagcacugaguucugcaaggaaaugaggaggccucagagucagagggccaaaggcugaaugaaggaggguacaggggcggggccacagcagaacugggaccaggaggugcuaggguuguggggagugacuuacaucauuaggauucucuguaggaaagucuucuacaggugggauggcacccugggcaaugagcugcccguaggaagggggugccugcugcugcacaaucucagccuccauccgggagaggggggcaaagaugcuagaaggaaugaggacugcucagucacugguaguucucggccagaguagaccaccucagccuggacaguccucccacuuccacacccgggccaggccagcuggagcugugccauggcuuucccaaaggucaucugaggucccuccucccuugaaacugcuuucaggaucuggaccugucccuuacaggacacaacugacaagcugaucaugggagccucuccccaaggugggcacuuucguggucuccuguagcugcacagcccagccucacccucagggucuacucuucuacugccagccccacucccacugaccuguacuccugggugcgaauggcauagagcuugcaggugcagcccagggcgaugaccaggagcaggccgcacacuaggcugccaaugacugcagcuguaaugaccuugcggggcagaacauaggagcagucccacucaucacugccguccgcacagucuggcugcccaucgcacacccacgucucauacacgcacuucucgucccggcaucggaaauugccaggcuggcaaugccgacagcgucucucaucugcuccaucagcacagaaagucugguaguugcagcggucagcaggcagguagcaggcuguggcaccagaggugccagcagccccacaggggaaguguccaggugggcagccugggcaguccuccucaucugugccgucagcacagucccaugagccgucacagcgcugugccucacuguagcagcgcucaccuaggccuucgccagcucccaggccagagccuaagccacagggucugucccaaggcaagcaauagccccgcacaugguagguggcauugaagccacgaccauugcuccaagcaacugugugguaggacacaacagccuggccagacagugucuccacagugacagccuugccauugcugaagugggugagacuacgcaguagucgggagcucucagggggcccagggccgucauacacaugcacugcaucuccaaagcccaaguccagggcugugaagcgcacggccagccgccggccaucauggggguccagcagccaauggcaggacugggggugggagacugaggcuagguguguauauccaggagaggagaagaccccauagaaguccuccaaggugacauugcaaggcagggaggggacgggucuuggggucaggccagggaaggggucugagcugcaaccugcuucaucagagccaucgccacaggcaucaaccccaucacagcgcuggacagcagauacacagcggugguucaggcacugaaacucuuccugcaggcacaucagccaaucugcagaggcaccauggagaggggcugugaagcaccagaacccucaggauccuccccuucugccuggggcuuucacugccugcuccucagacaucccuguccagccuaccuuggcuguaggagagcaggaagcccuggcccaugggugcucuggccccagcauagcuguaagugauggugacguugcccccgggcagcugcagagggcugggaggugccucacacagggagaucaguggcuggagaggggagcguaggguuaagcgcucugagccacaggccagguguagcuucuggaaccuaugggaguagaggagagcaggacaugagauacucuugacugcugcuggcuuucuccuccccuggugccaccaggccccuugugucccaggaagcauaaacaucugcuuauccaugaucuaaauggccaaaugaaaacucaguuagccuauuuauuuauuuauuuagagacagaguuucacucuugucacccaggcuggagugcaauggugugaucuuggaucacugcaaccuccaccucuuggguucaagugagucuccugccucagccucccaaguagcuaggauuacaggugcccgccaccacaccuggcuaauuuuguauuuuuaauagagaugggguuucaccauguuggucaggcuggucucgaacuccuggccucaggugauccacccgccuuggucucccaaagugcugggauuacuggcgugagccaccaugcccggcagccaaauuauuuuuaagucaauguagucaauggggaucuuccuaacaugguaggaauaccucaugguaucgccaugagaccauaaaauauauccuagagcccuuuggaaaaauugacuuguguucugggacugaguuaagaagaggugcacugcauuccaguuguuguagcacugucacccaaguaugguaccagcaguaacuggugauuaccauacaguucaauuaaccagaacucaccaucuuaucccaccccacugugccagaugugagaccuggauugguucuccauggcauucugaucccuuugccccaccagccucuccacagauugcccucucucuuugccuaccccuuucuggguaaauucauggaaaaugaacuaugugaggcaaacagccagguacuuaauaugauccccaaacaaugaccaaggucaggggagccuggggugacuuggaauguuuaaaagauccagagaggcugagggauguucuaagcugauuaaggaguaguucugaaucucaggcaggacaugcaaugaauggaaggacucuucagaacaguucuaucugagcugaggaccguuugcagaggggccucuguccuuuggagaugcgcaggacucaagcuagauguccacuccagcccagcuccaccucaauucacugagucugacccagaaaaagucagacuuuuagggcacacuaggccaaaucaaauucuacucuuuaccuguugacaaggauggaaauuccauagagaagugaucccugaaugggccaggcccaguggcucaugccuuuaaucccagcacuuugggaggcccaggcggguggaucacuugaggugaggaguucaagaccagccuggccaacguggugaaacccugucucuacuaaaaauacaaaaaaguuagcugggcaugguggcgggcaccugcaaucccagcuacucgggaggccaagacaggagaaucacuugaacccgggagguggugguugcagugagcugagaucgcgccauugcacuccagcccgggugacaagagugaaacuccgucucaaaaaaaaaaaaaaagaagugaucccugaagacuuccaauggaggggaaggggcaggggagaagaauggguucuugcucuuguucugcuucucaccugauggugacagucuguuccuugcugcccaggaugagccaggugcaguuggcaggggaggugcggcugucccggaccaggggccucuguaaggugcccugcacuucuaagagcacugcugggggguccucacaagcuggagagaggaagguaggacacggguaguagacagccccuuugcaucccacccuuccccuuccgcuuggaggcuugagguuuccaaaagucugggcucugcaaggaggagcagaguaucugccccugcccacacacagccuagaguuacagccuucuagcuucgcucuuucucuccacauucuucauagcuucaccaguaaauacuaauaucacgaacaauucugacgucugcuuugugccagccacugaaccaggaggagcaggaaauacugccucuacccucagggagacuacauccugguuaggacgaucaagcauagauauucccagaaaaaauaaaauaguacauagcaacuaccagaugaagguccacaccgagccucagcuuccuuaucuauaaauaaaggcuaaauuaucuccccucuaaaacuuugguaggucccauggaauucagggaacagagaguccuucucgacugcucccucauucccaagcccacggagccccagagguucccucaacucaccaugauuuggaaaaauaauccggucuggaugggccagagcgccuccuagaggaggaacgagaaagggcaggagcgugagacacuccuuaggaguuuucuucuucaccugagcaacucaagggagccauccgggacuuccgggcaguuaaucggaagagggaguggggggcgggagagggcugcggcgugggacuuccauggaaggaagguccggcagcagggccuugugggguugguggggugaucuaggggaagccggagagaggaccagggcccagcggagcagcugaagacuuccuggggguuggggccggcagugcuggggcuggcggcaggggcuggggggaaugggcaggcaggauagagugcggggccgcacuggagggaguuagagcugcuggcccggugacagaaggcuggggguugguaucguuucgguucuuaccaaggaggaggaggaggaggguggccaacagcauccugggcuguccagaggugccggaagggucccggagcuucuguggucuacccgauggggucgcggcggagccccgggcgcccaggcucccuggugccgccuccccaggggggcuccauggcccgggcucgacccguacucuggaugccagggcugggggcggggaggcggcggcagcccgggaguaggggcggugccuuucgccaacuuuggaguuguuuucuccguccgccgccgcacucuucucucccggggccggcuccugaagccccgggucucggcacuggggcgcgcccucgccuacagcccgcccgcaggcagcgagcgccccuggucuggccuggucgccaccugccgggguuugagaccacuuccucuucgggccaaacuuugccgacugucagcccccagggccggccgggugcugcuccacuccuccagcgcguccagccagcggagcgcgacagggaagcgggggaggggaagagguggcucggcccggcgccccggcccuugcccaggcgguacccccgcccgcccagggguuggaguagccggggcgggugacaagcccggucccaccccugccaauca

SEQ ID NO: 17575 - RNA, 4581 nt, Homo sapiens
cauuagcaugugugaccucaucagggggugggacaauuuccccaggugucuaggggggagggcaugugugugugucgggggggggggugguauuuaaagggaaaagcugacagugcugcugagugagggagagggugcugcgagcugcugggcugcacacgcacacgcacacgcacacgcacacugaugcacacggaccuggacacagacauggacauggacacagaaaccacagcacucugccccucuggcagccgccgggccuccccuccagggacgcccacaccaggugagggcuaaccugggcagguuccggcugaaaccaugggggugggagcugaagcuuugguggggaggucagaacuagggguugagggagcuugagcucagucagcaagaggagaagagcaauugagaaaguggagaagaccccugcucacacaagggauuggggcugggcuaggguggaggggaagagcugccuaaaugcccccucccccagcacucccagggcuuugcuugagaaacugguacauggccccuagcucagccucauucccgaggcuggaacaggcaagaaggaaggggagaggaaaggggcagcccacaagccugggaaucacaggcaggggcuaccccggggaacuauuguaaggguucuucuggcugcuggaggcccuggcugcuggccaaguauugauccugggcuauuuccagccucccucuagcccccuuuguugugucuguuguuccuccuccaguuacccugacccacgcauugucacucucccuuucgcucacacacacacacacacacacacacuaucucucucucucuacuucuacugcucuaugaacacaauauucucucccacucacagggacagacagggaugcaggauucucacauccaaccacgcaaugagggaugcucaccuacagggccacgggaagcagcagccccucucucucucucacacacacacacagagaacccacagagacccagcacgcacaucaucucaaaaagcaaaggcccuuuccuaggaagaagcucacuacaaaguuuuuuacucugcuauaccuacuccccagacacugggcagcaguuucagcuugucauccucucugcuccucaguuuggggauuaccagugcuggaaacaggaggaggaagggccucuugauggaaaaagaggcagcuuccccaaaccucccccaacuccaccguacagggccagaggccuagucuggggguuugccuguguaucaguguaaagugugaguggguaugugagccugcauucaggucccuucccugcauggggcacguuuugaauagguugggguugggaccgcauuggagaagcuaucaugucaacuccaguucaggcuucuggagacuuuaguguaagaggucaggccagacauucucaguuccuucuggguaauggucaucaaguggguguagcugggccucugauacuggaacagccuggauugagccuucugcauaugguugagcauaucccacucauagcuuccuuuucuuugcccucccauuuuauuuuagaagcagaugccacgcuacuaaagaagucagagaaacuguuggcagaguuggaccggagcggguuacccucugccccuggggcccccagacgaagaggcaguaugccuguccccuacaagcaccagcuccggcgggcccaggcuguagaugaacuugacuggccaccucaggccucauccucuggcucgucugacuccuugggcucaggggaggcagccccugcucaaaaggauggcaucuucaaggucaugcuagugggggagagcggcgugggcaagagcacccuagcaggcacuuuugguggucuccagggagacagugcucacgaaccggagaacccagguauuuggggaagcccuccagggguugagggggcucuggggcccuggucagggaaggaagugcucgugaccugagcagccccugaaggacagagcuuaacagaagcuuuuccaaugcuuucuguggcagccucccugaagaggggcaggguucccuggugcugagaucugaggugucccugguuaccaggucucacaaauguugggaaaccuccuaauggacuuuauacccucucccuauuucccagcagaggauaccuaugagagacgcaucaugguggauaaggaggaagugacucuagucguuuaugacaucugggaacaggugagaacuaagauguggcugcaggcaggugaugaagcugggagaacuggggaagggcaaagucuggcugaaggcuggugggacugcugguccugguuuccacauguacuggaaccugaccuuucauucauaucaccucagaaagcaaagacccacacuacagccuguggcuguuaagacccacagucuuuccaggaucuucugacucagagcaaacuuaggaugggaauuugacaaacccugcagcuccaagcuaggcuggacacccugaaauugacuccauccauaaauuuuucagccugaaggaaucugaugugacaagacaagagcucagggaucuggaauaucagggaagggggaaaaaagugaggacuucugaauauuuggacauaaagguuacuauguagaaauaagaggccaaauuacagacgugugaauaauauucauuuuugaaucaagagcuuaagaaauuaggauggcuacccuagucuaggauccucauauuacuaauuucuuccgccuccacaaacacucuggguagggagauucugccauuaacuagcucugcuguccuaagcagguggcuucuuucugccucacagcccuguuccuccucuuugagguguaggugcuggacaggaucuccuaugccuccagcccuaacguuccucugccugucugcagggggaugcaggaggguggcugcgggaccacugccuucagaccggggacgccuuucucaucgucuucucagucaccgaccgacggaguuucuccaaaguuccagagacccuacuucggcuccgggcugggaggccgcaccacgaccuacccguuauccucguuggaaacaagagcgacuuggcccgcucccgggagguaucacuggaggguguguauccugaacagauuccauacuugcgaucucaggggaaugcucucccuuccaagucaccucuucucccuaaggccuuuuuaccaucgcggacgcacucacuugcaaucagacccaggcuagggggacacucccaaugccccacucgaggauccugagaaucccuucuugucacuuccccucaccucucuccuaggccuccuucucccucuccuucgcaccuccacagacccaccauaugagcucagccauguucucucgguugcaagauucacuaguaccaaucccuugccaccgcacgcccaggcccucccuagacccacccucgccccgggucccguacagcccagcgggcgccugagccggugccuuccugcagagggccgccaccuggccgggacgcugagcugcaagcacaucgagacgucggccgcacugcaccacaacacgagggagcucuucgagggcgcggugcgccagauccggcugcggcggggccgaaaccacgccggaggccagaggcccgauccgggcagccccgagggcccugcgccaccugcacgccgcgagagccucaccaagaaagccaagagguuccucgccaaccuggugccgcgcaacgccaaguucuucaagcagcgcuccaggucgugucacgaccucucggugcucugagccgcggucgccauggccacugcggucgccauggucaccgcgcccuccgcucgcccccccucgccccgccccgcccccguccggcuuccuugguggaggccgucuaggaaaccaaaaacucccaggaugccccggugugaccgccgggggcggcccggggccgcucggcggcaccuccacacccgccccaacgcguucucuggagcuuugggccucagggcgccuagaaggcgaggacgcagaccugaaggcggccggugagcggggcggguucugcugggucgggaagaaaaauaauucugcaagguauuuuguuuuuuauuaauucgcgcuuggccaccucaucuguaaagagauucuaaaagcaagaucuggaaaagugcuucguagacuccuugacggaguuugccuccuuuguacgcugcgugaacaugccucaccuuuaagagagucuuaaagguaaagacacgaaaacacuuccuccagggaccuucccgaaaacguucuggcucucaucuggugcggcauguguccacuuugccuuuaaggaguucuuaaaggcaagggccuggaagugcuguuccugagauggauucucuugacuuaccaguccaccacggcacuuccccuuuaagguuauuaaagguaagggguggacagacuuucugcauucagauaaugagcaguggcaaccccuuuuggccagggccaggggggcaccagcaaggggccacccuuucccuuuucaauaaauaauuuuuguacugccucug

SEQ ID NO: 17576 - RNA, 10899 nt, Homo sapiens
cagcuaucccugcgcggacacccccggcgcucucgcacacaccgcgcuccgccccccuaggaaaguagauccggccaggcagacaaaaguuugggagagaaguucggucuguggcuagcgugagagcuaggggggcgggggccggggagaguggggcagucgggcgagucgacgcgugaacagauagaccugcggacuggacagccgcggccagagacccugcuagccccgcucagccccagaugcgcggggggacgcagccccucccgcugggggaugcugugggauuccuggcgcagggcauccaggccgcccgcuaagccccugugccuccccugugccccuggggaaccagaguccggcugcagggaaagagaaccggccgccgagacgccgcagggugccaggcggggagggggcgagaggccccaggcccgagggcauggagcgguuaggagagaaagccagucgccugcuggagaaguucggccgcagaaagggugaaucuagccggucugggucugacgggacccccgggccgggcaaggggcgccuaaguggguuggggggaccuaggaagucagggccccgaggagcuacugggggaccuggggaugagccguuggagccggcccgggagcaagguucccuggacgcugagcgaaaucagcgcggcuccuuugaggcgccgcgcuacgaaggcucuuuucccgcggggccgccgcccacccgggccuugccucuaccucagucguugccccccgauuuucggcuggagcccacggccccggcccucagcccccgcucuagcuucgccaguagcucggccagcgacgcgagcaagccguccagcccccggggcagccugcugcuggacggggcgggggcuggcggagcuggagguagccggcccugcagcaaucgcaccagcggcaucagcaugggcuacgaccagcgccacgggagccccuugccagcggggccgugccuguuuggcccaccccuggccggagcaccggcaggcuauucucccggaggggucccguccgccuacccggagcuccacgccgcccuggaccgauuguacgcucagcggcccgcgggguucggcugccaggaaagccgccacucguaucccccggcccugggcagcccuggagcucuagccggggccggagugggagcggcggggcccuuggagagacggggggcgcaacccggacgacacucugugaccggcuacggggacugcgccgugggcgcccgguaccaggacgagcuaacagcuuugcuucgccugacggugggcaccggugggcgagaagccggagcccgcggagaacccucggggauugagccgucgggucuggaggagccaccagguccuuucguuccggaggccgcccgggcccggaugcgggagccagaggccagggaggacuacuucggugagugagagaagugguuagggacgggaagggacccgucacgguauucgguucuccacugccccgacggcccaaagugccggugccccgggguccgaggugaagacgcgggacuaggaaagaagcaagagggauggaugggggcggccccagagcacuguccccuuccugcuaguuuucagaugaaccagggcuccuuauuucugcuaaauucaaccccccugguaucucgugaguccguuucucaagcauuugaaccucgguuuuuugcggcaggaggccucguagggaagggaccaaguggggcagugaaggcgcaucccccccaacuugcuccccccuuucacggcggugccccuggagguuugugcgcgccgcgcccccacccgggcccaggcuccgcccgcaggaauucggagaaugcgcgggugggggggcggggcaggcuggccgcgugcgugccgacuccugcccgggcgcuccaggugcccgcgggcggggcggcugccgccgcgcggcggaggggugggguucggggaucgggggacgcucccuagcauacgcggaguaguggcggcugucggggaaauggagccugggagacaggauggagcgcccugggacccaacugcugucccuccccaguccuguuggcuaggugcgugcgugggcauuuaaucagagacccaguaguaccagcuucuauuuuccccauccuccggaagucaggguaaaagucaugacuacugggacaccauuaccucuggauggauaacgacccuguguuauugccagaaauaacuuggccuugaauucugcuuauaaccucucagaauucaggccagaaguagcgccuuacuuccugacacuguuaaggaaaccuggucgcugucucccuccccuacucuguucaggaaguauugauugauuauaugucucagcuaugaggaacauuagggucuugaaagaucuuuuagucaaaauucacaggcacugcuacacacauaaaaaacuucgaaucugauugugauuggaaagaaguggcaggcuuaccgccuaagggcugugggccucuuucacuuuucuaagcaucucuucuuaccacucaugccccacuccuggaccccaugcuguagaacucuauggcuagaaaagugaauaggaagaggaacgcggccagggagggaugguuggguaggagguucagagguagcagggcggcaggcuauaagggcauaacucaacccccagccuccacccccauucuuuuccccaccuccaaauccaccgagaggaaagcccagaggagaugaugccaaaccgcuuugaucaaggaagacugaaugacagggcccauuuagcaguuucauuuugaggcccaggagagguggcuaguaaagaagucuuuuuggcugaaccaucagagccaaaaggaagaaaggaacucagagaaacugcaauaaaauggcaggaagaacauagguauagauaugcuggguuagaggaggugaggccaacgugccugagcaguuucguuugcuuuucccauaacguccaagguuuccuaaagaauggcuccgacaggacccccuggcauggcaaucuuggggcagaucuucacuuccaugaggaagccacauuuugaauucagagaugggggccccuucuccuugggagucagguugccuccuuugacagaaccccuacauaccccuugugccgcuagccccagcuugacuguacccuccuccugccccuaguaggggcccucuuccuuggcuucagccuugcccagcugccagagggugggagcaggacaggccugggcccaucaguugcugcagcugcugcacaggcucccaagccccugggcaaagacugggaugggccccaacaggcagggaguguggcagcgugccgagggggagagguggggcaggcccguugggaucugcuccccaaagacaggcccuagcccucacucaugggccuggaauuggggaguggagggagggaagaacacacccaggaaaggcaagucccagagccagguguauauaucuuagugggggauuuuggggaauagcaagcaguucaguucuguauucuucccaugauagaaggugacuaggaggcaucaggggcucugcuacucucccugcuuuccuguucaacccugguuccuggaacacacccugcauucucagcagccaccuccccacaggaaucaugcucacaugguccccucugcacggagcccucugccaagccagauccuuuucuccauccuuggaagucugcaguggagagaaaucauucuauaacugaacagcucguuugacugaugggaaacugaagucccagagacgauuucugggccuagccugcuuucucuagaaaguauuuucaagucugcugcugagcaccuguggacuggcaucuuugaccguucauccuacacacugcaacagagaucauaccuugccuguguagucuuuucuccccaacagaaacuaagcaucugaaugccagggaccauaucuucgacuuucuccagguuuccuuagguaguggugcuguguuaagcacaaaacagaugcucagaaaauaucuguugaguaauuaaauaaacaagaauggaucugcucagccaagaucuugcugcaucucauuacucguuaucuucucuacucagaagggagcccaucaaagggagacugugaccccuggcacaucaggaaagggcagucaggaaagcuugggaaucccugguuuugaccugggggaguagagugugacacuuuucucuucucaggcaccuguaucaagugcaacaaaggcaucuaugggcagagcaaugccugccaggcccuggacagccucuaccacacccagugcuuuguuugcugcucuuguggugaguguagccccaauacucaagcacuccccuccccugcccacauacacacuuacaagugcuauggggaacaggaggagagcuugugccucuucauuugcucacagagcagcuguuggauccccaccaagugucuggagguccgcagcugcucugccucucuugcuucccugucuguccucuacuuggcucucccuccgccugguggguccccuuucuggagucccuccuuccuuccucaccucuguuucucccucucgugcuucccugcuugcccauccuggacuugccuggcccuccagcuucuugguggggcuuggucuugggcagccaaguugccuggggcgacagugaaagacuggaauguggggagggugggggcaggcugggggaguggggagcuguuuggggcggagagggggguuuucucuuggcuggucagaguucagccaccucacuggagugcaggccaccgggccaugccaagcugaugacaucacgcuccaggaaugccugccacuguuagcucaggaggcccacuuggaaaggggggaugcucccagcggccuuaacugccccccuccccucccucauuacccccuccuuacugcuuacccauucugauuccuuugcuaaaccuuuaaucuccuaucucugccugucugacuucagcacucagcuuuucucacucccccaguuucugccugguucucuuuaggcucaucugucugucuauccuucuguuuacagggccucuucuggcuauaucucuuucccuaucuuuccuccccugugucucaugagcuucuaagucagcuuuccuaacccacuggacagaguuggaaguagggauuuugaggggaagaaggcaaaggugggaaaauugcucaugcuccaccuguucucacuccuucccuaucccugauaauguagacaccugggagcaguuccuggggguuggucacauggggaauuguccugccuugucugcuggaagaagauccuggguugucucuuaccccagugacucugggucccucuaagcuuagggaagcagccuuauacaaacaggagaggggaccugcuuugcuuccaaacaaagcacuuuguccuucugcaguaacuccaguccugaccuccauggagucugucccuggaaggagacaggcauuugagagcaggauagauaugcucaggcaaagaggcuucuagguugaagggucccagagggaaaggccuguuaacaaugugguucucucuaugcaaaucauauagcaccuuauuaagagcucacguauuccagcacguaguuggcuuuacucucccagguggcuuccuaugcacuggagaggaaggcaguuuguuuaggggaggggcccuagaaaacuguuaaggaggcaggagcuggaggagcagcaagcagaggagaggggaaguuggcuggaaugaagccaaagcaaauuggaauugcaucagauggaauuuuugugcggggaaggacagacagcaguuaggaggaaaagcacaaaguccagguuuaaauauauuaugcagcagcggggagcagugaccccagaagucuugcaccugggcugugggauagguuccagccccuucucuauuguuucuagggcgaacuuugcguugcaaggcuuucuacagugucaauggcucuguguacugugaggaagauuaucuggugaguaagggucaccuggaccuggaauugguuuccauacugacccccuucuugguggcccauuggaguaccacccaucauucucaguuugauaacagccuccguucgucuugucuuuuacuuuaguuuucaggguuucaggaggcagcugagaaaugcugugucuguggucacuugauuuuggagaagguaaguaaagugcuuucagcugagaagucucacugugaggcugaggagcgggaucagggacuaaauggauauugagagaagguuggggaaagaagccugucaccagaugaaucacuuucaucccauuccuccccagagcaacuguuuacaguggcuucccucugccuaugggaucaagucugggcucaaaagccugucaacccaggcuucuaugaccuagccccucccuaacucugcaggcacagccaggccuuccagccugagcuaggagugugggguccugagucuuuuuuuuuuuuuuuuuuuugagacagagucucgcucugacaaaguggaaugaucucggcucacugcaaccuccgccucccagguucaagugauucuagugccucagccucccaaguagcuaggacuacaggcaugcgccaccaugccuggcuaauuuuuguauguuuaguagauaaaagguuuugccauguuggccaggcuggucucgaauuccuggccucaagugauccuccugccucagccucccaaagugcuagauuauaggcgugagccaccaugcccagccugggguccugagucgucuucuuuuuuuuuuuuuugagauggagucucacucuguugcccaggcuggaguccaguggugcgaucucggcuuacugcaagcuccgccuccugguucacgccauucuccugccuagcugggacuacaggcgcccgccacaugcccggcuaauuuuuugguguguuuuuaguagagacgggguuucacuguguuagccaguauggucucgaucuccugaccuugugauccgcccaccucggccucccaaagugcugggauuacaggcguaagccgccgcgcccggccaguccugagucuuaauccccuuucugcuacugguuagaaucacuugggacucaguuuucuuuucuguaaaaacaaaagauaggauuaaaucagugauucucaaucaugguagccuagcagaucagcugggaagaacuaaaaaacaaaacaaaacaaaaaacaguguuuggaucccaucaccacagauugugauaauaggccuggaggagggccaaagcauugauguuuuuuaaaagcugccuaggugauccugauaugcagccagagugaaacacugcuggccugaaugcucucucaggcacuuuucagggucuccgccuccauuuuacgacuucuucaccgacauuacauagcauuguucugggaguauagcagcggguuggaugagguuaaugggaguaauaaggagcauaaugggcagcuggagagcugggacuggagggagacugauucucuugcuaccccaugagccagauccuacaagcaauggggaaguccuaucauccaggcuguuuccgaugcauuguuugcaacaagugccuggauggcauccccuucacaguggacuucuccaaccaaguauacugugucaccgacuaccacaagugagucugccccuugggaugcaguguggaacuggguccagggauuccccagccucagcucaucucuucccucucucuuucagaaauuaugcuccuaagugugcagccuguggccaacccauccuccccucugaggucaguaugucuggguucuccuucagggcagccagugccacugccuuuggggaggggauagggacaugcugccuggccuccugccagaagugguagugccaaggaauguacucugugaagauucccgugugacucugccucuuggggucaccacccugacccuaauauccgggccuggacaugucugaaagccuaacugggcccaggcuccaucucuucuaucccaguccagaggaggagacuuucuuugaggucgaggucaccagacugcagauguaggggcuggaaaaaggugggaagaauccucagcacugguaggaaggggucagaaaugauuuaagcugaguguaggggaugugccuauggagagaaaccaaaagccagugaggaccagaucuuauuggauccccuuguucccagccuagccuacuuuauuuaggccuccuguccccuucccuucccuuugcuuccugcacaacugagagacgcagguaaggccagggcuguuguacagagggagugugcuccaugggugcagcccagugaaggagaugagaguucugguaggauuugcagaagcaucuuaaaacuacaggugauugcagagagacucugggggcauuuguaugaucuucccauggggugggaaggguuguauaugagggaaagguggaggugaggcaacaugcugcucucaucuccaugggggucugcauguuucagggcugugaggacaucgugagggugauauccauggaccgggauuaucacuuugagugcuaccacugugaggugaguguugggguucagcggugcuggagaagaaguggaaauggggagaggggaggagucaaguccugcaacaaccagacaucuaugggagagguguagggcaugggaaaccagaaagauauugugaccuaucuucagucucuuuuuuguccuccagccacucucucugguccaaguagcuuaguccuuucugaaucugacucucccagagucaggacuuucuaagacuagggacucuggucaaacuucuugaaagacaggcuugugucauuauuucugcugcagcagugacaccugguguccagcugagguauuaguauuuucucagauugcucuuccaucccuuccauccuucccuucccaccccaucccuuucuuccaguuauuaggagucagguguugagcagggcagacuccuaagauacccucaguguccaaggugccuaggcugaggugaacuaggugccuucuucccuaggacugccggaugcagcugagugaugaggaaggcugcugcuguuucccucuggaugggcacuugcucugccaugguugccacaugcagcggcucaaugcccgacaacccccugccaacuauaucugagcugcaaucacugcugcugcugucacccugcagacaaacugcuguggccagugggccccucugaggccagccaaggcaaagaaugcacucugcaggccuggcagaagaguccucuggggaggaccccaagggccggagacccaaagaucaugauauuccaaauggauuguggaagagaaaccuuauauuuaccagggugggggcgacuggccuuuuucccaugugugcagucugagcuuaggcacacacaggaggguuccaggacuuucugaacaucugauucuguaucuucaguauauauauuuuguuuguuuuagagaugggaucucaccauguugcccaggcuagucuugaacuccugggcucgaaugauccucccaccuuggccucccaaagugcugggauuauaggcguaagccacugugucuggccuaguguaugauuaugcaugagucacgcaauguucugguccuggauuccaggaguagaggaccuagcuuuaaaucaauuaguuucagcuaaacugacuagaaccaaaucaaaguguaauucucccuccagcucccccaaaccccagaguuuugggguugugguugaugcagugugggaugucccugagagguagcaagucuaggguggugaguuccugcuaggcaaccaaauuuaagcuccucacuuuuugugacacauggugucagauauggggucccgcaccuauaucuggaugaagagguagaaacucuggaccucauuaaugaguuauuucuuggccuucuucuaaggacuaggagagcuccuuaucugucugagaauggggaccagcucugagugggguugcugccuguauucccuguuucucaggaacuuacaugggucuggggaggcuagguaggugauuguacgugguugcucuucuccuuggcugggggagguaaugagcagaucucuguggguguggagcuuguuggggggaugucuaggaagcuucagcuuagccacauucccaaguuuaggugcacugagccauauagcccaguguaugcauguguggguguguucaugcacacacacacucucucucuugucucucugucucucucucacucuuucuuacucucuucucaggucacuuguacacuugguuuccuaguagaagcucacuugccaccucucagaggggucccggauugcauccaucacaaucccaaaacuagaguuggggggaacuggagggagcaaaacacugauuugauacuagucaguuugcuugaaacuaguucaccuaaagcuagaucucuuaaaaccaauuuacugaaaacuuguuugcuuaaaguuaaugacuuaaugacuaauuugccaaaagcucaauuccuauuuugguguguuuauauccauuuagguguccuauucuuuuuugucaugcuuuggauauuucaaggauuuauaucuauucauccaagaguacuucugagcuauuaucagcaacauaaauuuaucaaauuugcagcacuuuguaaaugaugagauugcuuccuaccuuuauggaugucuuuuucuauguuaucuaccauucaaaaacuuuuuuaaaaaguuuaaaguuucuagcaauaaauacaauugguacagacauuuu

SEQ ID NO: 17577 - RNA, 10483 nt, Homo sapiens
cuuuacaaaauaaaguguuuguuuauuaugaaauuagagauggaggccccuccccuuccucccucuuuccccuuccccagccgccucccccuuuccuuucccuacucccucaggaagcacacaagacaaugcccagggcugggaugcccaggggaagcugacagcugggcagagcuccagggaggcggccacacgggaggcuggagcucuugcccugggaggcaggcugguucccucucucagcuggaggccaguggagccaggaugaggcugaggccaugaguaauggauggaaccaugcaggcaggucuguaaggacaggggagccacguuagaggcaguggggagugggagccuucauccaccgcccugccccacagucuaggggcacugaccuggggcacaacauccccugcaggagggugggcagcaguggcuggaaguuucucuugauuuugggauggacaacagaaaaaaacaaaaagccagucacagggacccagagagaaggaagggagaugugggcaggagacagacacagagcauguguaugggcaaggaagacgcagggagacuaugugugagcuucagaacugcagagacaaaacgccacggaggaaggagaggaaucacagugagagaucgcagggccagggccagggcaggaaacccaggcccggacagaggagcgugucacagauagagacaaagauuccuggagagagacacacacaccgacucaggaggagggaggugagagcgagggugccccggggaagcaaggagggacacaaggacagggaggaggccuggggccccugggcugcugccgcccgccuggaccccguggggcucacucagagggccugugcccgcugccccccccccgcggugggccgggccagcccgggcgcucagggggccgggggcuccuuggccccauacagcucggccagggugcggaagagcggaccccagucguccagcggcuccgcggggccgggggcgccgccggcuucgcugccggagcccagggagcugagggagccgcaagaggagccgcggcccucguagccguacaccugcaccgagucguacggggguacgccgggguccucguccgccucgcggagccgcagcgccaggagcugcgccacgucggcggggccggggggucugggcuggcgcgacacccgggcccggggcaacacgucucggcgcgcgggagggccgggcgccgggggggccgccccguccggguucugcaaggccgugaugucgaaggccucgguguccuccucgccgccgcccucgucgucguaggugaugauguucucucggacguccuccuccuccaguaccaucagugcuucuugcuucugccgccgcagggccacgaagagcaccaccagggcugcgcgagaggcgcgcacacaggcccugagccagcagggccgggagcgggcggccugucuccaugugaaaggcugacccaucaggugacagaagcccugugcuuaggggcugacaucuagcaaaccuugcauugaauccugacuucagcccuuacucgcuaugugaccaugggaaguugcuagacuucucugaagccucaauuugccccuuagauuacuuauguggagaauagggaaaauauauuuacuucuaaggguuguugacauaauaaaaugaaauaucacaagugacgugcccagcacuauacuuggcacagaguaggggcucaguaaaccauuguuauggcuugucauugucauuauggauuggcaggucacggauagaggccagagcuuuucucuuggaugcaucagguggugggaaaauccagguaugagggucguucaagcccuaagguggauuucccuguguccagaggccugguucuucuccacaccccugcaggcccagaucgcacagcuauguaccacuguggccugacucaccaagcagggcacccacacaggugaugauggcaagcagggcgccggugcugagcccagcagcugagaggugagccucaggccagcaggaugccacagagccgucaggcuggcagcggcacacacuaacagucacuguggcagugcugcucagcgccggcugcccccagucccacaguucuaugggaaccaaguagggggcauggcgggguggagcagggcgggagggcagcagcaggcuggcggagccaucugugggagagggaagguguugagguaucuucugggacaccuuccagguaggguugguccagcccauagagccagcuucccauagagccagccccccauagagccagcccauagguccagcccauagagccagcuucccauagagccagcccauagguccagcccauagagccagcuucccauggggaagguuuacaaagagccaacgaaugaguacaaguccacacccaucuucuguuggguagaaggccgaggcagguggggcaggggucaggcaggcugggcuagggguggaggaggaggagaaggggacagaggcagguauggacauggcuguaggaggccaccuaccucgguuguccuggacaguaaaguuggcaucagggcccagaggaccuugaaaggagacauggcuacuguugccaacuucaucucuguccagggcccggaugaccugaaucagcugggaggaagaagagagaggccuuguauggagugggcugcuggaggccuggacgucccaaccccucugccucaguugcucaccuggccaggagcugcagagucacacacaaaaguaucguagggcucagccagcuggggagcauugucauucucauccagggucuggauggccacuugcacgcgcgaggccugugcagaacugucugaaggcagaacaccaaaacauacacgccacacacacaccacacaguuuacacguaacauauguggugcaugggcauggaugccacaugaagcauauagcaugcacaagaaacacaugaaauaugcauguaauguacagguagaaaacaauguugcagaaugaauggaacaauaccaagugcauacaauauucauguaguacccaagauaugugcgauacacaauagacauucaacaggaaugccgcacccaugauacacauauacaauaacccacaugcagggcacaugcagcauaaaugaaagacagagggaaggugcauacgaguugcaugcagacaacagccaugaauauacaaaacacauucauaccauauauccaauguacacucaacauuuaaaacaaaugcaauguacaugaagcaaauguuugauaugcauagugaauguggugccacaucccccgacaacacccagugcccauagaaugcauuuucaugcauagaggccaugcacagcaccagugggguggacagacacauauacacaccacacacacacacacacacacacacacacacacacacacaucccaucagaggucugggaggcuguaguacagcagugagcaucacuuaucuuggguagaaaggugcugcaugaucuacagggugcagagcccaggccagccuggguaccacagccagacacaggccccaucuuuacccaucccuucaucaggugacucccuaccacuacccuaccuugcuucucacugccagugccuuccaagagagaaugcaaagugugucucccugucaccucucuuaggccaggucucccaauuccuuuagucuuuccccuaggcagagggauagcugacuagccuuggggaaaggggcugaggaugcagcaugggcaggggaggcugaguggaucgccuggcuaaaaggauugggauaccccagagacaggauggggaggaggucuacuucuucccugcgguaagggcccagcacugcuaggugaugucugggugcggguaggagcaggauuuggcaggagaaugagaagacagugacuagaaacgcacacacacacaaagcuauguauauauaagcagccaaaaacauacuguguguacacggacacacacggccauccacacagacauccaugcacuaacagauaacacgugcacugccagguaguaucugugcauaucuacuaugcacacaguugcauguauagaaacauaaaccuagacacauagcauuaaacacauuugagaggcaguacgguggggauaacagcucagacucugcacacugacuggaucucacagcuccaccacuuaaucucuaugugaccuugggaaguuacuuaacuucucuuugccugaguuuauuguuuaaaaaugaggaaauaaucauacuucccucauaaaguuguggugaugauuaaaugaaugaauccauuuugaagaugaauagugccugauaaacaauaaguaauaaauuaucuguccacaaauacccacauacacaaaacacauacaaacagcuacaugugcauaccacuguauauaucaaucacacauaugcauaauuaacauaaauauaauucuguacacucaacaguaaacacauauauauccauuacagauauauacccacaaauauauauuuguguauaucuacauacuuuccccacauuuggaauuauacacauggcugagaacauacccacaugugcacauucauauaggccuucacugacacauucagauauccacauauacaagggcaguuuucauaugcaguaugaagacaaaaggguggaggagccccugaggcauaagcagggguauaagggacuauucacagaagaucgggagggaggucucccugucuguaugggcuagggcugcccagaggcagcugaacccgcugcuggccugacugaugggggagaccgcauauggagcuggcacuccuccccuuccuuaugguguccacuccccuaccuugggggauucccacagcgcuuccaacagggcuucucugggguggggcugcuggugcacuccacucagcaaccagaagagguacccagccccuuucuggcccccagcuccagccugaagcagagagugggcaggauggggucugucaguacacagguugggggcuauguaaggucuaguuuauuucuggguuggggcaagucagguaagggaaugacuugagggucaggagaaugcucaggcacacccacugugcccacccagcccagccuaggggacuaggagaccaggaggcccgcccugccugguagcaaggauccaggcuaggacccagauccaggcuaggacuuggauccaggcuaggacucagauccaggcuaggacucaguggccgcacgcuggugagggugcgauggcaguuagcacccuucuccacccccacacccagggacagcuccucggccaggaggcugcugccgccuugugggcccuggaguccucaccgagcucuguagccagcacagugagguugugccaggcgcgagccucgcgauccaggggugcugcuguauggauggugccuuccucgggcuggauagagaagcaacgcuccggaucugagugggggaggauggaguaucuggggaagggagagacaugcuggggcugaucuggggcgggaccacagcuuguuccacccccucucuucuuucuucccucuguucaccuugucagaccucaugacuccucuggguagagccauaauucagguuggaguccccuuaaaaggcauauaucccugggggaucaccaccauuaaacaccuguuaagacucagggccacuggguuucacggggggagggggagaagacacagaauggaguagaagcgggauaaacagaccuugacucucagacuucugggcccuguucugagaacccagggacauguguuucagcccugcucugccuugggcuggcuaugugacuuagggcaaauuguuuaaccucuauuuacucaacugaaaagugggaaugacaccaguaccucccucacagagcugugacagggaugcuggccggggagggggaaagaguggcuguucugccacuuaccaacugugugaccacuuauggcuggcuucuaaaacaaguggugaugagaacaccuacuucauagggcuguugugagaauucagugucagcaaggggguaaacugugaagcacuuugggaaugaucaauagagauccacuuaucaaaugagacuauauccacuugcacugccacugggaggggccaccaucaucuacccagagggguggacagacgguugaggaguggucagccaggcccuccggcucuccccuggcacccaggccugcagaccagcaagcccagcugcagggagggaggcuuuugcugggauaugagugauuugcuauaagguagggggcacauuuacucauucucugggugggaagagccugccaucuggcuccccagcccacaucccagcucaccuaccugauugggcuggcaggggaguccaggucagccgcggagaucuggccuaccaggguccccggggccuuguucucaggcacugucaggugguaggcagccugggugaaggcagguggcucuggggcaucuugcacugccacacgcacagaggccacauccuugaagggcccucgccgcagauaggcugggucaaugagcguguugguggccucgacacggaaggaguaggagcgcuggcucucaaagucuaggggcuauggugaggggagagggagaaaaagugaggcauguggaaaccagggcaggucccaggcucuuggaaggugacaaguccccuccucacaugcaugcagugcucaguccucaugugaggagagguggcacuggagggacaguggccuugguggucaggaugcacagcagauuacuuaggaacucuaggucugccccuagcucccucauagacuugcuaucacuucuucuuucuaagcuccagggccucaucugaaggaugaggaggugaccaugaucucuaagcuccaacagagagauccugagucuguucuagaagaacaguuaaauaugugcccugugggucggcaggaggcaggucuaagagaaagcauuaacaggcaggaggcuaaccuugcggacagugaggagcccgucucgacccugcaagucugugcugaugcugaaggccucagaccccuccccauccaggaugcuguaugccaucagggcguugucccccaggucuggguccugggcccggagccggcccaccagugugccagguccagcugucuccaccacggagaacugguauaggccuugggaugacagaggggagacaccuucucagagagguccccagcccuccucccuccccacagcacuuuauucucccaggaucuggcuggggaggaggcgaggagggaagguuucuccagacacuguagggguggggugaucaaaggauggcucagguggcagcaauggccccuuacucugugggaacuuggggggguugucguugacaucgcugagcgugacagucaccguagugcugccugacagcccccccauguggccgcccauguccuuggccuggaucaccaccaagaacuccuccugugucucccgguccauguuggggauggcuguacgcaccacuccuagggagagaugcuggucagagggugucuguccccuuggcugccccaccgggcucccaggcuccauccucaccagucuggggguccacagagaagaaaggcaguccauccagaacaguguacaccagcuuggcacuguucccauagcuggggucaucagcaucgugagcagucaccuggaucacugaugucccugugggggaugccagcacgccauucagcagcagcagggaaggauggggaagaacaaccgauggggggggaugcagauacgagggaggcugaauugaagggggcagguucuggggcagacaacaagaagggaaggagaggugagagagcuccagaagacgggaacuggggcauucagagcuggggugcucaccgacauuggacaucucgggcacgguggcaugguagggcccaaggggaaaaauggguggauugucguugaugucuugcacuuugaugaugaacucugaugggggcuccaggggccgguuggaggcucgguccacggcuugggccaguagcacauauugcgccuuuuccucccggucaaggcucuugguaacaugaauauugccuguggccucaucaaucacaaauacggugccugcccccuccccggucaacagguacuuggugcggcccucuccccggucaacauccgagugcagcugcaggggucacgaaaagauggcagagggcuccaaguacagagacaggguuaaagagucuagguuuggguagagcguugggaguccugagggaccaaggucauugcagaagugaugaaguugcagggcagggccugagggcuuggugucagaguagacaugggaggggucauccuuaccuugccaaugagaacaggcucuggaccagcauauuccucaaugacaaagaacugguuccagacccagcuccuucgaguccgcagcagagcaggcccuggguguucccgggacccugcccaggcccgggcuggggcugccagacgccccaugcagccccagccacccagccaggccagcaggagccucaccaggccccacauguuuggacuccagccagggcucuguucacuggcccugggugcugaggcugggccaggccacguggcccaugagcuggcugggguggaggggcagaugcguugaggcuaccccauggauccacaccugcaggacaagcagcugcucaggcucaaggaaaccccuagcccuccucccccgcaaaauuagaugcugaagaccagaccuccaaggaaccagacacuccacugcccagaacucagacuaagacagagagcagagaggcugauccuuccuccacccaggcucugcauguauucaccuccagcccuccaagcugauaaaucucuggucagucaacucugaguagagaacuggggaggaacacaggagaggggaugcugggagggcuuggaaucccaaaucuggucucuguccucccagguugggcacguagccagguauuggaggaggcggggcuaccagagaaagggcuuaaaauuacggaguugggauucauggagguguggccuuaaggugucuagggucagcaugagaugacaaggagugcagccucaggcagggcugagagucugugaaagucccuccccacaagggggagccccacucuccaggcccugucuccagcccacgcugccagugcaguccuugaagggggacugggcucgugagacaggaguugggagccagagcugaaggaagaggauacagggugggggacagggggaggugaccggggagagagguccacccagaggcuagagacagauaaugacugacggcuagacugacucagggacuguccggcagagaaaugacuggaugagagacagaaacagaacaguggcaagagacagaaugagagagaccagggcagcagccugggugucugaaggcagagaggaguccuaggggccaggcuuggaaacgggucaccgggggcaguuccgggcaggcaggggcagaccucagcuucgggggugucaagccaggccucgggaacuuaauucugggagaaggagcagacaggagggguggaggcagggaggggccacgggaagggagcuagagaggagacccuucccacugcucuccuuucuccuaggggcgggggggaggaccccucagguagcuguggcuucugccccuccucccucagagcagacacacaccugacagucccuuugcucccgagggaagggggaaaccggaggaaggcuggggaccagagagaaggcgggaugaggaggcgagaaggaaggggauagaggagugggaaacaggauagcaggaaggggagaggagagggagggaaaggagagcaagaaagagaaaagagaaaggcaggaaaggggagaaagguagagaaagaaaaaggcaaagagggagaggagauggaaaaaggacaagagggagagggaaggguuggggagacagagggaagggauaaggaaggcaaacaggcagagaaggaagggugaagagaaaucgagagaagaaagagggagagaggugcgaggggagaagggaaagaggcagagcgcgggagaagggagccggcagcgggcucccagccacggagcgcaccccuccgaagacccccgcaggcugcgggcccccuccuaccccuccgcggauucccgaccccugcuccggggcaggcgcccuuaccuggcacugccgaggggcccaggccggcgggaagcgcccccgcccgcccccgucgccgggucccgggggcacagccccgagccgauuggagcgggcgccgcggcuccgcugcaggucugagcggccccggcgagaacaagggagcg

SEQ ID NO: 17578 - RNA, 36913 nt, Homo sapiens
acaguuuaaaacuaagucagauuuuuauuuuuuuuuccauagaccacaucauuuaauaauaaaaaaaauaaaaauaaaaauugaacaaaaggaaaagguggauauaaaguggaaccugugggaaagaggcaagggcugcaggacagaagagacugggaacugcaggggcccugggacucaggaggagaugcugauucagcucauaggugacccaguccuggccccggcuguucccaagagaaggcuguaaguacccagggaggugguaagcaggauggaggaaaaaucagaggacuggggcaccuggcuguuccccaucucuggccaaccaccuccuugccuaaccuagcucuugccucucagacuuaaugggaaaugagagggagggucgggcuaagucccaagagauagguuaaggggguguguuuggggggaaaaggauggccacuuuuccauuugguauguauguagggauaggugaugugaaagacccuuggcuccagggugguggagacugugccuaucccucuguggccauaacccccuggggccgaguggcugguaccugcagcucuaguguuuucccagcuagcggcgcccaccccggucccgcacaggugugcuccgacuccggcuucugcuguggcgcuuggugucccugcgaucccuuucccugccucguucucggucccuuucccuaucccgaucucgguccccccugucccgcucccuuucucucucucucucccugucccucucccgacugugcucccgacguuucucucgcuccagcugucgguuccguucccgcucggcuuccuucucccgcuccuuuugcucuucuucuucuugcuccuuucgccgcuucucccgcuccuuggcccguucggcccgcucugccucuuucugaacgaucuguagccagguaggaaaggcagagaauaggcagcucaguccuggucacagccuccauuugugccuggacccugccuccuagcucagggucagcuuuucaguuaaacaggaagggguugggggcucaacaacugcauccugucuuucuuagagcaccucucucccuccuaguuucagccuuuuuuuuuuuuuuucugagacggagucucgcuccgucgcccaggcugggagugcaguggcacgaucucggcucacugcaagcuccaccucccggguucacaccauucuccugccucagccugcugagcagcugggaccacaggcgcccgcgaccacgcccggcuaauuuuuuuguauuuucaguagagacggggcuucaccguuguuagccaggauggucuugaucuccugaccucgugauccgcccgccucaggcucccaaagugcugggauuacaggcgugagccaccgcgccccgccaguuuuuuuuuuuuuuuuuuuuugagacagucucacucugucgcccaggcuggagugcaguggugcuaucuuggcucacuguggucuccgacucgcagguucaagugauucuccugccucagccucccuaguagcugggauuacaggugucugccaccaugccccacuaaguuuuguauuuuuaguagagaugggguuucaccauguuggccaggaugguaucaaacuccuggcuuagauggaggcuuagaugauccgcccaccucagccucccaaagugcugggauuacaggcaugagccaccaugccuagccaccaaguuucaacuuuuacacacauugacagguacuggcaccauccaugccuggcccuugguauuucccuagcucccuaccgucagcguagaugugaacaaaucucuuuuuugaguagcauaagccuaaaauucccaaaaggcccauuacuaagaaacuaaguuaaagaugcaaaaacucuuaaaaagcagggaaaugaauuuauaaaacacgauuucucagcuaaauacaaucaaguucuuuuuuuuuuuuuaauugucugagacagaguuuuguucuuguugcccaggcuggagugcaauggcacggucucugcucacugcaaccuccgccucccggguucaagcaauucuccuccucagccucccaaguagcugggauuacgggcgcuugccacugcacccggcuaauuuuuguuauuuuuaguagagacaggguuuccauguuggccagacuggucugcaacuccugaccugaggugauccacccgacucggccucccaaagugcuggcauuagaggcgugagccaccacgcacggccuaaaaucaaguucuaagaagccuggucggcacagccagcuucccagacauccacaaacuucagcugcuaucugcgugucuaucuuuacccuccugagucugguuucucuauguuauaccaauuaacugaaaacugccuuuuugugaugcuuaguuuauccuaaaccuaggaaguacuugggccgacucacucucgcagucacaugaaucuccccucacccugaccucaagccucagugccacuagggagcagggcacgaagaagagcacucaccuggcugucagucagugggagccaauagaugcagggagcugccuuggucuuucggaaaaggucauccagcagcuuggcaggugguuccuccugggcuuucucugagguggaaaaaagugaaccagauaugaugcaucugacccucugucccaucccaucugggucccuuucccaccuacuaguggguaugcguaccccauagcuaaguaccuaccuuucuucucacucuucuuuucuuuagacuucgcacguuccuugcggcggcggucacgggaccuugaucgggaacggggcccuucucgaacuuugucccgaucccauucacgcucugaucgaguccgcucccgccgcuccauuucccguucccguucugcccacuguucccgcacugcccguuccugcucccgcugcucugcccgggggugcugugguggcuggaccggggguggggguggggggugcaggggccgugguauucccugcuccucugucuuaguuucagagggacgguccaccaagaggccucggugauaauccagcuguggggagaggagggacaaggacaguuaggauagaggugauaucacucccacucaaggagccaggauggccgggcgcgguggcucacgccuguaaucccagcacuuugggaggccaaggcggucagaucacgaggucaggagaccgagaccauccuggcugacacggugaaaccccgucucuacugaaaauacaaaaaaauuagccgggcgugguggcgggcgccuguagucccagcuauucgggaggcugaggcaggagaauggcgugaacccggaaggcggagcuugcagugagcugagaucgcgccacugcacuccagccugggagacagcgagacucugucucaaaaaaaaaaaaaaaaaaaaaaggagcccagguaccacuuugaagccccaugguacaauuaaaggaaccaaagccagggaagaagagaaaagaacagaagcucagagacugcaggucuggcaaggaucucagcugaaaucuagcagauaauggcuuccccugccccuccucucuuuccucucccuagguuucuuaccucaucuugcucggcauagucagcacaaaggaauuugggauuggacuggggccauuugaccccgugcagagcugugcggguggcaacagcuuccucuacuguugaguacugguggaggaagggagaagauggagggucacagugugucugcaacccuucccacgugcugcaacacccuuaaaccugcccacacuggucacaaaaggaaauauaugccaugaccuauagaaucagcuucuuccccucaccguuacaaagcaaugagauuugaucuugucaauccagaaggccucuuccaccaagguuccugugcgccccaacaacuccuuuagcuggccuaaagugaaaggacggaccugccaaugaaaauagacuuucagggucuagcagaaggcaagaccaccacccaaucuuuagauuucccgagcugcugucacaggaguauaguuucaagguuugggggagggcagagaguuuaggaaccuugcaguaagaaugugagaagagugguggugcuucccagcacuaauugagacguuguaugugaggccuucugcaaguccucaaaacaacccugcagggcaacagcuuuucccccucauuuuuagauggguaaauauguuaaguaacucacucaagaucagugaguaacuuaaucuauugguagaccaguucaacuaugaguggaaccuaggaggcauaagccuaaagcucaaacuuaaccacuaagcaagcugggauggugagaaacaaugacuuaccaaauuggagauauggacaauguugcuaaucuugccccgggguggggagggcaccugggcaguucggacugggucaucaaugguaauggaaacuccggacuucugcuggcuaauggaacgucgaguuaagguaucuccuaaagucacuaucaagaagaccacaagaacagcuuuugguaggaagcaauacuggcucuuuucacccucaauguaacucucacgguucccuuucuuuuauaccaagcagccacuccuuaaucuaaacgugcagagcaccuauaaucugcaaaguacugugcuaggcuaaccuccucaucauggagauucaaagauuaaacagagucaaaucuggcccucaaguagcuuacuuaauauguaggagaaagauaugauauacgaaaaaauauaaugaaaggcaggaaacauucaaagcuuucagcgauccaaaugaggugcucugagaauucagggagccgcauuacauuucucucacaauaugucacucaccuuucuuuacuucaugcucugcaggugggggcaaggccaccucuacugacaccuggggagguacaggagguucugcuucagguuccuucucuucuuccucuucuucccucugcccauucuccuggcccucugcagguacuaccuaucaaggugucagagaacacagcaggucuguuaaacaccaaacuggcauauucuuuucagccucugguuccccgguaagaguagcagucaaucuagcauguuccuuccgcuagggguauuucguuaucggcucacuucuaccagauccugggauuguuagugccucaacuuugccuugaggaaaacuaagacaggaguuaguaaauuuuuucuguagagcaaagcaguacuucagguuuugcaggccacauaguuuguugcaacuacucaacucuggugauguuguagugaacaaacagccacagacaaaagugaaugaacucgugugguuguguuccaaucaaacuuuauuuguaacagguagccagcuggauuugguagucugaccccugaaagugucagucaacccaacccucugcacagacagggaaguucccuccaaagacuuuaucucagcuccucagcuagcugcucugcaucuacugcucccaccuuuccccugacacuggggugcagaagccuuaccugagugacuguccggcauauuuucagccccuugucaugggucccaucaucgccauuacgcucugucucauccucagagaugcgagagucaucagcaugaagauccacaacagccuccugccccgccagggguuugaugucggggaugaggcucugggacacagauaccccccaccccguuacacugggcccaugucuacucccaccuuaacaggucucauccucccuucccuggcuccucccaccucaccuuuagugauucaguggugauacugauggaagguuucuucugugugguggcugugcuggcuccccagcgucguuuccgaccaggcuggccccccucugugucacuguuuccagcuggcacccccuugguagcugcuguccccaagaaauagacccaacaguuagauggucucaggaccucugcuaguucaaaccguaauaccuacagguuaccucuggcuggaguuuugguaaaagguuaacuuaaagaaaucauauuuggaggcugagugugguggcucacaccuguaaucccagcacuuugggaggccaaggcggguggaucacgaggucaggaguuugagacuagccugaccaacauggugaaaccccaucucuacuaaaaauacaaaaauuagccaggcguuguggugcaugccuguaaucccagcuacucagggugcugaagcagaauugcuugaacccgggaggcggaggcugcagugagccaagauggugccacugacugcacuccagccuggugacagagcaagacuccgucucaaaaaaaaaaaaagaaaagaaaucauauuugggaacuggggaaaccauggcuucagacugaacacugaucuaaaagcaguaagggagggguagcuaguuugaugagccguuuaaacuuuuaaugguagacaguaauaucaaguaguguggaagaaaaacugagaaggacauguaaaugcagaagaaacaagaacacuaugugauacuaacaucuaggcagaacuaagaucaugaugggaucuggucuuccuuuaauuuucacacuacagauugauauuuaaguuauaaacaucuauuauacuuuuguaaucuagaguuccucauuggggaaaauguuaaaauuguuacuguuugagguguggggcacuuucauuuccuugggugcucucuuagaauaacgcauaaacaaggucaggcacgauggcucacgccuguaaucccaacacuuugggaggccaaggcaggcggaucacaaggucaggaguucaagaccagccuguccaacauggggaaaccccaucucuacuaaaaauacaaaaauuagcugggcaugguggcgcaugccucuaaucccagcuacucaggaggcggaggaggauugcuugaacugggacccggaggcggagguugcagugagccaaaaucgcaccacugcacuccagccuaggguacuacagagggagacuccgucucaaaaaaacaacaacaaaauacccagaauaauucauaaacugcuaagcaucacauaggagucccugaaacucauuccuuguugaguauucagguaucugaaagaauaaaugccucuaaggcuaaaugggacauggucucagacaccucacacuguaucucauuaaaaugugacuggagcaauaugauggggauugucucaaguuuugaauuccaaaaugaaacccuacauaggaaaggauucagauuugcuaggcacaagggguggggcaggagggagugacccaagaaugccauugagaaugaaauucugguucucaaugaaugcugguuuuuaugguauuccugacuuuuaucagggauuuggggcuggacuuacagacaacggagaucuuccucuugaaugauuugggcagcgagcucuguaugaagaagaaaaaggggaaaaaaaagagaaagagagacaccccacagagaggggggaaggagguuagauggggcagucuuagcuuagccuccaaagacacagauagagugagagagagagacagagagagacacagagacagacagagaccaaaacagaagcggcaaacggcaaaaacgaagcagaaucaaugcaaguuagagaaaaaaauaaaacuaaacaucagagcagggaaaagucaucuacuccguaucacaccuguguauuagcuuaaccagaaauaagcuggaagaggaguucaguagccucucagcccccuaaagauguuggucauacccccucuuucaccgucugagucgagaggacaccaagccaaacaaacugugccccaaacugggucaucuaguccucccagguccuuccuugcuaacucgaggaaacaaggaaaaccaacuuuggauggcaacuucaacaagguaacccuccuuucuucaauggccagacugaugcccacugacaauggcuuugagaugcuuggacagcagacugucaugucaagacugcccagacccccaccacacuguggaaaagggcagcaccagacccacuggagaugaggcucuugagccaagugcuagcaaaaagaacucaaaggugucuuugauaaaggaagguuuuuaugaagggcagauuguccccaaggagauccuuagacuuuccagccaccgcagggagcuccagcagagucuuacuguuuccucuccaaccagggcucaagccuuaggggcucugccaaagaccagaagacaucuuugggacaagucucuaccccaaacacucagugggugaaugacgaaagacuauggggggcgggggagaaaagugagagagaaaaagggaauagaguauuuucaaguguaggugcuuauuucuggaaaaacuaagaccacucuaccacucuucuaaaggguagggcagaaaccucgugaugaaaucccuuucccauccacccccacccgcagccccguuugugucgucuaaccaagucuccuuggucucuguuaagggccagccugaccccuagcugggccgcucucgauggguaaguuagugagaaaaacaaaacaaaaaaaaaggucuuaauuaaaacaggaaaaacaugaaccaaauaaauaaauaaaagaaaucagaaaaaauaaagauauagaaaaaaauaaaauaaaauauuaaaaaaagaagaagaaaauaaagaagaaaauaaacuaggaauaugacaaauguuccagguaccaucucacaccugggaucuucaguucagccaaucgcaccucacuguguacuguaucuagucaaccgccgguccaaucagaaugagcccucccugcuaggcgcugugcaauuggugggggguuggguuggcaaaaaaggugggcgcacggcgugguagucagcacggcacugccagaguccucccaggggcgcagggggggcgggagggaaacguguggggggacgcugcccaguuuccaugaugucaagacaguucacuggcgguggccaggcucagcgagggauagaggggggaaaggggcagagacaucaguccuggcccugaagggacaucaucuugcagucccugaugagauggccugugaguagcaggaaugauccuugccuuuuaucgugagaggcaggcaggacccuauguccaccaguggcaagcugcagcaauaacaccacccaauacuuggaauccaggugaugacuccagagucccuuucuccucugccuguaacuggggaggggguccucucaccgagugggaucauggagccucugaugaagguagccuggggguaggugaauaccccaggaccuggcagacauucagcagcaaggucagaauacuucucuucggagaguuguggcuggcaucuccucagggacuccagcugagacagugguuccagucagguggaugaaaugagucccugccuccagggauggaggagaaguuggagcaaccaacaugcugcccuucaccauggacaacagggaccaaaggaaaguccaucugaugagcaaguggugacacaugggcugggcugucaucagcauuaaauccccaggggcucagacccuagacuccucugcacgguuccuagucgucacagcuuaaguagagggucccacucaguguuuuacagcauggcacugcgaucacaaacuuuaggaggucuuggugcccuagauggggaucccaacagucuguagcaaacaaggcaacccacaguccucaaaagggcaagggcaugugggcaggcgccccagcacuggcacaagcucuucuuggggugucccaaguagggagaugaugcaaguccaccccuuuccaaauguuuuuugcuugcucaauacaagucucuccagaacaguguucuucuuggcccccugauguaagcaagacagggaggcaaaagggggcccaucacaggagcccauauacaugccccccucuggccaagacaccuggauagcagacuuggcucugauugggcagcucaguagcagcggguggguccagaggaagaggcggcaucagcgauuggccaguugggcaggguuauauuuuacgggcggauuaccguacaugagguacuuggacaaaguuuuacggggaagaaggaccuuguaauaaauaauauucugcacaucaaaucacuuucaccggcccccacccccgcaacacacaccagaaaaaggcuacacacacaacagucccucccaccuuguuaccccucuccuaaacccagcucauucuuucucaauuacuuuaagagccaagaagacuucgcuggcucugaugggggaagcccccugaagugggugcaggacacaagauaacauaugccaaaaaaggagguagaggggucacagguaacugagaaugggccuuccggaucacaagugcuggcuucuaaguagcuacaucucugcagucagaccacuggagggcagaggaggaacaaaaauuucucagcauggcuggucuggugagaaccaccaauguccacuagauggcguugggcuccaucaggcuuuuaaaaaggagggaaagcuaaaggaguuaccaccaggagaagcuugggaagacagcaggaaaagcugaacauaaaucuuagauaaagggccauuaucagacuuucccguuaguuacaaacgucuagagucugggcacuacuuccccaacaaggaaaggaaaaugaaugagcccuguccccgucacaaggggucucccuugcuaaaccagcgaauucucccuuggcccuauucugauccaagucccugccucaucccuccuuuaaguuaacccaccguguaagagggaucacuagagugcucuacucuuuccccuagguccauuccugcccacccgccccaauagguggcuuggauguuuaccucuuucuucuccucaucuucaacacugcccuccgggcggucaucauugcugacuuggucugcaauaggcaugggagguucuggaacaucauuuucaggucuguuuucacuuguguccauggucacuuccuccuucuccucacugacaggaggggggagugguggugggggggcgggcagaaaagaaccaaggggaagagagagcaagauguuaguuacugggucaggaaacccuccugccucaucacuugggugggauuaggagggcugcuuuucugaucaagguuagagaccuugucccaaugggaaaagugggaaauagauuuuccuuggggaaagagcguggaucacagcaaccacauccaccuauugcccagaugaguuaaaaguugucauuugugggguuaggacuccaacuauucucagguaauaacucaccagaguacuccuauaugaaaggagaaaaacccuccucugaaaauagucccacaaaagugacugugauuugcccacaacccuguggccucagucucccuggccaaaggcaccuuuauauggcaaaauugcacgagaaacgaagggaagcccgauucccuuaaaaagacaagaaagaauggccaaggcuuuggcaaaaaagccugaccuguguuuaaucaacugcuuaauaaguaaaggccugcugauccucaggaucuggagacaccagcauggagaaaauggugggggguggggggugcggggcggggggugggagcugcagggaagaagcaggccuggugaagguucaagcuucaaggacccucucucauucaaaaggaaaaauuaaaacugcugaauugaguaugagagcucagagauuagggccacuuuuaccugcucagagguguagaaacuguuccuacauucggcuuucacccaguuucucccacucccucauuccaacuuccaagagauaaagagagcaggccuccuagucaggacacacccucccccacacaggcagcuucccccaagaacaccaaacccacucucccacucuuaaucucacaaguuagcucccauuucaggcaaagaaucccagagauucacuucagauaaacuaucuuuccaccuuugauuucugucuucguccccaacuucuaucucaaaucucacccccucuaccacccaaacaccaagcaaaaaaaaucaaaucaagaugaucagaggccuaaggcucaggagaggggaaaccaagccucccaggccgauaaccaccaccagaaaagucagcauucccaacaggcugacugacugacacucagaggucagaagaaccucccuagagcagucaagaagggaugcacuagggggguuagggggaggggaaaaucggaacugugcccccagcuaaacaggcccccagagaaacacgagauuuagcugcuuacaucuagagaaaaggcuuauacaaaaaaaauaucuauuucccauacagaaagggcauguggggccaauuagaaacugggcaggcaggacaaagggggaaggcagaaugacugaaaacaaaccaaaacgaaagacggaaugaaagccaugaggaagagaaggaagacgaagggagcuagggcggcggggaaaaggcauacauggaaaugugaagcucucacccuucuuugcuuucugauaacaugauuuuuuuucucccccuggaagugcuguuuaucccuuucuggaauggaagaaauaacaaaaaccaaacaaaaaaaauccuaaaaaaaauaaagaaaaaaaaccacaccuuccuuguuccaagaucccaccaccuccuccccagccacccgauccagagagagaaaauugagauguagcaaccggggauccaaaaaaugguaaauggaaggggagguggugguggugcggggaggcuaaaacagaucuggcuuuuaagagauaagcguuaaguccucacggcaaaccccgaguucggcuggauuggucucucuggagaaggaggaagagggccaggcugcugguaguggcuggcucuauuguauuggcggagcggcagcgaucagccggagacaugcaggggagccaucuugccacuuacccagcagccugugugugcggaugggggagggccuugcugcagcaggggaggggaaagaaaagagggagggagcugagugagcaagguucuuauccuuuggcaggccacagggagccgacugcuggcuccagaggccuggccuucuuuucucaaguuacagcagcuacagaggcuuaaccccccagggcuggagugcucccuccuggucuucccagggggcaggggagggggcuggguggaggacauguaaaguuacagcugcuugauuggaagauucuagaaaauagagagaauagaaggcaggcaaacaguagaggugggagugaaaaaggauuaaauaagaacgauaaagccaaaguugaaaagugauuaaagaaggaugguaaugaaagcuggauagaggguggggcaugagcaauguuuuaugugccuaccauccucuauccaguaaucuaggcauggaacacugaaaccagaccaaccagucagaugcugcagguagggaggugggaugggaauugucacuauccaaucacuacaguaacuggcugcucaccccggcaaugaccacguguuacuacuccaacauguccuuuucccagggaugguggagggaaguggauagcagggagaguucuuuuuucaaauaccaguagaaggggggcaggguuggugucucugaagagaugacagacaacuuuguuuuauagagucuuuaauaaggucacccugccccaggguccacucgggccagaaaaagaaaggauaaacagggcaaggggaccuuggguagcugaagcuugaaggccacuucuugaagcaagggcuccaaggugaggcucuaaaguagauaagacagugaagugagagugcugcuauauggggcggggaagaucagcugggcagaaagcgacugggaacuaagcagaaaauauuaaucaugggaaucuucacuagaccaaagugggaaacagaugcuaauaguucaaaaagugcucaguagauacucaaaaugcuuauuuguugacugcagagauguuccuuuuguguccuaguggcaguagaaguuuacacuaagauaaacuucugagaaccaaagcucagugucucguguaacauuugagcuuuuaagcuaggaaugaaauuuucuccccgcugcuuaaaaucuuacacuuacaaugccaacugcaugcuaaaguggccauauuuauacauuacuuuaaauguuuccuuucacauaguggucccugucugcucaggguuaagagugaagacucuggagucagacuggcuagccccacucuguuaaaaguugugugauaguaggcaaguuccugguucuguauaucugucuuguaaucugcaaagugggcauagugacaauaccuauuucauggaacaguguaguuaaguguuagcucuuaagagucuggcuuggaggacaccccaagugaagguacagauacauguaaaauacaugcacacuuaauaggccauuaucucaucugaugccaccucuggggcucugaguuuccucaaaagaguagacugcuuguuuucugaggcaaagccauucagugauuggcaugacagguuuucagcaaugcccuuaucacucuguauaauaacugcuacuuuaucugccccccaucucuacccugcauaauuccucaaggguagggauugcaucucuuggccccuagcccagggccuaacacaaaguaauguucccuaacuauuucugaauuagggugucauuguggguaccaaguggacacuuacuaaaugcuugcuaaccuaaaaguuuucuuauugaaaaaaaaauuuuuuggcugggcaugguggcucacgccuguaaucccagcacuuugggaggcugaggugggcggaucaccagccugaccaacauggagaaacccugucucuacuaaaaacacaaaauuggcugggcgugguggugcaugccuguaaucccagcuacucgggaggcugaggcaggagaaucacuugaacccaggaugcagagguuguggugagccgagaucgugccauugcacuccagccugggcaacaagagcaaaacuccaucucaaaaaaagaaaaaaauuuuuuuaauagaauccccacaaacaauguuacaccacagaaaauguuaccuucagccauccucaaauaaaaugcucuguuuauccacuguccuaaaauacucucagcugcuaauaugccucugcagaaguggcugauuuugagaaauuuuguuauugaaaauuccuuuuuuuuuuuuuuuuugagacggagucucacucuguugcccaggcuggagugcaguggcacaaucucagcucacugcaagcuccgccuccgggguucacaccauucuccugccucagccucccgagcagcugggacuacaggcacccuccauuacacccggcuaauuuuuuguauuuuuaguagaaacgggguuucacugugucagcuaggauggucucgaucuucugaccuugugauucgcgcgucucggccucccaaagugcugggaucacaggcgugagccaucaugcccggccgaaaauuucuuuuuuuuaagaauaagaaucuuaccacguucuccuuuacccucuuaagacacaagaggcguguguuuucuauuuccccaugaucaauucugugggacccaacaauuccgaacauuuuauuuucagacaauaaugagggccgggcaugguggcucacgccuguaauaccaacacuuugggaggcugagacaggaggacugccugaggccaggaguuugagaccagccuggccaacauggugaaaccccaucucuauuaaaaauagaaaaauuagcaggguguggcagccgcgucuauagucccagauacucaggaggcugaggcaugauaauugcuugaacccaggaggcggagguugcagugagcagagaucgggccacugcacuccagccugggugacagagugagacucugucuccaaaaaagaaaaaagauaaagaggaauccuugaaacuguccccaaaauggacucuaucuacuugcaggacuaguaccaaaaccuuguuaaccaugugucagagcccaacauagcuuaacagucugugaaacugcacagaauaagcaguggggauaucuacccauaaguaaacaguacacaaagaagcccagaagaaaaggguacaacuacuuggaggcuaauaauaucacauuacaacucauaugugaauaugagauucagagaagcuaauggaaaaggaaauuccuauaggcauauaugcugaaauuuuaguuauuauagaaaauucacgaggagcugaaaaacugacgugaaaauuuaauaagaaacagugggacuagauacccucagaagcauacuggucccaagauaaccuagaacaguaugauuuugggguauauguccuuagauaauuucucaguggagcaaacucuauugaugacaacaaauucugcuuuuucaugcaucauuugggauauuggcauuguauguccccuggggaauaucaauuacaccaucauauuggcuuaaggaaccaauaccuuccuccuacacaggcagaaggacaaacaugcauuguaccaagagccuaaaacugcuauugccugcuaggucugugcauacaggaagguuguaucuagagaaauccaggucugaauuaacuacagcugaaugauacagcugcccacacaaacaaauccccucuuuucuuucuuccccuuuuuuuuuuuuuuuuuuuaaguaaaaagagaauaccauuauuuucugcuauauggggacauuuuuguuauacccauacaaggcagaagaccagaguuuugaacagcacucaacugaaacaggacugaggacccacaaauuccugcuccaagcaaugaaaaagacaccuuaccucauaaauuuagaauuccucaggcacaaucagaaucagaauggauuuaaccaaacacagcaaaaagucagucaaucucuuccaaauggugacagguccuugaagucuaauuuuuuuuuuuuuuaacacuuuacugcucuguuuuuuaaagucauaugacuucuuguugagacagacagaaaaaccaagguuaggccauaaauggucuuuuccauuuuuuuuuuuugagacggaguuucgcucuuguugcccaggcuggagugcaauggcgugaucucagcucaccgcaccuuccgccucccggguucaggcgauucuccugucucagccuccugaguaacugggauuacaggugcacaccaugcccggcuaauuuuguauuuuuaguagagacgggguuucaccauguuggucaggcuggucucgaauuccugaccucaggugauccaccugccuuggccucccaaagugcugcaauuacaggcaugagucaccacgccuggccaugccauaaauggucuuuuccauuuagcauuguugauuacgcuuucaaaauuggccagagcucuagagggcugccagacugcacacuuaacacucuggaggggugagagaccaggaaggguguuguuaaucaguugugguagggccuccagaaauguaugcaaccuucucaaagauuuauuuaccagauccaaugccuauggguuuaggcuucugggcaugcuguuuuguuagaauguugaacaacccaugugauaggcagguagaaggaaagcagguacgagugaugugugugaacugcuccucagugaagacugcauuucccuucuauacacuacuccacugaagcgggccuaggcaacaauggacaaucuaaguauuugcccaagaugccacuugccuaucaucuuauuagaaucaaugugacuaaauuaucucagucauaaaaugaagaucaaaaccaccuuuaccuggaguggggggacaggaaacucuaugacuccaagcuucaugugcccuggacuugcaugggaauguccagaaaaaaagcugcuucaaaacaaaauaaaaugccuuucuguugcuaggaucucauaaacccacagaauuuuaaggcuagcaaagagcuuuucagaaaaucacuuucuucccaaggugcaucggaagcaguuccucaggcccaauuaguagcaggcugucaauacccacuucaaaacugccauuucacaaaggacaugcuuuuguaaaauggaauguaaaauguaccuccauggaauugggaggaggggggcagguauuaugucugguugagggauauggaagagaaaaugucaccccauuuccucaucgaugauguagcuggggaauccugaauaccuuccagaauccgcugaguuuucacuuuauggucccagaagaaaaacccuuuuccaaaggauagcguacccauuccagaagggaaaaaccaaaaaauuucaaaggaaguagagugaacuuuuggcugccaaacaaaaaauguuaacagccacaagauggcagcagagguaagacugucagaaucgacaaggauuauaccccucagcaaggguauacccccagguaaaagcuauauaguaaggucuauaaaacuaucauuaaagucacaggcaaaugagauaaaucaugucaccugcccacuacccuccaaaagucagaguuaaaguacaguuugaagcucucagaagaguauaaauuauuagacaauuacauauaggggaaaucauacugguagcauuaguguuaauauggcauaaaaacaaguauagaauaacuuuaggcuaacagucuacacaggacauucuacaaagcaguucaggguuccugaugucuaaaagcuacgcaaucuuauucccauaaggcuucauuuuuucauuucccaggagacuuugaagccaggaauucuggcucauuggcuucuuaauuuauaauaccuaucucagaagaaugaaugacauaccuauuuaauucuaauuuaaccugauaugaguauuucucuaggacuuaauauaaagauuuuaaaaacucacauuaauuguauaaauuuuaaguucaaucaaauggucuuaagggcccaggaacaaacuucugacuugaaaggaacuucauaauuugcuguacuguaugcuguaagaacuaggauauccuagcagaacuaggauagcuuaaugacagguaguaacuagggaacuagggaaaaugcacaaacuaaaaaauagcacccagcugugccuuuauuaagacccucaauauccuuuauuaaacuggguuccuagguaaacaugaguuaaagauuaagaugcccggagucaauucccuuacaugguuuugaguguggaagcagaagcuucuauugccuaaaucuuaaaggaguugacuauuuuggcuggaugaucccaggugaguuuuccuugugcccugacgaccacuuuucagguuaccuuaaagguggcagcucccaacauaguaacugaagucuagccuuuguccagauaaagcucugccuuuauguuuuaaaaggaaacuaggacugcuuagucaaagaacccuagggagcgaagaacuaucgcacacucauaguucccuguuauaccccggucgagauauaucacuuacacagugugaugaauucuuucugauucuggcagaugagaggucugagucucugagguuuggggcuguguggcagcugguggcucugccucuucagcuucacacuucuuugggcuccccugucaggagauagcaaaaacgaacagagcaaaacauuuagaucugcuugguuccuuuucuucuaccuggagccugaaaaaggcagggcaggacauacacaguaccagcuccacacacggcccucuguaucuguuauuucauuuuagaauaaggaaaggaacauggcuuaaaaauagguacuucaagaauauuuaugccaguaaucauuuuaucagaauuuuuaauuuuuuuccuuuuccucagugauccuuguucugacagaauucuuuuuugagagaacugagaaaaggcugacuuccuuuuggcagauaaaaggaggaguuaugaggaagaauugacccugggggcccuggagauaacccugcugcucagccucauguagaacuucuacgaaccagggagcuggaaaugaguuaagcaggauuaacagguauccaccacauuucuacugaaccuuguccagacuuaacuuuuuaguuuuauagcaaagacaagagggaagaucuugcuuaauccuccaucucuguguagggaggggucacaauagccuacccgcucaggcuguaaccucugggucacaugcuuuucagcugauucaggcugacucagacgccuugcuuggacagaggaugaggagguggaaguccucuccuuuggcucacagaccugcaguuguggcacugguggaguugcaaccuccugaccagaagagggaucuuugguuucaguauagcuggugcugcugucccuggagacuccagggcucagagacuaaaacaaaaugaaacacauaacaaggaaaauuauuguauaugguauauauucaguagauugcugaguuuuccaguuuccauggaccaaauuuuauacucuggaccuuuuugucuguguuuacucccauuuugucuguguuuauucccauuuaguggucuccuugaccacuuauuuaacaaauuauuaaguuuuaacuagaugcuagauccugggacacacacguaaaagggcaugcccacauccucaagaaguuuccaucuaguggaggagaugaguacauaaauucaacauucuaucaagggacucaaaaugaaaaagaaccccauuucgggaaucaguuaauugaaaauacgauucugaaaugaggagaaaguaaucagugaaggagaguaaaggaggcuuuuccuauuccuuucagaaaucaugacaggcucuccaggggcugaaaugaaaaccacuggaauaugacagaacauuaauacacccgggauucucucauacucacuuuucugcuguugcuugaugcugaacgagaacgugaacgugaccuugaucuggacucugauguugaucuggagcccaucuugggucuaccacgaggguuggcaugaguacgugccugggcuacaucucucugcuuggaucugagcggugaaugagaccgagaaccugaacugucaggagagcgagaucuugaucuagaacuggaggaggaagaugaggaggaccggcuagaggaugaaucagcugacuguuucaaucuguggcuugggagaaggguaugagaagcucuucugccuuccuucuguuccaaagauggcuguuucagacauucuucagugauuccuuuggccagugcuaauuccucaauuuuuagagggaggggcugagcagaucugucugacucagguucaagauccuucugggcugaguagucagccagugugcuuuucugaaccagaggcaggacacucuccucuggcacuuucucugcuggagauucugcuuuggugucugaaggacuugacaaaggagacaggccuccuaccaacuggacaguaugcugagauacuaauagcucccuggugucagcaucuguauuaggaggagauaacugaaugaggacagcgggggcugggccuuccaugggcucuauuucuucuucgcuauggagcuguggaugaggugguggagaagaugcuuccuuuguuaguaaagguggaggagucuccuccucgcuggcaguuugcucuggcagcgcuacaagugaggccuucuuucgaucuucagucagucgaggaggggaaggagacuucgauuuuuccuuuaagccuugugaagauuuuauuucucuuucuuccuccucaaggggagauguuguuuucauuuccuucuccugcugcugucuggccagaugacuuuuucuagccucuuccugggaucuuguaaaucucccuccucucucuaacaccuccuguuccugggaucuuguuuugggucucucauccaucaucuccucugguuuuacucuagguaucucuuccccuucuuccuuaaacucuuucaggauuggugccucccuagauuuuugucccucaucaucaccuuccucuucuucaucaucuucuuccuccuccuccuccuccucuucuuccuccucuguuuucaaauuucgaucugcucugacccuuagguuucuggaagguguuucuugauccucuuccuccucagcagguuggcugcccucagacaguuuagcugcucuugccugaaagaacagauacacaauggcuccaaauguauuugcucacagucaacagaggagagaaaguaucuaaugaagacaccccuaggaaggagaaauucaaugauauauacuuucagcaacagaaacaggagugacaggagacaaucaugacuaacguagcccuuaggggaaucaaaacaaagugaccaaaagaaauaucacaaugaagcuacuuguauguaguuuaaauuuuagcuucaagcacccccuuuuuuuuuuuuucaguaaaauauuagcagaacaucuggaaaguaaaaggguggauagggggcugaaaggaacuaaccuacuaucaauuaauacgauuaucuuuuuaucauuuugguauauuucuuuuuguucuuuccucuaaucauuuccuuuguacagucauaauuacacuacacauaacauuuuuguauucugcccacuuaguguuauauaacuuuaaagcuuugauugaaugguuaauuaugucauaucuugucuaauaaugugcuuuaagaauacagagcagccugcuaauuuucaaauuuaaacuuuuaaaaaauauucacuuagaaaucuaaaaggcagagcagaucuaaauaaaaagacaaaacgaacaacaaaaagaugacaaagaggagaaggaagauaaccacaaagaaaucuagaggccaggcaguggcucaugccuguaaucccaauccuuugggaggcugagguggaaggacugcuuaagccuaggaggucgaggcuguaguaagcugugauugugccacugcacuccagccuaggcgacagagccagacucugucccaaaaaagaaaaacaaaaccccuaaauguagagacauacaaacucaaaacaagucugaagaagagaagauauccaaagcauuacugaagagguaaugcuuuaggagguaucugaguuaccugucugacccuagaugaucgucuuucuccuuuccuugguuucucaucaucagagucaccuuucucuucagaaauugaggagcuuuuuccuauugaaugaaaaagaaucaagucagauucaugaagugaagacucauucauggcuuuuuaaaaaucaggcuuucuaauauccaaccaauuauagcauaugagccuaucaagacauaucuguaucgguuucuuugacuucuacacuaaagaaaagacuacaaaaagcccuaacuaggucagggucuuauugguaauucuuggugugcaagucuagaauauuuucaacaccucgaagccaauucacauguuauaaauaacucaaauaaauguaaaauaauuuccaggggcuucaaacugucuagcagggauguacaaauaugaaguguacuuauuucuacaaaguguucuuacucugaauaaaguuuaagacuucauuauguucuguauccauuuuuuuggauugccuauuacuacuacuuucuaauuucaaccaaaauauuaugaugaaauauaugaauuugcacaauaacaaacucaagaaauaaauacuuagaggaauguuuuucagcgcccuaaaguuccugaaauuacuucaagccaacuggaugggguuucagaauuggguccugucuauuagguuuuauguauuagagcucaauauuuuuuuuuuuuuuuuuuuuuuuucugagauggagucucacucugucacccaggcuggaugcaguggugcaaucucgccucacugcgaccucugcccccuggcuucaaaccagucucaugccucagccuccugaguagcugggauuacaggugcccaccaccaugccuggcuaauuuuuguauuuuuaguagauaugggguuucauccuguuggacaggcuggucucaaacuccugaccucaagugaucugcccgccuuggccucccaaagugcugggauuacaggcaugagcucacauguuuuucuuuuuuuuuuuuugagacagaguuuugcucuuguugcccaggauggagugcaauggcaugaucuaggcucaccacaaccuccgccucccagguucaagcgauucuccugcuucagccuaccgggcagcugggacugcaggcgcacgccaccauaccuggcuaauuucgguauuuuuuacagaggcgggguuucaucauguugccuaggcugguucgaacuccugggcucaagcaauccccccgccuuggccucccaaagugcuggaauuacaggcgugagucaccgcacccggacuaggugagauuuuuuuuuuuuuuaaggaaaaaaaaaguucuauuaaaaagcuuggaaaccaccaaucuagguuauccugaacaauaaauccauguaaaacggaaagaaaguuucacucaaauuccaugaaggaagguaacuggguaaaucacuuaaguaauuugggucucaauaucuuucuuuuuagacaguguuuuacucugucacccaggcuggagugcaguggcaugaucauggcucacugcagccucagccuccagggcucaaguaauccucccaccccgguccucccaaagugcugagauuaagguauaaaccacugugcccgagucucaaaugucaugauugagaaaaaggaggggcugcacuagaugauuuccaaauuuccuaccagaauuaagaucaacuaggcggccgggcacgguggcucacgccuguaauccuagcacuuugagaggucgaggcaggcggaucacgacgucaggagaucgagaccauccuggcuaacauggugaaacccugucucuacuaaaaauacaaaaaauuagccaggcguggcggcaggugccuguagucccagcuacucaggaggcugaggcagaauggcgugaaccugggaggcggagcuugcagugagucgagaucgcgccacugcacuccagccugggcgacagagcgagacuccgucucaaaaaaacaaaaaagaucaacuauguacaguagcaauacuaacaucaaugagaaccaguuuagaaaauagcaggaagauaauuauauuccagauacuugaucagcuagauuggacucaauguuaauacaguacaaaagguucuguacacaaaaccauguuguauaguaauagugcaaauaaagcagaugguaugcagcucuaacccaagaucuucucucuuauuuuuuuuuuuuucugagagagagucuugcucguugcccaggcuggagugcaauggcacgauuucgguucacugcaaccuccgccuccuggguucaagugauucuccugccucagccuccugaguaacugggacuacaggcgcccgccaccacgccugguuaacuuuuguauuuuuaguagagacgggguuuugccacguuggccaggcuggucucgaacuccugaccuugucauccucccccuccuuggccucccaaagugcugggauuacagguguaagccaccaugcccggccuucucuauuucuauauccuuacaaucuaaaaugaacuaggcgaaugcuucuguaauaauaauuaaaaaaucaaaaugaggcugggcacgguggcucaugccuguaaucucagcacauugagaggccgaggcgggcagaucacgaggucgggaguuugagauuagccuggccaauuagguaaaaccucaucucuacuaaaaauacaaaaaaaauuuuagcugggcgugguggcguacgccugcagucccagcuacucagggggcugaggcagaagaaucgcuugaaccugggaggcagagguuguagugagccgagauggcgcuauugcacuccagccugggcgacagagcgagacuccaucucaaaaaagaaaaaaaaaaaaaaaaacccaaaaugaaacuaaugaaaucaauuagaagacuacacauauuuuguaaaacuuuacuucaugaucauuugauuaaaaggaccucugaguauauaccauuucguaucuggguaagugaagaaagauuuguguuaugguuguucauacaggauauaugauuagaauauauagugaaaggccagacucuuuagcaaacauuugaagacaucuguaagacaguagugcagugaaaugaaauacucauuucauaauucagugaucugaaauaggcuaaguuauaaaauaaguaaaaccaaaauaaaaaguuuucauaaauguuaggcaaaguuccuucacaaguaucagugaaagaagcugauuuaucucacacacaccaaaaaaaaaaggcaagugcaagguuggucagagauaaauguguuaaagucaacgcugggcgcaguggcucacgccuguaaucccagcacuuugggaggccgaggugggcgaucacgaggucaggagauuaagaccauggugaaaccccgucucuacuaaaaauacaaaaaaaaaaauuagucgggugugggggcgggugccugcagucccagcuacuugggaugcugaggcaggagaacggcgugaaccuggaaggcagagcuugcagugagcagagaucgcgccacugcacuccagccugggcgacagagcgagacuccaucucaaaaaacaacaacaacaagaacaacaacaacaaagucaaauaacugaguugcaauuuuaaaauuaguauguacaagcaaaacagccucuuuaucuaccuacugugaauuauaugcuauuuauugaauuauaauguuauuuuugauacuguaaaacugcagugauaggauuucuggaugauuacuccucuggaagaacuuguaguaagucaucaaagagaucuggagaaaugaacagggcuguucagaaaguucuggucaucacuguuuugcaauaaaagcagaaacuggaggcgccucagacaugaaacaagaaauuagucagcaaugcaaaauauaaagagaugaggaaucucuaguuccuuggaaagagcugaugugaugcagacaaacuucugaaaaaggugauaucuucuauuauaagaacauggccacaaugaaugucuuaggccagauguuaguaacacguguagacagugagcgcuuuagcuaaggguggagcugauacugauaacaggcuaauaaauacauuucaggauucgaaaaacaagucaggguaaauauuagauuuccaagaguccaaagccagaaggcuucacagaaaggaaaaggcaguugcuagacaaugcaggauauauuaaagugcagaauguuuaaggguuauagaggaaauaguucuucauccuagaaaacaaauuccuggguaggauuugugggaccaaaguaaggaagccagagaucgaagaaaagccuguggcuaaaagguaaccuuaggugugaauaagaagcaggaaugaagagaauacagaccuggaaacaaugccaaaccuaaaucugacucauguuagaccuguaaguaaguuaccuagcauuucucuagaauuuccgcauccagguuuuaauauggagaaaacggaaugaggggcauacucuauaagccaaaggcuggcuaaaaucaccuuuguuaaagaaucaauauucugaauaugcauuuaaaaauguauuuucuuaguuugagcucuuuuugaaaaaauuaaggacgguaagaauuucuguacacacagucaugauauagaaggaaauucagacaauuuaugacuaugguagguggauaaugaguccuaacaccuuagaaauaucugaagaaagugauggagacauaagagggaaagucagacaggauuuuauaaaccaauuauuucuuugagacaugguuucacucuguugucugccaccuugacugcuagggcccaagcaaucuucccaccucagccucccgaguagcugggacuacaggcaugugccaucacagucagcuaauguuuucuauuuuuuuguacagauaggacucacuauguugcucaggccaaucuccugggagauccucccaccucagccucccauagugcuaggauuacaggugugagacaccacaccuggacaaaccaauucuuccuuccuauuuggaauuuugccaauagcauauaaacaggaggaugcuggaauauaaaccaaagaucuugauaaauuauaacacugaaaaacucuuccuucaguuagucauucauaaaaugaauuggucaacagaaccacucagggacuuuuuaaaaaauguagagccccaggacucccauuccuugagauucuuuggguaggggccaggaauccauauucuuaaacauaguaauauuaaaacaaauaaaaaaucucccucaggugccaguagcguuuagaaaaauguuaguaggaaacuuaaucaaaaauuguuauucaagagagaaccccaaaacauucaaagccaacaaauaagcugccauugcaauggcauacuggcauauggcagacugagauucuauaccuggaagaaucugauuucuggacaaacacuaggguuaaugcugauucaacuaagcacugauagaauuccaaauggccacuccauucaggaccuuaacuaaauuuuguacaacaucuauaaugggauucuuaucuaagccaagaucagagguagaaaaguuuauggcauaaaggacacugaagagcauuuacggcaauuaugagcaguacucuacaauuuaccacauucauauuuuccaauuuauuuuucaccuuuuuuuuuuuuuaacgucugggguuuuuuuuuuccuccaucaaucauuagccaugggcagggucuuacugaugacauaaagcacugaaaagauuggcuacccuuacucuaaaucuuugcuuuugaaaucuauuucagaaaucauuucucauuuucauuucgaauuauauuaagaacugacagccucucuuuuuaaagagagguccuuaucaaaucaugguccuauuaagaauuuucaaugguucccccauuaccuauagaacuaaaaaaaaaacccucauacuuacuggccuggcauuuaaagcccucuguguaucacccucaucuaccuuuuaaauuguuuugcugacuauucuugaaugugaaauacucuacucuggcuagauuagucuacuaccucuccuuuaaaaauaccauuuucauuccuaucucucugacuuuguuccuuccuaaaaauaucuucuuguauccucucugccaaaccauuucuaaggcucagcucaaauccuguaucuccuuaugaggcuuucucuaaucacuguaguccucagagcucuuccacucuuuugguucccuaugucuguaucauugucacauacuaucuucuguuguucgauuuauguguaauuguucucucuuccuaacagacuuuaugcugugcuaacucccaauauacucucacagagauauguaugcaguaggaauucaauaaauuuuuuuuuguuuuaugugagaagaaauaccgacaauuuuagaagagcuuucucuuuccucucggcuuuaaaaucaagggggaaagggcgcagggagcaaaguggaucagcugagggucuacuacucucguauuucaggagaaaagaggucccuaaggaacuuaauaauuccaaaguauuggccaguauuuucuuacuaaaagauuucuagaaaugucuuucugggucuaagacuaggaucaagaaaaacagggacugaguaaaacaggaccuuaaaacuagacucaaaggcucucuauuuucucuagccuuuuggaaaauuucuuucccaccauuaaaugucuccuaaaaaaucuauuuccaugaagagucuaucgcugcucagccuuuuaacuaaaaucaaguguaguccaugaaggaauucuguauuaaucagaagagcuggaaaccuccauacauccuaaaaacacugauuaugguggauuccgcaucccccucaacacuaauuauucaaaauacuuguuaaguuacacauugguuuaacauauguacuaacaauccacaugucuuauauacauauuaaguaucccuuuuccaaaaugcuugggaucacaaguguuuuagauuuuggauuuuugaauauuugcauuauacuuucugauucagcaucccuaaucugaaaacccaaaaucugaaaugcucugaugagcauuuccuuugagugucaugugaauacucaaaaaguuuugggucuuuggauuaggcaugcucaaccugcacauauuuuccucaaaguauacugacuuagacagguaguucccaaaagacaaaggcuauauuuauagacuuuugcuugagauauuaugcaaaauugggugccuauuaugauuuuauguauuuuuugagacacagucucgcucuauuguccaggcugaagugcaauggugcaaucuuggcucacugcaaccucugccucccggguucaagcgauucuccugccuuagccucccgagucacugggauuacaggugccugccaccauacccagcuaauuuuuauauuuuuaguagagacaggguuuugccauggcuuuuucacgguuuuuccaggcuggucuggaacuccugaccucaggugauccuccugccucagccucccaaagugcugggauuagaggcgugagcgaccacacccagucugggugcuuaauauuuucuauaaugugaagaaauuaauuaaucuugccugaaccaaucccauauacuagguuagagcucccuacuauaauaugcucacauaauacucugcguugccuugcacaguagccaaaacaacuguaacuaauguccauguccucacuagacuaaguuucuuggggcugagacuuguuucuuucuuuacuauauuccucgugccuagcaugugccugguauacaacaaguacacaauaaaaauuuguugauuaaaccacagcagauacccaacuccagagggugacugaauguguuaacacguaauauacacaacuggugaagagaugaaaaagagcugacuguugccaaauucagagguagaagaguugaagagguacagaugagaagaaaaaucacacugcuucguaaaacacugagaagguaacacaauauauaggugaaagcagacuucaaaaaggguauacuuuccaugagaaacagaugucaaauaucaaugucacagaauuucccugggacuuucauggaggcuuagcaugaaaggagguguaacuaccuccccccaccaacuacgcaggauugacaaaacagcgcaguggggagggagauacguacugggcgaaugucugcugagcuccagcucuggucucuccaggcugcucugaaagucaggaggcagcagggaagccacucccucaggauggaucaucucguccuccgacucagcugaagcuucugcaaaguacagaucgggucggggcagggagggagugaaggacucagcauguaggaauauguagaggagugaaggaggucaggcaaagucacagauacagagauacauaccaaaaagagcaccguauaaaaagaaaaaacucccugggauucagcucuacuucaucuaaaugguagcuuaauuuacuuauaacucuuccuguuggcaggaauccucuucuaacaagacagucaaauuaaguguccucuucccugacaaaaguaaauaguaaaccacuuggcuucaugggcuaugaaagcaaguaaguagcagucucagccucacuuauuucugaaauugucuaguuagacaggccuaucuacuuggugacagggauaagaaugacgaacuccuuguuaaaagugacaaucugggcuuaccuucaaguucugcagcuucucgagcuucacguuccagacgcugccuaaguagcuccugcugcuuuuccagauacuguuuuaugaaacuguucuggcucauuuccucaccaaucuguguagaggaaaugaaaacagagggucuaggaaaacaaaccaggagaaugcaaagaagaacauuccauggagcaaagguccacuccuuauaguugcgcccaagaaagauaacuaaaauguuggaaggcuuuuuucuaaguuaguucuauauugaagaacagaauagccuugagucacacacaaaaaaagggcaaaaagaagagcugcacauaaguuuuugauuuaaauauucaguucccaaagagugauacugguauacaaauuacuauucuuuauuuuuauuuuuugagacagaguuucacucuguugcccaggcuggagugcaguggcgugaucuucccucacugcaaccucugccuccuggcuucaaaugauucuccugccucagccuccugaguagcugggauuacaggugugcaccaccacacucggcugauuuuuguauuuuuaguagagacgggguuucacuauguuggucagacgggucucaaacuccugaccucaagugauccacccgccucagccucccaaagugcugggauuacaagugugagccaccgugcccagccacaaauaaccuuaaauuaaaauuccuguaauuauaucuuuuaggcuaaauuccuagauuacguggaacauuaucuaaaggguaaucuaaaauuuccuuuugguaguaucaagacugaaacaugggggcucacgucuguaaucccaguacuuugggaggcugaagugggaagacugcuugagcucaggaguucaagaucagucucagcaacauggcaaaacccgucucuaccaaaaauacaaaaaggugggcauauuguggugugagucugucauccuggcuacucaggagguggugggugcagugaacugagaucgugccacugcacuccagccuggguuaaagagcaagacuccaucucaagaaaaaaaaaaaaaaaagccaguuccuccaaaagaucaaccguuaccuauccaggaaacauuuuuuuuuuuuuuuuugagacggacuaucacugucauccaggcuggagagcaauggcgcgaucuuggcuugcugcaaccuccgccuccuggguucaagacauucuccugccucagucuccugaguagcugggauuacagacaugugccaccacaaccagcucauuuuugcauuuuuaguauagacgggguuuugccauguuggccaggcuggucucaaacuccugaccucaggugaucuacccgccuuggccucccaaagugcuagcauuacaggcgugagccacaaugcccggccucauauccaggaaacauuuuaucaaacaacuccaaaauucaaguauaguauuuaaaaguaugaaaucaagagacuaagaaaagggauauccauucagcauuuagacaaaguuauaacuccauuuugucugggugaaaggaaauccuugguaacaggagcuuaugccuuuuccuauuuuuuuuuuuuuguaauacagauucccaaguugcccuucugaccuccagcuuucucuucacaaguucuccucccuagaaccuucuugcuuagcaaguccuauuuagaacugaaaaagcaaaaaaaccugaauacuuucuauguuauuagucauguuuccuaaacauaguaaagguuuauuuucaccuaaaguagaaaugagucucuuggcacucaauggacauuguugaaggguggguugcauguguauuacagaauaggcauguuugcugcacaaacccgguguuaauaaaagcaaagcuucaaagacuaacaugcaaugggcaaaaggaauacaauuaagcugauuaacuuaugcaguuucuuaugcuuguuaaaguacuuaauugaaccucugaaugcuggcuagauuaugauacuuacagcuuaaugaggugauaacaaaggaggaggagggcucucuuguuuuccacaguauccugagacuucaucuaguacugaggcugcacacuauugcuuuaacaaagacuuggauuuuuccuuuaaguauaugacacauuauaaugaggggauuuuuaaaagcugaaagaaacuuuaagagacugugcagccuaauaauuuuuggauuuuaacuguggaauaauuuaaaaauuuuaugcagaaacucaauaguuaaaaaguagaucuaaucuaguuuaagagaggaguaugagccuugcuuacuugggaaaaagguauuuccccuaggaagcuccccaaagcagcuccacaaaacccuaagagaacaguuauaaacccauggguuuagucuguuucucauauuacagauaaggaaauggagaagaccaaggccuccaaagguuguuucuuauccuaaguaaagagguauuaguaauguuuaugaguaagugcacugaguuaguaguuaacacuaguaauggugggugacuuacacaggauugaacccuuggaaaaucuacaucaacaagaguucuuaaucagcaacuauuucccuacacugccauauuggugaucuacuucauaucuauacucaaagacaucaacuaccuuuccuaaauucauggcagauaaaugacuucagaucucuguacuacacguaauuaauggaagccacaccuuucuacacaugccauuucaauuauuauaaacuaacagugccucugauucuguucuuuacuccaggcccuuguauacaacuggguugauuagaauucaacuguccugguuugagaacauuucugacuaagagaacuuaggaaaacagucaugaggacuuaagcaucaaauauacaacaccacguccuuccaugugucuggauauccaaagggcccacuccauugaauacaccuucuuucucaccugggaauuuggcuggaaugcagcaugggguguugaguguuucuguaaauuuucuagcauuagagccugguauagagaaggguaaaagucagaaaugaugaggaaaaaaaagaaaaacaaacccccaccucuaccacaaccucuaaauuaaacgcaaugacuuaaauacacacaauuaaacuguauuccuuuuccagggaccugaaaacccuuuacuaacacuguucucauucaucuucagaagacccauaaagguagccaugguuacuguuacuaaauguacagauauaaaaugcaggcacacagaaucagugaccuggcuaugucauaauaucaguaauagaaccaguacuaaaaucccuauuaucuucugcacuuucgccaagugccccuucuaaaucugaucaugcauguaaaauuacuuaaaauacucaaaccagccauggggcuccugguuuuugccugacggaauuacuuggucaaaggguuacccaguaccagggucaauuuguauaauuuccaguacuguggcaccuagauuuaucaaauuuauaaaauuuucaaagaggaagcuacagaagaaaaugaccacagacccuguaaacuguggucuaaccuagucuauccacacaaacacacacacacaaacacacacacacaaaacuaucagcuucuguauaagcaacggucugccaacucaacccuggagccaacccagaccuaaucugcacuaccugccacguauccuguugaacucuaauuaaaaccaagacauccucaucuucccuucuuuaaaccaaaccuauacacuugaaucgagcuacaccuaccucaugacaaucccaccuuaaucuacucaaaccgauucaaaauccccaauauauaucaaccugccucgccucucucaccaauauucaccaaacucuuaaccacccaaauugccacuagaugccacuaaauuagagaccucucucucaucaagucccuucaaauaaaggucucucuucaucucaccuccucaucuaaucgagcagacauuuuacccuaccccaguccuauucgugcagauaccgauaccaaccccauccaccccuucgcgcaacuauaccccuaacuccgacccagcccaacucgccccccucaggccagcaacgccguagguuguagugggauuuaacuccuucugcagcgcaugcgccgaaaccacagauacaaacaaggagggggugggggaaggaggaaggagcuuaagacacuccuggagaguagugcacacccucccauuugggcucgcgcugcugccguuaaggcgggaaccggcgcgaucuccauuccagcgcgaaccucaucaaccaccgugcgcgcggauccagaggcucgcgcuggcggccugagcgagcucgcgccgagcccggauacugcgccugcgccgcggcagaggcucgucucuaccggguccgcucuccuccgacaccccagcaacgccgacuccucaccccuuugagccgcuugaccagggcacucuucugcccgcucuuggcuaggccucgcugcuccagugcggccuucaggucggucacccgcagcgccugaagaggcuucccguccagagucaccuccuccagcuccgccaucuugcgugagguacucggguccgucccgacggcuucgggcaucuucgguaauuuccgccaacgcccuucgaacguaccgagaugaccccgcccacugccauacucuaccccucgauuaccacucagaacuccccggguuccuccggauguccucggauguuuccgucuccacaucguuaccaaucaauucuuuccauccgcccugcagcgccccuuuucucgcccugcuuucaggcucgguuuucuucgucuugccgaagcuuugaaucgaauauauucggaaacccucgacccugguauaaccauaaucggagauguucguuuauuuccggaccuagagaugaggcgcuggggcgcuug

SEQ ID NO: 17579 - RNA, 4262 nt, Homo sapiens
aaacaaggcaacccacaguccucaaaagggcaagggcaugugggcaggcgccccagcacuggcacaagcucuucuuggggugucccaaguagggagaugaugcaaguccaccccuuuccaaauguuuuuugcuugcucaauacaagucucuccagaacaguguucuucuuggcccccugauguaagcaagacagggaggcaaaagggggcccaucacaggagcccauauacaugccccccucuggccaagacaccuggauagcagacuuggcucugauugggcagcucaguagcagcggguggguccagaggaagaggcggcaucagcgauuggccaguugggcaggguuauauuuuacgggcggauuaccguacaugagguacuuggacaaaguuuuacggggaagaaggaccuuguaauaaauaauauucugcacaucaaaucacuuucaccggcccccacccccgcaacacacaccagaaaaaggcuacacacacaacagucccucccaccuuguuaccccucuccuaaacccagcucauucuuucucaauuacuuuaagagccaagaagacuucgcuggcucugaugggggaagcccccugaagugggugcaggacacaagauaacauaugccaaaaaaggagguagaggggucacagguaacugagaaugggccuuccggaucacaagugcuggcuucuaaguagcuacaucucugcagucagaccacuggagggcagaggaggaacaaaaauuucucagcauggcuggucuggugagaaccaccaauguccacuagauggcguugggcuccaucaggcuuuuaaaaaggagggaaagcuaaaggaguuaccaccaggagaagcuugggaagacagcaggaaaagcugaacauaaaucuuagauaaagggccauuaucagacuuucccguuaguuacaaacgucuagagucugggcacuacuuccccaacaaggaaaggaaaaugaaugagcccuguccccgucacaaggggucucccuugcuaaaccagcgaauucucccuuggcccuauucugauccaagucccugccucaucccuccuuuaaguuaacccaccguguaagagggaucacuagagugcucuacucuuuccccuagguccauuccugcccacccgccccaauagguggcuuggauguuuaccucuuucuucuccucaucuucaacacugcccuccgggcggucaucauugcugacuuggucugcaauaggcaugggagguucuggaacaucauuuucaggucuguuuucacuuguguccauggucacuuccuccuucuccucacugacaggaggggggagugguggugggggggcgggcagaaaagaaccaaggggaagagagagcaagauguuaguuacugggucaggaaacccuccugccucaucacuugggugggauuaggagggcugcuuuucugaucaagguuagagaccuugucccaaugggaaaagugggaaauagauuuuccuuggggaaagagcguggaucacagcaaccacauccaccuauugcccagaugaguuaaaaguugucauuugugggguuaggacuccaacuauucucagguaauaacucaccagaguacuccuauaugaaaggagaaaaacccuccucugaaaauagucccacaaaagugacugugauuugcccacaacccuguggccucagucucccuggccaaaggcaccuuuauauggcaaaauugcacgagaaacgaagggaagcccgauucccuuaaaaagacaagaaagaauggccaaggcuuuggcaaaaaagccugaccuguguuuaaucaacugcuuaauaaguaaaggccugcugauccucaggaucuggagacaccagcauggagaaaauggugggggguggggggugcggggcggggggugggagcugcagggaagaagcaggccuggugaagguucaagcuucaaggacccucucucauucaaaaggaaaaauuaaaacugcugaauugaguaugagagcucagagauuagggccacuuuuaccugcucagagguguagaaacuguuccuacauucggcuuucacccaguuucucccacucccucauuccaacuuccaagagauaaagagagcaggccuccuagucaggacacacccucccccacacaggcagcuucccccaagaacaccaaacccacucucccacucuuaaucucacaaguuagcucccauuucaggcaaagaaucccagagauucacuucagauaaacuaucuuuccaccuuugauuucugucuucguccccaacuucuaucucaaaucucacccccucuaccacccaaacaccaagcaaaaaaaaucaaaucaagaugaucagaggccuaaggcucaggagaggggaaaccaagccucccaggccgauaaccaccaccagaaaagucagcauucccaacaggcugacugacugacacucagaggucagaagaaccucccuagagcagucaagaagggaugcacuagggggguuagggggaggggaaaaucggaacugugcccccagcuaaacaggcccccagagaaacacgagauuuagcugcuuacaucuagagaaaaggcuuauacaaaaaaaauaucuauuucccauacagaaagggcauguggggccaauuagaaacugggcaggcaggacaaagggggaaggcagaaugacugaaaacaaaccaaaacgaaagacggaaugaaagccaugaggaagagaaggaagacgaagggagcuagggcggcggggaaaaggcauacauggaaaugugaagcucucacccuucuuugcuuucugauaacaugauuuuuuuucucccccuggaagugcuguuuaucccuuucuggaauggaagaaauaacaaaaaccaaacaaaaaaaauccuaaaaaaaauaaagaaaaaaaaccacaccuuccuuguuccaagaucccaccaccuccuccccagccacccgauccagagagagaaaauugagauguagcaaccggggauccaaaaaaugguaaauggaaggggagguggugguggugcggggaggcuaaaacagaucuggcuuuuaagagauaagcguuaaguccucacggcaaaccccgaguucggcuggauuggucucucuggagaaggaggaagagggccaggcugcugguaguggcuggcucuauuguauuggcggagcggcagcgaucagccggagacaugcaggggagccaucuugccacuuacccagcagccugugugugcggaugggggagggccuugcugcagcaggggaggggaaagaaaagagggagggagcugagugagcaagguucuuauccuuuggcaggccacagggagccgacugcuggcuccagaggccuggccuucuuuucucaaguuacagcagcuacagaggcuuaaccccccagggcuggagugcucccuccuggucuucccagggggcaggggagggggcuggguggaggacauguaaaguuacagcugcuugauuggaagauucuagaaaauagagagaauagaaggcaggcaaacaguagaggugggagugaaaaaggauuaaauaagaacgauaaagccaaaguugaaaagugauuaaagaaggaugguaaugaaagcuggauagaggguggggcaugagcaauguuuuaugugccuaccauccucuauccaguaaucuaggcauggaacacugaaaccagaccaaccagucagaugcugcagguagggaggugggaugggaauugucacuauccaaucacuacaguaacuggcugcucaccccggcaaugaccacguguuacuacuccaacauguccuuuucccagggaugguggagggaaguggauagcagggagaguucuuuuuucaaauaccaguagaaggggggcaggguuggugucucugaagagaugacagacaacuuuguuuuauagagucuuuaauaaggucacccugccccaggguccacucgggccagaaaaagaaaggauaaacagggcaaggggaccuuggguagcugaagcuugaaggccacuucuugaagcaagggcuccaaggugaggcucuaaaguagauaagacagugaagugagagugcugcuauauggggcggggaagaucagcugggcagaaagcgacugggaacuaagcagaaaauauuaaucaugggaaucuucacuagaccaaagugggaaacagaugcuaaua

SEQ ID NO: 17580 - RNA, 4262 nt, Homo sapiens
uauuagcaucuguuucccacuuuggucuagugaagauucccaugauuaauauuuucugcuuaguucccagucgcuuucugcccagcugaucuuccccgccccauauagcagcacucucacuucacugucuuaucuacuuuagagccucaccuuggagcccuugcuucaagaaguggccuucaagcuucagcuacccaagguccccuugcccuguuuauccuuucuuuuucuggcccgaguggacccuggggcagggugaccuuauuaaagacucuauaaaacaaaguugucugucaucucuucagagacaccaacccugccccccuucuacugguauuugaaaaaagaacucucccugcuauccacuucccuccaccaucccugggaaaaggacauguuggaguaguaacacguggucauugccggggugagcagccaguuacuguagugauuggauagugacaauucccaucccaccucccuaccugcagcaucugacugguuggucugguuucaguguuccaugccuagauuacuggauagaggaugguaggcacauaaaacauugcucaugccccacccucuauccagcuuucauuaccauccuucuuuaaucacuuuucaacuuuggcuuuaucguucuuauuuaauccuuuuucacucccaccucuacuguuugccugccuucuauucucucuauuuucuagaaucuuccaaucaagcagcuguaacuuuacauguccuccacccagcccccuccccugcccccugggaagaccaggagggagcacuccagcccugggggguuaagccucuguagcugcuguaacuugagaaaagaaggccaggccucuggagccagcagucggcucccuguggccugccaaaggauaagaaccuugcucacucagcucccucccucuuuucuuuccccuccccugcugcagcaaggcccucccccauccgcacacacaggcugcuggguaaguggcaagauggcuccccugcaugucuccggcugaucgcugccgcuccgccaauacaauagagccagccacuaccagcagccuggcccucuuccuccuucuccagagagaccaauccagccgaacucgggguuugccgugaggacuuaacgcuuaucucuuaaaagccagaucuguuuuagccuccccgcaccaccaccaccuccccuuccauuuaccauuuuuuggauccccgguugcuacaucucaauuuucucucucuggaucggguggcuggggaggagguggugggaucuuggaacaaggaaggugugguuuuuuuucuuuauuuuuuuuaggauuuuuuuuguuugguuuuuguuauuucuuccauuccagaaagggauaaacagcacuuccagggggagaaaaaaaaucauguuaucagaaagcaaagaagggugagagcuucacauuuccauguaugccuuuuccccgccgcccuagcucccuucgucuuccuucucuuccucauggcuuucauuccgucuuucguuuugguuuguuuucagucauucugccuucccccuuuguccugccugcccaguuucuaauuggccccacaugcccuuucuguaugggaaauagauauuuuuuuuguauaagccuuuucucuagauguaagcagcuaaaucucguguuucucugggggccuguuuagcugggggcacaguuccgauuuuccccucccccuaaccccccuagugcaucccuucuugacugcucuagggagguucuucugaccucugagugucagucagucagccuguugggaaugcugacuuuucugguggugguuaucggccugggaggcuugguuuccccucuccugagccuuaggccucugaucaucuugauuugauuuuuuuugcuugguguuugggugguagagggggugagauuugagauagaaguuggggacgaagacagaaaucaaagguggaaagauaguuuaucugaagugaaucucugggauucuuugccugaaaugggagcuaacuugugagauuaagagugggagaguggguuugguguucuugggggaagcugccugugugggggaggguguguccugacuaggaggccugcucucuuuaucucuuggaaguuggaaugagggagugggagaaacugggugaaagccgaauguaggaacaguuucuacaccucugagcagguaaaaguggcccuaaucucugagcucucauacucaauucagcaguuuuaauuuuuccuuuugaaugagagaggguccuugaagcuugaaccuucaccaggccugcuucuucccugcagcucccaccccccgccccgcaccccccaccccccaccauuuucuccaugcuggugucuccagauccugaggaucagcaggccuuuacuuauuaagcaguugauuaaacacaggucaggcuuuuuugccaaagccuuggccauucuuucuugucuuuuuaagggaaucgggcuucccuucguuucucgugcaauuuugccauauaaaggugccuuuggccagggagacugaggccacaggguugugggcaaaucacagucacuuuugugggacuauuuucagaggaggguuuuucuccuuucauauaggaguacucuggugaguuauuaccugagaauaguuggaguccuaaccccacaaaugacaacuuuuaacucaucugggcaauagguggaugugguugcugugauccacgcucuuuccccaaggaaaaucuauuucccacuuuucccauugggacaaggucucuaaccuugaucagaaaagcagcccuccuaaucccacccaagugaugaggcaggaggguuuccugacccaguaacuaacaucuugcucucucuuccccuugguucuuuucugcccgcccccccaccaccacuccccccuccugucagugaggagaaggaggaagugaccauggacacaagugaaaacagaccugaaaaugauguuccagaaccucccaugccuauugcagaccaagucagcaaugaugaccgcccggagggcaguguugaagaugaggagaagaaagagguaaacauccaagccaccuauuggggcgggugggcaggaauggaccuaggggaaagaguagagcacucuagugaucccucuuacacgguggguuaacuuaaaggagggaugaggcagggacuuggaucagaauagggccaagggagaauucgcugguuuagcaagggagaccccuugugacggggacagggcucauucauuuuccuuuccuuguuggggaaguagugcccagacucuagacguuuguaacuaacgggaaagucugauaauggcccuuuaucuaagauuuauguucagcuuuuccugcugucuucccaagcuucuccuggugguaacuccuuuagcuuucccuccuuuuuaaaagccugauggagcccaacgccaucuaguggacauuggugguucucaccagaccagccaugcugagaaauuuuuguuccuccucugcccuccaguggucugacugcagagauguagcuacuuagaagccagcacuugugauccggaaggcccauucucaguuaccugugaccccucuaccuccuuuuuuggcauauguuaucuuguguccugcacccacuucagggggcuucccccaucagagccagcgaagucuucuuggcucuuaaaguaauugagaaagaaugagcuggguuuaggagagggguaacaaggugggagggacuguuguguguguagccuuuuucugguguguguugcgggggugggggccggugaaagugauuugaugugcagaauauuauuuauuacaagguccuucuuccccguaaaacuuuguccaaguaccucauguacgguaauccgcccguaaaauauaacccugcccaacuggccaaucgcugaugccgccucuuccucuggacccacccgcugcuacugagcugcccaaucagagccaagucugcuauccaggugucuuggccagaggggggcauguauaugggcuccugugaugggcccccuuuugccucccugucuugcuuacaucagggggccaagaagaacacuguucuggagagacuuguauugagcaagcaaaaaacauuuggaaagggguggacuugcaucaucucccuacuugggacaccccaagaagagcuugugccagugcuggggcgccugcccacaugcccuugcccuuuugaggacuguggguugccuuguuu

SEQ ID NO: 17581 - RNA, 6586 nt, Homo sapiens
uguucuauaaagcugagauuggggagagugagccaggguacuucugagaaagaggucagggaacaggauuaucauuagcauucugcccacagaguuggcacuuacccaguaacaucgggauuccuagaaaaggcccaagcacagacccucuagcagguguccuagucacggacccaaccuaguggcgacauuaggggguuugccuguucaaggccagugggggaagagggagggagguggcacaccaacagguguggagcgcuggcuagggccaggagagaauuccaauguauggaaaggcuagaguguaagugggaaggugagggggguccugugcugauccugcauagaugggacacugacacaggagacagcagcaaacuccuucgagucacagaugaagcucgggggcccccugucuucuccaagccaguccaggagauuggcaggaugggaaggcagagcacagucagaaacuaugaucauuuccuaauaagagauuauagcaagguuuuaaauuuuguuuuuaaagaggaaaaaaaauauaacaucaugguuacacagaggcucuggagauucccuggguucacaauccuacuucugccauuuacuagcugugcgaucuugaacaaauuucugagcuucucugagccuguuuccucaucucuaaaacagagauaaugacaauguucuacuuacaggguuguuuugggcaugcaugcaaacaaaacagauuuuaugaucgagucauaguucuggaaaggaagaaaaacccagauuugcgcacacaaguguuaaguaaaugugagcccucacuauuguucauacaacauggcagugacacacauacauuagacaagagauuauuacacacugagccuccacccagucucccuauuauccucccaugggcuccuaauugaugacuaaacagugcauugcuggguggcuuccaguaguuucuuucuucacuuugcugcaacuuugaacugaaggugauccacaugguacaugacauucuuccuguuuucuucacaagacaaggaugauguuuaaaugggcauuuguuugcggaaugacuuggagaguuccucucuuucagccaucuuuucucaaagacuaaggcuguggacaggaugggcaugguaacaagccaacaagccucauacucuauucuuuuuuuuuauuuuuugagacggagucucacucugucacccaggcuggagugcaguggugcaaucucagcucacugcaaccucugucuccccguuaaagugauucuccugccucagccucaugaguagcugggacuacaggcaugaaucaccaugcccggcuaauuuuuguauuuuuaguagagacaggguuucaguauguuggccaggcuagucuugaacuccugaccucaaaugauccaccuaacucagccucccaaagugcugggauuacaggaaugaacuaccgccccugcccccacacucuauucugaaugcauguaugggcacaugugcaugccuguccccuuucacucagugauaaggaagaaggggaaccagaaauuucuguuugagaaauuaguaacagaaauggguguggggagcugguuaccugggagauccuuguucauuuguaacaucaggaacugcuucuuuuccuccuucucucuucuagaagacugucaaggagcccgagugagggaagcagaccaaccauggucuuggagaaaagaaaauaggguuuccaucccuucuggagggagaaggaauagcagagaugaacaugaaugaagaaggaaacaaauggaaauaaacaaaaugaagguaaauacccuauauguuaaaagaaaaaaauacccuauauguuaaaagaaaaaagaaaagagaaggaagagacacaaggaaagaaagagagaagcaaagagguuaggaauaggguaagagaaaaggaaaaacagcaaccagcagaggaaucacuccccuguuaagguuaaccaggaggagaggcuuauauaaggcaugaaugugaguggguaugagaguccagcuuucccacugcacuugcucugguuauggagcagacugccaucuucuggugccauuuacuauucaaguugcuuugguguuuuuuuguuuuuguuuuuuuuuuuuuuuuuuuuuuacaaccaaguggauugauugaaaugcuuugauucuucauuugaaauguuucuauuccauauacccauuaucuuuuauccucacaaaagcccuuaacauuguuuccuuuaaucuuugggguucuuaagcaucauuuccaccaacagagauguaccuacccacaguugucucagagcauggaggcugaaagucugugaggacaagagugaaauggagcagaggauaggcugugguuuggaagcggcucuggaauacgcuggggguggcgguggggcugaagguugguuaugggaugcuuccugggcuccggaacaucugugccaaaaacuggaggacccauccucggcuccagccagacgcuuggggugcuauguauucugaaccauagcacuagguuggaaaauuuggcuccuaaucuauacucugccauguacagaucacaaaauaucauacaaggagccuuaaaaggucaucuaaccuaaauccaguuucccaaggagaacacuggggcacaaagaagugagagguaacucgcccaaaguuauauagcuagucagggacuuccucuucggagacaaaggaaaucagaauagugauucuucugauucaccgucccucgacaaacaguccacaaagugcuuggagguuauuaaaaggcaccccagaaaaguaaggcuggcauuuuccuggaagccccugaguguacaaccccugaggcucaguauuuggcuauaaaaacaggucuggaguugcuuuggccuccguuuuaaucccuaaagcugccuggaggcuggagcucugauagcuaccugucaucacuccccagccaguccgcggacaccgcagccaggaacugucagaggugacaagggaaucccgucauaaugccaaggaccaaggagcaguggccagguuccugggauuaagcaaggcaauuauggcugaguuaaagcuaggauggguaggacagggggaucugagguggaaaaggccgguaagaagagggaaugcgccagcaauguaaaugccuucgacugggugggcuacuucacaucauaccuccuccaucuccaaaagguucuuaaccuucuucaaccgccuaggccugauggaccuccucccuuucucccagagcccacucacugaagggaaggccaccaucauccccauucuuuuccuuuuuuuauaaucccuccggugccguuucgggucuccuuccuccuauauucugaguuccuuccacucacauccaaccagcuuuuaacacccggaucucccggagcuucuuugguuccgcucacuccccccgcccccacgcccccacgcccccacgccccugauuuccccacccuuuucgcccuccccggcuugacucccuuggaccgcucccgccaauccuggucucuccuacuccuccccgccacaucgggucgccccgcccccgggugccuuugguguuuuccgccgucggccgcaggcgccucgucucagauaaaguggauccagcccugcggcuccggagcuccgccacugcccgggugcucgggcccacguagagcauagucacggccgccguuguugucccagaacucgugaccugucacacgguagcgcaaggcgaagagcagggcgcccccaaucggcggcgcgggcaggcggaaggcgaagcggucggcgcgcggcgggggcggggccggaccggcguaggcggcuggcgccucgcguuggcuccgccagccgucggcgcuccagcgcacgcucacgcgcuucucguaggccagguccaccacgcgcgcgcucccggccacgcccagcgggcccgccucggcgcguuccaggcagaugcgcugcgucagcaagcgggcggcgaagccgggcucgcuggccggcuccagggcggcgcgcgccuccugggggaaagaagaagcgggaggagggagcccagggcggagagaggggagagacagggggcggugucagagcaaggcacuggaccaaucagaggccgaccccggcguccaggccggcagagugcggcccagcugccaggguggccuagagccacucgcagaugggguccccaaaagggaugggcaggcgcaagcccagggaugggauggagaugggugcucuuuggcaaauccacucccacaagcccgcugcggccgacuggaggagguccccaggaggggaggugcccccgccgccuaccuggaggccgcgggcgcggggcuggcagggcgcgaaguggcggagggcgucccucugcaauuggaucugcacguggcggggcacccggggcagcucaccgggacggaagcggcgcacgacagccagcuccaaccccagugcgucggcgaaacgcacucucuugcgggugucugggcuacggcugcggggcgcccgggccccgccgccuccggcuggugcagaucgggcccggcggccccgacucggugcgugagcgcgggaucgggccccgaaccgcgucccgcccucgccuggcuccuccuccggcuccuccucgaggcugggccgcuggcuacgguaguaggcgcgcuccguuagcgcggcgaugaagcucagguugcggggaaugucggugcccgggggccgcucacgggacauggcagccccuuccccggcggggccagcucgcagcgccaccgcgcuccccucucuuccucucucccgcccgccccgcgucagcgcagaagucgcuggguccgcuucugcagccccucgcugcuguguauucuccuugcagacaccuccaggauccuccaccucccguugcuuugccucuccucugugaccacccuucccucccucuggccgucagcuuccagggucuuagacuaucacauccugccuccugcuagcggucugcucugagcgugcgcucaacugcacucacccuccgguuccaaggcccucacggcccgggcgcccccgcccacagcccucugacagguggcuccgcuugucuucgcugcugcaccagggggcggggacuccaccuuugcggucccgagugaagcuacucaaccuuuuaaaaaaaacauccacggacgggacgcgauggcucacgccucaaaucccagcacuuugggaggccgaggugggaggaucgcuugaagccuggaguucaagaccagccugggcgucauagugagaccccugaucucuacaauaauaauaauaauaaaauguaaaaaguccucaacuuuuccggcacagcacaggaaagguuaacgccgggaagaaaaaauaaccuuucauuuucuugcaggggaagguucaaaacgcccagcaugugacuuuaucuuugggguucacuguuuucuuuucugaaaccuaggcuccugguuugggcagggggugguggugcgugcaaagaaggaaaggucaugaaagcuagguagagucuuucaaauagaaggugagaauauggcacccgaacugagaacugcaggaagaccuagcuucuagugaccuugagcaagcaaggcauaacuucucuggagucaguguucucgugugugugugugugugugugugugugugagugugagauggagucucgcucugucgcccaggcuggagugcaguggcgugaucucggcucacugcaacuucugccuccccgguucaagcgguuuuccugccucagccuccugaguagcugggauuacaggcguccaccaccacgcccggcuaauuuuuguauuuuuaguagacacgggguuucaccaucuuggccaggcuggucuugaacuccugaucucaggugaucugcccgccucggccucccaaagugcugggauuacaggugugagccaccccugaacucagagccauacucugaacucaguguucuuaucuguaaaaaagugguggaguucugauuucuaauccaaguguaagcccuuugagggcaggggcuuugucugauucauggugaguuuuaguauaugguaggcacucaaauuauugaaugaacaagcacccaacaacucucuuggaguugggacuguggaauuauagguccagugggagcuuccaagaagggcagagcuggcuuuuuccccuuucauuuuuuuuuuuuaacauuagugaaaaaaaaaagugaaguuguuuuuaguuuuuuucuaacuuuccuacugaucuaauauagcacuuacaaugugcuagguacuguuguaaggguuuuacaaauacuaacccauguaauacaaccaucagaggaauagagacuauuaugucuaguuuaaagaugagagaauugagggagagaggggagaggacucuuacccagggucacauaguuaauaauuggggaggugggauuaggaccuaaacaguuuagcucuagaguccacgcucuuacccgcuugguuauauaagauuaaaacauuuaacaauaauag

SEQ ID NO: 17582 - RNA, 7275 nt, Homo sapiens
cucccucugccccccccuuucuccucccuccuuccuucccucccuuccucccucucucccucccucccagcuccugcaccaggaaacggcccggaucccggcagcggccugacccgugagaucccuaaccuggcaggcgggcgggguuggagacuggcugagguggggguaagggaggagcugggccuuugggcugcacuagggggaaccgggaauagagauggugucggcaggaagcccuuggccuuggguuucccgggaggacagucauuaaacauggauucggccacacagcugguagagcguugggggcaggggccuaggcccagagcugcaacccuagcccuucccaggccagaaccugaucccuggccuuccccuccugguucugaucucccccuccccuuuccagggcuccacgcuggccaggaggaugaaaggccccagcugggggcuccuugccaccagugcugugucuuaagagcugccaucccggcugggugagugucuccuuccuuucucugucuggaguaacccauugcgucucccaccuuucucuucagcccaucugcucccccucaucuugugucucugccaacaucuuuacaucuugcauuuggggagguccuaagacccuuccucuagccaagaagguguggacuaaggagacccggggguggggguguuguaggggugucauugagcugacguugucuuauugugaaaagaaucuaaaguauccuaaacagaaaauuuacuuguuuuacauuuaauuuggcauauuaggaauguaauggccagccacucacagccuagucucauaucaugacuuaauucccuuguucuugccucucccuguccagugaguccugagcauuuccucucuccuccucaucucacuggguuggucaaaccagaagugcuccuucugauucucucuucauauauucaugccagucuuucauccuugccucuuauagccgcccggauggcgaccccagccucggccccagacacacgggcucugguggcagacuuuguagguuauaagcugaggcagaaggguuaugucuguggagcuggccccggggagggcccagcagcugacccgcugcaccaagccaugcgggcagcuggagaugaguucgagacccgcuuccggcgcaccuucucugaucuggcggcucagcugcaugugaccccaggcucagcccaacaacgcuucacccaggucuccgaugaacuuuuucaagggggccccaacuggggccgccuuguagccuucuuugucuuuggggcugcacugugugcugagagugucaacaaggagauggaaccacuggugggacaagugcaggaguggaugguggccuaccuggagacgcagcuggcugacuggauccacagcagugggggcuggguaagaagcuucucaauugccgcucugcacauccuucugcaaagcuggucuccagggggaagaugggggcucugauuggaggcugaggcagcuauguugggaaugagguacggggcugagucuccccgucuggauggaauuagauugagagaugccuggacucugcacuccagggcugccaugcagucaacacuggaugggcucauggucccaagcagaggacagaauacacacccaaggagugccugcaggggaauguugucagggacuuuuuacaucugagucauggcgugggagguggggaggaccagggaugggugguggucaggcaagccuuggcaaaggaugcuaguucugagcagaauuuuucgccaaggaaaggauggaauucacuggaggcagagugggcagaugaaccagucucucagggugggggugcaccuggggggaucagaggggcuugcagggagaagagcuuuggccagagaggagcuggguaugggguagugcucgcaguggauggaacuggaacucuuccucuccucuucucuccacucuuuccucuccugauaucccuuucuccuucuuucucuccugcuucccuucucucccacaggcggaguucacagcucuauacggggacggggcccuggaggaggcgcggcgucugcgggaggggaacugggcaucagugaggacagugcugacgggggccguggcacugggggcccugguaacuguaggggccuuuuuugcuagcaagugaaaguccagggccagguggggcuagguguggcugggggccaggagagcaggaacagaacagagaaaugcccuuggaagaaguggaguugguggaugggugggcauggaacaggaugggcagagaaaggguagugugugagggagcugaguaggccagguaggcgauuggaagagugagcaggacacagaggggaggggaauguuuuggcaaguuuaggggcacaggagauguagucguuccagggcugggggaggugggagggaucacgccuauaggugugggcacaugaaacgaccuggaacuugcuucacagcccugaggaagguggacuuacauaagcagcuguauuccauuagaugagugggauuuagggaacgcagaaggcacaucccuuuggaauggaagcuuagggguucucaggugauagggagagguggcuguuaacagugggcugcuuggacacgcgugugcaugugcacgcaugcuggugugcaugcugggcugccuggcaaaucugguggugaugggauuccucaaggagaaaacauucccucuugcaauggcaagaacuaggggcaguucucugucccuccucccaaccccuccuuuccccugcccuuguccugaugccucaaggcuuagagagaaacauuguauccagaccgagggcucugcugcuucuuuccagaaagugauuggcaaggcuuuggagagaagagcaguucugcagcuggccuuguuccuucaucaucccccuuccuugugcauuaugcacuugcugcugccuccugggcucugauagaagggcagggcuguugagccuggauggguggaggcuuagguagccggaccugccugccacccuccucucccacucaggcacaauggugccuaaaguguuuccaaucucugggaccucuguacccaaacugaaacucuaaauuggggcccuaacuaauuuuccuuuugagguugugggcauaagugcugaucuagaauacagucugggucccacacugugucucagugagacuguugaugccuugagaugaccauuucagaucugaaucccaugggugugagggugauggguacuccaggacuggccuaugcuguguugugggcuuugguucggcuuuaucaggggccaggcauauggguucuagaguaccuaccaugaccuagaagcauuuaugauuuauuugaagccacacuguuugcauggguguuacuugucuguaccucagagucugaggauguuaacuuuggaacucgcaguccucuagaacagcuucagauuauggcuuuuucuuuugaggaagaaauuauucacuccagaugcaugcccugagccagaccucacugcugcacuuuccaaggugcuaagauugcugcucuccaaugcuaacuuucugacacagugcucuagaacccugccugugguccugagcacugaucaccuuagcuagaccaugguugacucuucuuggagauuuucacuugguccuagaauguggcaacguaguugugcucgccagaacgugggaccaaauuggccucagguguugaguccagacuucugcuuuugagagagggcugcacuuuuucaugguauuucuaggggaggugguaggcugcaugugccacuuggucuuguugugaguaugcugacaccagaaacucagagccagcuuguggcaagcaguugggguggggggucucugacuugcucaggacaaacuaggccagugguuuucaaacugcuuggcagagcccugaaguuuccuagggguugccucaggaguccuuggggagaugaaggggguggggagcugagcaggcugggcaauuugcccucaaacagaacagcuccccuuguagcugucuuacauauugggguucaggguaagauuuuauuugcauuaagggguuugcugcugaaaaaaaguuggaaaaccacugacuagaccaucggcuccaaauuggagucugugcuuccuuccccagguauggagcacacucuucacccuacccucuaccacaggacacauaucccuguuagcauuccccgggaccuuuagccaagaggagcugcagggaccauggccagguuaccaaaaugcccugcucugaagccuugacaccuggguggaaagagaggcuguuuucugaaaggguaaagggcuuggucuggauucccagaagcauagcuuagaugggaccacagugggcaauuuugaccuguccugcccuucuuagcuugaagggaaaccccagagacucuucugucagggaaaacuagggacucucuucuagagccauauaguuccuugggauuagcucuuggccaagaaggcugaguaugguucccaauuuuuaaauccauuucauuuuuuaaaaaauaagggaaauaaauguaauugccauuuuucaaagauuaaguaggaggagagggguuucuugcucuccagagcccaaagggacaaauagggacuuuguuuaggccaaggaaggagcggaaguagggcaacucgguccugcgauuauuaaucccacuccccacuuauucuagggcacacaaacacuauuuuacuuuuuuaaaaucauaaaacggcagaacagauuugguuaguuuagaagaaaagaaagcucuauaaauauaaaucuauauuccuguauuuuuauuuaauaauuuauaaauaccaaguucauuugacuuuuauuuuuguguaauauguaaugaucguauuaaaaacaauaaauaaagcccagaaguuuaaugagaaggacugaacaggguuugugacuucuacacuguauagccuggggucaggacauuuccuugauccaaucaucucuucaugaccuuguuaaaggcaagaauuagaauaacagggauuugagaaaguguugggaucauuaagaaaaaaagagucuuucccccauccucaccccacuccuauaccagccaaauggucaaagccaagaauuccuucuauuucaaccugagccuugggaggguguguguauaugguacucugggacugccacuaacaauaaccaaaugagaaacaaagaaaaccuaccaaaaaucuuugugugauaguaaucaagcccccaguugugguucaggcucuaaucagaagugugugauaauaaugaacauuucuccauggugccuuccugccuaccucagacuuaaaaauaggucugggccaggugcgguggcucacaccucuaaucccagcacuuugggaggccgaggcgggcagaucacuugaggucaggaguucgagaccagccuggccaauauggggaaacccugucucuacuaaaaauacaaaaauuagccgggcaugguggugcgugccuguaaucccagcuacucaggaggcugaggcaugaggaucacuugaaccuagaagguggaguuugcagugagccaagaucgagccacuguacuccagccugggugacagagggagacucuaucucaaacaacaaacaaacaaaaaauaaggcaaggcggagucuggcaaaaaugggagucccugcuuccuuugcugguccugugagacauuugguuucagccauuuuaaugcaaauugauaaacuggauggaauuucuaagaauauucagcucauccuucucuaccucuaaucuuggaccacaucaaaaucauguuaacugaaacagugauccuaauuuuaaauuucaggugggaauuucuagccuuucuguaauccagugcaauagacugguacuuggguuuauguguuaaauugcaagaaauauaauuguuuagaggaauccagcauucucuuucuauucuuuauacaaaagucuacaggggaaaccauauuaaaaucagagaguggcuuagugaauauggcacuaugggaaaggaaauuagauguucuuaauaguuaauaucaucaaguaugauagcugguguauuuaucuccacuguugugugauugauuuaaugauugauuugcauuugccuaguuccaaaaaauauuugcaauaucuuacuauaauacacaaaauaauaggaaaacauaaauuuuuuaaguuggguugaauuucaagucaagguuaaguaaaaaaaauaaguagggguaaagggaaaauugaaauaagauggcggcaaaaggaaaauuaaugcacagaaaaacauucuauaaguagcauuuccaaauacuaaagcuaggcugugaauucagcugugagcuucuugguggcuaaagcaaauuaaaauacagaaugaaauucacauuccucuuaggauuuauaaaagccuaucaguuacucaagaggggcaaaaaaaauuuuguggcuuuucuaagaagacaaugauauaguggacaccaccuucugugacaucuaaaagcaaauaugauguugaguuuugaccacuguuucuucuaaaaacaccaaauggagauucagaagguccuaagcgagaaauaacacugguggagaacuguaugaaggaaauauaauccaucuaucgcuuuagauagcccaaaauuuaauccuguauuaaaccaaaucaucauagagcagcauauuugggcuaaauugugaugaaccuaguagaacacacuuaggaccuucugaaucuauuagaagguccuaaguguguuaggacaaaugacaccuucaauaaaguugggcaacacuuaguuacaauuauuaguaaauggauagauuguagauauucuguguuguuacuuuuuuaaauuuuuauuuauuuauuuauuuugagauggaaucucgcuguguugcccaggcuggagugcaguggcgcgaucucgguucacugcaaccuccaccucccggguucacuccauucucuugccucagccucccgaguagcugggacuacaggcgcccgccaccacgcccggcuaauuuuuuguauuuuuaguagagacgggguuucaccguguuagccaggaugguuaccaucuccugaccucgugauccgcccgccucggccucccaaugugcugggauuacaggcguaagccaccgcgcccggcccucuguguuguaacuuaauagcaaauccuuugaagacuu

SEQ ID NO: 17583 - RNA, 7275 nt, Homo sapiens
aagucuucaaaggauuugcuauuaaguuacaacacagagggccgggcgcgguggcuuacgccuguaaucccagcacauugggaggccgaggcgggcggaucacgaggucaggagaugguaaccauccuggcuaacacggugaaaccccgucucuacuaaaaauacaaaaaauuagccgggcgugguggcgggcgccuguagucccagcuacucgggaggcugaggcaagagaauggagugaacccgggagguggagguugcagugaaccgagaucgcgccacugcacuccagccugggcaacacagcgagauuccaucucaaaauaaauaaauaaauaaaaauuuaaaaaaguaacaacacagaauaucuacaaucuauccauuuacuaauaauuguaacuaaguguugcccaacuuuauugaaggugucauuuguccuaacacacuuaggaccuucuaauagauucagaagguccuaaguguguucuacuagguucaucacaauuuagcccaaauaugcugcucuaugaugauuugguuuaauacaggauuaaauuuugggcuaucuaaagcgauagauggauuauauuuccuucauacaguucuccaccaguguuauuucucgcuuaggaccuucugaaucuccauuugguguuuuuagaagaaacaguggucaaaacucaacaucauauuugcuuuuagaugucacagaaggugguguccacuauaucauugucuucuuagaaaagccacaaaauuuuuuuugccccucuugaguaacugauaggcuuuuauaaauccuaagaggaaugugaauuucauucuguauuuuaauuugcuuuagccaccaagaagcucacagcugaauucacagccuagcuuuaguauuuggaaaugcuacuuauagaauguuuuucugugcauuaauuuuccuuuugccgccaucuuauuucaauuuucccuuuaccccuacuuauuuuuuuuacuuaaccuugacuugaaauucaacccaacuuaaaaaauuuauguuuuccuauuauuuuguguauuauaguaagauauugcaaauauuuuuuggaacuaggcaaaugcaaaucaaucauuaaaucaaucacacaacaguggagauaaauacaccagcuaucauacuugaugauauuaacuauuaagaacaucuaauuuccuuucccauagugccauauucacuaagccacucucugauuuuaauaugguuuccccuguagacuuuuguauaaagaauagaaagagaaugcuggauuccucuaaacaauuauauuucuugcaauuuaacacauaaacccaaguaccagucuauugcacuggauuacagaaaggcuagaaauucccaccugaaauuuaaaauuaggaucacuguuucaguuaacaugauuuugaugugguccaagauuagagguagagaaggaugagcugaauauucuuagaaauuccauccaguuuaucaauuugcauuaaaauggcugaaaccaaaugucucacaggaccagcaaaggaagcagggacucccauuuuugccagacuccgccuugccuuauuuuuuguuuguuuguuguuugagauagagucucccucugucacccaggcuggaguacaguggcucgaucuuggcucacugcaaacuccaccuucuagguucaagugauccucaugccucagccuccugaguagcugggauuacaggcacgcaccaccaugcccggcuaauuuuuguauuuuuaguagagacaggguuuccccauauuggccaggcuggucucgaacuccugaccucaagugaucugcccgccucggccucccaaagugcugggauuagaggugugagccaccgcaccuggcccagaccuauuuuuaagucugagguaggcaggaaggcaccauggagaaauguucauuauuaucacacacuucugauuagagccugaaccacaacugggggcuugauuacuaucacacaaagauuuuugguagguuuucuuuguuucucauuugguuauuguuaguggcagucccagaguaccauauacacacacccucccaaggcucagguugaaauagaaggaauucuuggcuuugaccauuuggcugguauaggaguggggugaggaugggggaaagacucuuuuuuucuuaaugaucccaacacuuucucaaaucccuguuauucuaauucuugccuuuaacaaggucaugaagagaugauuggaucaaggaaauguccugaccccaggcuauacaguguagaagucacaaacccuguucaguccuucucauuaaacuucugggcuuuauuuauuguuuuuaauacgaucauuacauauuacacaaaaauaaaagucaaaugaacuugguauuuauaaauuauuaaauaaaaauacaggaauauagauuuauauuuauagagcuuucuuuucuucuaaacuaaccaaaucuguucugccguuuuaugauuuuaaaaaaguaaaauaguguuugugugcccuagaauaaguggggagugggauuaauaaucgcaggaccgaguugcccuacuuccgcuccuuccuuggccuaaacaaagucccuauuugucccuuugggcucuggagagcaagaaaccccucuccuccuacuuaaucuuugaaaaauggcaauuacauuuauuucccuuauuuuuuaaaaaaugaaauggauuuaaaaauugggaaccauacucagccuucuuggccaagagcuaaucccaaggaacuauauggcucuagaagagagucccuaguuuucccugacagaagagucucugggguuucccuucaagcuaagaagggcaggacaggucaaaauugcccacuguggucccaucuaagcuaugcuucugggaauccagaccaagcccuuuacccuuucagaaaacagccucucuuuccacccaggugucaaggcuucagagcagggcauuuugguaaccuggccauggucccugcagcuccucuuggcuaaaggucccggggaaugcuaacagggauauguguccugugguagaggguagggugaagagugugcuccauaccuggggaaggaagcacagacuccaauuuggagccgauggucuagucagugguuuuccaacuuuuuuucagcagcaaaccccuuaaugcaaauaaaaucuuacccugaaccccaauauguaagacagcuacaaggggagcuguucuguuugagggcaaauugcccagccugcucagcuccccacccccuucaucuccccaaggacuccugaggcaaccccuaggaaacuucagggcucugccaagcaguuugaaaaccacuggccuaguuuguccugagcaagucagagaccccccaccccaacugcuugccacaagcuggcucugaguuucuggugucagcauacucacaacaagaccaaguggcacaugcagccuaccaccuccccuagaaauaccaugaaaaagugcagcccucucucaaaagcagaagucuggacucaacaccugaggccaauuuggucccacguucuggcgagcacaacuacguugccacauucuaggaccaagugaaaaucuccaagaagagucaaccauggucuagcuaaggugaucagugcucaggaccacaggcaggguucuagagcacugugucagaaaguuagcauuggagagcagcaaucuuagcaccuuggaaagugcagcagugaggucuggcucagggcaugcaucuggagugaauaauuucuuccucaaaagaaaaagccauaaucugaagcuguucuagaggacugcgaguuccaaaguuaacauccucagacucugagguacagacaaguaacacccaugcaaacaguguggcuucaaauaaaucauaaaugcuucuaggucaugguagguacucuagaacccauaugccuggccccugauaaagccgaaccaaagcccacaacacagcauaggccaguccuggaguacccaucacccucacacccaugggauucagaucugaaauggucaucucaaggcaucaacagucucacugagacacagugugggacccagacuguauucuagaucagcacuuaugcccacaaccucaaaaggaaaauuaguuagggccccaauuuagaguuucaguuuggguacagaggucccagagauuggaaacacuuuaggcaccauugugccugagugggagaggaggguggcaggcagguccggcuaccuaagccuccacccauccaggcucaacagcccugcccuucuaucagagcccaggaggcagcagcaagugcauaaugcacaaggaagggggaugaugaaggaacaaggccagcugcagaacugcucuucucuccaaagccuugccaaucacuuucuggaaagaagcagcagagcccucggucuggauacaauguuucucucuaagccuugaggcaucaggacaagggcaggggaaaggagggguugggaggagggacagagaacugccccuaguucuugccauugcaagagggaauguuuucuccuugaggaaucccaucaccaccagauuugccaggcagcccagcaugcacaccagcaugcgugcacaugcacacgcguguccaagcagcccacuguuaacagccaccucucccuaucaccugagaaccccuaagcuuccauuccaaagggaugugccuucugcguucccuaaaucccacucaucuaauggaauacagcugcuuauguaaguccaccuuccucagggcugugaagcaaguuccaggucguuucaugugcccacaccuauaggcgugaucccucccaccucccccagcccuggaacgacuacaucuccugugccccuaaacuugccaaaacauuccccuccccucuguguccugcucacucuuccaaucgccuaccuggccuacucagcucccucacacacuacccuuucucugcccauccuguuccaugcccacccauccaccaacuccacuucuuccaagggcauuucucuguucuguuccugcucuccuggcccccagccacaccuagccccaccuggcccuggacuuucacuugcuagcaaaaaaggccccuacaguuaccagggcccccagugccacggcccccgucagcacuguccucacugaugcccaguuccccucccgcagacgccgcgccuccuccagggccccguccccguauagagcugugaacuccgccugugggagagaagggaagcaggagagaaagaaggagaaagggauaucaggagaggaaagaguggagagaagaggagaggaagaguuccaguuccauccacugcgagcacuaccccauacccagcuccucucuggccaaagcucuucucccugcaagccccucugauccccccaggugcacccccacccugagagacugguucaucugcccacucugccuccagugaauuccauccuuuccuuggcgaaaaauucugcucagaacuagcauccuuugccaaggcuugccugaccaccacccaucccugguccuccccaccucccacgccaugacucagauguaaaaagucccugacaacauuccccugcaggcacuccuuggguguguauucuguccucugcuugggaccaugagcccauccaguguugacugcauggcagcccuggagugcagaguccaggcaucucucaaucuaauuccauccagacggggagacucagccccguaccucauucccaacauagcugccucagccuccaaucagagcccccaucuucccccuggagaccagcuuugcagaaggaugugcagagcggcaauugagaagcuucuuacccagcccccacugcuguggauccagucagccagcugcgucuccagguaggccaccauccacuccugcacuugucccaccagugguuccaucuccuuguugacacucucagcacacagugcagccccaaagacaaagaaggcuacaaggcggccccaguuggggcccccuugaaaaaguucaucggagaccugggugaagcguuguugggcugagccuggggucacaugcagcugagccgccagaucagagaaggugcgccggaagcgggucucgaacucaucuccagcugcccgcauggcuuggugcagcgggucagcugcugggcccuccccggggccagcuccacagacauaacccuucugccucagcuuauaaccuacaaagucugccaccagagcccgugugucuggggccgaggcuggggucgccauccgggcggcuauaagaggcaaggaugaaagacuggcaugaauauaugaagagagaaucagaaggagcacuucugguuugaccaacccagugagaugaggaggagagaggaaaugcucaggacucacuggacagggagaggcaagaacaagggaauuaagucaugauaugagacuaggcugugaguggcuggccauuacauuccuaauaugccaaauuaaauguaaaacaaguaaauuuucuguuuaggauacuuuagauucuuuucacaauaagacaacgucagcucaaugacaccccuacaacacccccacccccgggucuccuuaguccacaccuucuuggcuagaggaagggucuuaggaccuccccaaaugcaagauguaaagauguuggcagagacacaagaugagggggagcagaugggcugaagagaaaggugggagacgcaauggguuacuccagacagagaaaggaaggagacacucacccagccgggauggcagcucuuaagacacagcacugguggcaaggagcccccagcuggggccuuucauccuccuggccagcguggagcccuggaaaggggagggggagaucagaaccaggaggggaaggccagggaucagguucuggccugggaagggcuaggguugcagcucugggccuaggccccugcccccaacgcucuaccagcuguguggccgaauccauguuuaaugacuguccucccgggaaacccaaggccaagggcuuccugccgacaccaucucuauucccgguucccccuagugcagcccaaaggcccagcuccucccuuacccccaccucagccagucuccaaccccgcccgccugccagguuagggaucucacgggucaggccgcugccgggauccgggccguuuccuggugcaggagcugggagggagggagagagggaggaagggagggaaggaaggagggaggagaaaggggggggcagagggag

SEQ ID NO: 17584 - RNA, 4002 nt, Homo sapiens
uauuuagaucuuuguuuccaguguuccacuuuuaucaauaauugcuauguagaacauaaauuuuuaugcauguccggccuagauuucuggaagcaguauuacugggucaaagugcaaggcugugaggaagggaguuuuguagacagcuucccucuaauaagaaauucuccugggaaggugcagagguaaaaauaaacaagcuauuuauuggcauauuugcuuagcagaaauaucaaaaaaugagguuacuaaaaauagacauccagguuuggaaguuuguauuugaaacaaugaacaauagugagccauuuguugauuuucuuuuagagacagucuuuagcucuauccccaggcuggaguacaguggagcaaucauggcucacugcagccuccaccucauaggcucaagauucccuccuucauccuucccaaguaaguugggaccauaggcacgcgccacgauggccggcuauuuuuuuuuucuuuuuguagacugggucucacuauguugcccaggcuggccuugaacuccuggccacaaaugauccuccuccucggccucccacagugcuggaauuacagucguaagccaccgugcccagcucacuugugcguuaagcacuaaaugcuguuagaggaggauucuucagcagaucaacuaccggaagaggcauagguguuuuuuguuugguugguugauuguuuuuugugugugugugacggaguuucgcuuuuguagcccaggcuggagugcaguggcgugaucucggcucaaugcaaccuccaccucccggguucaagcgauucucuugccucagccucucgaguggcugggauuacaagcgcaugccaccacacucggcuuuuuuuuuuuuagugacgggguuucaccauguuggccaggcuggucucgaacuccugaccucaggugauccacccgccuuggccucccaaagugcugggauuacaggcgugagccaccgcgcccggccaauuuuuuuaaaaaaugauuccguccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucauggucgauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggaugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagcagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacguuaguggugcagcgcaccagcauggcacauguauacauauguaacuaaccugcacaaugugcacauguacccuaaaacuuagaguauaauaaaaaaaaaaaaugauuccgucacauucugggagaacgcagguaaaaucaaucaauaaauaaagaucccgauuuuccaggcuggauaacccagaaaccacggaauccuaaagucucaauaaacguuaaagcacagauaguaaguaaucuggcaauagaggaugggcgcccagcagaccgccuacauaaucaguggagccgagugcaagaugaaaauaccaggcacuugcuuuaaaauuacuaauaauuucaagaccguuaacacuagaacauuaaaccaaacauucaggacccuucuaagcgcagaggccaucaaagcuagcccuggugacaagcucaggucuccggaucuagagacuaggagacgucgcccgaaagcuggccaaacccucgcccucacugggagaggccccaggagggcccaagaaggccacgagcccucgcucccaucccugcccucaggagcgggcggagggaagcucgcagcuuucccaaggaagugcaggcugcagggaaugaaguucagcucggacccugagccucugagcccgagacagcaaggucauucaacccacacguccccacccagccagggcgaggaucagagauguggcaacucccggccuuggacucaggcuuguuacucauaaacccgcaggagggggcaggagggggcaggaggcggcgagcgcgcacccuggacccgcggccgggggcggagaggcaccgcgaggacagagggacuagcgaaggucugcaaaucccggagggccaagggagcgucaaaggggacagcggaaccggaaaagcuuugacagaaagacgcguguauuagggaacgucugcaaagaccgcggcggaaagccagggauugucuuaaaaaauugucagaccggauaaagggaggucuaaaaggggaccgucccaagagcaaggcuuccaaaagcuaagcccggaaggacgguauggaggucuacugggacgcugggcaccccuuagggcagaaccgacuggagcugcggccagcgacagaagaacggcuccagcuggacaggggaagcaguggggagaaaggaggcccuugggcacugucugaaaagugcgaugccaaaugaucuuuagggacagacaguaaauuauaucccuugcuaaaauaccucucgguagcgaaccaccaaacguuucuuuuuuaagccccgccucucagccguuacgccuaguucggcugucucugauucaggaagcuggcaguucccacuuacuccuccccagcaagagcuaacagcccuccuugggugu

SEQ ID NO: 17585 - RNA, 3454 nt, Homo sapiens
uagccccucccucgggcagccccuggacugugacccagccagcaccgccucuccuaguggcaacuggcugggaauggcugaggggcuaccuacugcuugcggccugccagcgggaggaggggggcggaaagaagaaagggggcgggguugaggggggcgggccuggaccuggggagugaaagcgaaagcccgggcgacuagccgggagaccagagaucuagcgacugaagcagcauggccaagccguguggggugcgccugagcggggaagcccgcaaacagguaauggggaaucggaggccaggaaggggucauagaacccucuuggguggaggccaagcugggugguucaggggaccaagcagugccagagaacucccccaaucucgcuagugccuucacuucucggggauucccagauuccugccuucugacugcagugagcaggagcuuccagggaaagcuaguuuguggugagaaaggccugagccacaguucgagggcacccuguuguggguggaagcuuuugacaacccagacccuuaaccaacauccggguacugcucucuguguagguggaggucuucagacagaaucuuuuccaggagguaagucucuggauuugagcgauuugacccagaaucuuggaccaauacuugaggauaacagccucucagaaugacccccccaagucacccuagacuuaacccuacuucccuuaccaagccuucacccaaaguaaccccggaauuauugauagcuaccuuuaaucugaccuuucuuaugacucucccgacuucuggcacuucucccgucuuuugauguggaggaaaaaaaccauggcuuccaaagcaggaauaucacaguccuaaccuucguucugccauuuaccagcuugggcaaguccuuucauuuucaggucuucaguuuccucauuugcaagucuuggacccagugauuuccaaaggcccuuccaguuccauuugucagacaucucauugagcauauucugugauuccccucccuugcaauguaacccacaggcugaggaauuccucuacagauucuugccacagaaaaucauauaccugaaucagcucuugcaagugaguagugugggccccuucugccccauccuauguccucuauccccuuugcccacccucucuagcuaacaacuggauucagcaugcagagaauaguuucaaauaguggauuaggaacauuaggauggcgugaggcaugagccuagguugggaggcagagugcaagugggauguauggagggaaggcugugaccuaggaugaagggaagagguugggcagcccuugacagugagcucugugcaggaggacucccucaauguggcugacuugacuucccuccgggccccacuggacauccccaucccagacccuccacccaaggaugaugaggugaggcacucagggugcaggacuuggacuauaaacccaauggagaagauagcccuucaaccucugugacuuuucuaaagcuacuuuccccccuuuuugccuuagauggaaacagauaagcaggagaagaaagaagguaagagagauaagaggugacuagggaaggggugauggcacacugacuacuggaugagaaagggccugaauccccucuuucucacaguccauaaguguggauuucucccugggaaugagaaaguccugucccugcuugcccugguuaagccagaagucuggacucucaaagagaaaugcauucugguaagccugggaaaugggggaagcagaaagagaagacacacaaggugaggcccuggacuccuccguagauacaaguccuucauacagagaccuaguccugaaaaagaaaacuuccuucugugccuugggcuuagauccccuuuguucuccucguucuguuagaccucucuuaucacaacgguacccccaaaauuagagacugugcaguauccacucuguaaccucagaaccuacugcuguauuggguucauaguagaggugguaugauauagugagugaauuguuuuaaaagauuggacccuagagagagacugcuuagguucaaaucgugauucuaucaguuaccuagcugguagccuuaaguaagucacuuagacauucugugacucaguuuuuucaucuguuaaauggguacaauaaauacauaucucugaagguugcugugaugauuacaugaaauaaauacauggcacaguaccugguauguaauaaguacccaauuaaauauaacuuuuuuuaggaagugacaguaauaggaagaacucaguauguuuguugaaugauucuuacaugauaccucuuaacacaggugauuacauggauccaacaccugauccccaagauugaagauggaaaugauuuugggguagcaauccagguaagaaaaggguaacugaagauacuuagaguggggagagccucagggggugagcuagacaugaaccaggaggaggaggaagauaguguaugaaauggggaggacaugaaguguugucuuugccucccgugucaccacaggagaaggugcuggagagggugaaugccgucaagaccaaaguggaagcuuuccagacaaccauuuccaagugagggcagcuggaggaccagcauugggggcaguaggagcauuucuuugggacccccagagcugggcagcccuaucaggaugaugggagacuuugggaagggucugagggaguacaucucccugaacacucauuccugugguauucccuugcuucuggcagguacuucucagaacguggggaugcuguggccaaggccuccaaggagacucauguagugaguggauaguccaccagccuuuuagcugggugugggacgaggagguguggaggaagaaguccuccuugucuuguuugugacuuucccaauguggagaauauuaagcuaaaagcauuaccuagaaaaacugguuugggcuucaacaaccuugacccuuuucucugcucaguccuuugggauccuauuucuuggugcuaagaagggguucauucucaaguuaaccuauuuccuauaaaaggaaaccagacucaugucccagccucccaugggacugacucagcuuugccucccacauugcagauggauuaccgggccuuggugcaugagcgagaugaggcagccuauggggagcucagggccauggugcuggaccugagggccuucuaugugaguguggaguaaggcuuuaggggagguggaugagugggggcaggcaggggauuggcuaagaaccugacucuugcacucuggccuucucccaggcugagcuuuaucauaucaucagcagcaaccuggagaaaauugucaacccaaagggugaagaaaagccaucuauguacugaacccgggacuagaaggaaaauaaaugaucuauauguuguguggauuc

SEQ ID NO: 17586 - RNA, 9129 nt, Homo sapiens
aguuggagguuuuggucuggauauaggaacucgagcccugcuguuaagggcacgguccuuuauaaagccgagcuggccacugaaugcccgaagcucgaguucuccaacccagcuugggaacucccggcguggggaaccuacauugccagagucggguuuccgcgauucagccggugcucagccuaacggaaguggaggagccggaccucuuugugggaagcgaauugaaucaccuuggcaacccgcggggcgugcagcaacgcccuuuccuccggaagugggugucagaaccuccacgugcugucccucccccuccccuuuucggcccaguagcggcggcucaguugcugccauggagucagccgggcuagagcagcuccuacgggagcugcugcuaccggacaccgagcgcauccgucggguacggagcaggcguaaccgggccagggcgagcgggagguugcgggaaaggcccaacucucaccccuagcuuccccccaggccacggaacagcuccagaucguucuucgggcccccgccgcuuugccggcucucugcgaccugcuagccucggcggccgacccccaggugagaccccugacucuccccuccgagcuucccacuguacgccaccggucaagccccaguauucgcccacugcgguccgcucagcaccuuccugcccggacccccacgugcuugcuuccucguccuagauccgccaguuugcggccgugcugacccgcagacgacugaacacccgcuggcgacggcuggcggcggagcaacgggagaggugggcugggccugggguggggcggggccaggcggagacuuuucuugggcaggcuggguaccaaacaccugccaccuguguuccagccucaagucccugauccugacggcccugcagagagaaacagaguaaguaccuacccacuucucucgggaucuugacgacuuugucuagguuucugccuuccuuuucggcuccaggcugggacuuguggggcagggacuucaguucuagacgcaagguggagugaggauuuuaaggcuguuuugaagacuaaaguucuugaggaagggugaugaugaucugccaaacccaagucagaagaauaagacugaaauucaggcuaaguuagacugaacuuaccagauuacaugcccacagugcuguugggcucccucugagcugcugucucaugugucccaacuuggcaaagacccugugcccacaccuccugaaaguuucuguccuggcugccccauugagccuggccacugugugcagaggaagguauugaagggugauuggaggagaucucuccuguuugcaggcacugugugagccucagccuggcccagcucucagccaccauuuuucgaaaggaaggcuuggaggccuggccacagcuuuugcagcugcuucagcacaguacccacagcccccacagcccagagagagagguaccaucacaugguuggcaggagggagggccugagaggcuggauagaccuuguaagcuugcucucccauccucuauucuuggacagauggggcuuuugcugcuaagugugguggugaccucccggcccgaggccuuccaaccccaccaccgggagcuucuucggcuucugaaugagacucuuggugaggugggcucuccugggcugcucuucuacucccugcgcacucugaccaccauggcucccuaccucagcacugaagauguggugagaugugggcccucguuaucuuugacucccuuuccucaugccuucauguccucacccguaaaaguuacaaagcugcuuuggauucuuuaccugccuguggcccuuccugacaauugagaggggaugcuguaggugggccuggcuguuaugccugggcuccuccucgcaauucaggcugugaggaagcugccagcugcuggggugugagauugggcugcaucaugcucucugugaugugucccucagccucucgcucggauguuggugcccaagcugaucauggccaugcagacucugauccccauagaugaggugaggacaggugggcaggagcucuguuggaaggagagugcagaaguguccaguuuggcccacugaagaagagcaugguaaccuugugccuuguuugucugucaggcaaaggccugugaggcccuugaggcuuuggaugaacuguuggagucagaggugccggucaucacccccuaccucucugaaguccucacauucugccuggaggugagccuggaguggacauggccccugcuacaugcucugcugggacucuccuucccugucgcugauuuuuauuauucuguggacagguagcuagaaauguggcccugggcaaugcgauacgcauacguauucucugcugccucacuuucuuggucaaagucaagagcaagguaagugagugcccauugacacacaucaccccacccccaucuccacccuuagucucacuccuggggcuuucgguccaucucaggguaucuaaaguacuguggggguucaagccuuggccuggccucaccccagcuccugccugggagguugggaauuuucugucagaccccuuauggccuggaagacuggaauuuuuaaugugagcccauccugggagcagauucuuagggacacuguuccaccuucucugucaaggccuuacugaagaaucgucuccugccacccuugcugcacacccuuuuccccauuguggcugcugagcccccaccaggccaguuggaucccgaggaccaggauucagaagaggaagaguuggagauugagcugaugggggagacucccaagcauuucgcuguacaagugagauguggggcaggacagagggggaagguguuagguggcugugggacguuggggaggcagagauggagucaagcaaaguaagucuccccaucccaucucagguuguggacaugcuggcacuacaccugccccccgagaagcucuguccccagcugguaaguguggcucuguccuucuggugucccuaccuccaagugugccuagucccccugaggccaacgacguuuagacccugggaggugugaaggccuauuaccacaggaaugggcaggcucuugcugggguuucagaagcgugccacaugcuucccuagaugcccauguuggaagaggcuuugcggagcgagagcccauaccagcgcaaagcuggacuccuggugcuggccgugcugucugacggagcuggcgaccacaucaggcagagguauguauuccccugucccagggugaggguugcccacagggaggaccauggcuguccugguuuacgcuuguuguucaagcuuauuuaucaacagcguuuccccccauuaucaaaaguguccuggcuuggaagauaaaugacauggcuuaccagcuauagggaccaggggcugcugcccacccucuggugacaggaaaagccuugguuuuuccagggaaaaugaagagaacaggucagccuagggcucucagguguagcuucucagccuauguccucuuguuugccccauccagacugcugcccccacugcugcagauugugugcaagggccuggaggaccccucgcaaguuguacgcaaugcugcgcuguuugcccugggccaguucucagaaaaccuacaggugaaccaggcugaaugugggagccaccacuugaauguccccuuccccucaucuuucaucucuucaagcaucccugcugccaucagcacucuugugugugcccggcaggugaaccugacucaggcccugcuugcucccucccccagccccauaucagcagcuauucaagggagguaaugccacugcuccucgccuacuugaagucggugccucuuggacacacacaccaccuagccaaggccugcuaugcccuggagaauuuuguggagaaccuagguagugauggcaguggggagcuuggggaagggggaugaggcggcggcuuuggcugaauguacaggaugugcaucucccugcauugcugccugugguaggggaaagggugugauggugccaaaaaaagguuuccgccuggagggaggugggcgugcagguagcagaccuggguugguugguagaggagcauccuuucccacagggcccaaggugcagcccuaccuuccggagcuuauggaaugcaugcugcagcuucugaggaaccccagcaguccccgggccaaggagcuggcugugagcgcccugggagccauuggugaggagagaggcaggaggcagggaugugggguucacccaaaggcccuguggcugguggucccugcccucuccagcucugauucuguccuuccauccugcagcuacggcugcccaggccucgcugcugcccuacuucccugccaucauggagcaccugcgggaauuccuguuaacaggccgugaggaccuucagccugugcagauccagagccugggugagugagagguucccagguggggcucccagugccagcaaagggcuggugcucaccugguguugacagauugcccccacaggagcacggaugucuuccuucucaucaaaggggugugcuucaugcuguaccaagggguggggcgggauuucugaaucccucccagccaccaccuuuggucccguagcccaccuccaccuccuggugcuaauggagcccuugcccccacagagacacugggggugcuggcacgagcagugggggagcccaugaggccgcuggcugaggaaugcugccagcugggucugggccucugcgaccagguagacgacccugacuugcggcgcugcacgugagugaccccucacccugccucugcccuuguccccuccccuccugucuucccacuggacccacuggaauccccaccccagacuccagucgucugguuuggaccauagccagguguucccgggcucccccauccugccuggugguagcaggcaggaccuuacagcuucuucugccugcuuugaccagguacagccuauuugcagccuuaucgggucugaugggugagggccuggcgccccacuuggaacagaucaccacgcucaugcugcugucacugcguuccaccgagggcauuguggugagcaaagggugggugggcugggccaggccugcccugcaaugggauuuaucuccugggcccagcugagccaaaguccuugccgugccuccgcuccagccucaguaugacgggagcagcuccuuccuucuguuugacgaugagagugauggggaagaagaggaggagcucauggaugaggauguggaagaagaggaugacucagagaucucagggugcggaggggugcucuucugaucaggaaucuagacuuuggcuuuagacaagggccuagugcuggaucugcuccucuuggugccugaucaccacugccuccccuucuuacucuagguacagcguggagaaugccuucuucgaugagaaggaagacaccugugcugccgugggggagaucucugugaacaccaggugagcauucgcccuucccuggcacugaaaacccugccugggggccccuuacccacggcugugucucucucuguaguguggccuuccuuccauacauggaaagugucuuugaagaaguauuuaaacugcuggaggugagcgggccggcggguggagugggugggguucucaggcugggggcccuguguucacggugcacauagcagacauaucccgccccuccucauccugcagugcccucaccugaaugugcggaaggcagcccaugaggcucugggucaguuuugcugugcacugcacaaggccugucaaagcugccccucggaacccaacacugcuggugaggagaggcugggccaggcuggggguucuuggggaggggcagggccugacuggugcuucagccaauaauguccccagcuuugcaggcugcccuggcccgagucgugccauccuacaugcaggcagugaacagggagcgggaacgccagguggugauggccgugcuggaggcccugacaggggugcuccgcagcugugggacccucacacugaagcccccugggcgccucgcugagcucuguggcgugcucaaggcugugcugcagaggaaggugagcagggcaggugggcuucgggaaggagaggugcugggccucgguuggggacuggcuacaaguccacccccuacccccaugaaaagagaaggggcgugaaagcuccgcuaaguugagcuacuucuuguagacagccugucaggauacugacgaggaggaggaagaggaagaugaugaucaggugagagccagggauaaaaacggggaccaggcgguccaggcagucuccacagggacagggguggacaguguauuugggcuuggccuggggcagccagggccacuaaaagagacugguaauggccagagggauacaacccugaucccacuaagccagugggaguucagggaaggagagcaguguggacuggggugugcuuggagugauagguaggagcagaagagccaggggaagaagcugggucauggaaacacccagcuugagaggggccagcccuaucaaccaagggcagccccagggaccccugcagcugguggcagagcgugggagggagguguacagucacugagcuggcccuggugcuccagccccugaccuggcuccacaggcugaauacgacgccauguugcuggagcacgcuggagaggccaucccugcccuggcagccgcggcugggggagacuccuuugccccauucuuugccgguuuccugccauuauuggugugcaagacagugaguguccaucuucuggcuucaagcccuaguccccucgugcacccggugcccaccacagccuuuauccuuggcccaggcugaucuguacuccuuccuguucucccccaucagaaacagggcugcacaguggcagagaaguccuuugcaguggggaccuuggcagagacuauucagggccugggugcugccucagcccaguuugugucucggcugcucccugugcuguugagcaccgcccaagaggcagaccccgaggugcgaagcaaugccaucuucgggaugggcgugcuggcagagcaugggggccacccugcccaggaguauccuuggcucgcaggacgggagggacuggagguugggggaguguccccagggcuugcaggugggcaaggucuaccugagcguguggccauuccuugacuguggaccagacacuuccccaagcugcuggggcuccuuuuuccccuccuggcgcgggagcgacaugaucguguccgugacaacaucuguggggcacuugcccgccuguugauggccagucccaccaggaaaccagagccccaggugagggagggagacaucaggcagggcuuggaagcugaggagggagggugguggagggcagggcagguuggccugagacauuugugugcccaggugcuggcugcccuacugcaugcccugccacugaaggaggacuuggaggagugggucaccauugggcgccucuucagcuuccuguaccagagcagcccugaccagguaaccuugcugcuggcagcccucagaggggaacgugccgcuccacucagugauaggcacugucugcugaugaggcucgggagcuccaggcugucaguugcaccugaugcaaggugacaguuucagcuguucuuuugguacucccugcaccauuucuuauuugucugcaaggauuggcagccaguccugugaugggacaggagggacuuccuuucuccacguagcauuuuuccugaggaagcuccauuucuacccuuuggucugagccagaaguugcaguuuuccuaggcugguuuccuaaaccggggcccuuucaaacugugcucuguggagcccaggguaccucugggccaccacaccauacauuucaaucagaucagcucugcucucugaagagauuuugccuguaccaaguagcuagguuuggagucaugucagaguguuugugucacccuugucuuauaccuuuagagacuguuguguaggugaagcuccugagugucuggguuucuuuaggucuugaggcuaugacuuuaaucaucuugucccacaucccccauucccuccaaaaaaaaucauuagcaccaaguuucauugguucuucucauguucauaguugucuuggaugccugugaaucaguaccaggugcaaccaccccccugauaagagauucugccacuccuugguccugaccacccuccuagaccuggggucuggggcugcugcccugagucagccacucuuuccucacagguuauagauguggcucccgagcuucugcguaucugcagccucauucuggcugacaacaagaucccaccaggugaggguaggagucauaggcaggggcuugcgggaggcugggaguggcagggcucagagagccuggggcagcgaggcuuuaggagccccgaccuuucucccucccucuccacccagacaccaaggccgcacuguugcugcuccugacguuccuggccaaacagcacaccgacagcuuucaagcagcucugggcucacugccuguugacaaggcucaggagcuccaggcuguacugggccucuccuagacugcaggcugcagccaguccagagagaauagagccugcccaggccuuaagaccaccucucagcccaguucaguucugccuuaccaaagauucugagacucauacccauuuggagccagccccacuugcugccuuacagggcugucccugaggcuggaucuguuacaaaugagucaugacaucauacuguaauaaaagcagcuuguuuucugcuugaacaauagcucugagagcaagaaggcuggaaaugcacauucagaaaugagguaagcaggacccagugaggcacgacgugguuuacuagaaguggccgguuuccuggcagcuuuguaaauggacucuaaccucaguggaaucugggccccggcuggaucaggaggcgaccauauggcuuuucuuguuucacgugaagaaucuguugcgcugagagc

SEQ ID NO: 17587 - RNA, 6919 nt, Homo sapiens
cgccucucagggcucagccucagcagcaggugguucagccggaaagugcuucgaacccagacgccgccugcgcuccaucuccccggcccucgcuagucccgucccgcggggacagcucucgggccucggccagcgcgagccuccuggccaagagcucucaaaccccaaaucuuuccaggagcaagcgagcggccuagcagccacuccucucccgaaggggugucaggguccucgcugccaggccucagcccccuccccgggaagccgucgcgaaggaguccccaggggccgcagcagcgaaggcccucugcguuccaggcaaggagcuuuccgccaggcugaggucgccgccggugagggcggaagugguaagacugacguguccugggccgcgcugccgaucgccgggaggacccccgccucgccgaagacgggcggggcaagccgagccucacgggguccccggagcugggccgggccuccagauggagaaggcgcaacggggaguucuugaguaagccagagcgguguccagcgcgguguagccgcagccgccgcugucaggcgcagcaacgggcaaccccguagaagucggucggcagguccucuccaacccgccgcuaccgcgccgcugugggagagaccccagcaggagcccaaaggcagcuacgggggcgcgaaggccgcuggcgccgccucggccagcccuucccgcgcggugaggaccccggggcuguggcgggaagggacccgaggugcgagaccgagcggcguugccauggaaacgggccagggcgcguaguagaggccccgggccagacgggcugcggguggggugaaccccagguugggaggaugagagagcagagguggagcggggucuuugggauagagagacgugggguagggugaggcggggagggggccaaugggagcaaguggagccaggggaccucaguucgaggcaccugaccugggguuucuguaaccucccugguuucuauaaccucaggauucccccaaacagguuccacugccuuaaggaugacagucguagggaacccucgaaguuggagcugccagugguugccaauccugauacuguugcugggcacaggccaugggccagggguggaaggcgugacacacuacaaggccggcgacccuguuauucuguaugucaacaaagugggacccuaccauaacccucaggaaacuuaccacuacuaucagcuuccagucugcugcccugagaagauacgucacaaaagccuuagccugggugaagugcuggauggggaccgaauggcugagucuuuguaugagauccgcuuucgggaaaacguggagaagagaauucugugccacaugcagcucaguucugcacaggucagccucuccacauuggcuaucacguagcccuccuucccagagacuaacagugccuuacauuuaugguucaggguaccuuuauggaaauugucugauuugauucuaacuacaauacaacccaguguggcaggcagguuaggugaugcuauucuaauucaguugacuaagauacauacuugcucagaaguuacuuuuuucaagauuacauggacagugauuugcagaacugauaucagagcccaggguuucuuacugcaagcuucucuguuggucaugaggucccaacuaucagucccacauaguucuguuuccuuccaugccuaccucuuggcuguuucuuagcuguuuccuguagucucuaccuaaacuucccugucaugcuuuuucuuuagugaauccugguacuucuccuuaguccacuccagaccuccuuauaccucaccgcucuccuuuuucuaggccuuaacccugucaagccauacuugcucuuuuuuggagaaucucaacauacuagagucuaacccagugauugucaacagggaacaguuuugucccccaagggacauuuagcaaugucuggagacauuuuuuguuguuacagcuggggggguacuaccagcauagaaugggaagaggccaggaaagcuacauccuacagugcacgggauaaccccacuaugacaaagaauuauccaacccaggcugggugugguggcucacuccuguaaucccagcacuuuuuuuuuuuuuuugagacagagucuugcucugucgcccaggcuggagugccguggcgcaaucucggcucacugcaagcuccaccucccggguucacgccauucuccugccucagccucccgaguagcugggacuacaggcgcccgccaccacgcccagcuaauuuuuuguauuuuuaguagagacgggguuucaccguguuagccaggauggucucgaucuccugaccucgugaucugcccgccucggccucccaaaguguugggauuacaggcaugagccuccgcacccgaccaaucccagcacuuugggaggccgaggcaggcagaucaugaggucaggaauuugagacuagccuggccaacauggugaaacccugucucuacuaaaaauacaaaaauuagcugggugugguggugggcgccuguaaucccagcuacucgggaggcugaggcaggagaauugcuugaacccaggaggcagaaguugcaguaagccgagaucgcaccacugcacuccagccugggugacagagcaagacuccaucucgaaaaaaaagaauuauccaccccaaaauaucaguagugcugaaggugagaaacuuugcuguaacucugcgccuggggagaucuugugugaccaacuccugacuugcucuuuauagguggagcagcugcgccaggccauugaagaacuguacuacuuugaauuugugguagaugacuugccaauccggggcuuugugggcuacauggaggagagugguuuccugccacacagccacaagauaggacucuggacccauuuggacuuccaccuagaauuccauggagaccgaauuauauuugccaauguuucagugcgggacgucaagccccacagcuuggauggguuacgaccugacgaguuccuaggccuuacccacacuuauagcgugcgcuggucugagacuucaguggagcgucggagugacaggcgccguggugacgauggugguuucuuuccucgaacacuggaaauccauugguuguccaucaucaacuccauggugcuuguguuuuuacugguggguuuuguggcugucauucuaaugcgugugcuucggaaugaccuggcucgguacaacuuagaugaggagaccaccucugcagguucuggugaugacuuugaccagggugacaauggcuggaaaauuauccauacagaugucuuccgcuuccccccauaccguggucugcucugugcugugcuuggcgugggugcccaguuccuggcccuuggcacuggugaggugauaaaaaugaauuggggauuuaucucaugggauagaacuagguagggaguuuguucagaaaaggucuguggaucuucucuucuauccagaggggcagaccuaagggauaggguggcucuagcaagaaugcacguauucuauuguagauuuucuggauagcaaaacugggggagauuguuuugcuggaggcccugggucugggagaaggggggcugauuccucugaaauugcuagaagagacacaggugaggccuaacuugggcuuuccgcuaccguccugcaggcauuauugucauggcacugcugggcauguucaaugugcaccgucauggggccauuaacucagcagccaucuuguuguaugcccugaccugcugcaucucuggcuacguguccagccacuucuaccggcagauuggaggcgagcguuggguguggaacaucauucucaccaccagucucuucucuggugaggacuuuccuuucccuggugggccuuucuggacuuaggaaugaagaacacauuguggcuggucacaguggcucacaccuguaauccuagcacuuugggagaccgaggccggaggaucacuugagcccaaaaguuugagacaagccuagacaacauagugagacccucucucuauaacaaaaaauuagccgggcauggugguucacaucuguaaucccagcuacuugggaggcugacccaggaggauugcuugagccuggggagccagggagguugaggcuacagugagccaugauugcaccacugcacucuagcugggcugacagagugagacugucucaaaaaaaaaaaaagaacacaucauagaacuugggauagagucaggaugaggcuugaagggaaggaauauuguaaaagaaagaagaaaaccaaaaaaaaacaagaaugcauuucuuuugaauaguuuaaaauuacuaagcccucaaaauguccuaggcaguguggaaagcacucagcaauaacugugugaaguagguaauauuuccauuccacagaugaggaaacugaacuaaaggcugcuuaaguaacuugucugagauuacacuccuaaaaaguagugaacuagguuucagcagucugacuuguauucucacccauuacacuaaaauaacacccuugaauuuuuauuuugaaggugggcccacucuaggcuuucaaaccagauugcccuuucaaaggcaguaguagucucuguucugaacccuucuuguucccaauucugugugucugauuuuuaucccaucacauuuauauuugaaccaaggcuuucugaaaacagggccuuaauccaaaggaaugucucaugcuaggaauuaccaacuccaaggcaagacaggccccuggaggcagauggauuugugcuacucucagauuauguaguagcuaccuggauccuuaaugacaccggguugggggaugguguugguaagauaaagagcaaagaguccgggugugguggcucaugccuguaaucccagcacuuugggaggcugaggcaggcagaucaccaggucaggagaucgagaccauccuggcuaacacagugaaaccccaucucuacuaaaaauacaaaaaauuagccgggcgugguggcgggcgccuguaguccuagcuacucacucgggaggcugaggcaggagaauggcaugaaccugggaggcggagcuugcagugagcagagaucgcgccacugcacuccagccugggcgacagagcgagacucugucucaaaaaaaaaaaaaaaaaaaaaaaaaaaacacagaacaaagaauaaugggaccugaaaggguggaggugaaggcagucgacucugcagggacauccaggagcaugagucugccguuagaguggcaggcugcuucagcccccuccccuuuugguccuggauguaagugggugcccuuagagauguagcuccuaguguugacccucccuccgggggcccaucccugcagugccuuucuuccugacguggaguguggugaacucagugcauugggccaaugguucgacacaggcucugccagccacaaccauccugcugcuucugacgguuuggcugcuggugggcuuuccccucacugucauuggaggcaucuuugggaagaacaacgccagccccuuugaugcacccugucgcaccaagaacaucgcccgggagauuccaccccagcccugguacaagucuacugucauccacaugacuguuggaggcuuccugccuuucagguauccucccuuuauuccauggcuauuacugucagguuccugaccucaauuuuuccugucccuacucauccaguacccuaacccaacccguugaucccugguucagugguaccauucagagaucauuaaaugguuccuccuauccccaagcaggacugagcuugaaugauaugagagugucucacuuauaaagcucuccggagacauuucccccuucaccuuccugguuucugacuuuaaugccuauggacaucaugugggguuuaaagcccauuugaugacccauuuacuuuguugaauaccucuuugugccaggcaaagaauaaaguggaauaaaauggacaagaucccugcccucaaucuauuagggaagauauucuugaagugagagcggcuaaucauaggcaaaaaauccccaugaagccaggagaucuggggcagagaguggagugaacucacuuuucacaaugacccagcaacaugggagagggugggggcuggauuucagcccagccacugugcugauggugcacagcccuuuaaugcuguguaucaucucuuuucuucacagugccaucucuguggagcuguacuacaucuuugccacaguauggggucgggagcaguacacuuuguacggcauccucuucuuugucuucgccauccugcugagugugggggcuugcaucuccauugcacucaccuacuuccaguugucuggggaggauuaccgcuggugguggcgaucugugcugaguguuggcuccaccggccucuucaucuuccucuacucaguuuucuauuaugcccggcgcuccaacaugucuggggcaguacagacaguagaguucuucggcuacuccuuacucacugguuaugucuucuuccucaugcugggcaccaucuccuuuuuuucuucccuaaaguucauccgguauaucuauguuaaccucaagauggacugaguucuguauggcagaacuauugcuguucucucccuuucuucaugcccuguugaacucuccuaccagcuucucuucugauugacugaauugugugauggcauuguugccuucccuuuugcccuuugggcauuccuuccccagagagggccuggaaauuauaaaucucuaucacauaaggauuauauauuugaacuuuuuaaguugccuuuaguuuugguccugauuuuucuuuuuacaauuaccaaaauaaaauuuauuaagaaaaaggcu

SEQ ID NO: 17588 - RNA, 3417 nt, Homo sapiens
cuccaaaacagaauacuucaagaacagauuaugccacaggcaugcaauaaauucccauuuauugacagucugaccuugcuggcaggaugguuccaaaguucuguuggaagccagcucuauauccucaaucuagcaagaugagcaguuuuccagggcacaccaugguaagggggcccacccaauccugcccaucugaucccacaggcuggcccccggauagguaacuugguggcaacucuagucucucaucauguacaggggguaaaccaguucaugcgaagaucauguauuaagcugccuaacauauacaaaaacacugcuagguccugaggaaacagagaugaauaaauuacagucuuccucugaggaguuugaaauuagcaagggagacagacacauaagaaguaaaauaacacuacagugagauaugcuauaaacaaaccugggaggagauguaagggaaggcuuuauagagaaggugacauuugcacuguucaaaaaaaaaggauaaggccaggugcaguggcucaugccuguaaucccagcacuuugggaggucaaggcgggcggaucacgaagucaggaguucgagaccagccuggccaauauggugaaaccccaucucuacuaaaaaauacaaaaauuagccgggcaugguggugcgcaccuguagucccagcuacucgggaggcuggggcaggagaaucgcuugaacucggagguggagguugcagugaacugagaucacaccacuacacuccagccugguugacagugagacugucucaaaaaaaaaaaaaaaaaaaaaaaaaggccaggcacgguggcucacacuuguaaucccagcacuuugggaggccaaggcgggcagaucaugagguugggagaucgagaccauccuggcuaacacugugaaaccccgucucuacugaaaauacaaaaacaaaaauuagccgggcgugguggcaggcaccuguagucccagcuacucgggaggcugaggcgggagaauggcgugaaccugggaggcggagcuugcagugagcagagaucacgccacugcacuccggccugggcaacagagcgagacucugucucaaaaaaaaaaaaaaaaaagauaaguagggaauaggagauugggugguuuaggcaggaggaacaauaugaggcuugccggcuugagagaauaugauauucaguauuucuauuugaauacagaauaggguuccagaaggggaauguaccuugagaaguaauuaggauccaggucugagcagucucauaugccaggcuauuuugacucuaccuuguaugcucauauaaucuggguauacaucaaaaucagugcuuauuuuuuugagacagaguuugguucuuguugcccaggcuggagugcaauggugcagucucagcucacugcaaccuccgccuccuggguucaagcgauuacccugccucagccucccaaguggcugggguuauagccaugagccaccaugcccggcuaauuuuuuuuguauuuuuaguagagacgggguuucaccauguuggacaggcuggucuugaacucccgaccucagguaauccaccucggccucccaaagugcugggauuacaggagugagccacuacgcccggccucagugcuugcuuuuuuuaaaaaaaaaaaaaugcugaugaccaggcacccccuccccugagaauccugauuuuaaaaaagaaacuuuccaguagcagugugaaaaaugacccagggggaaggugacuaggagacuagcaagguggcucucaugguaguuuaggugagagaagauggagccugaaccaaagagguggaggcaagcaucuggaagauauucaggaaauaaguggagagggcuuggugacacugauaucugagcgggaagauagagagaaagaggcccaaguuucuggcuuuagagaccaggugguugucaguuagagauuauuucuaagccacucucaguucuuguucuuuuuucuuuuucuuuuucuuuuuuuuuuuuuuuuugagauggagucccgcucuguugcccaggcuggagugcaauggccugaucucgguucacugcaaccuccgcuucccagguucaagcuauucuccugccucagccucacaaguggcugggguuacaggcgcccgccaccaggcccagcuaauuuuuuuguauuuuuaguagagacaggguuucgccauguuaggcuggucucgaacucccgaccucgggugaucugcccgccuuggccucccaaagugcugguauuacaggcgugagcccaccgcgcccgaccucaguucuuuuucuaauuagaaaauucacugauugucuaacaaaacuccaccaucugcuucuuugaaccucaccuauaucugcagggaaagaacugggucagaaagggcaguaauuguagaagcagguaaauuaagggcuuuucaggccagaagucacuugugauuuuuccacugugcuucuuccccuggggagagagaagcuuaaguccacuuccuuacacguugcucccagguggcaaaacagaagucacugcucaaagguccgauuuucaaggggaacucccuagacggcagauccccuuuaaaacagcugagacaaacacaaggguaaacuuuuucaaaauaaucugccauacaaagugaagagaagcccaaagacauacacagugauaaauaagaacaaaaacauagacuaacggaccucgagauacuuuaccgucaauuaacaauaaccauguuaggcugcccaacucacagagucaaaggacagaccucucuccuugcgcgccucugcgccaaaccggguuucggcuugcuuaucgugggcucugaacggucacugugcggccagggaagucuccagcacagccucgggaagacauuccuauuacauauuuaucacuuuggcgcuggccauucgugacaggugggagacgagugaggugagauucagauguugggacccuugcaugggacagaugcccaaagcuucgccccuuccccgguuugggggccacgaaccgccucucagggcucagccucagcagcaggugguucagccggaaagugcuucgaacccagacgccgccugcgcuccaucuccccggcccucgcuagucccgucccgcggggacagcucucgggccucggccagcgcgagccuccuggccaagagcucucaaaccccaaaucuuuccaggagcaagcgagcggccuagcagccacuccucucccgaaggggugucaggguccucgcugccaggccucagcccccuccccgggaagccgucgcgaaggaguccccaggggccgcagcagcgaaggcccucugcguuccaggcaaggagcuuuccgccaggcugaggucgccgccggugagggcg

SEQ ID NO: 17589 - RNA, 7315 nt, Homo sapiens
cacccccccccccccccccacuggguuccggaaaggcucaggguugcucccgcguuucgguucagugacgucguaaauuggaaugaggcauccaguuuagcaacagcagagaugacgacucugcgauucugagagucccuggcgagcccgggcuagcgaaaagugggggcagaacgaacuacaucucccaucgugccaggaggcggucccgcccguuucccccugggaguuguagucuaacccccucggauccaacagcaaccucagugcgugaacucuguuauccagaaggccucgcccugccgccgccgaagcuggaauucgucggcuaguaguucucgccggcaacuagaggaaccuguuggcguggcccagaaggcuuagcgggauugcacgagguuaguugcuaagcaagguggucuuuggucaacugccgccuggaccaaggcaacaggaagugaguaccucuauuccggaaacuaguuaugaacccuccccgccccccgucgccaacauuccuucguuccccuaaaucagccucuugccccauugcucuuugcagggguagaagaaggaaguguagcgggguaaggaaugcaccgucagggucucucacaacccuuucccagcucuccuccccaacaaacaguaccugggauggagcccuaggguaaucgcagccacgggaugggucgaggugacaggcuucagggaccacacuucggccuuugcccgaccuuccacaacuuaagcgaagagaggccaccagccguaacagggcguuaaagcccaggggaagauugguccuuaugacuuccugccuuccagcccucagauucaucgcuaccccgaggcuaagcgccaugccucauauugacaacgaugugaaacuggacuucaaggauguccuuuugaggcccaaacgcaguacccuuaagucucgaagugaggugagcaagcuucucuacuugcuguuucuugaccccacgcucccggugggccacaaccaagaaagaugccuguccuuguccuaauaugguacguuuuuuggauuaaugaaauggucaauuuccuguucauaucugcagguggaucucacaagauccuuuucauuucggaacucaaagcagacauacucugggguucccaucauugcugccaauauggauacugugggcaccuuugagauggccaagguucucuguaagguagggcuuuccucaugccccaucccuauugguguccaguuagcccagcugacugcagagguguuugcauccccacccccaugcccagucaguucucuggcaguuagcagucaggaugcucugauuuacgguuuuuuccacuacugaagcccuuuaucugauaaguucaaaaggccaucugaauuagugagauucaaagcuaaguucugcuccgauauuucugauauaugaacagaauuuucccuuuuguccuguuuagcaguuuguacaccuugccaacuuuucccaccacccaggucacccccucacagucacaugcaucccuucaguuaugcgauuguccacauuaagcauucacuguuuuaguccagaaacuacaguuuaagcauucaaaaauccuaacuagaagauccuaggagaagcagcuuauuaauuuucuuuaauaagaacaauucauuaauaaaagaauacuucugccauucuuuuuuuaaucuuccucuucuuuaaguccuagguuccugggaguuucugggaugugccccaaaugggauguguuuuucuuauauacaaguuguucacuuugaaauggaagaugcugcuccugucaguacuauuaccugccucuauacuuguugcugagaagguagagaguuaucugggcacuuugagaacauaugcacucugcugguugauccauguagcccugguugaugaauucugcuauuguuuguggcuccauuagucuuaaggacuucauauccuuuuucuauuuuugauugcugugucuuuguggaaugucuugucauuucuuuaagguugauaguuaugcaguuuuauuuuuacuuuauuuuuauugccauucaguaacugcuuaggaaucuuucuguugcccacuguccaucugcccugaccaguagaguucagaauuggugacucugacugcagaguuaacaggcgugcuguaauacaugaaccuuuuuggggacugucuugaugcuuuauguggagccuggcuuucaguauugcugacgagagguaaagaaaucagguuuuagagauaagagccaagucuuacuguaauaaaaagguuggaugcaagcaaacaucuuuuucuaaguuugguauguaaucugaugugcucaucaugccacacucugccaguauaucuccaacaucugcugacuuccuauccuauggugacuuuucuuugcuuaucaguauguugaugauagaguuguugagaaagcagaauucaauaccagcuuuagcuagauauuguugaucucugaguacguauguagagcacuuguugcuagcuaauacaugacuuccuuggguuucuuguuaguugcaagauuugugcuguuucagccaacugcugucucuugucuguuugcauguagacauguaaggcacaaacaccagcauacacaauggccuuugaaugccuuccucaaaguauugggauauuguuugcaaucuguugagcuagagaauaugaguuugaugagucauuauguccuugaacuuuauuaaaauggacugaaugaaacagauuuuuuagcuugauccauguccccaacuaggaaauuuguccuuuuuuccacuagagauggagacaggguaggguagccccuuaucagcucuuaucaaccuuaaggcauuaccuuuggugagcauccagaucuacugaauuacugcugguaaaugaacgagaacauaaccaaaaauaguuuaguacuagguuaccuuaggaggaggggcugagucagugcagagaaacacaggcuccauccagcuucuucaugguucuuucaugucugcugccugucccacugcaccagcagcuugucaccuuuuaagucagaagcagugaaugugcuggcagaugaaauccaacccagaucacucaguacuuuggugggaaaucugacaaguacuagcuuaugguaaaaagcccuacuaguauuuguagagagaagaaagguugaacucaaaucccagcucaaccugaguucuuugacuuguuuccuccccaacuucaaucauguccucccucagauagaauaggucuguuucuagaaaagagaccuuaauaaaguuuucucccuuuugaugcuucuuugucuucuccccaguucucucucuucacugcuguccauaagcacuauagccucguucaguggcaagaguuugcuggccagaauccugacugucuugagguaacacugggcauacccugcucccuuccuuaucccaguuuuccagcaauuauauuuuggcuuucuggggaccagcacucaccaaugacccacuggcugcccaccagaucaucucugauaugccaaugacucuguuucucccacagcaucuggcugccagcucaggcacaggcucuucugacuuugagcagcuggaacagauccuggaagcuauuccccaggugaaguauauaugccuggauguggcaaauggcuacucugaacacuuuguugaauuuguaaaagauguacggaagcgcuucccccagcacaccaucaugguauguuucuauuacagucgguaccuuuuuaucuuuccacuuuccugccacuccguuuugcuacaucaguccauuucuccucugcugcauuaugauauuccuaguucauuuaaucaugauacuggaugauuauccauaguucuaagcugaaaaugucuauuuggucaguguaguaucucugacccuugguucauagucuuuguaaaucugaugucccugaugucacucaccaaaccaugauggaacaucugugcacuguacauaccugugguacauagacaucugcccacugaaauggacacauacuagucacauaaaaaggggucacaugaauaaugauuuaucuuuuuacaaccuuagaagaguggccuucauuuucuucgcagcauugaggggugugucuacugaucaucaaaagccaaucaacuggucaaaugggucuuuagccuauacuaccaugccuucucccuuucccugaagccagacagguucuaugacagaauggcuuaaggacagaauauguuugggucucuugaggaaggggagcuaaaucuacuguaaaucagaugugagccugguccaguaguucccuuugccucacugaaugcuccuccaugccacuucaugugucccuguugaucauagcaccuuguugccuuagaaaagugcaucauggaccucggcuuuacccuagguucaguggugacauuggccacucacuccuaccuuggcuugguguuggguggauggguagggagcaggguucucuaaaguggcuaguguaaaagcccucagagggcccaguagaggggaccuaguuauccuuucuuuguaauaauguuggaaagucaugguccaugcauaccguaacaauacaugaccuccuguuucuggcccuaaggaugcuguauuucaauugcucugucucaggcagggaaugugguaacaggagagaugguagaagagcucauccuuucuggggcugacaucaucaaagugggaauugggccagguaagcugguucauuggggccacuggcuaccccccuucaguggcaaacaccuguggagcacgucauucuuacccuuaucauguucuuccuaggcucuguguguacuacucggaagaaaacuggagugggguauccacagcucagcgcagugauggagugugcagaugcugcucauggccucaaaggccacaucauuucaguaaggcucaagggcaggguaggguaugagcgggguuucugcaggguauggagguggcagagauggauuagaauuccuggguucuuguuggcuuugaguugggcuguugggacaucgcugagggcuugggaaauccauguuguauucauagugcuccuuacuuugcaggauggagguugcagcuguccuggggauguggccaaggcuuuugguaaggagcuugagggcacagaaggaugauucuauacaagaggaugaaucaccucugagggucuagggucaggcuaagagaggcucaggaagucauucagauucuuucauaauaugaauuagugacuccgaagucuaugguaucaucuggggcagccagcaggggacaucugagacuccaagugugggccagggccaucugaccaucuccuagauugcugcacagugcagacuccugagccccagccauaccuaaaaauaggcucugaggaaugggacagcacaucugcauuuuucauuuugcacagcuucccaggagaucauuacucccauuaaaguuggggaucuuugcucuugggacacaugaaaugagucuuauuuagcugggcacaguaaaaucaaaugaccagacgaugaugguaaaaacagcaaaaggagaaagcaaaagccaggcagggacucuccagaggcucuuuuuuaaaucuuggggaaaucauacccacugaggaauagaggccagggcagaucaggccugcguggauugugggucagcuagggaagcagaaggaggaagacgcuggaaucauugucaggacugagaauauggugugaguugcuuuugaggguggccaugugagcaccuuggccagauuaaucucuuuccccccuccaugaugguggcaggggcaggagcugacuucgugaugcuggguggcaugcuggcugggcacagugagucagguggugagcucaucgagagggauggcaagaaguacaagcucuucuauggaaugaguucugaaauggccaugaagaaguaugcugggggcguggcugaguacagguauguguggaggcccaggagcuuaguaauaguauggaggcagaacucauggcugcugagagggggaugguacaguucucagagaagcauggugaaccggggcucaaugcuagggucuguggaaaagucccugggcuuaaggaauccagaaggagaagauaauaaaguuuuuccuacuuuaagagccucagagggaaagacaguggaaguuccuuuuaaaggagauguggaacauaccauccgagacauccuaggagggauccgcucuacguguaccuaugugggagcagcuaagcucaaagaguugagcaggagaacuaccuucauccgagucacccagcaggugaauccaaucuucagugaggcgugcuagaccugagcaguucuacccucccaaggcaccaguacucuaccauggggcaucccaagugggguccucacccaucccagcuacugcagcucuguauuacuuugucauuuccuguugucucacuccugagggcuccugcaguaacucuguacuucucuaucugcacacacaaaaugcccaaggcacucacuggggaggaagcaaggaagcaaacagucugagaaaaugaugcaagaaaaucaaaugggaaucuggggacccaacacaacauccugaagauuauuaaaaggaaaagaugcugauugguacauaaaucuuuuacauggccuuggucuagaggaggcaggcuuuuagaaucauguuuuguuaauccgcuucacuaaauuggaccuucacauaucuaaaaagcucugaaguguuuguauauuugaaauaccucaauaaagagagagcucauugacuguaaagagaugcuggggcuuucuguacaaggcuagcaucugggugcugcugcagaguggguggugguagggucagcacugacccaguggggucaagaacaaugaguauuauucccaugaaguaucuccauucuagugccaccacacccagauaaucuggcagcaugagaauuuacaaaguauauucuggccugaggacacauauuuccagaauaccaaaggacauuucucuuccaggcuuucaacccugcuaacccuuuuaggcacagcugaacaacacuuagcaagggaaguaaaaaaaggcaaagggauccuuucaguuuggaagggccaguucuguuucuaaggaaugacuuaugcugaccuuauggaaaccuuaauuccccuccuucacaucaaggcaguauuuuaacaaauccaaaguuuaauuauuaaggauuacaaauauuuuuagcaguguaguuaggca

SEQ ID NO: 17590 - RNA, 7315 nt, Homo sapiens
ugccuaacuacacugcuaaaaauauuuguaauccuuaauaauuaaacuuuggauuuguuaaaauacugccuugaugugaaggaggggaauuaagguuuccauaaggucagcauaagucauuccuuagaaacagaacuggcccuuccaaacugaaaggaucccuuugccuuuuuuuacuucccuugcuaaguguuguucagcugugccuaaaaggguuagcaggguugaaagccuggaagagaaauguccuuugguauucuggaaauauguguccucaggccagaauauacuuuguaaauucucaugcugccagauuaucugggugugguggcacuagaauggagauacuucaugggaauaauacucauuguucuugaccccacugggucagugcugacccuaccaccacccacucugcagcagcacccagaugcuagccuuguacagaaagccccagcaucucuuuacagucaaugagcucucucuuuauugagguauuucaaauauacaaacacuucagagcuuuuuagauaugugaagguccaauuuagugaagcggauuaacaaaacaugauucuaaaagccugccuccucuagaccaaggccauguaaaagauuuauguaccaaucagcaucuuuuccuuuuaauaaucuucaggauguuguguuggguccccagauucccauuugauuuucuugcaucauuuucucagacuguuugcuuccuugcuuccuccccagugagugccuugggcauuuugugugugcagauagagaaguacagaguuacugcaggagcccucaggagugagacaacaggaaaugacaaaguaauacagagcugcaguagcugggaugggugaggaccccacuugggaugccccaugguagaguacuggugccuugggaggguagaacugcucaggucuagcacgccucacugaagauuggauucaccugcugggugacucggaugaagguaguucuccugcucaacucuuugagcuuagcugcucccacauagguacacguagagcggaucccuccuaggaugucucggaugguauguuccacaucuccuuuaaaaggaacuuccacugucuuucccucugaggcucuuaaaguaggaaaaacuuuauuaucuucuccuucuggauuccuuaagcccagggacuuuuccacagacccuagcauugagccccgguucaccaugcuucucugagaacuguaccaucccccucucagcagccaugaguucugccuccauacuauuacuaagcuccugggccuccacacauaccuguacucagccacgcccccagcauacuucuucauggccauuucagaacucauuccauagaagagcuuguacuucuugccaucccucucgaugagcucaccaccugacucacugugcccagccagcaugccacccagcaucacgaagucagcuccugccccugccaccaucauggaggggggaaagagauuaaucuggccaaggugcucacauggccacccucaaaagcaacucacaccauauucucaguccugacaaugauuccagcgucuuccuccuucugcuucccuagcugacccacaauccacgcaggccugaucugcccuggccucuauuccucaguggguaugauuuccccaagauuuaaaaaagagccucuggagagucccugccuggcuuuugcuuucuccuuuugcuguuuuuaccaucaucgucuggucauuugauuuuacugugcccagcuaaauaagacucauuucaugugucccaagagcaaagauccccaacuuuaaugggaguaaugaucuccugggaagcugugcaaaaugaaaaaugcagaugugcugucccauuccucagagccuauuuuuagguauggcuggggcucaggagucugcacugugcagcaaucuaggagauggucagauggcccuggcccacacuuggagucucagauguccccugcuggcugccccagaugauaccauagacuucggagucacuaauucauauuaugaaagaaucugaaugacuuccugagccucucuuagccugacccuagacccucagaggugauucauccucuuguauagaaucauccuucugugcccucaagcuccuuaccaaaagccuuggccacauccccaggacagcugcaaccuccauccugcaaaguaaggagcacuaugaauacaacauggauuucccaagcccucagcgaugucccaacagcccaacucaaagccaacaagaacccaggaauucuaauccaucucugccaccuccauacccugcagaaaccccgcucauacccuacccugcccuugagccuuacugaaaugauguggccuuugaggccaugagcagcaucugcacacuccaucacugcgcugagcuguggauaccccacuccaguuuucuuccgaguaguacacacagagccuaggaagaacaugauaaggguaagaaugacgugcuccacagguguuugccacugaagggggguagccaguggccccaaugaaccagcuuaccuggcccaauucccacuuugaugaugucagccccagaaaggaugagcucuucuaccaucucuccuguuaccacauucccugccugagacagagcaauugaaauacagcauccuuagggccagaaacaggaggucauguauuguuacgguaugcauggaccaugacuuuccaacauuauuacaaagaaaggauaacuagguccccucuacugggcccucugagggcuuuuacacuagccacuuuagagaacccugcucccuacccauccacccaacaccaagccaagguaggagugaguggccaaugucaccacugaaccuaggguaaagccgagguccaugaugcacuuuucuaaggcaacaaggugcuaugaucaacagggacacaugaaguggcauggaggagcauucagugaggcaaagggaacuacuggaccaggcucacaucugauuuacaguagauuuagcuccccuuccucaagagacccaaacauauucuguccuuaagccauucugucauagaaccugucuggcuucagggaaagggagaaggcaugguaguauaggcuaaagacccauuugaccaguugauuggcuuuugaugaucaguagacacaccccucaaugcugcgaagaaaaugaaggccacucuucuaagguuguaaaaagauaaaucauuauucaugugaccccuuuuuaugugacuaguauguguccauuucagugggcagaugucuauguaccacagguauguacagugcacagauguuccaucaugguuuggugagugacaucagggacaucagauuuacaaagacuaugaaccaagggucagagauacuacacugaccaaauagacauuuucagcuuagaacuauggauaaucauccaguaucaugauuaaaugaacuaggaauaucauaaugcagcagaggagaaauggacugauguagcaaaacggaguggcaggaaaguggaaagauaaaaagguaccgacuguaauagaaacauaccaugauggugugcugggggaagcgcuuccguacaucuuuuacaaauucaacaaaguguucagaguagccauuugccacauccaggcauauauacuucaccuggggaauagcuuccaggaucuguuccagcugcucaaagucagaagagccugugccugagcuggcagccagaugcugugggagaaacagagucauuggcauaucagagaugaucuggugggcagccagugggucauuggugagugcugguccccagaaagccaaaauauaauugcuggaaaacugggauaaggaagggagcaggguaugcccaguguuaccucaagacagucaggauucuggccagcaaacucuugccacugaacgaggcuauagugcuuauggacagcagugaagagagagaacuggggagaagacaaagaagcaucaaaagggagaaaacuuuauuaaggucucuuuucuagaaacagaccuauucuaucugagggaggacaugauugaaguuggggaggaaacaagucaaagaacucagguugagcugggauuugaguucaaccuuucuucucucuacaaauacuaguagggcuuuuuaccauaagcuaguacuugucagauuucccaccaaaguacugagugaucuggguuggauuucaucugccagcacauucacugcuucugacuuaaaaggugacaagcugcuggugcagugggacaggcagcagacaugaaagaaccaugaagaagcuggauggagccuguguuucucugcacugacucagccccuccuccuaagguaaccuaguacuaaacuauuuuugguuauguucucguucauuuaccagcaguaauucaguagaucuggaugcucaccaaagguaaugccuuaagguugauaagagcugauaaggggcuacccuacccugucuccaucucuaguggaaaaaaggacaaauuuccuaguuggggacauggaucaagcuaaaaaaucuguuucauucaguccauuuuaauaaaguucaaggacauaaugacucaucaaacucauauucucuagcucaacagauugcaaacaauaucccaauacuuugaggaaggcauucaaaggccauuguguaugcugguguuugugccuuacaugucuacaugcaaacagacaagagacagcaguuggcugaaacagcacaaaucuugcaacuaacaagaaacccaaggaagucauguauuagcuagcaacaagugcucuacauacguacucagagaucaacaauaucuagcuaaagcugguauugaauucugcuuucucaacaacucuaucaucaacauacugauaagcaaagaaaagucaccauaggauaggaagucagcagauguuggagauauacuggcagaguguggcaugaugagcacaucagauuacauaccaaacuuagaaaaagauguuugcuugcauccaaccuuuuuauuacaguaagacuuggcucuuaucucuaaaaccugauuucuuuaccucucgucagcaauacugaaagccaggcuccacauaaagcaucaagacaguccccaaaaagguucauguauuacagcacgccuguuaacucugcagucagagucaccaauucugaacucuacuggucagggcagauggacagugggcaacagaaagauuccuaagcaguuacugaauggcaauaaaaauaaaguaaaaauaaaacugcauaacuaucaaccuuaaagaaaugacaagacauuccacaaagacacagcaaucaaaaauagaaaaaggauaugaaguccuuaagacuaauggagccacaaacaauagcagaauucaucaaccagggcuacauggaucaaccagcagagugcauauguucucaaagugcccagauaacucucuaccuucucagcaacaaguauagaggcagguaauaguacugacaggagcagcaucuuccauuucaaagugaacaacuuguauauaagaaaaacacaucccauuuggggcacaucccagaaacucccaggaaccuaggacuuaaagaagaggaagauuaaaaaaagaauggcagaaguauucuuuuauuaaugaauuguucuuauuaaagaaaauuaauaagcugcuucuccuaggaucuucuaguuaggauuuuugaaugcuuaaacuguaguuucuggacuaaaacagugaaugcuuaauguggacaaucgcauaacugaagggaugcaugugacugugagggggugaccuggguggugggaaaaguuggcaagguguacaaacugcuaaacaggacaaaagggaaaauucuguucauauaucagaaauaucggagcagaacuuagcuuugaaucucacuaauucagauggccuuuugaacuuaucagauaaagggcuucaguaguggaaaaaaccguaaaucagagcauccugacugcuaacugccagagaacugacugggcauggggguggggaugcaaacaccucugcagucagcugggcuaacuggacaccaauagggauggggcaugaggaaagcccuaccuuacagagaaccuuggccaucucaaaggugcccacaguauccauauuggcagcaaugaugggaaccccagaguaugucugcuuugaguuccgaaaugaaaaggaucuugugagauccaccugcagauaugaacaggaaauugaccauuucauuaauccaaaaaacguaccauauuaggacaaggacaggcaucuuucuugguuguggcccaccgggagcguggggucaagaaacagcaaguagagaagcuugcucaccucacuucgagacuuaaggguacugcguuugggccucaaaaggacauccuugaaguccaguuucacaucguugucaauaugaggcauggcgcuuagccucgggguagcgaugaaucugagggcuggaaggcaggaagucauaaggaccaaucuuccccugggcuuuaacgcccuguuacggcugguggccucucuucgcuuaaguuguggaaggucgggcaaaggccgaaguguggucccugaagccugucaccucgacccaucccguggcugcgauuacccuagggcuccaucccagguacuguuuguuggggaggagagcugggaaaggguugugagagacccugacggugcauuccuuaccccgcuacacuuccuucuucuaccccugcaaagagcaauggggcaagaggcugauuuaggggaacgaaggaauguuggcgacggggggcggggaggguucauaacuaguuuccggaauagagguacucacuuccuguugccuugguccaggcggcaguugaccaaagaccaccuugcuuagcaacuaaccucgugcaaucccgcuaagccuucugggccacgccaacagguuccucuaguugccggcgagaacuacuagccgacgaauuccagcuucggcggcggcagggcgaggccuucuggauaacagaguucacgcacugagguugcuguuggauccgaggggguuagacuacaacucccagggggaaacgggcgggaccgccuccuggcacgaugggagauguaguucguucugcccccacuuuucgcuagcccgggcucgccagggacucucagaaucgcagagucgucaucucugcuguugcuaaacuggaugccucauuccaauuuacgacgucacugaaccgaaacgcgggagcaacccugagccuuuccggaacccagugggggggggggggggggug

SEQ ID NO: 17591 - RNA, 7384 nt, Homo sapiens
aaccuuaaggcauuaccuuuggugagcauccagaucuacugaauuacugcugguaaaugaacgagaacauaaccaaaaauaguuuaguacuagguuaccuuaggaggaggggcugagucagugcagagaaacacaggcuccauccagcuucuucaugguucuuucaugucugcugccugucccacugcaccagcagcuugucaccuuuuaagucagaagcagugaaugugcuggcagaugaaauccaacccagaucacucaguacuuuggugggaaaucugacaaguacuagcuuaugguaaaaagcccuacuaguauuuguagagagaagaaagguugaacucaaaucccagcucaaccugaguucuuugacuuguuuccuccccaacuucaaucauguccucccucagauagaauaggucuguuucuagaaaagagaccuuaauaaaguuuucucccuuuugaugcuucuuugucuucuccccaguucucucucuucacugcuguccauaagcacuauagccucguucaguggcaagaguuugcuggccagaauccugacugucuugagguaacacugggcauacccugcucccuuccuuaucccaguuuuccagcaauuauauuuuggcuuucuggggaccagcacucaccaaugacccacuggcugcccaccagaucaucucugauaugccaaugacucuguuucucccacagcaucuggcugccagcucaggcacaggcucuucugacuuugagcagcuggaacagauccuggaagcuauuccccaggugaaguauauaugccuggauguggcaaauggcuacucugaacacuuuguugaauuuguaaaagauguacggaagcgcuucccccagcacaccaucaugguauguuucuauuacagucgguaccuuuuuaucuuuccacuuuccugccacuccguuuugcuacaucaguccauuucuccucugcugcauuaugauauuccuaguucauuuaaucaugauacuggaugauuauccauaguucuaagcugaaaaugucuauuuggucaguguaguaucucugacccuugguucauagucuuuguaaaucugaugucccugaugucacucaccaaaccaugauggaacaucugugcacuguacauaccugugguacauagacaucugcccacugaaauggacacauacuagucacauaaaaaggggucacaugaauaaugauuuaucuuuuuacaaccuuagaagaguggccuucauuuucuucgcagcauugaggggugugucuacugaucaucaaaagccaaucaacuggucaaaugggucuuuagccuauacuaccaugccuucucccuuucccugaagccagacagguucuaugacagaauggcuuaaggacagaauauguuugggucucuugaggaaggggagcuaaaucuacuguaaaucagaugugagccugguccaguaguucccuuugccucacugaaugcuccuccaugccacuucaugugucccuguugaucauagcaccuuguugccuuagaaaagugcaucauggaccucggcuuuacccuagguucaguggugacauuggccacucacuccuaccuuggcuugguguuggguggauggguagggagcaggguucucuaaaguggcuaguguaaaagcccucagagggcccaguagaggggaccuaguuauccuuucuuuguaauaauguuggaaagucaugguccaugcauaccguaacaauacaugaccuccuguuucuggcccuaaggaugcuguauuucaauugcucugucucaggcagggaaugugguaacaggagagaugguagaagagcucauccuuucuggggcugacaucaucaaagugggaauugggccagguaagcugguucauuggggccacuggcuaccccccuucaguggcaaacaccuguggagcacgucauucuuacccuuaucauguucuuccuaggcucuguguguacuacucggaagaaaacuggagugggguauccacagcucagcgcagugauggagugugcagaugcugcucauggccucaaaggccacaucauuucaguaaggcucaagggcaggguaggguaugagcgggguuucugcaggguauggagguggcagagauggauuagaauuccuggguucuuguuggcuuugaguugggcuguugggacaucgcugagggcuugggaaauccauguuguauucauagugcuccuuacuuugcaggauggagguugcagcuguccuggggauguggccaaggcuuuugguaaggagcuugagggcacagaaggaugauucuauacaagaggaugaaucaccucugagggucuagggucaggcuaagagaggcucaggaagucauucagauucuuucauaauaugaauuagugacuccgaagucuaugguaucaucuggggcagccagcaggggacaucugagacuccaagugugggccagggccaucugaccaucuccuagauugcugcacagugcagacuccugagccccagccauaccuaaaaauaggcucugaggaaugggacagcacaucugcauuuuucauuuugcacagcuucccaggagaucauuacucccauuaaaguuggggaucuuugcucuugggacacaugaaaugagucuuauuuagcugggcacaguaaaaucaaaugaccagacgaugaugguaaaaacagcaaaaggagaaagcaaaagccaggcagggacucuccagaggcucuuuuuuaaaucuuggggaaaucauacccacugaggaauagaggccagggcagaucaggccugcguggauugugggucagcuagggaagcagaaggaggaagacgcuggaaucauugucaggacugagaauauggugugaguugcuuuugaggguggccaugugagcaccuuggccagauuaaucucuuuccccccuccaugaugguggcaggggcaggagcugacuucgugaugcuggguggcaugcuggcugggcacagugagucagguggugagcucaucgagagggauggcaagaaguacaagcucuucuauggaaugaguucugaaauggccaugaagaaguaugcugggggcguggcugaguacagguauguguggaggcccaggagcuuaguaauaguauggaggcagaacucauggcugcugagagggggaugguacaguucucagagaagcauggugaaccggggcucaaugcuagggucuguggaaaagucccugggcuuaaggaauccagaaggagaagauaauaaaguuuuuccuacuuuaagagccucagagggaaagacaguggaaguuccuuuuaaaggagauguggaacauaccauccgagacauccuaggagggauccgcucuacguguaccuaugugggagcagcuaagcucaaagaguugagcaggagaacuaccuucauccgagucacccagcaggugaauccaaucuucagugaggcgugcuagaccugagcaguucuacccucccaaggcaccaguacucuaccauggggcaucccaagugggguccucacccaucccagcuacugcagcucuguauuacuuugucauuuccuguugucucacuccugagggcuccugcaguaacucuguacuucucuaucugcacacacaaaaugcccaaggcacucacuggggaggaagcaaggaagcaaacagucugagaaaaugaugcaagaaaaucaaaugggaaucuggggacccaacacaacauccugaagauuauuaaaaggaaaagaugcugauugguacauaaaucuuuuacauggccuuggucuagaggaggcaggcuuuuagaaucauguuuuguuaauccgcuucacuaaauuggaccuucacauaucuaaaaagcucugaaguguuuguauauuugaaauaccucaauaaagagagagcucauugacuguaaagagaugcuggggcuuucuguacaaggcuagcaucugggugcugcugcagaguggguggugguagggucagcacugacccaguggggucaagaacaaugaguauuauucccaugaaguaucuccauucuagugccaccacacccagauaaucuggcagcaugagaauuuacaaaguauauucuggccugaggacacauauuuccagaauaccaaaggacauuucucuuccaggcuuucaacccugcuaacccuuuuaggcacagcugaacaacacuuagcaagggaaguaaaaaaaggcaaagggauccuuucaguuuggaagggccaguucuguuucuaaggaaugacuuaugcugaccuuauggaaaccuuaauuccccuccuucacaucaaggcaguauuuuaacaaauccaaaguuuaauuauuaaggauuacaaauauuuuuagcaguguaguuaggcaauccaagccuggacuuccacuucauuccuacuaaacuacuugcagagcugaggaggcaggagacuagaguacagagagcauuuuaguucuaucacaaaggucuagaacugucucuacagucacaggaagaaacagguauggcaccguggccagaaggggguagguauucacagagaguggguaucaaggugucaaacuuugucuucugauaguuuuccagagauuccuguagagaagggagcagggagagccuacuauccgaaaccauucccugaacccucugaauucugaagcauguggauuucucagucuuguucuacccauccccuuucccagcuuucugcuccuucccacucaccuuuccuucccccuggccauuuucuuccucaucagagucuaaaaccaaguccccuaugguaaugacggagcugcacagagacggaggacacacuguaggagggaaaccagaaucaaacuacuacuucuagaugaacacaggcucuugagaguccccaagagaggaggcuguugauccaauccugacucagacuaccuaccuggcuuccuggcccuaggagguaauaaugauagucucaggggguccauguagcaauccaagcaauuccugaggugagagcaagcaaagaggauaggaugaagggaaggcaggcaaagaaugugcuccuaguaagaagcaacucuguuccacucacuccuuuugcucuguggcaggcaagucaacuggguucuccuucagagcccuuccccccagggucuggcauggacucuuagacuucccaguggaggcugcucuugugcccauggcuaggucugcuguguauaucgcauguucuuccuugcucucaggcuuagauaugaccuggguuggugagccgagauuccuaaagggaaacagcaugacuguggggcgcuccuuauggccuccccuaguggaggcccauugggacugaacucuucgucggccuagaggggccagauugaagugucggccagcuagagguucugggugcguccuugaagauggucccugaggaagaugugugccaggcuuggcuuuuggcaggggauuguggagugcuagucuuuguugcugaggaggauucuguuccaugggcucagccagguucacugagucaguaacagagcacucugaaaaagaaaaugaggccccuuauaaagagaacagauaguaacagaauaacugguuucuuaugcccggagcccauggaacuauuccaguggacugccucaaaaggucucaggcuaaacacuacaccuccaaauuccuaguaccuggaagcagccaccccauguccacaccauauugucuccaggcaagagaagaggugauagagacuccaggcugcauccaacucagcacauccugaagcugugggcagggacagagguaugaagaccacaauccuugaaacagccaccccacacucugcccuuacauguuuugccccagcgaaaccugcugugccugcgguguaggcagugcuuucuccagcugacacaaguacucaaaaagcagcuuuuccauggcagccagaaaggguuccccauacucuuguucaaguuccuacagcaggggagauuaggucaaaaguggguuaguggccaggcacgguggcucacgccuguaauccuggccauuugggaggccgaggugggcggaucacuugaggucaggaguucgagaccagccuggccaacauggugaaaccccaucucuacuaaaauacaaaaauuagcugggcauuuguaaucccagcuacucgggaggcugaggcaggagaaucgcuugaacccgggaggcagagguugcagugagccgagauugugccacugcacuccagccugggcgacagagcaagauuccucaaaaaaaaaaaaaaauggguuagagaaaauagccacauaauagccuucaaaccagucucaccugcagcuucgaggccaaauccacaggagccucugacagcugcuucaccugcugguaaaaaguuuccugugccuccaaaaucuuccucagauccugcuuugucuguugaggauacagaagacagagaaguuagcaccaacauccaguagacaggaggagcaacuuugcugcaccaaguguaacuggggucagggcuuguuccggggauuacucacagccuugggaucccgcacuauagguccagauucuggaaaguggugauucagggcuuucaggacuugggcccaaggccggcccugcaggaucagcuccaccaccaccuguacgguacugaauucagaauccccacuucggggcaagcugaccuuuuccaacuagucucauccccaagcugugggcccuugucaggugcucgcaucccgccccuuucuuucuuuccccuuccagguccuacuugcuccaauaccuuggccuuuaggcccauacaaaggcguucguggugccgguagcgaaccaagccaggggcaacagcgcgcagagaucgcagaaacuccaguacucgcggaaaauguuccacgcagcguccgcgcacaaccugccagcuagccgcggcggcgaagcguagagcugcgggacccgccaccaggggcguagccauggucggcgggcuccgcccggaggcggucccuccggguuccucacccggaugggugaggcuuuccgaucacuccuaggggcggggcuucuggcaacucccugucgcuccggucugucggcucuggguaccucgcgaucugacucggcucccuuccaucggcccccagaauucugggggagggggucuucuggcucgggcuggaggagccugaguggagaagcugaccgucuccaguggcacugggucgcucagcuuuaaacgucgccgcugucucgagcccgagggugccucacuuccggcu

SEQ ID NO: 17592 - RNA, 7384 nt, Homo sapiens
agccggaagugaggcacccucgggcucgagacagcggcgacguuuaaagcugagcgacccagugccacuggagacggucagcuucuccacucaggcuccuccagcccgagccagaagacccccucccccagaauucugggggccgauggaagggagccgagucagaucgcgagguacccagagccgacagaccggagcgacagggaguugccagaagccccgccccuaggagugaucggaaagccucacccauccgggugaggaacccggagggaccgccuccgggcggagcccgccgaccauggcuacgccccugguggcgggucccgcagcucuacgcuucgccgccgcggcuagcuggcagguugugcgcggacgcugcguggaacauuuuccgcgaguacuggaguuucugcgaucucugcgcgcuguugccccuggcuugguucgcuaccggcaccacgaacgccuuuguaugggccuaaaggccaagguauuggagcaaguaggaccuggaaggggaaagaaagaaaggggcgggaugcgagcaccugacaagggcccacagcuuggggaugagacuaguuggaaaaggucagcuugccccgaaguggggauucugaauucaguaccguacagguggugguggagcugauccugcagggccggccuugggcccaaguccugaaagcccugaaucaccacuuuccagaaucuggaccuauagugcgggaucccaaggcugugaguaauccccggaacaagcccugaccccaguuacacuuggugcagcaaaguugcuccuccugucuacuggauguuggugcuaacuucucugucuucuguauccucaacagacaaagcaggaucugaggaagauuuuggaggcacaggaaacuuuuuaccagcaggugaagcagcugucagaggcuccuguggauuuggccucgaagcugcaggugagacugguuugaaggcuauuauguggcuauuuucucuaacccauuuuuuuuuuuuuuugaggaaucuugcucugucgcccaggcuggagugcaguggcacaaucucggcucacugcaaccucugccucccggguucaagcgauucuccugccucagccucccgaguagcugggauuacaaaugcccagcuaauuuuuguauuuuaguagagaugggguuucaccauguuggccaggcuggucucgaacuccugaccucaagugauccgcccaccucggccucccaaauggccaggauuacaggcgugagccaccgugccuggccacuaacccacuuuugaccuaaucuccccugcuguaggaacuugaacaagaguauggggaacccuuucuggcugccauggaaaagcugcuuuuugaguacuugugucagcuggagaaagcacugccuacaccgcaggcacagcagguuucgcuggggcaaaacauguaagggcagagugugggguggcuguuucaaggauuguggucuucauaccucugucccugcccacagcuucaggaugugcugaguuggaugcagccuggagucucuaucaccucuucucuugccuggagacaauaugguguggacaugggguggcugcuuccagguacuaggaauuuggagguguaguguuuagccugagaccuuuugaggcaguccacuggaauaguuccaugggcuccgggcauaagaaaccaguuauucuguuacuaucuguucucuuuauaaggggccucauuuucuuuuucagagugcucuguuacugacucagugaaccuggcugagcccauggaacagaauccuccucagcaacaaagacuagcacuccacaauccccugccaaaagccaagccuggcacacaucuuccucagggaccaucuucaaggacgcacccagaaccucuagcuggccgacacuucaaucuggccccucuaggccgacgaagaguucagucccaaugggccuccacuaggggaggccauaaggagcgccccacagucaugcuguuucccuuuaggaaucucggcucaccaacccaggucauaucuaagccugagagcaaggaagaacaugcgauauacacagcagaccuagccaugggcacaagagcagccuccacugggaagucuaagaguccaugccagacccuggggggaagggcucugaaggagaacccaguugacuugccugccacagagcaaaaggagugaguggaacagaguugcuucuuacuaggagcacauucuuugccugccuucccuucauccuauccucuuugcuugcucucaccucaggaauugcuuggauugcuacauggacccccugagacuaucauuauuaccuccuagggccaggaagccagguagguagucugagucaggauuggaucaacagccuccucucuuggggacucucaagagccuguguucaucuagaaguaguaguuugauucugguuucccuccuacaguguguccuccgucucugugcagcuccgucauuaccauaggggacuugguuuuagacucugaugaggaagaaaauggccagggggaaggaaaggugagugggaaggagcagaaagcugggaaaggggauggguagaacaagacugagaaauccacaugcuucagaauucagaggguucagggaaugguuucggauaguaggcucucccugcucccuucucuacaggaaucucuggaaaacuaucagaagacaaaguuugacaccuugauacccacucucugugaauaccuacccccuucuggccacggugccauaccuguuucuuccugugacuguagagacaguucuagaccuuugugauagaacuaaaaugcucucuguacucuagucuccugccuccucagcucugcaaguaguuuaguaggaaugaaguggaaguccaggcuuggauugccuaacuacacugcuaaaaauauuuguaauccuuaauaauuaaacuuuggauuuguuaaaauacugccuugaugugaaggaggggaauuaagguuuccauaaggucagcauaagucauuccuuagaaacagaacuggcccuuccaaacugaaaggaucccuuugccuuuuuuuacuucccuugcuaaguguuguucagcugugccuaaaaggguuagcaggguugaaagccuggaagagaaauguccuuugguauucuggaaauauguguccucaggccagaauauacuuuguaaauucucaugcugccagauuaucugggugugguggcacuagaauggagauacuucaugggaauaauacucauuguucuugaccccacugggucagugcugacccuaccaccacccacucugcagcagcacccagaugcuagccuuguacagaaagccccagcaucucuuuacagucaaugagcucucucuuuauugagguauuucaaauauacaaacacuucagagcuuuuuagauaugugaagguccaauuuagugaagcggauuaacaaaacaugauucuaaaagccugccuccucuagaccaaggccauguaaaagauuuauguaccaaucagcaucuuuuccuuuuaauaaucuucaggauguuguguuggguccccagauucccauuugauuuucuugcaucauuuucucagacuguuugcuuccuugcuuccuccccagugagugccuugggcauuuugugugugcagauagagaaguacagaguuacugcaggagcccucaggagugagacaacaggaaaugacaaaguaauacagagcugcaguagcugggaugggugaggaccccacuugggaugccccaugguagaguacuggugccuugggaggguagaacugcucaggucuagcacgccucacugaagauuggauucaccugcugggugacucggaugaagguaguucuccugcucaacucuuugagcuuagcugcucccacauagguacacguagagcggaucccuccuaggaugucucggaugguauguuccacaucuccuuuaaaaggaacuuccacugucuuucccucugaggcucuuaaaguaggaaaaacuuuauuaucuucuccuucuggauuccuuaagcccagggacuuuuccacagacccuagcauugagccccgguucaccaugcuucucugagaacuguaccaucccccucucagcagccaugaguucugccuccauacuauuacuaagcuccugggccuccacacauaccuguacucagccacgcccccagcauacuucuucauggccauuucagaacucauuccauagaagagcuuguacuucuugccaucccucucgaugagcucaccaccugacucacugugcccagccagcaugccacccagcaucacgaagucagcuccugccccugccaccaucauggaggggggaaagagauuaaucuggccaaggugcucacauggccacccucaaaagcaacucacaccauauucucaguccugacaaugauuccagcgucuuccuccuucugcuucccuagcugacccacaauccacgcaggccugaucugcccuggccucuauuccucaguggguaugauuuccccaagauuuaaaaaagagccucuggagagucccugccuggcuuuugcuuucuccuuuugcuguuuuuaccaucaucgucuggucauuugauuuuacugugcccagcuaaauaagacucauuucaugugucccaagagcaaagauccccaacuuuaaugggaguaaugaucuccugggaagcugugcaaaaugaaaaaugcagaugugcugucccauuccucagagccuauuuuuagguauggcuggggcucaggagucugcacugugcagcaaucuaggagauggucagauggcccuggcccacacuuggagucucagauguccccugcuggcugccccagaugauaccauagacuucggagucacuaauucauauuaugaaagaaucugaaugacuuccugagccucucuuagccugacccuagacccucagaggugauucauccucuuguauagaaucauccuucugugcccucaagcuccuuaccaaaagccuuggccacauccccaggacagcugcaaccuccauccugcaaaguaaggagcacuaugaauacaacauggauuucccaagcccucagcgaugucccaacagcccaacucaaagccaacaagaacccaggaauucuaauccaucucugccaccuccauacccugcagaaaccccgcucauacccuacccugcccuugagccuuacugaaaugauguggccuuugaggccaugagcagcaucugcacacuccaucacugcgcugagcuguggauaccccacuccaguuuucuuccgaguaguacacacagagccuaggaagaacaugauaaggguaagaaugacgugcuccacagguguuugccacugaagggggguagccaguggccccaaugaaccagcuuaccuggcccaauucccacuuugaugaugucagccccagaaaggaugagcucuucuaccaucucuccuguuaccacauucccugccugagacagagcaauugaaauacagcauccuuagggccagaaacaggaggucauguauuguuacgguaugcauggaccaugacuuuccaacauuauuacaaagaaaggauaacuagguccccucuacugggcccucugagggcuuuuacacuagccacuuuagagaacccugcucccuacccauccacccaacaccaagccaagguaggagugaguggccaaugucaccacugaaccuaggguaaagccgagguccaugaugcacuuuucuaaggcaacaaggugcuaugaucaacagggacacaugaaguggcauggaggagcauucagugaggcaaagggaacuacuggaccaggcucacaucugauuuacaguagauuuagcuccccuuccucaagagacccaaacauauucuguccuuaagccauucugucauagaaccugucuggcuucagggaaagggagaaggcaugguaguauaggcuaaagacccauuugaccaguugauuggcuuuugaugaucaguagacacaccccucaaugcugcgaagaaaaugaaggccacucuucuaagguuguaaaaagauaaaucauuauucaugugaccccuuuuuaugugacuaguauguguccauuucagugggcagaugucuauguaccacagguauguacagugcacagauguuccaucaugguuuggugagugacaucagggacaucagauuuacaaagacuaugaaccaagggucagagauacuacacugaccaaauagacauuuucagcuuagaacuauggauaaucauccaguaucaugauuaaaugaacuaggaauaucauaaugcagcagaggagaaauggacugauguagcaaaacggaguggcaggaaaguggaaagauaaaaagguaccgacuguaauagaaacauaccaugauggugugcugggggaagcgcuuccguacaucuuuuacaaauucaacaaaguguucagaguagccauuugccacauccaggcauauauacuucaccuggggaauagcuuccaggaucuguuccagcugcucaaagucagaagagccugugccugagcuggcagccagaugcugugggagaaacagagucauuggcauaucagagaugaucuggugggcagccagugggucauuggugagugcugguccccagaaagccaaaauauaauugcuggaaaacugggauaaggaagggagcaggguaugcccaguguuaccucaagacagucaggauucuggccagcaaacucuugccacugaacgaggcuauagugcuuauggacagcagugaagagagagaacuggggagaagacaaagaagcaucaaaagggagaaaacuuuauuaaggucucuuuucuagaaacagaccuauucuaucugagggaggacaugauugaaguuggggaggaaacaagucaaagaacucagguugagcugggauuugaguucaaccuuucuucucucuacaaauacuaguagggcuuuuuaccauaagcuaguacuugucagauuucccaccaaaguacugagugaucuggguuggauuucaucugccagcacauucacugcuucugacuuaaaaggugacaagcugcuggugcagugggacaggcagcagacaugaaagaaccaugaagaagcuggauggagccuguguuucucugcacugacucagccccuccuccuaagguaaccuaguacuaaacuauuuuugguuauguucucguucauuuaccagcaguaauucaguagaucuggaugcucaccaaagguaaugccuuaagguu

SEQ ID NO: 17593 - RNA, 14485 nt, Homo sapiens
acugaaagauggacagagcagcagcuucauuaaaaaacaguuuauuagcaucuguucccccagugcaagugaagacugacucccucuccgggagcccuggacucccccuccgggagcccuggacuccccaccugagcuccuggggagcugcucuguagugugccccuaucuuggggcaauguccuugcucaucugacuccagucccauugcuccuggcacggggcuaagcuccaccucgagaugccauagggauggucucuccuaagugacugucaccuccagcgucugagaagaagcccccauccccaggggcuggggccacauccaccuggaugacaccgugcaccugggagagcugugggcuguccaagcuggcaaugagcuggcgggggccuggucgcacaggcacaaacgacuggcgcagugucacuguuucauugccuccaaugucccugugggcagagacaaggucaugggccuggaguaauuggggguggaguggggaguaagagcugauccagggcagucaggaggaagaagcaggagguggacccauucagacaauuccaggcuuaccugaaauuuccacacccaagaccaggauccccagggcgccucugcauagccagcucagcagccacccaccagcugccugugcuggaacucuccccaucgucugggacuccucccucccugcucccacauccaccuggacaaagacugcugaugccaccgcagaggccucucaugccauccccuccaucaccacugcuccugccccagacagaacauccucaucucaccugggguuuccaaaaccaagaaaacuucaaaaugagacuuugggggcccaacacaauauuuucaaauacuuucaguuuugacaagagcauagguugaagaaaaguaaucacucucugcuaugaucgucguuccaaagagaaaagagcauuuucacacaccaaaacauuagaaggauguuaucuuugaaaaaaaaggaaaauccuucccaagaacagacaacagacaucuuuaaauggacauaaacccuuaugucucugugugugugugugugugugugugugugugugagagagacagagagguggguggacaaacacacacacacacacacaaccaguguuuucauuuucuccuuuccacaugggccucugaaaaauugauucccagaccuccccugggaaucaugauuucacuaguccucuaacgggacuccuugccucgcaucccacuuuuguauucuguucugcuaaccacucagaggugaacuaaauccuucaaggauuuagugcuccuuuggugcuuguggcacacgauccuggcucucuaacuugacacacaggcucacucugacccagucccugcuacuugcacagccucaucaccccccaucauuccuccugcugagcagcccuaccgaaugccuucuuccccagacucaccuccacagucaugcuuugcagucuuugccuuguguggaaugagcacccagcucugccuccccacccuggguguccuugugaaggccuacuuuuccuccaaggccuggcacaccacuuccucagugacggcuccccugagcaccuccugccucuaggaaaaggaaacucacccuucucugagcuccuccagcaaucugcacguuucauuuuauacacugaacaugacugcauuuauauugcauuugcucgugccugugggaauuuguccuuccugccuuugccuaaaccuuaccucuggugcccuauucaacccaagccugccgcuggggacccuuuccagacauagaaccugugcauuaacuauuguccucuaagagaaugagccaacaucccuaacuccaaggaugaguuuuuuucagggcaaagcauuuggcuuggaaccugguucugagggguuucccuggaccacucuacucccuuuucuaccacuuguuagcugugaggcuuaugagaagcuauuuaacuucucuguuccucacuuucugggucauaaaauggaagugaaaguaaaaggaggagugggaucugauuaucuugaagguguuucugagcucucugaaggagggaggcagggauauauaauagaacguaguaugauaggaagucuauaaauuaagucuauaacuuaauggcuaggcuauguccugacugcuuacaaauuugcacucuuaauuuuugcuaacuuuucauagauacaagauucaagguuguucaagcucagaccagcccucagaagucuauuuacucuauaccauaauugaacuauaauauuucagaaaguaaccuuuacauugcaguaacggauuauuuucaagagaaacuguuuucuagguggaaaugucaagaucucucccuccccuggucucauugugaggugggggacuuuaccacaccucuuuugugagcugaagcugaguacaagccaucugcuaaagcugggauguuccuggaacugagugugggucaugaaaccaacuccccaacaaggacaccagaacuuagacgucgaaacgagcauuguccaauuguguacuuguucaaucguauugccugggcuugaaacauguuuaaaacuccuccuggacucuucuucagagccauuuaaaccauacacacaggcgugugcucagugaugccacggucagccuguccuuccuuccacagcaugccucgguucugauggaaaagggcaguuacccacuuguucacuuaucuuauuaauuagucuuagcucuugaugacuucagguuucucugcaaagucaaaucuaccccuaagaaggcagacugaccacucugaggacauucuagagaauaugauucagacucugagggaaauucccaggaaggguuuggaacagacuuccagccucucuggugacugcuuuugguggugacaacagccaucuggaggagugaguucuggaauguuuauuaaguggccagucaccacagggggguggcacaccuuaugcuauaaugggguuccaugccacagccucugaugugcgaaugagaggcaaaguacacccaucuuggaaucuuagguaccugaaccaacagcucagagaugucccccuggaggcucccaauuguacuggaggcucuggucugggcucacagcagcuaaggagccacagacuguccagggaggaucugccuuaagaaaccaucauccaacccugucuuuuacuguagggagacucacauaaacccuacagcuaaagacaggaaacaggucccccaacacucagcacaguggcccuuuccuuacuuccaggcagggccaagaggcaaaggccugguggggcugcugaggcaaguccagcucugcggaucccuuaggacgaggaaccuccccccaccaugguggggguguggguaagagaugccugcugggcaagacuagcagagcaggcuacccgggggguucaggcucuguucacugagcugccagagaccaugguauggugacaugaggaaagcccuacuuugugacacaucauagcauucccaggggcccaggcuggggcaaagaucaacauagcuuccuucucagcuuuggccuaauggcgaagguggcagccaccaccaggagagcugcugugugugagggaggggugggcaagugggcaggggguccucugcuuccuccccucaguuuccccaccccaagccauuguucuuucucaggaacucgcugucugaagaugaagccugccccugucccagaaggcugaucuagaaggccaggcucuggccugcucugcuuucccuccgugcuuuuccuaggcggggacggggcagcacguguaagucuguaucaaagaugacagccgcaggcccaggaacacagcaugugugugcccucacuacacccaggggcuugcccagcccaggaucaggcccagacgggcuggguaagggccugagggauggaguucucuccucuggaacugcuacuuggcccucauggcacaaaacaaacaaugaguuugagagccugugcaugguaugcaccacagugggaagagcagaguuugcccccuacgagcugugagaccauaugagaugugaccgccagcuuccccaucuguaaguggggguaauaauggcaauaauaaaaauaacaacuaccaauggagcacuaacuuugugccaagcagugcacuaaacaacccuagguccaggggcuauugcuaucccugcuuuacaggugagaacacugaggcuugaaggagagaagucgcuugcccaagggcauauagccaguaagugcuagagcugaacccguaucauuaggauuccaaaacuucgcuugugugugugugucucugugugugugugugugucugugugugugugugacagagagagagagagacacacggggucucacucugucgcccaggcuggagugcaguggcacaaacauggcucacuucagccucaaccucuccaggcucaggugauccucccaccuuagacucccaaguagcugggacaacaggcgcacagcaccaaaccugguuaauuuuuuaaaaauuuuuuguagaaacaggguuucaucauguugcccaggcuggucuccaacuccugggcucaagugauccacucaccuuggccugccaaagugcugggauuacaggugugagccaccacaccuggccuucuaauguacuuaaauuagaguuuuuguguccaaaggagauaauauuccugaaagggccuggucaauucuucagugcugggcaaauauuagcaaugaguuacuaaugauuccuaugugggccuucugcucccuaauuagauagugaggcagggcaaggacauggcauagcaccaggugcccaagaggucucccuaaaggcuggugggacugagcugggccgggagguauugcuagcuggccccaaccugcuugguuggguccugacagaacauacuuguccagacagagagggagcaaagcugggagccagggcagccuguggggaaggccagaguggaagcagggguagggggagaggccagacucacccaacguugaggaucuugggccucuguaacccagagccuucgagccggaagacgacauuggugagggugacgggaaggggguucuugaagacaaucuguacuucacacuccuggccaaccacugcugcucccaguaacugagagaaaaagaggcccaucccccacgucagagacccuggccaaacacacggggaccguacacugcaccagagaggggaagcugcuuagaagcaaaaccuccccgagucccacauuuauccuccugagagaagauuccccagaagucagagaagaaacuccaaccuauuccucaauaaaggcugucacagaaccagagacauaagaucccaugcuacagaugaggaaacugaggccccagagccgguccuugaccuucuccuacaaaggcucaucaggccagccugcugcuggcuuagcgcccaccucugauguccuuauccccuggccuucacucucugaccaccccucaugccccagcaaacugcauucaccgugagggagaggucuggggugcgcagacggaaggugugcugcuuggccagcaccugcccgcucuccuugacguggccugagacauugagcagcauggcccccugguccacaagauggggccgguauuccuuguaggccacuggcauggucacacgguccgcuguggagaagaggcauggcgucacugaggccugcuucccuacaugaggcuucccccagggacuccccacugcuccuggggucuccauguccacagcccugaggugcccagccauccagggggcagggcuggguaaggagcacuuacaggccccuggugccagcuccacuuccuucuuggucuccuugaagaugguaccacugacaccaguauagaaagugacugagagguagaggugcaguuucacugugcggcggcugcugcugugauugaucagcaucacagagaccaucagauccugccccaucaccgcguccugugccuccaccugcauggccacauccuccgcugagccccgguuggcauacacauuggguuugcugccgugggcugcugcugucucuacugccuuccgcucugcgucugagccuggggguugagggucaagggugagguuccaauucccacguggguggccaagcacuuggcaggaacacuuguuguggggcccagagcuggcuggguugggggaaugguaccuucugggugcuuauagagguaggugauguccucccgcauguuggagcugauggccuuugugacaaugagugugccgauggccuucuccuccacauaaacaaucuugaagcugccaucauccugccgcugccaguacaccuugucacuauucaccuguggggggugggggugagcaggaaugagugagccagagggucugaggguggccugacucccggccuccuuccccugaucccaggagcuaugggacagggcuuggucccaagggugggagcuuccuggcagagcccaaggggagacuuuccaagacgagccagacgaggccagagugcagggaagaagcuggucugggaggcuccuggcagagcacuuuggcaauaucaguaaucccucacacucaauggcugacuuuacgacuagugaagcaguuucauacccguuaucucuucugaucccgaguauaggaagcaaggcagccuugauuauccccuuuuacaggugaggaaacugacuuguauaaugagugacuugccccgggucgcagagcuggucagucagcggugaaguugggaccagagaacccaugacugaagcccaagaaggcaccuggagcccagcccucaccucagcaaaaaugaaaggcgugucguacuucauguagaccaggccauucuugauggacuccacagagcaggggccgcagcagaagaugccuagagagugaggcgggacagaggcaagagaucugagaaggcggagagggcucuucagacccuggguaagguccacacagggccccagccccacccacucaggcccggucccacugccugguggccucuggaacaaggucaucagcccugacccaaacacuugggggucaguugacagccagugcaacacagguauggaaaacaaagagagagcggcuccauuuggcucucaaucugcuuuccucagcccaggcugcucugcuggaggaugggggcaggguacagaugugcggaccagccugccugauaaccaagucccugacauacucuuucauggcuggcugacacuggauguccaccaucugugacccccagaggacaggacgccccauccuuuaucauaaccaacccagaguccacaguggcccugccugcuggcugggagagcgaggacaccaccgccaccaccauuccagagagaugcggaacaacccucagcucugcagccugcugcccuuucuacuggggggagcuggugggaaauagagucugcccuuaucauacucaggaggcugucuagaagagauaggcugacaggaagaggccuggcaagagaggacagagugguaagugaguaccauccaaccggaaagaaucuuagacaagacauaacacuacacacuccuuuacagacggggaaacagcaaggugaaguucaugccaggaucucacaagacagguggugcagggagaaugaaaggagcucagacuuuuugaguagcugcuacacucccggcaugcugcuggucccuucagauacagaauuucucauuuaauccucccaaucaccauauaugguaucuauuaccccaaauuacauccaaaccaccaaagccuaaaaguucgaggugcuugcccaagagcauacaucugagaagugaucaggcugggaucaagccccagucuggcuggcccugagcccccugccugauguccaccccaccacuucccagaguugggggccagagcucagaucugccagcgucugggacaggcuguuucagcaucacaggcaucaccggguugcacagcucauggggcuguguucacauaucugagugagagggagggcacugggaagaggccaggggaggaauguaggcuagggaggacucucugaccugggguaagggagaggcuggacagaagguagcuggcagggcaggccugguggccuggggcugggguaucacgguaagaagggguggggguuuguuugagaacagaguguaugguaguucuaauuucugcagaaacacauguauguggacacagaaaagagacccguugguuauauuaacaguaauuauauauuaaggcagggucauaagggcuauuuucuucuuugaaccuaucugagcccugauuuuuuucuaugcuguauauauaacucacagugagcaauggaacagacaggaaggaacucguugaaagcaagaguaugugcuuaaaaggacuggacuugcucugucacugaccuaccacucugugccccagaggaggucacuccaucucucuggccacccuuuggagugggucaaaaaauccggcugaucgucagaaucaccagaagaacuuucaaaaauauacauuguuagcaucuauccugggaaagucuaauguaucagguuuggaguagaaccuagaaauuuacuuuaaaaauauuuuugaaaaaaaacccaaauaccuccugagagagaauagggaagcuuuacauuuuguguuguucaauucuauacuuuuuuuuuccuuccaagcauguauuacuuauaaaaaugacuuuaaaaugguccuucaguuaauuaucuccaggauauguaaguuaaaaagcaaguaagaauagugaauaugaauucuuucucugaauacucuuccagcuuuugaauuuugaaccucccuuguauauuaaccauuauaaauaaaauaaaccauuauaaauaaguaaaauguaggcaaauagagaguuauauagaaugguaaaaauaaacuaacauccacguggugguucagcugacaaacccguuuaagaagccgcgggguuacauggcuuggcucuccggcccggcccagcacugacacucuggacuguguuaaucaggugggggagauaagcaggggcaugguggggaguggggggcccagcuuaccacugcuagucucuugggguguggcauccaccaccugccacccaucaaagcccgagggcagauccggccucuucauccagcagucguuccacacauggaaguuccuggauggacauggaggaggggcugggucugagccccagggucaggaguccucaguuuccccagccuccccagcccugcccacccuccaccuccaaagcucaggucaccauucuucagcacagaugggcaguccaccccagcucaccagacagaaucaugguucaggugcuccaggggcuucauguucucgucgaaguagauguccaugguaagggaugugucugugucgugggcggaguugaaguuggugacaguacggguggccagacccaggcagcgcagcacuguggaggagcgaagguugggguucaaggcauggguugggggcaagugaggcaucgugucaggaguaucagggggagaagggcaacuaggauugccaagcugggcauagacugccagggucagggccacgggggccacaaggccuuugggcuacagagcacuuggggucaggggaagcuaggccaccugccuggcucaguccuugccugucccuucucccuccuuucccuuaggccucucucuguuguuaacacuaauuaaugauaauuaaggccagccuauuacccacccccgccugcacccugcacuguagccacaucugggcagggcuggguaagccuggcuuuccucccuucucccuguagggcccgggccacuccugucccagucccuccacuaccugugguggucacgccagcaaagacccagcacuggccauaggggacggaauaucccgugcguagguagcuaagcaggaucuccacgcugcccacccacgcugauggguuggugccucgggaguaaucaccagaccaguucccaaucaggacuccauugucauccagggaguucaccugcccaggacaggaugagauagggcggagguggaggaggggcucaggaccugccaugugguccauggggaccagccgggccccgauccugcaaccaccccuuaccccuaaaugccucaggauccagacaccagccugagcuccacccagcccuucccucagccaucugccccccucccacccgggcucugacacaggaaugugaauccugggugugccaaguuuuggguuuggcccuacauuccacaggagcugggacaggagccaggaaaggcgggguggggggcaggcaagggagagaagaggagggagaccccuuccugaaguauccuuuacgagggcagggacagggcuggggguucuugaggaauccagaaagggcaggaggaggguggggguguggcgaggcagcaggcacacacacaguaggacucagagaugugagggugcucaccauggcagagaugacccgggagacauugacugggucuccacggccuccauauggcaucccccgccgguccaggauguauaagcaggcauccagcaccccguggucaaacuggaaggagggauggagggcagaggugacagccugaacccuaggccagcacccugcuccaauaccccagcccccacacccaccccagcuccucuggguguaugugacccuggccagccgcaccauaccuggccguaguuccagguccgcucaccaaucugugcuucggucccguaguaaauucucccagacucauuaagaacauacuccugccgccaauccucaugguccacguacacaauguccucuguguccccagaacacacaaaacugguucccuccaguucucucccugggccucaccuacuucuggccaguucugcaggacucauguccacagaagaaaaugcggggaugccccuagccugacaggacugcugugggaggacacggggagcaugacagaugguggaggagauuggcuguagccaggggccuuugccaggagagguguggcuggcugugugacccugggcuggccaccuuucugcaccaggccucgguccucucaucugcccaaugggaggcuggcuucuccuggggucaggcaccuaggcaccccgccacauccgagggcaggaagcccuucccugucuuucccucccaucuacccucugcuccagaccccagcugcucaccugggcaccagggguugaagaggauguagaucucauugcgggggucaaagggcaacuggaacuccccagcgucugauugugugcggacugugaacugaaacuugccgaugauggcguugggggaaguguggacccgcagguucagauucugcccacuggccuugaccaccugggcuuuccagccuccacugccccccuugcccacugggaugaucacgugcgugcccuugcccaccucgggguuguuuccuagaguaggaaaucagcaauuagcuggcaaggccucccugaggagaggggauggagccugggacuucucccggccccacccacaauguguaugagccacuguguaugucccuacguugggccaucaccuuauucucugacagucucccuuagagcagcucugucuccacccaaugcuugcccacauguuagggcagugccgcaguccaacaucccaaaccuguuccccugacacugaacucugagguggggaggagagacgagggcuccugucaccuucugccugccugacuaucacagugccugggcuggaggggcagauccaccugccccguaugaaagggcaguccugauccugaaggccaacccugccugcuuccuggggcugcagcuuccagagcccagggcaucccugguggaggugguagggguuccugggaaauuaaaggaugaggugggcaagguuaggcccuaaucaaaggguaaaaggagucaccugccccaggcagcagcauaaucaccagccugagaagucaagcuacaccaagcaacgcgguaagggaggcaccugccuugggucauggggacagagggacagagacagagagagacagaauuggcagagaugggggacauggaaggcaagagggagagagagagauagaagagagaaccagccacauccuggggaaugagaacagaugcacaaaggacagagcagcaaugccgaaggaggcaccgaggcaggcccugaagaggaguacucugagaccgaugccccaggaggcuugaggaggaugggcuugggaaaaacugcaacaccaagacccucucugagacacaaccccaggggcacacccacacacuugcaccugccuuaucuggcagaggugaggaguggggcagggaggagccuaaagaccucucugacccuaaugccagccucuccccaccaaacauagggccuucacccgucccaauccaagccccacugaccgaugaguaacucaagggugaugcgaucagaggauucauagguccgggacaggaggaggagcauauggaaaggcugcccgcggcgcacuaucagcucgucguacucauacucgucuguguggugcucucggcgguucugguccgagcgcgagcucagcaaguccacaccguucacuacuagcaugcccucugcaaggacacagcuccgugucagugaagccccaugaggagcccaggcccuuaucauuagcuuccuaucccccccagaaaugccaggcugagucucuggucccauuaaagccuuuuagcucucagcugaggaggacagaccggccucaccucggauggugccaucuccagcugcauugacaccgcugccccgggauacaggccggcgggagucugagccccgggagccaggucuucgagugccagagcuggacccucgaccccuggagucagaggguucagguccccagucgucaucugccgcauuucggcaugaacagcagccacagcagcgagcccagaaggaacggccuccuccucugcgagagcguccgucuggcucuggcucuggcucuggagauggcgugguagggggcugcaagggguugccaccccaacggcccacaucggaacguggcccauccaucaugccuguuaggaagaggcaggguggcuccuuaacccagguagucccagccaguugacccagaaacccuccauccagacagcugauucagucccacccgaugaccgaaacaaucccaccuuggcccagagauucuccagacacauccagagaccuuccgcgaagaccauucagacucacccagagaagcuucucaugcugcagagaaaagccuuccccucacccccaccaaacaacauccgaaaaacugcccaaugaagaaacccacucaacgauccaucccaggaaauccacauaguucccugcauggacacuugucccagccucaagacccagcugcacacacaucagagugcuccagcaucccugggccugguccguccaccugcuagcucugcagucuagaggugcacaacacugacagcuucuagaacucauuucuuagcagaaaucccccaacucaagguuccucacaagacagacaagugaccccggggccugugguccuuggcauucccaagucagggaagaccccacuuggggcugccaggagggguagggcauggcaggugcccggagccugugcacagggaaagcagagucuugguguugggaacagccuagcuggggcugacagguacacagcuggcccacaccccaccuugcuggauccaggcacggccucugauagugugggccgccuggacucggcaccacaguacccgugggagccccucaccuggcagcaguguuggcaaccgcaguacugaguccuggggcugagauggaacaggucaggauggaugggacaggacccacagacuggaugccgcagggacagaccugguaagugacuuaugugggagggaggggccaaacugcuguagggggcggagagaagaggccaggccucugggcgggaaauggggagaagaugcuagggagggagcaggggugaggucugggggcuuaggcugggcuuuggugggagccaccgcugugauggccccuggcaccaggcugauuccuaccagacugggcaugugaggagccccuucucccggaugaagaagcugcaagggcaguggggcaggcaggcccuuccacccacagcccugucuggccgaccuucuggucccaagcuuaggcugccuaccucugcucucacaggcuccugcugccgaguucugugcagcccaagccaggcucagcccuaugaaauug

SEQ ID NO: 17594 - RNA, 2075 nt, Homo sapiens
uacuuccucucuggcugauuuagcaaacagcaccuagaccuggggccaggccuuuggcagugggacagauccagggauaggcuacaccacccugcccugacccugggauuggcaucagcuuccaaccaguuccugccaaagcuuguaaguaaguuuccugggagcggccgugguuguggugguggugggacagugugcagccaugaaagaaggugcaaaggaaucuccaaagaaagccugaccagcguaaaaaguugggaggcuuuguccuugucacuuguccacuaaacuccuccccucccuguuauuccugguugacccugggcaucucuggggacaguaggcaggugauugggaaaguuaaugggauugaggggcugagggccuggcagggggcaaaaagacuggccuuucaaggggugcagcauugguaggaacucuguuugguucugggcuuuagggucuccuaaggggaggagacugaaaaggucuggaaaugcugcugcugcuguggucacuguauauuuugcaauugggucuguggacaggaaggggccgcaugacccaguuaggaaacuagucuuuguacucaaccagaucccuuuaaguugucagucugcagcgaugggggcaguauauuucagggggaccucugaugcugcugacccuggagauagacuagaguucucagccuagguguguccauggcgucaggaaacccuugguccucuacucucaugcguguguccgcccucacucuccagguccucccgacggccaugaacacuacaucuucugcagcaccccccucacuagguguagaguucaucucucugcuggcuaucauccugcugucaguggcgcuggcuguggggcuucccggcaacagcuuugugguguggaguauccugaaaaggaugcagaagcgcucugucacugcccugauggugcugaaccuggcccuggccgaccuggccguauugcucacugcucccuuuuuccuucacuuccuggcccaaggcaccuggaguuuuggacuggcugguugccgccugugucacuaugucugcggagucagcauguacgccagcguccugcuuaucacggccaugagucuagaccgcucacuggcgguggcccgccccuuugugucccagaagcuacgcaccaaggcgauggcccggcgggugcuggcaggcaucuggguguuguccuuucugcuggccacacccguccucgcguaccgcacaguagugcccuggaaaacgaacaugagccugugcuucccgcgguaccccagcgaagggcaccgggccuuccaucuaaucuucgaggcugucacgggcuuccugcugcccuuccuggcugugguggccagcuacucggacauagggcgucggcuacaggcccggcgcuuccgccgcagccgccgcaccggccgccugguggugcucaucauccugaccuucgccgccuucuggcugcccuaccacguggugaaccuggcugaggcgggccgcgcgcuggccggccaggccgccggguuagggcucguggggaagcggcugagccuggcccgcaacgugcucaucgcacucgccuuccugagcagcagcgugaaccccgugcuguacgcgugcgccggcggcggccugcugcgcucggcgggcgugggcuucgucgccaagcugcuggagggcacgggcuccgaggcguccagcacgcgccgcgggggcagccugggccagaccgcuaggagcggccccgccgcucuggagcccggcccuuccgagagccucacugccuccagcccucucaaguuaaacgaacugaacuaggccugguggaaggaggcgcacuuuccuccuggcagaaugcuagcucugagccaguucaguaccuggaggaggagcaggggcguggagggcguggagggcgugggagcgugggaggcgggaguggaguggaagaagagggagagguggagcaaagugagggccgagugagagcgugcuccagccuggcucccacaggcagcuuuaaccauuaaaacugaagucugaaauuuggucaac

SEQ ID NO: 17595 - RNA, 4009 nt, Homo sapiens
cuagcauuccaucauguuuauugacuccugggggacaggucacaaagucaguuugugggcaggccagacugcccuagaaggaagucaggggccucaagggguggcacucuuccuuaacucguaacucuuggaggcaagcuuggaaggugcuuuauuucccgcuaugauuauaccaacccuguggccugcuccaggcuucaggaucuuuagggccuucuugcgaaccuacugguggggggugcugcaagccccuccccuugcccgaaggugccaagccccaugugggcaaggcaguugucuguugcauagucaaguaguuguugucuccaacuugcaccccagagcaguuguauauguuaacgagcggucgcccuuuaagagaaauagugaugguggcaggaggguuuagcugucagaaaggccaaguuggggguggguggggaguaugaagucucuacuugucaguggcugugucaaggugugcccugugcuccuccccucagagcuccucuccagaauuguguuagcagaagcucuagagaguggcaauugacauuugagacccugaucuuuuuugcugggagguccucuggacugcugaaacaauggaacuuagggggcucacagagcugguguuguggaaaguuagaagauucagggacaaauccaagcuuuguugugugaccucagagggcuccuuucucagggggugucgguuuucccauuuaugaaaugagaagguugaguuagaucaucuucuccccuccccuccacaaaguacccugaaucuagauauaggucuggaggaggagucugguggaagaauugaacagggaaaagaaagagguagagaauggguaccuguuacuggauuuggcuccgggguccugcaggaccaguucaugccuugucucucagcccccugcaaacagcacagagcauccaguucugcccuggagccuggcacucccacugcacuccucucagccccaaguuuucgcuggcaaggggacagcauuuauaggacucuuagugcauccccuaauccugucaaugucucaccugauucccucgggguccaggacuugguguuccaguugagguagggcugggcaucugguuucugaaaguugaggucucuggagucuggggagguugggccaucgaaucugaagaugugccugcuguccaggcuuguggaaccugcuccucuugugcccugcuccucuugguaaggcucgggcauuuuuuaggaacagagcugggaggcuccucuagauucaguuuguuuagccacucagaaaccaugacaucauuacgagagugcugguuuucuaugguucuccuaaagccauccauuucugucccuccuuggccugacucugggauagaaaaucuccuauugcugcuccugagcugagacaggaaauccuuuaccugcagggaugggaggaguuugcuggguaugacuuggaugagccagaguaaacccaagggaguagucucucgguccauaaucuguugucugggaacucaggggugggcuggggacgguggguacaaaggucaaggcauaaaaagcaguggucaguggugagucauuggauggccagguagccacgcugugccaucccugaccagcuccuggggaggggugauguuggcacucaccguggagacagcagcauucauauuguucuccaccaucuggaagacuucaucaguuuuugguaggcauucuagagggacagcagaguggagugcaggugagcaaaucuucuuuuccugagaaaagcccccugcugacagacccaagcuuauccuagauccagcuaacuggccagcucacccuggaaggagggucuguccuugggcucacugcuccagcagagcugcauuagcuccuucaguccuucuaagccgggagucucaggcccggcuuggggcagcucagccaaugaaggccgguucugccuguugcacacugcuucguacacgagugaugguucgguuggcacuggaguaggggaggagggugagaagagaaggcauucaggguaaaagggaauuaucugcuucaucauggaaagaggcagggaguguaaugugggggcacgaggagggaggagggcagucuaaguaggugagcgggaaggggaagccuuggggcuuucaagagaagggcaccugggguuaaggaucccagaauccuccuagagucuuacacucaacuucucuuccagcaagcacugcccacauuaggaucccgaagcugcaggagacacaaagcugaggaucgguccaaucacuggcaagacuccuuuccuauacaucauccccugggagggcccagagaaguguaggaauccuggcuguguguuugggccgggauccuuaccuguagacgucacuggcuguggaggccuuccgguuuacguuaacaaacaguucuggggccaaguagcccagggugcccccuggcuccccggacccugucccugacugugagccucccugaaauguggacaggccaaaaucugccagcugcaaaggaaggaaagaagugggagguagggaagacaagggggccagagagccuccaggaaccccccugcccccagaaggugcagguucagcuuuguaaagggaguguggaggucaagggaagagguucccuuggaugguagaucuaggugccuugugguagggcuaggucaaggucugagucuccagggcugggucagccaugacucuuuggaggggcugguggggcagcugguggaaaugacucguguggcucagggccucuaucaccugguaggcaggagcuaaaacuccuggcugggcuuuguccccuggcagcccuguguccagagagagaggcuacgccuauucaauagacagggcucuggaggucuaguguccggcgggccuggcuggagcagcucuggggccuugucuugaggcugagagggguguagaccagcugaccuugacgugcagcucuggguccagcaggacguuggauggcuugaggucccggugcaggagcaccggguucuggucgugcagguaaaacaucccaagcaccacuucuuucagcaggcggcaaaggagcggccagggccgagggcacugggacugcagcagccccgacaaggagccguucuccaugaauuuagucaccagagccggcuugggaucuuggucccaguucaccuucucgauaaccccuucuaggcgcagcacgaauucguuauccagacuugccauggccuugaccucccuggauaucgccuuccuacacuccaggagagagcuggagucgcaccggggucgugggaaaaucccucccuucgccauucaggccccagagcacaguggcuccaccuuuuuggccagauugcggcuggggucaaccggggucacucacgaguuuacgaucuugaccgccacaucguagccccacuuccuauguugcgcccggaacacugugccgaacccgccuuugccgacgagcuccugguucuccaguuccucgauggacaccaagggggcgggggcaccgcugggccugagagaggggugucgcccacuagccggccgugccgugccucagcgcugcuccccgcgccccugugacucggcguucucacugcaauccccagccucccucgccggcccccaccguccccggacucaaagacguucucugagcgagucuguggggcucucugggugugaaugucggaggcugcgaucgacaugccacucccuacucaccauaacuugacgcacgacaucaggcuggaaggugccagggggccucuggaaauugcgagccguaggagauggagugacuucuggggcuugguccuuucgcagagaggggaaggggucugucugugcaggggucagucucuagaccaagacggugagucuacuuuccggguuguuacccuuuuuccgaguugacugaacaacuucccuuauaggcgccucuacaguc

SEQ ID NO: 17596 - RNA, 4009 nt, Homo sapiens
gacuguagaggcgccuauaagggaaguuguucagucaacucggaaaaaggguaacaacccggaaaguagacucaccgucuuggucuagagacugaccccugcacagacagaccccuuccccucucugcgaaaggaccaagccccagaagucacuccaucuccuacggcucgcaauuuccagaggcccccuggcaccuuccagccugaugucgugcgucaaguuauggugaguagggaguggcaugucgaucgcagccuccgacauucacacccagagagccccacagacucgcucagagaacgucuuugaguccggggacggugggggccggcgagggaggcuggggauugcagugagaacgccgagucacaggggcgcggggagcagcgcugaggcacggcacggccggcuagugggcgacaccccucucucaggcccagcggugcccccgcccccuugguguccaucgaggaacuggagaaccaggagcucgucggcaaaggcggguucggcacaguguuccgggcgcaacauaggaaguggggcuacgauguggcggucaagaucguaaacucgugagugaccccgguugaccccagccgcaaucuggccaaaaagguggagccacugugcucuggggccugaauggcgaagggagggauuuucccacgaccccggugcgacuccagcucucuccuggaguguaggaaggcgauauccagggaggucaaggccauggcaagucuggauaacgaauucgugcugcgccuagaagggguuaucgagaaggugaacugggaccaagaucccaagccggcucuggugacuaaauucauggagaacggcuccuugucggggcugcugcagucccagugcccucggcccuggccgcuccuuugccgccugcugaaagaaguggugcuugggauguuuuaccugcacgaccagaacccggugcuccugcaccgggaccucaagccauccaacguccugcuggacccagagcugcacgucaaggucagcuggucuacaccccucucagccucaagacaaggccccagagcugcuccagccaggcccgccggacacuagaccuccagagcccugucuauugaauaggcguagccucucucucuggacacagggcugccaggggacaaagcccagccaggaguuuuagcuccugccuaccaggugauagaggcccugagccacacgagucauuuccaccagcugccccaccagccccuccaaagagucauggcugacccagcccuggagacucagaccuugaccuagcccuaccacaaggcaccuagaucuaccauccaagggaaccucuucccuugaccuccacacucccuuuacaaagcugaaccugcaccuucugggggcagggggguuccuggaggcucucuggcccccuugucuucccuaccucccacuucuuuccuuccuuugcagcuggcagauuuuggccuguccacauuucagggaggcucacagucagggacaggguccggggagccagggggcacccugggcuacuuggccccagaacuguuuguuaacguaaaccggaaggccuccacagccagugacgucuacagguaaggaucccggcccaaacacacagccaggauuccuacacuucucugggcccucccaggggaugauguauaggaaaggagucuugccagugauuggaccgauccucagcuuugugucuccugcagcuucgggauccuaaugugggcagugcuugcuggaagagaaguugaguguaagacucuaggaggauucugggauccuuaaccccaggugcccuucucuugaaagccccaaggcuuccccuucccgcucaccuacuuagacugcccuccucccuccucgugcccccacauuacacucccugccucuuuccaugaugaagcagauaauucccuuuuacccugaaugccuucucuucucacccuccuccccuacuccagugccaaccgaaccaucacucguguacgaagcagugugcaacaggcagaaccggccuucauuggcugagcugccccaagccgggccugagacucccggcuuagaaggacugaaggagcuaaugcagcucugcuggagcagugagcccaaggacagacccuccuuccagggugagcuggccaguuagcuggaucuaggauaagcuugggucugucagcagggggcuuuucucaggaaaagaagauuugcucaccugcacuccacucugcugucccucuagaaugccuaccaaaaacugaugaagucuuccagaugguggagaacaauaugaaugcugcugucuccacggugagugccaacaucaccccuccccaggagcuggucagggauggcacagcguggcuaccuggccauccaaugacucaccacugaccacugcuuuuuaugccuugaccuuuguacccaccguccccagcccaccccugaguucccagacaacagauuauggaccgagagacuacucccuuggguuuacucuggcucauccaagucauacccagcaaacuccucccaucccugcagguaaaggauuuccugucucagcucaggagcagcaauaggagauuuucuaucccagagucaggccaaggagggacagaaauggauggcuuuaggagaaccauagaaaaccagcacucucguaaugaugucaugguuucugaguggcuaaacaaacugaaucuagaggagccucccagcucuguuccuaaaaaaugcccgagccuuaccaagaggagcagggcacaagaggagcagguuccacaagccuggacagcaggcacaucuucagauucgauggcccaaccuccccagacuccagagaccucaacuuucagaaaccagaugcccagcccuaccucaacuggaacaccaaguccuggaccccgagggaaucaggugagacauugacaggauuaggggaugcacuaagaguccuauaaaugcuguccccuugccagcgaaaacuuggggcugagaggagugcagugggagugccaggcuccagggcagaacuggaugcucugugcuguuugcagggggcugagagacaaggcaugaacugguccugcaggaccccggagccaaauccaguaacagguacccauucucuaccucuuucuuuucccuguucaauucuuccaccagacuccuccuccagaccuauaucuagauucaggguacuuuguggaggggaggggagaagaugaucuaacucaaccuucucauuucauaaaugggaaaaccgacacccccugagaaaggagcccucugaggucacacaacaaagcuuggauuugucccugaaucuucuaacuuuccacaacaccagcucugugagcccccuaaguuccauuguuucagcaguccagaggaccucccagcaaaaaagaucagggucucaaaugucaauugccacucucuagagcuucugcuaacacaauucuggagaggagcucugaggggaggagcacagggcacaccuugacacagccacugacaaguagagacuucauacuccccacccacccccaacuuggccuuucugacagcuaaacccuccugccaccaucacuauuucucuuaaagggcgaccgcucguuaacauauacaacugcucuggggugcaaguuggagacaacaacuacuugacuaugcaacagacaacugccuugcccacauggggcuuggcaccuucgggcaaggggaggggcuugcagcaccccccaccaguagguucgcaagaaggcccuaaagauccugaagccuggagcaggccacaggguugguauaaucauagcgggaaauaaagcaccuuccaagcuugccuccaagaguuacgaguuaaggaagagugccaccccuugaggccccugacuuccuucuagggcagucuggccugcccacaaacugacuuugugaccugucccccaggagucaauaaacaugauggaaugcuag

SEQ ID NO: 17597 - RNA, 5444 nt, Homo sapiens
cccguccagugggcaggcggcuucaucccuccuuucucucccaaagcccaacugcugucacugcaugcucugccaaggaggagggaacugcagugacagcaggaguaagagugggaggcaggacagagcugggacacagguauggagaggggguucagcgagccuagagagggcagacgaucagggugccggcggugagaauccagggagaggagcggaaacagaagaggggcagaagaccggggcacuuguggguugcagagccccucagccauguugggagccaagccacacuggcuaccagguccccuacacagucccgggcugcccuugguucuggugcuucuggcccugggggccgggugggcccaggaggggucagagcccguccugcuggagggggagugccugguggucugugagccuggccgagcugcugcaggggggcccgggggagcagcccugggagaggcacccccugggcgaguggcauuugcugcgguccgaagccaccaccaugagccagcaggggaaaccggcaauggcaccaguggggccaucuacuucgaccagguaaucccccuaccccuguccaggggaccuggaaagacccugcaaggaccuggaagcaacuguccaagcccacuuugcugucucugaggcuuuaagaaaacagcuuccuacaucuuucacuaaucuggccuauugccccaccaccccaccgacgguuuccccucccuccacccauacgcagcccucuccuugccccuucucaccauuucuuuugaaucuguucacuccuauucacuccuacuugccacuccuucuauucauuacucacugccccugccccuaguccccaugguaccccugagccaugggcauuuccugagccccacucagcaggcucugcuucccccagguccuggugaacgagggcgguggcuuugaccgggccucuggcuccuucguagccccuguccggggugucuacagcuuccgguuccauguggugaagguguacaaccgccaaacuguccaggugaccucagcacuggcccccauccccggcucaggaggguggggagggggaagaaggggagcccagcugaccuccggguggacucuccauugaccuguguccuggaggccaggaccaggggaggaaugggccugccuugcauugaguguggaggaugugcagaguccaaugcuggccgccccucagcccucccgggagagcccauuaaaacccagcuucccaagaggaagcuccugggaaagugggggguccugagcuaagggcuggggaaugggggcuaacugggcuccccuccccaggugagccugaugcugaacacguggccugucaucucagccuuugccaaugauccugacgugacccgggaggcagccaccagcucugugcuacugcccuuggacccuggggaccgagugucucugcgccugcgucgggggaaucuacugggugguuggaaauacucaaguuucucuggcuuccucaucuucccucucugaggacccaagucuuucaagcacaagaauccagccccugacaacuuucuucugcccucucuugccccagaaacagcagaggcaggagagagacucccucuggcuccuaucccaccucuuugcaugggacccugugccaaacacccaaguuuaagagaagaguagagcuguggcaucuccagaccaggccuuuccacccacccacccccaguuacccucccagccaccugcugcaucuguuccugccugcagcccuaggaucagggcaagguuuggcaagaaggaagaucugcacuacuuugcggccucugcuccuccgguucccccaccccagcuuccugcucaaugcugaucagggacagguggcgcaggugagccugacaggcccccacaggagcccagauggacaagccucagcguacccugcaggcuucuuccugugaggaaagccagcaucacggaucucagccagcaccgucagaagcugaaccagcaccguaugggcuagggugggaggcucagccacaggcagaagggugggaagggccuggagucuguggcuggugaggaaggaaggaggguguauugucuagacugaacaugguacacauucugcauguauagcagagcagccagcagguagcaauccuggcuguccuucuaugcuggaucccagauggacucuggcccuuaccuccccaccugagauuagggugaguguguuugcucuggcugagagcagagcugagagcagguauacagagcuggaaguggaccauggaaaacaucgauaaccaugcauccucuugcuuggccaccuccugaaacugcuccaccuuugaaguuugaacuuuagucccuccacacucugacugcugccuccuuccucccagcucucucacugaguuaucuucacuguaccuguuccagcauauccccacuaucucucuuucuccugaucugugcugucuuauucuccuccuuaggcuuccuauuaccugggauuccaugauucauuccuucagacccucuccugccaguaugcuaaacccucccucucucuuucuuaucccgcugucccauuggcccagccuggaugaaucuaucaauaaaacaacuagagaaugguggucagugagacacuauagaauuacuaaggagaagaugccucuggaguuuggaucggguguuacagguacaaguagguauguugcagaggaaaauaaauaucaaacuguauacuaaaauuacauuuuaaaaguugaauaauguuugaguuaaauaggaaauaccaaggugaauuugugguuuugaaaagaaauaacuuuuugaacugucacuaauccuaaaaacaacaucaggaacaaucugauauccauucuuagaaacuggaucuuugcuucagauauuagucaccauuaaaaaaaaauaccaaaaacccucagguuccuuggagaauagcugcacaccuuaaguaacuccaggcccagaacauguuguugaugacagaaagcaaagauacuuuuuaaauguauaaaguaaagcugaaaaggcaaaggaaucaauuuaaagaagcucccacuugacaugcuuugacaauuugauuaucaaaaggaaaauaauacaguuaauuggaacaaggugaauuuuuuaaauccauguaccugcaaugauauucaaaaaggaagaagucacuauaaagugugacaaaaaguaguuaauaugcugagugaagaagagugaauauaggcuauuuuuagugagucgugauaaguacaagaacauaaauauaguaggcauuuugucuauuugcaagguacauuuguuuuucuuuaucuauguaaguagggaggggugaguacagagaacugugaauaauuccaagaagaucuggcacugugccaagaaugaaagauacugguggaacuauuugaguauauuuugcaacuaagaagaaaaacaguccaauggcguguuauaagacaauggauuagucagauguccaaaagacaacuguucacugcucaggcuugaucguucaucuccuagaaaauggauccucuguauuaccccacuaauuauaaugagauauuaauuaggcaaaaugauuaagaguagguuuggcuguaacaguaaaacccaaaauaagaauagcuuaaacaaaauaggaaaucauuuuugucucacauagaaaaaucuguaaauaagaguccagggauggauggcagccuuaugaucauuugaaagcccagucuucugucuuguucuaccauccuuagcuugccaccucaugacccaagacggcucccugagcuccagacauuacaucagccuaacaggaaggaggaaggaagaaacaacacaucucuuuccuugaaagaagcuuucugaaauaugcaccaauauuucugauugugucucaguagaauuuagucacccgggcucaccaagccagggagcuuggcuaggagcuacaguguuuauuccaggcagccauguccagccagaaguugggaguuuuauaacaaggaagaaggggaaauuagcuauuggggaagacaacuagaaguuguuuuuuauuguuguuuuuugaggcagagucaugcucugucgaccaggccggagugcaguggugcaauuucagcucacugcaaccuccaccuccuggguucaagcaaugcucaugccucagccucccgaguagcugggauuacaggugcgagccaccacacccagcuaauuuuuuguauuuuuaguaaagaugggguuucgccauguuguccaggcugguaucaaacuccuggccucacgugaucugauuacaggugugagcuaccacaucuggccacaaaguacuaccaacuugguggcuuaaaacaacuguuuauuaccucacaguuucugugggucagaaguccaacaaaacgugacuggcuucucugcucaggguuucacaagaucaaaagcaaaguauaagcagggcagccuuccuuacuggaggggaagaauccacuucuaaacucauuuaaaguucaguuccuuacgguuguaggacuuagguccuagcccccuccauucucaagccaacaacugcaagccaaguccuucucacacuuuaaaucucucaggccuaccuuucuaccacaucucucugacuucaguguagaaaguucucugaguuuagggacucgugugauuaggcccacccagauaagccaggauaaucucccuauuuuaagguccacaaccugaauugcauauuugaaguucguuuugccauguaacauaacauauucacagguuccagggauuaaggcauggacaucuucaggacaucugcauaucagagucacuaaacucaaagauggcaucauguagagaaaaggcaugcagcuacaauaccacugcauggaaaacguaugggcuugaaaauuucccaugauauauacaagauaaauaccagcucagauuuuaaucauuuuagaaggugaaccaauucccaggucccaaccaaaaauucauugauuaauaauccaaaacuugaucuacauugagauauauuuuuauuuuagauaucuaaauucaaaaauugcccugagcugagauaaugucucucaggucuaccacccauuuuuauaguggauuuaagcauagguguuauaaacuuuauaauccuuauaaugguaugugucccuuaccaaaaugaagcuuuuagagaaacugacauauuagugauucaguugaaauauuuaggaggauuugauuguuuuuaaucaacguuuaaaucauuuaacuuguuaaauguauagauuuugauuugcugguuauagaaaucguguucaaauauuuagacaauuuuuccuucaguagguuugugaauagauuaaacaauaaauaaagcacaggug

SEQ ID NO: 17598 - RNA, 11589 nt, Homo sapiens
uccgccccaggccaggaagugacucaagaaacaguuugcgugcgauguggacaagagagguccccgcugggugaggaacccgggaaggcccgcccagauucgggcccccugcccuuguccccugggcugggggcgcgggcaaagcgggggccuggcgggcgcugagaggaccugaagccggcgcgggcggcggaggcgguaggcgcgccccuccaccgcgcccgggagcggggagcgggggccgcggugcggaguaggcccggcccgggguggcugccccaguccgcggugggcgggcccggcccggcccggccccugggcccugggcggugcuccuggcccgacggagaggggcagcggacggcugggggaggggugggaguggcuugaaccuuggaaauggcagaccagggcccccagaggacagccuaguucaauccccugcugaggauucguccuuaagaagcuucagagugccccaggagacuccuucuggccuccaggccgagcuggagcccccccacccuucuugcuccggacuguggucauccuuuuccaaagcccagacgcccacucucgauagacagccuuguuuaccgggacuuccucuccggagaggccugcgugacauacacccucccuaccuccaguggacucagaugcuugucaccuccuggggcuguuuaccagagccuuaacuaggugcgaccuguugauagcugguguagucccaggaaccaggauuuggauggaggguacaaugaggcucugagcugccuucuccccuuccagggcugggggcagcagccaugccuaccuggggggcccgccccgcguccccagaucgcuuugcggugucugcggaggcugagaacaagguucgggaacagcagccccauguggagcgcaucuucagcgugggggugagcguccuuccgaaggacuguccggacaacccccacaucuggcugcagcuggagggccccaaggaaaacgccagcagagccaaggugaacgccuucucucccccaucccuccaggcaccaaggacgcuuucccccagggcggaggagagcagggccgaggagagcagggaagaggaggggccuggggaggaucuccacuucuugguugucucacuggcaaccucagugccccugaguuuugagggacuuuccaacucuauauuuguuuucaguuucagcuuaauuucuucugugauggcccaggcuggcaaaaaucauucugugcucuuugggagaauagagauaucuggcugaacaaguuggccccaccaaggaaugcacuguggggugggaggcugggccacauugcuuccuuugggauuaggcugggguuccaggauggcucaaucauguaccagcuuugugaugggagucucaguuuccuuaucucuaaaaugggaauaacaucauguggauacuccagacauccuggagcucaggagcgagcaaggagccaggaggggugaucugggccaguuaguuuacuuuuccugaccuucccuuccucccaaccaggaguaccugaagggccucugcagcccagaacugcaggaugaaauccacuacccgcccaaacugcacugcaucuuucugggagcccagggcuucuuccuugacugccuggccuggagcacgucagcccaucuggugcccagggcgccaggcucacugaugaucaguggccugacugaagccuuugucauggcucagagccggguagaagagcuggcagagcggcugagcugggacuucacgccaggaccaucuuccggagccucucaguguacuggagugcugagagacuucucugcccugcugcaguccccgggggaugcccauagagaggcucuguugcaguugccccuggcuguccaggaggagcugcugagucuggugcaggaggcgucuagugggcaggggccaggagcacuggcuucuugggaggggcggagcucagccuugcugggugcucagugccaaggagugagagcucccccuagugacggcagggagucccuggacacuggaucuaugggacccggagauugcaggggagcaaggggagacacuuacgcuguggagaaggagggagggaaacaggguggucccagggagauggauuggggguggaaggaguugccuggggaagaggcgugggagagagaaguggcccucaggccacagucaguggguggaggggcaagggagucagcaccccugaaagggaaggcccuggggaaggaggagauagcucugggaggaggaggguucuguguccaccgugagccucccggugcccauggcuccugucacagggcagcucagucccgaggagccucccuccuccagcggcuccacaaugggaaugccucuccuccgagggugcccagcccuccaccugcaccggaacccccauggcacuguggagaccggggugacugcggagaccggggagacgugggggacaggggagacaagcagcagggcauggcacggggucgggggccucaauggaaacgaggcgcccgagggggcaacuuggugacuggcacacagcguuucaaggaggcccugcaggauccuuucacccugugccuugccaaugugccuggccagccagaccuccgccauauugucauugacggcagcaacguggccauggugugaguaccugguggggcuaagggccuaggagagggaggauauguccugaggggcuggcauuguagccagggugccaagccccuccucuggccgacccccucccacuacaggcauggccuccagcacuacuucuccagccggggcauugccauugcugugcaguacuucugggaccguggucaccgugacauaacugucuuugugccucaguggcgcuucaguaaggaugccaaagucagaggugaguugggccuggucuucagugucccaggauaggcucuguuuccacuuugaggagaacccuauuauguucuuuuucaauagagagucacuuccugcaaaagcuguauucccucagccugcucucccucacacccucacgagucauggauggcaagaggaucuccuccuaugaugacagguacuugcuccucuccuggccccaggcuugauauugaaggagcccuauggaagacugagggagagagaaaagcuccuggugguuuacgcuguuucuaagccuuggugguggguaaggggccaguuauuccucugugugccuuaugauuggguagguaaaccugcccugcaggugugaugagaugaacuguagacaaccauguuugucuauucaucauucaucaaacaaaaugauaccuuguauuuauauagugccuuacugucuagaaaauacugguuuaguggaaaggugggaaagcugguuacauaaguagcugacagaugucuucuuauaaccugaauuuccaaacaugcagagaaauuucccuaacauucuggaaaaaccagaguaaaggucaaaauaacaaguaaaauggagaaacacaacgcaugaauaauaggacuguacaaaacaugguauaauagaaagaucacuggauuuagaauuggaagaucugaauuugagccucaaguagcacuacucauugacuuugacuguggaacuuuucuuagugaauuaaccucuuugucucaggguccuccuccauucauuuacccuccuugugaauauacgaaaaagauaagguaugugcuugccuugcucaaggugcuaggcaagaguacagugacauuccauccuaacuuugcacagaccuacucaaguguggcagcggguauaucuccaaucuacagucguggagacagagggucagagugguuaccugucuuagcaaaggggaauuagaccucaaagcugccagaugguuugaaugaaaauacaaggcacacuucuaccauagucugccuagguggugugagaaaugagcagauuuuagaaagccaaguuaaaaaauuuacaaguucuuuauucucuaggacauuauacaguuuuuaaaaauuaguuuuuccaaaccauagugauuauauacuuugucuuuucaaacacuuaccuucuauuccuuaacaagcaaaugguauucuacaaaaaagcaguuuacguucucccaauguuauucuauuuauaucuagaugucacagauuacccaagauauggaaucuucuuuccacaccugcauugaaacagaauugaaacugaagauugaguucguuuuaaugaauguuaaaggcaugugucugcccaguugugugggaccugguuggcagauaacauaauauaaauugggaauucgcccaguaacagugaauaagcacagugguacacagcguaggcauacggaaugaauguugcugaacaacauacuguguaaugcgaucauaguaaaauaugcuuaacuggaaaauaccauuugcauaccauaaguguaccauauaauuuuuuuuugguuuguuuuugagacggagccuugcucugucgccacgcuggagugcaguggcacgaucucggcucacugcaaccucugccucccagguucaagugauucccuuaccucagccucccgaguagcugggacuucaggugcaugccaccgugcccagcuaacuuuuugcauuuuaguagagaugggguuucaccauguuggccaggguggucuugauuuccugaccucaugauccgcccaccucagccucccaaagugcugggauuacaggcgugagccaccaagcccggccauagacauuuguaugucauucccuuaauuuguuucccagacagaagcucagagccugauaucugucacaccuaauccugacucccaguucccccuauaccacacuaucuuucaaauacugacugcucacuuaguacuaggugcauggccugcaggaggaggugggaacacugggaacaagaucugauucuugacuagagagccgaaagaaaccauaaaucaaacacuacaggaacucagagggaaaggagccccauucuggcugggguuuugugggaaaggagagauuugugaguuuuuguguugagaagacugggauggguuggaucucuguuucuaaaucuguuaaaaagaccaccacccaucacuucaugaguccuacccugucuuguggaaucagaauuacugaauggagcccaggcauuuuuuaaaaaaguucccuugguaauucuguuccuuagcaagucuugggaagugccuuccagauagaggaaauaguuggagaaauauggaagucagcauaagacauauguggagagcagaguguaaucugauuauugauuuuagcuggaguugagaguggguuagggaauauugggagagauaaggcuguaagggugauuugagcuggccuguagaaggccuuagcugccaggccuggguguguggacuuuauuugguaaauaaagggcaaguguggaagaguuuuguguaggugauaagcaugcuuucuuggggcagggcaggggagacuggagggugggugaguggucagaggcggggacccccuuguuaggagguuaugcauaaucucaguugcaauaucugaauuacuggggugguaauggugggccugggaaggaagggagcagagcacaaggcuuuucaaaggaaaggcauguuggauuugcaagggauugguugggcaggguggaagacagagcuagaucuuacuguuuacuaacgaggcacaaaguguugggugaaggacuaugguuggcagauaggaugcuacugggagaccaccuuggauucaucuuuguuuccucucuaggccauggcacuugcaucuagucaguugccuguagcugggucaaggugagguagggggccagaucuccaucaccagaaguggccuaugggagacaguaaaacuucugggguuggggccuuggagagucccaaaugguugcugugguuuuuacuuuuauuuuuguagauuugggggauaccaauacaguuuugcuacauagauauauugcauaguggugaagucuaggcuuuuaauguaaccaugauccaaacagugaacauuguacccaguagguaauuuuucaacccucucucgguugcugugguuuuggagacagguucauggugaagcuggcugaagagacagaugggauaauugucuccaaugaccaguuccgggaccuggcggaggagucugagaaguggauggcaaucaucagagaacggugagggagcccucccgcugagaacugggcacagaugcagauguuuuucuaaagccagcucugcucuggccauggggugaaaacucugggaaggaggugaaguuuucuugaaggauggagccagcagcuucuggugauacuggucucgguugucugggaggugggcaagggcccccucugugaccacacauuaucuuucgccauccagccugcugcccuuuaccuuugugggaaaccucuucaugguaccugaugacccacuggggcgaaacggccccacccuggaugaauuucugaagaagccagccagguaaucaauccccuagacuacuuacaggcagcccccaccccuggcccucucucagcaggcccagagacuuggguggaagugugaccucaguuugggccagcuuaauuuugcagugguuugaguugcauuggccuuggccuuuauaagcuucccaggggauccugacauagaaccuccuugcugggagggaaacaccugcuuccuguuucucuuaaucagcauguuugauggaguuauuuggaaaaugguugcuuauacugacagccaguuguauucagcaugccuucugcugaccauuacauaagugauucauuuaggacuagaacuagaucauaauaguggcagaguucacccuguuucuaaaagaacggcccaucuucccuucagaaguggguugauacugccacucaguggucagcuucaggaacuucaggauuucucccccaaagccaggaauaggcaggacaauuacgagaggggugcccacuaagaucuaauuucccccccaggaugcucaucagcucuuuuuggucuguuucuucccaggacacaggggucuucuaaggcucagcauccuuccaggggcuuugcagaacaugguaaacagcagcaggggagagaagaggaaaaagguagugguggcauucggaagacccgggaaacagagcggcuccggcggcagcugcuggagguguuuuggggucaggaucacaaaguggacuucauccugcagcgggagccauacugccgggacaucaaccaacugucugaggcccugcucagucuuaacuuuugagccucaccugcuugaguggcugccgcccugucagcuccagccgccuccagcucagcccuuucugugagagucccucugcugcucacucugauccagaggcacccugaguuggugcuuuggaucagggaagccacuuugggacagguccauaaagugaacugaucuuaccgagucaggaccucagccagcucucaagagguucugcucagccuuaacuucucaacuuugccuuagcacaggguuucuguagggagugggggcugcuagaggggauuaguuccggagacugagacuguuggcuccaccuccaagcugagcuaggguggagggcagggugggcaggaagugacaggaaguuaagcuguuccucucccuggcugcugcucuggauggccagagaacaagaugcucccuugcugagcuccugggagcguggaaggagaugcuaggcccuggcacaguguuauguggacugggccacgauaggguggagugagcuagugaagaaggcagagggagacuuggcuucuggucucagcuaugccuguuuugugaccuugauugaguugcuugggcuuuacuucugccuacaaaucagggguaaaaauaccuguugggaggagaaaugagaacauagaggaaagccucuuggaggaaaggugcuuggaccaagucucaggugugucugccuguggcugcacaggcucucuaaccgaaaccucacuuucagagagauguggguccuuugucuccaggauccacacccuagauuuuaacacugcauucucacuauaacgugcccuauaauggcugcaucccuuuugagcaaccuccaaaaucuacauuuacacaguagguaaauuagggaugacugcauuaucaaaauacucucaggguuccuauaaauggcagcucuccuguuguauucagguguuguuuacagacuaacaaauguguuggcaaaucccugguuagaugcacuuccugguguugagaugaacacgucgauuuuucaccaaucgaugaagccaugcucugcaaugacaauauuaaugugauccgacccuaacauuuucucuauggaagacguauguugcauaaagcaaggcacacuucugcuuuauguguguguguauggggaugggaggacuuaacggaaguugaaccaguugguucuagaugaaccaauuaucuggaaaaugaaagaaccagaguuggaaggcacuugacuggccaccagaccaacucugcuguuacugacaugcuuucuucacccugauuccuagaggucauugcccuggaucugcuugaaguccuccugugccagggaauuuacuaucuccaggguagcacauucccuguguagacgguauuaaucaguacuccuuacuuuagugcagccuaaaguaugcuuuucuguuacauccaccuuugaggcuggucauaccuccaggaacaauacagagccagucaacuuccuggaauccaagaccagauaaagaaguaggacaggugccccuggguucuguucugugugggccuguggggagucucuagacaagaucuuuuccaggcccugacuucugccucccucugaguggcacagggaguugaauacugcauggcgaguguaaugaugauggggaggguccuuguguccucaccccuuccuuuuuggugauuuacaccacuguaccauacugacccaggcugggggcagguguguuggagacaggcuggucaaagaggugacaaugauuaagagauaacccagcggucccugagaagagauugguuaguauggccugaacugguggcugggggaacugugucuggucaaguuauggcagaugucacagcuuuagguagguaaaaaggguccuagaugaaaaccuuggaguuuuuuuuuuuccugauaggguuguuuauacuucuugauugguuucuugccauuuucacuuucagugauggugggugugcaguagaccaaaagugucuucugcccuuuugugcuaagggcccugguugacugaguggccccagucagaugagaggcaaguccuaagcuucuuauagacagggauguugacuuuguucugcugcagccugauaaacugggaccacugugugguuaguaaugcacuugccauuuggugacacagacugaaggcuauccuacaccugggccuuaccucuuccucuacuggcauccuaauggcacucugacagcauccagggugacuacagggcccauuggaaauggaucaucauucucucuucuagugucuaucuuuaucauaaccugaugucccaaacuugugacaaguucuuuuggcaacugaaggaccaagaagggaaacggugaugagagagacugcucauuguaacuuucaaaaccccgucuuuggggaagaaucaucuagggugacauuccuugaaguaaaucccaggagaaucuaggccaaagagaugagccaagguuagugagacaauuuauuuuuauugccuaaacugcagagcauucucuacacagcguaaaggagaaguggggcagcugcaggacauguagagaaaccaaacugggaaaucuuacaaggaguugaaaagauuaaugucccaaccugaugagauuacggccuugagacaauaagguggagcaacagaacaaugggaaagaggacugggagaggaaucuaagaaccagauggcuucagcucucuagaggagcugagccuauucacagugccuaaccuggaagccugugaggaacaggccucaggcccuugccacgaccuacuuaggcuacaauuuccuuuaaggcagccccuagcucugggaaggaauacugguagccaguggccaguguucgcugugggaucaccuucuggcccuccagcagcaugauggcacgcugucgcccaaagacagcuugcaccacagcgcuggggagagggaugaaggcucggcggcccagggcagcacccaaggucugggcaaacucagcauuaguggcggaggauggagccacuccauucaggaccccgugcacgugguuugcuucaagggcaugggucaggauuccugccagguccccgauguguauccaggggaagaauugguggccugagccgauggggccccccaggcccaggcgaaagggcagcagcauguggcccauggcaccacccccacggcccagcacaaccccuagagcaggaaagagggaagguacagggguccucucagccuugaaggagcccacugcuccuccugguuucuguuuccccuuccucacucuccccaugcugacuuggcucuguaacagaagugagcaguauggcugucuuuaagaccucacaccuucucaucugcagguuggcuagaagugguggcauccucucacucuguaauuguaaucucagcucuccuaaucccaucacuuccccagcccagagaagacauuccaacccugucugauacccaggcccguuucucaccugagcgcaccaccaccuggcguguagaaucuccaggaagccuggcugcagcuucccauuugguuacgagguuggagaaaaagucaaaguccccuccugggcugucuucaucauacuccgcagucagacugggcugguaguaagcugccgguggaacacaaucauuugcccuggguguccuugguccugccuggcucucuguaguggaggcuccccuuggccucaccuucucuggcccuuaggaucuccccauuuggagacagagccauuuggauauuuuccccuugaacuucuccaugaccugaagcguuccuucccuggaggaacucugguugcagggcuaaacuuagaggcugcuagaguguagugguuaagaacaggaacuuggguaccaggcgccugaauuuuaaucagcucccucauuuauuaacucucugacuugaugcaaguuacuuaaccucucuguauagaauuuucacaucuuuaaaaugggaauaauaguaccuaccucauaggguuguuguaaggaauaaaugauaauaagcauaaaacacuucaaauaguggcugguguguauaauuguuugcaauuacuuggucccaaaggugaccaggaacucuguuccuaaagaacuauggugugagaaguaagggacuuugggauagguggacuuuucccuggcauugagugaugccacuccccacuguuuuuucagggucucaauuucu

SEQ ID NO: 17599 - RNA, 3068 nt, Homo sapiens
uuagugagacaauuuauuuuuauugccuaaacugcagagcauucucuacacagcguaaaggagaaguggggcagcugcaggacauguagagaaaccaaacugggaaaucuuacaaggaguugaaaagauuaaugucccaaccugaugagauuacggccuugagacaauaagguggagcaacagaacaaugggaaagaggacugggagaggaaucuaagaaccagauggcuucagcucucuagaggagcugagccuauucacagugccuaaccuggaagccugugaggaacaggccucaggcccuugccacgaccuacuuaggcuacaauuuccuuuaaggcagccccuagcucugggaaggaauacugguagccaguggccaguguucgcugugggaucaccuucuggcccuccagcagcaugauggcacgcugucgcccaaagacagcuugcaccacagcgcuggggagagggaugaaggcucggcggcccagggcagcacccaaggucugggcaaacucagcauuaguggcggaggauggagccacuccauucaggaccccgugcacgugguuugcuucaagggcaugggucaggauuccugccagguccccgauguguauccaggggaagaauugguggccugagccgauggggccccccaggcccaggcgaaagggcagcagcauguggcccauggcaccacccccacggcccagcacaaccccuagagcaggaaagagggaagguacagggguccucucagccuugaaggagcccacugcuccuccugguuucuguuuccccuuccucacucuccccaugcugacuuggcucuguaacagaagugagcaguauggcugucuuuaagaccucacaccuucucaucugcagguuggcuagaagugguggcauccucucacucuguaauuguaaucucagcucuccuaaucccaucacuuccccagcccagagaagacauuccaacccugucugauacccaggcccguuucucaccugagcgcaccaccaccuggcguguagaaucuccaggaagccuggcugcagcuucccauuugguuacgagguuggagaaaaagucaaaguccccuccugggcugucuucaucauacuccgcagucagacugggcugguaguaagcugccgguggaacacaaucauuugcccuggguguccuugguccugccuggcucucuguaguggaggcuccccuuggccucaccuucucuggcccuuaggaucuccccauuuggagacagagccauuuggauauuuuccccuugaacuucuccaugaccugaagcguuccuucccuggaggaacucugguugcagggcuaaacuuagaggcugcuagaguguagugguuaagaacaggaacuuggguaccaggcgccugaauuuuaaucagcucccucauuuauuaacucucugacuugaugcaaguuacuuaaccucucuguauagaauuuucacaucuuuaaaaugggaauaauaguaccuaccucauaggguuguuguaaggaauaaaugauaauaagcauaaaacacuucaaauaguggcugguguguauaauuguuugcaauuacuuggucccaaaggugaccaggaacucuguuccuaaagaacuauggugugagaaguaagggacuuugggauagguggacuuuucccuggcauugagugaugccacuccccacuguuuuuucagggucucaauuucuuagugaaaguacacaaagguuaggagaaacaugcauggaucaagggccuaggaagucauuuugccuggaaaagaccagugcucuggugugugcauagcuacagaggucugaguuaccccguuccccuggcgaauauaaggggcuggugauuuggggggcguaccuacaccugugacuaagacccaggccuugggggguuguggggcuuuggugauggcuuuagccagcaauuggguggucucuaggcggcugccgauuaccucuuuuuggaagguuucauuccaucugcaggagaaacaugggaaauaaaaagccacuaaauacauaagugcacauaucccucucucugucuuuuccugggagcuauuucauaccaauuucuuguaaagcccugaauuucggcuuaagagaaacagucaacgucuccuguagagggaaagggcauucauuuccugggcauccugaguuauacgugaggacuuaagccaauuggcugacuggguggaggagcagguggggguggaggaguggagcagaaugaguagucugggauaucgguuuaguucggaaucugggagcuccauuacccauagcucacagguucucaucaguggggcacuguccucccugugcucuaguggguaucagcuuuagggcccgggcugaccuucggagaggguugaggauguucucuccggccagguugacggcggcaucgcagcucggcagccccgaugcagcgagcucauccugucggagaaagcacacagugccccugccccgcccugcgccgcccaacucugcccucccacccgcuuccagaggauggacuuacccacgugauccggccgggcccgggcuuucgggagaccaacgucacuucguggccucuggcauucagcagcuggguuagggcugucccaaugaagccugucccgccaccugaucggaaaauacaaauuguuuauauucccguggaguuggggugggggcgccuuccguccccgcuguggcacccucuuccggcgccaucccaucugacaccaggcuucuccccacuuaucccccuccucgcgaugcagaggugacacaggucacagggauuagggagauucggcuucucgggcuaggaggccaaggccagguugccugugcacuagacagugcccucccggaagcggauucccaguccucaaucuccgacuaagcccgcccagcacucucccuuucugcccucccucacccacaagcacacgcauagcgacuaggaccuaacgcgccugcguaaaguuuagaguuuaccucaccucagacgcgacuacg

SEQ ID NO: 17600 - RNA, 2849 nt, Homo sapiens
gaugaaaccuuucaugguagcaggagaaugggacugugaauucucaauccccuguccccaccccuuccuuccucucucagggccuuaaagucuaggaggaggaagcacagcagcaacugacugggcagccuuucaggaaagaugcagccacuccugcuucugcuggccuuucuccuacccacuggggcugaggcaggugagugaccauccccacccucagaggccugaccucaucccauagauucuugagccaaauugccuugguauauccuaauucuguacuguugagcaaguuauuugaauuuguguuuccucaucuauaaaaugagaauaauauuaauaccgaucuugcagaguugccaugagaguuaaauaaguuagaguauuuaaaugucuuggaauugcccgcacacuauaagugcuauaaaaacaugcuuuguguaaauaauuuggcagcaugugucagacccuaccuaggagguaagaauacagcaauaacaguaccaucagcucaugucuagauuuuuaaacaccagucccacguggucuugaauuggacucagagggcucugggaagcuccaugaggauaaaaguauaagggaacuucaggaacaauccuguacuuacagcaaagcauucuccucaauaccugaggcugaagcuggccuugccuggaacaaggguuguucucccucuuuuggagaggaggagggaggugaggccuaggauggggaaaagggcuccuuucaagacagcaguguuuccuguagaacccuggagcccccucccaaucugcugccccauagacuccaagccucagcaccaucuccucccucuccugcacccucucuccugccguccccaucuuccagccuuucuggagccaccaaucugguacccacauugcagguucagcaagcauagagcuaagugccaaaugcuuccuuccaggggagaucaucggaggccgggagagcaggccccacucccgccccuacauggcguaucuucagauccagaguccagcaggucagagcagauguggaggguuccuggugcgagaagacuuugugcugacagcagcucauugcuggggaaggugaggagcuaaggaacuuccuggccagccaggaacacagcccugcggagcucuucgguggaagagccaucugaaagaagaguuguagcaaugaaagggugaaagaaagaccaagugagucuuugcgggagggaacaggccaguguaaaugaggaggaaaggaggauaagaucaaaaagagcaagaggaagagauggaagacacauauuggggcucaaaauauaaacucaggcuauuuaucaacuuaaucuggggaagcaaaccugaaggcaaguaccacccugucaucccuagcucagagcugcugagaaagaggauacagcugagccccagggcccucccauccccucgauucugguuagcugcagucuugcccuccccgugcugucugccuacccugcagagcugguggaccauagcuccugcagcccagaccuaccucuugcuuuugcagcaauauaaaugucacccugggcgcccacaauauccagagacgggaaaacacccagcaacacaucacugcgcgcagagccauccgccacccucaauauaaucagcggaccauccagaaugacaucauguuauugcagguaccaccuaccuggcccucuggcuccuuccuaguguguccggggacaauggaggaggaagugagggcaaggcuccgggguggcggggagggcaugggauguguacugcaccagcgacccccgagccuuggcuggaggccccagcugagcgggaacgccuacauucuuccuccagcugagcagaagagucagacggaaucgaaacgugaacccaguggcucugccuagagcccaggagggacugagacccgggacgcugugcacuguggccggcuggggcagggucagcaugaggaggggaacagauacacuccgagaggugcagcugagagugcagagggauaggcagugccuccgcaucuucgguuccuacgacccccgaaggcagauuugugugggggaccggcgggaacggaaggcugccuucaagguaaggcaugggcauuggccaacacaccccgggagagaggggcccgugcagagccaggcagugcgaacagauuccauccccacagccucagccuggcagccagaccagggugggcuggggauuguuuuccccaucaaccuggucucugggggaauaggaggaagacccacaacacauacauaggcaacauucuccuggagaagggagagguaccuugacucagauugggcuggagacaguaauuaaggcagagcugaaguccagcgaccgaaaagauccagaggcuuggcuccuguaccccaccgaucuuccaucucacacacacccagcaauugaaggggcccacccaccccugccuucccugagagcccggagcucagggaagcaggagcagggaggccugucucagucucccuucuccucucuaccuacagggggauuccggaggcccccugcuguguaacaauguggcccacggcaucgucuccuauggaaagucgucagggguuccuccagaagucuucaccagggucucaaguuuccugcccuggauaaggacaacaaugagaagcuucaaacugcuggaucagauggagaccccccugugacugacucuucuucucggggacacaggccagcuccacaguguugccagagccuuaauaaacguccacagaguauaaauaaccaauuccucauuuguucauuaaacgucauucaguacuuagu

SEQ ID NO: 17601 - RNA, 3228 nt, Homo sapiens
uuuacaccagagauccauuuauuacaguccugcaaccccgacugcccaccccuuggggauucuugccucugucccagagauggucaggcccagaggaagguuagucucaugccugcuguuagaggcgcuucauuguucucuuuauccagggcaggaagugugagaccuugauguagacuccuggaggugucccuuuuuuguuuccauaggagagaauaccuugggcuacguccuuacacacgaggggccccccggagucccccugugaacagagagaggaaagacugagcuaguguucccugggauggguggucucuguuauggauuuugugugacaucagugccaggcaggccuugucacucaccucccucaguccugggucuccagcauggcccuggcugugcuuucuggcucuccccagaccaagccuuucucugcaauucucacggacacuuuggugauaagugacugucggaugacagauccuuccccuccagccaccccaguccacccaaggaguggacuaaagacuagauuccagggggacacaggcugcccaagcucugggcugagagcauaaagaucuggccacugucauaccccagaacucccucaaguuccucucucccuguggucuuucuggguagaggcuggaaacccaaccuugaaaccggucugugucuucuuuggaucccccacacaaaucucaguggcucugcuguaauugccauggaagagacguucacacuggcaguccuucugcacugucagcaacacuuccugcagugugguugcuaaagugcucauugagacauaaccccagccagccacacugcacagcugcccuggcuucaccugggccuugcugcuagguagccugagaggccgcacagcugugguccacuuggccuuucucuccagcugguggggaagaagcaagaaaguccaggucaggcaauggccuucugggccccgacacagugauggggcugcacaaucuucccucuccucuaaggcacaggaacugaccaagaggucaggauggaaaggaggaaagggccggcaucccagugggaguggaaccaacuggaccaagaagagcaagaguggcaggagugugccucaccugcaguagcaugaugucguuggagaaguucuuaggauuauaggcuggaugggggaugggucuuuucacagggauaaacugcuggguccgcuccuguuccuugauauugugggcccccaaggugacauuuauggagcugcacagagagcagagugaggauggggguggagucacaggggauagagcccaggagcagugaagagcagaugacagcuguggcaggguagggcugcagcugaggggaaguugaagggacaggagggcuccagggcugagugacugugcccucuacuucacaaagacaugaagaguagggcuucugggggcucucucuugccuucaggaaauaucaugaaauugcucgaguuugcauuuugauccuuaaugcauggauucaaccuuuacuacugccuuauugggccagugugugaaaccaugccacuugcucugaccucugacccucugacccucugacccuguccuauuucucagccuuucaucaucuuaguccuauucccagguggcugcuccgaugagcuuucaugggcuuguguuaccaggaacucuggaagcuccccugggcugcaguccccaggagaaaacaagggucccuguagggggaacucaggaggugagcuggugcugcuccuuaccuucccuggcagugagcagcugucagcacaaaguccuuucucacuaggaugccgccacaccucuuccgacucuucucuugcagaaacugaacaaaggccauguaggggcgggaguggggcuuggccucauggcccccgaugaucuccucugaaaggaaagacuggaagauaaaguagcuggggauggcugcagucaggagagaaggcuuaggacgacagugauugagggugaaguguuuugugugcugcagacagugagggagggguccuccugagcucugcaggcaguacuccuugcaggcagagcaagcuuuucugaacuuuaagucucagaaccuucucucagaaagaauggacagugcuugacuucugcauccuacugcagaaacacacauggaggaagaaagaucuauuuucacagugguagagccccagaggauccuggacaggacuucccaggcuccuccuuuuuagugagucucucugauuccucugagccucugcuguccuccugauuggugccauuuucuaaugaucuacccaugagcuucuggaguuggauuuucuaaaauucucaugugccagggcugaacacauucuagguucucaguaaguguuguuuggugcauaaaugaauagccuccaauuagccuuuggcugagguuuaguggggguagugcuggugggauucaggaccucagggauguuagaggggguuaucaccaggucaguggaguagcugagggccugcaaaggcagaaggaaguggagaaaucaacuaaaaaugaaucgcaaagcccagguggagccaagguaaugggagagcuauggacacagucaucuugccaucucugagaucaguugcaccaugggcuucccuccuggcaggggugacugggugggggcacugaauaagugguucuuaagcugaguccaguaacaacuccuaugacugcaacuuggugucugagcuccucuuuccuggguuggaguguagaguaauaauuacuuaucuuuuuuagcuucacauucccuaccaaaugccuuucuaagaacaauccacacuccaggucauaaaggagaggucuagggagaggcuaacacccauuaaaccuuuuagggaacacccuucauuuuucgaucuuugcugagugucuaucuagccucagauuuauaagucuggguguggaaugggaggugggcucagauugaggaaaauuccugaccagugcucauggguacaggguaucuuauaagauggguucaggccucuggaauagggauagucacuuaccugucccagccccaggggucagaagaaaggccaacaggaggaggaauggcugcauuuucucaggaaggcugcccaggucagagcuguugguguugacuccuuccagaaacaaaugcuggagggagaugaaggagggauggguacaguaaacuca

SEQ ID NO: 17602 - RNA, 3228 nt, Homo sapiens
ugaguuuacuguacccaucccuccuucaucucccuccagcauuuguuucuggaaggagucaacaccaacagcucugaccugggcagccuuccugagaaaaugcagccauuccuccuccuguuggccuuucuucugaccccuggggcugggacagguaagugacuaucccuauuccagaggccugaacccaucuuauaagauacccuguacccaugagcacuggucaggaauuuuccucaaucugagcccaccucccauuccacacccagacuuauaaaucugaggcuagauagacacucagcaaagaucgaaaaaugaaggguguucccuaaaagguuuaauggguguuagccucucccuagaccucuccuuuaugaccuggaguguggauuguucuuagaaaggcauuugguagggaaugugaagcuaaaaaagauaaguaauuauuacucuacacuccaacccaggaaagaggagcucagacaccaaguugcagucauaggaguuguuacuggacucagcuuaagaaccacuuauucagugcccccacccagucaccccugccaggagggaagcccauggugcaacugaucucagagauggcaagaugacuguguccauagcucucccauuaccuuggcuccaccugggcuuugcgauucauuuuuaguugauuucuccacuuccuucugccuuugcaggcccucagcuacuccacugaccuggugauaacccccucuaacaucccugagguccugaaucccaccagcacuacccccacuaaaccucagccaaaggcuaauuggaggcuauucauuuaugcaccaaacaacacuuacugagaaccuagaauguguucagcccuggcacaugagaauuuuagaaaauccaacuccagaagcucauggguagaucauuagaaaauggcaccaaucaggaggacagcagaggcucagaggaaucagagagacucacuaaaaaggaggagccugggaaguccuguccaggauccucuggggcucuaccacugugaaaauagaucuuucuuccuccauguguguuucugcaguaggaugcagaagucaagcacuguccauucuuucugagagaagguucugagacuuaaaguucagaaaagcuugcucugccugcaaggaguacugccugcagagcucaggaggaccccucccucacugucugcagcacacaaaacacuucacccucaaucacugucguccuaagccuucucuccugacugcagccauccccagcuacuuuaucuuccagucuuuccuuucagaggagaucaucgggggccaugaggccaagccccacucccgccccuacauggccuuuguucaguuucugcaagagaagagucggaagagguguggcggcauccuagugagaaaggacuuugugcugacagcugcucacugccagggaagguaaggagcagcaccagcucaccuccugaguucccccuacagggacccuuguuuucuccuggggacugcagcccaggggagcuuccagaguuccugguaacacaagcccaugaaagcucaucggagcagccaccugggaauaggacuaagaugaugaaaggcugagaaauaggacagggucagagggucagagggucagaggucagagcaaguggcaugguuucacacacuggcccaauaaggcaguaguaaagguugaauccaugcauuaaggaucaaaaugcaaacucgagcaauuucaugauauuuccugaaggcaagagagagcccccagaagcccuacucuucaugucuuugugaaguagagggcacagucacucagcccuggagcccuccugucccuucaacuuccccucagcugcagcccuacccugccacagcugucaucugcucuucacugcuccugggcucuauccccugugacuccacccccauccucacucugcucucugugcagcuccauaaaugucaccuugggggcccacaauaucaaggaacaggagcggacccagcaguuuaucccugugaaaagacccaucccccauccagccuauaauccuaagaacuucuccaacgacaucaugcuacugcaggugaggcacacuccugccacucuugcucuucuugguccaguugguuccacucccacugggaugccggcccuuuccuccuuuccauccugaccucuuggucaguuccugugccuuagaggagagggaagauugugcagccccaucacugugucggggcccagaaggccauugccugaccuggacuuucuugcuucuuccccaccagcuggagagaaaggccaaguggaccacagcugugcggccucucaggcuaccuagcagcaaggcccaggugaagccagggcagcugugcaguguggcuggcugggguuaugucucaaugagcacuuuagcaaccacacugcaggaaguguugcugacagugcagaaggacugccagugugaacgucucuuccauggcaauuacagcagagccacugagauuugugugggggauccaaagaagacacagaccgguuucaagguuggguuuccagccucuacccagaaagaccacagggagagaggaacuugagggaguucugggguaugacaguggccagaucuuuaugcucucagcccagagcuugggcagccugugucccccuggaaucuagucuuuaguccacuccuuggguggacugggguggcuggaggggaaggaucugucauccgacagucacuuaucaccaaaguguccgugagaauugcagagaaaggcuuggucuggggagagccagaaagcacagccagggccaugcuggagacccaggacugagggaggugagugacaaggccugccuggcacugaugucacacaaaauccauaacagagaccacccaucccagggaacacuagcucagucuuuccucucucuguucacagggggacuccggggggccccucguguguaaggacguagcccaagguauucucuccuauggaaacaaaaaagggacaccuccaggagucuacaucaaggucucacacuuccugcccuggauaaagagaacaaugaagcgccucuaacagcaggcaugagacuaaccuuccucugggccugaccaucucugggacagaggcaagaauccccaaggggugggcagucgggguugcaggacuguaauaaauggaucucugguguaaa

SEQ ID NO: 17603 - RNA, 739 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaag

SEQ ID NO: 17604 - RNA, 1879 nt, Homo sapiens
cagcuaccggguccgccagggucaggagcccgagauucgccgcccgucguagcggcccgcuucggccccucggggcccggggcucuccgggaccuacacagcccgggagacuccggcggggcugccugcccucgcccgagcccgggggcccaagcugcggcagcggcucccaacgccucugcucgaggagagcggcggccuggaugccccagcgcccucccuguccaguuccuugaaggcccccaagaggggcgaggccggggaggugcuggagcggggccaagugagcuuucggggccgcgguugaacuggagucuugagugcgcugcggucaguggaggcccuuccacccucgccgcgccccguggggaauagucccccaccucccgccauggcugcagcaggaggagacgacguccuccauuuugucgggacaacugugggaacuugggaccccucaaaaccaaaccccguggggccaggacuugucccggaagccccgacugggcucugccauucggacaagggaacagccccagcugccggcgucugcguccgcggggcaguacuggucgggcgcgacgguggagacacccagacgcagcuccccgccuccaucaaccaagauggagggagcugcaggcucccuuggagcugggcucucgcggguuggaggggcugaggccugcccuggggcgucccugggcgccgccguccugugcuagcagcccggggcgcuggcccugccuaggccuuuuuacugccugccaccgucuccugguccggaaugguugauggagacuccauggaggcucccuccacagcccgcucuaucgcggggcgcacccgcugcggccccugcggggagcagaaucagggacagauggcgcccggugagggcgggccccacaggccaccuccacgaggggucuucucuuuuguuccucgucuacaccuacgucuucggcggaugucauggugcugaaccauuucccggacuccacguaaagauggaagcgauuccgcuuucgucucgcccuggcgguucuuagugggauuacaauugaggauguuaguuuggaugaaaguuggugaaauacuuaccuuaugucuggaaauacagauaaugugauuuuuaaaaaacacauugagccccguuuuacuucugugguaugguaaaggcacagguuuauucaaugaaaaucagacguuaaccaucuaaugcagggguggccaaucuuuuggcuucccggggccacauuggaagaauuggcuugggccacacauaaaauacgcuaacaguaacaauagcugaugagcuaaaacaaacgaaaaaaccaaaacgccaaaaaaaucucauaacguuuuaagaaaauuuacaaauauguguugggcugcauucaaagccguccugggccgcaugcaacccccaagggcugcagguuggacaagcuugaucuaagacaaaagcauguucacggauugaugagaguucuguguaagccuuugcauauugcauagugcuguaugucauggauaugccuaauaucaccuacauuuuuuagguccucaguuacucuuuggaaauaagugaauuacauguaaugucaucauuuuaaugacugcuguaaauuacaagcacugacuacccugaguucguggagaagggcuccauagagaaaauuugaaggucugacagaaacuuuaaaugguaagcucaguagccacuugucaucuauuuucugauuaucuuuuucacaauuuuuuggcauugauacuguucaaagauuaaaauuggguaacauuucuuuuuccugauaguggcaggaaugacagguucaugucccaaugaaaacgcucaccucaguaugcugccaug

SEQ ID NO: 17605 - RNA, 28473 nt, Homo sapiens
uuaaggacaacuuuuuauugcuaccagaggcuuuuaucaucaguacacaguucugacugcaauaccuuuuucagacugcaaagggagcucaggauccagaagucauuaaaagaaacauaaggcuggggaggcagggggaguaaguucuauuagaaaauccuaauagcuuaacaaaacuaggguacuaaauucaguuauaacauguuacagacuuaaaucauagagcugccccaacaucuagacagucucuccuacugauuauaaaugagugaaaacuaucaguuagaaaaaucuaauuuaaguuguuaauacauguuucuuuggugagcaccuggauauauuuaucacaaauucuuuuauacaaaugucgaaaaugcuuucaacaaaccuaaguguccuaauuacaugccacuuuuaagcaucacuuuaagguaaacaaaaaugaaaaccauaauuuuaaauuaaaauuugaaaugagacacaaaaucaaccugguaauaugagaacuuuuucuuuugccaucucugauuaauaugggacaauuccaaaguacccuuuucagacuaauuggaacuugagucauggcugucacacugaaauaauuuguucauucaacugcagugaaaaucaauauagaucaacaugcauaaaguucaguaacuauuaaauggagaagcaagcaaaagcaacaggaaaauuaaaucaggaugcugagggggaacaggauugcuggccaugaauuuuaauugaauuuuugacggggcaagcuacguuacauuauggcagaaaaaaagugcaacugacauacuacaaagagauuuuuuaaguuuaaaaaaaguuuggaucuuuuggauuucuuuuuuuuuuuuuuggucuuuaugugcuuaaauaacgcugaauuauaauuagccacacaaauaaugagaguuuuauuuuuuuuuucuggcucacuccaaaucagccuguuaagguauauuuccuucuacagccuuuccugauuuugcauguucucauucccaaaguagucuaccuuaguuuacacucaaagguagcacuuguugaaacuacaugacagaaacaggcugcaaagguggacaaggggaagcaugucccucuugucuugauaaaucagugccacacacagaacccacauuuucugagacauuaucuucauuauagagccguuugauuccaucauagaagucauccacuuccauuuccucuacuuugcguuuaguagaggucugcuugcacccacuggcagcugggagaugaugguaaaaggcugcuguaccucugacuggcacuucuggcuugcuguuguccuuggagaagucugggccugggacagaggagggauguaaucugaacacuccuuugucacaggucaccagggugugcuugaggggacgguagacauaaacggaauucagaggcagggaagacugcagaguagaaaggugaugugccacaagcucccgacaauggaucaacugggagcuauccaucugggccaggaaaaaaaaaaagccacacacaguugaucauuaauuaacauaggcugcucuguuaucucugguggccauuuuuccucccugugcuuuccguccccgcugagucuuuucucuccccacaucuaccuccaacucauuuauuuauccagcuacccauccaucaacaucaucuuagaaauuagguccaaaucuguauuucuaauauaauuaucuuuggaacuugaguuuuguauuugcaauguaugcugaacauuuacaugagaacagaaacuacuuuuuuguauccaacgucuguuuuuuuuuuuuuuuuuuuuuuuuuucagucuauucccccugucuggaaggcccuucauccuacucucuuggccucuucuaauuuuuuucaguggaguccaaaguacucauaaacacauucauuaaaaauguaagaagccaaagggcaaaaaaaaaauuuuuuuuaaucagggaugaggagggaagcuaagaauuuuaaaauaguaaaugaaaaauuuagaaauauguauuuuguagaaaauaguagacuuagcacuaagaugaaauguuuuugguaaaguuuuuaauuugggaguuuugcugauuccuucuuacccuucaggacaauucacagauaucaauccuuucuggaguuaccccugacucccucaacaccccaaaacucuaaaugccacggucaucuguuucuauaucaaccuuuuaacauauuuauggccaggcgugguggcucaugccuguaauccuagcacuuugggaggccaaggcagguggaucgcuugaagccagaaguucagaccagccuggccaacauggcgaaaccccuucucuacuaaaaauacaaaacauuagcaggacaugguggcagaugccuguaaucccagcuacucaggaggcugaggcaugagaauagcuugagcccaggagguggagguugcagugaggugagaucaaaccacugcauuccagccaggccaacagacagagcaagacucugucuuaaaaaaaaaaaaaaaagacacuaaaaccuuucaacguauuuaccacauuucaguauaauaaucuauuuaaccauuuagccuuuccauuauagacuacaagaccaaagguguggcauuguauuauauucaucuuuuuaucccuaaguuucuggcacaaugacuguacauggaaggccuuuaaauuauuaccuguaguaaagugucucucuuccucacuuucaauuacagcauugucaaaauaaccuuaguuagcaucauauauuccuucccugcucucuccagcggcaccccaaugccuaccagaaauaagcuaaacugcuuaguuuaguauuaauaagaaucuccauaaucugaucucaaccuucuuuucuagccuuauuuccuagcauacccucaacuuguggucuacacucuugcucaacaguccugcucuauaugaugcacuaaucuuccccuuucuuauuuuacccuuaaucaucuuauuucuaccuguugaaauuguauugcgcauuccuuccaggacuggcuaaacaccaucaccuucaggaagccuaucuugaccauuuaacuaucagggaucacuuuuuuccaguuuugaguauucuggacauuucuguaccaagucuuacuuauccucauauaaccugcagcacucaccaugacuguuugcaauaccacagagaaaauaggggaaaauaacgcacucuacaagaacacauuuggucacaaaauuauuuuuaucucuaaauacauucacuauuuguuacugaaaaauaccagaggaaagaaugguaaaaggcugauguuagucauuguauaauacaaaugcaaaguaacugaaacugucagaaauauacaagaaaauggcagauuuuagcaucuaccauaauguucacugauuuuuuuccccuaguuugaaaggcauuagauaacacacuguggguaagacacuauuaacuaguauuagaauuuguucucccucccuuaaaagaaaaaaaguuaacauaacacuuaagauagucccugaacuaucaagcuuacauuuaggcuaggucuuauuauauaucccagggauguagaacaagcugaaacaugcuaaaaacauuggaacaaagcacagagaaaggauggagcuucugccaauauuuuaggaagccuaaaaaaaaaaaaaugaaagaaacugggaguaaaaaaggggcuauaguguagaaauuauuucuaaaaaauaaguacagucaucccacaguauccaugggggauuaguucuaggaucccccaaaagauaacaaaacccaacaugcucaagucucuuauauaaaauaauguaguauuugcauauaacccacucgcauuguccuguauacuuuaaaucaucccuagauuacuuauaauaccuaacagaaugccuacacaucacuucaucuguguagauucaauguaguacucagcaugccacaaauuccagguuuuuuuggaacucugugaaauuucuuccugaauauuuucaauucacgguugguugaauccagaugccaaacccauggauauggagagccaacuguaccucguuuaaugaaauguucuuuagcaaaugaaugauauuuauuggccuaaaaagguaaagguaccacaaauauucuaaugccuuggucacugggcauaauaaaugccauggcagaaucaauacuauggcagaauccuaaaaagacauguauuuaaguaagaggaagacuaugucacuauaaucuuucugugugaaaaaacgaaguaaauagaguuauauuuuagcggugggagacugacaagaaaugauagagcuaaaagaccuuagaaauuauucaaaacaaaaccauccauaugaacuccacuuccacccaagucccaaguaagucuuuucuccaaaauaacaucaaaauaaauuccuucuaaucuaguacaaucugaauuuguucuauaagacaccaaaauaauuuguuccuucuugagauccaguggaagaaacaaaacaagcacauauacuggaacuaccaaaacucucgacaccagacaaguacucuaauggaguugauaaaaaggacuuaaaugaacucuaauuauaaggugucaagagaauauguauuauuuuuuauaacaauaaaugacauaaaugguagguccagauggauccagguuugaugaacagcaugaagcacugaggaaccugcuggaauagucugaccacagccaccuucaaaaagaaccaggagacugguggggaggggucuguuuuuuuguuuuuuuuuuuuuaaauuugcuucuuuuuacuuuuagaugguacaugugcagguuuauuaacuagauauauauugcaugaugcugagguuuggaguacaagugauccugucaaccagguagugagcacaguacccaacaguuuuucaacccuugcuccccucccucccucccccuucuaguaguccccaguuucuacuguugccaucuuuauguccgcguguacccaacguuuagcucccacuugugagaacgugugguauuugguuuucuguuccugcguuaauucacucaggauaauggccuccagcugcauccauguugcugcaaaggacaugauuuuguucuguuuuauggcugcaccuacucuaguuuuaaacuagaacauguacuuugacuacugcccagcuaggaacuacaaagaccaccacacuaaucuagguagaguuaacagccugaguuuauaaggcuaaggagagaaagagguuuagccaucccagaauggugaccaacagguggcgcaagagcuuaaggggguguagugggagguuaacagggacaaaaggaagauugccuuucaaaccugggaacacucaccauacuuugucucaaagugggggcucaggcagaacuagugagaguggccuccucacagcacgguaugucugugauggacucuccucaaaccaagacacugggaaucaugucgcaaauaauuuuggcaugaucucaucaaucugaugcaagacuuuccuauauuaaaaccagaaaacuaggaagaaaucugauauuguggccuugucacacgucuaaacacaaagauauuagaccugguguucccuaccugaacacagcaaacuuagcaaaaacagaaaugaguccuaaagaacuaggagccauccauguuuggaccacauggguugguguuagagaacugcuagaacaagucccaaaagucucuaccaagauuuaugaccuuccuuuucuucacuaacuuccccacugcaauuauauacuacauggggcauaucucuuaaaaagaaaaaaaauucacuguauuuccaguuuucaaacuacguccaaagacuaccuacauaauauaaucuaaaccuacacuacauagguagauuucuagcuauggaagggaaaacgcuauguugaguggagaucugcccuuaaacacaaguauagcuccguucuucuauucuauauucugggauuguguguguacaagauuuucuuuggggaagggggacugggaaaggguuccacuucuaaaacaaauuaugaaaaccacugaacuagaauuuuuaagguuugugugguaugaaaaaaagcauugguucuuuuaaaucacuacuaaguagcucuacacggcucuaagaaagucuccaguucccuacaccagagcuauaaaauaaaggaggugaaugaaauaacuucuccaaagauucugucaaaucccagguuugcaauacuccuucagcuaagaagaaaaaaaaguuucagugaauacucucuuccucuagcaccagaaaacuuacaaaagaguaucagauuuuccaguguuuuucacuaggaaaacaugaucucaaagcuacagaauacacaugcuauuuacaacauuauuauuuaugcuucaaaaucuguccucugacacuaacacuuuaaagcaaucuuuuucuguacuaucuugagaguaagcacagagaauaagucagaaggcauuuagagagaugucauuuguuccaauaaaaauaauguaauguaggagguuuucuauuaagccuauuccucuacuucacagucuaaugugagugauuaauauucaacuuuucuuucuaacacuccagggugagcaaaguaaauuuucugugucauauuauucauuuaaauggugguuuaucauaauuucuaaaaauucuaaguagcaacuaccuccuaggauuuauucucauuacagcauuuaauuauuuuaaucuaagacaauuaagauaucccuucaaaacaaaaaacagcccauguuacacuacauagguagaucucuagcuaacauacugcucugaucaucaaccuuuuuaugaaaagacugagcuccccucugcucacaaacuagagccuaaaauucuuggaagcacugacauacuuguuuaaaaaaaaaauuauuuuuuugccugguucauuuucuucagacauacuucuuaaaauguuugcuauaagaucaauuauaacuuucuuagaaaaacaccaaauucaacuauuauguuuuucuuuuauaauaaucuaaauuuuuagcucaauaacugcaguucuuugcuacaauuaguuuauugcaaaauguuaagcuuagaauuucacaaucuucuaaguaaaauccaauaaaacaaaucagaauaacuacuguuaaauaagaauaaauagccauauaaagggaaaguagguucaugagucuuuuauggauucagguggcaggaaaauggucugcagcagaucuaaacucgguaaguucuauuuggugacaugaauagaaccaguaagccuucucucaaaguaguugcuaacauacagcacucucaccaacuuuccauuugaaugagaauuuucuccacugaaccuuuacauuuuacuuagguaguugauaauuuaucaaccuauacauuuuauaauaaucuguagauacaaguuacaaacuaaucuuagguaauaauggaacugccagggaaaaaccucuuucagaaaaguggcuucuaccugccaguuugguauaaauacuucacuuacuagccaacaauaaauuauuugcuugucuaaaaagcaacuuauucuaauuuuuguuccugacauccguuauaaaaugagugaaguaaagaaguacuacauuaaaaccuacagauguagcuaggaaguuucuuuacaaaaaacuaaaggacaauaugguauugacaaucuuaugaacauuuuagaauucuuaaaaauaagagaaaugguuaaaaggaaucuuaaaaauacuauauaaguuuuauaugaaaaaaagagaucaccuagcccguaaauuuaaaauauauacuuuacucuugucuacucuuaagaaugguuugccauuacaacaugagaaaugucuuuuaguuugguaacucuauguauuccaauaauagaaaaacuuaaaaagaacacuauuuaauuagacugacaccuaccugugcuuucugaagcaguucaauuguaagagaaagccaaucaggaaugaguuucuccauuuccagacuaaccauggccagagcaagcauggauccucugaauugcagaaguugguugcaggccauacagugaaguaguugcuugguaaggacugccaaauguugagaugggcucaauuugggcaaacugaaaaguaacugaggccuaguugacacugcaauggcauggaacugaaaaucacaagaacaucauuuuaacuuuauuuaaauaucugggaaauuacauauagaaauugaugcaaccuauucaauuucuuuuuuuuuuuuuuuugagacagagucucacucuguugcccaggcuggagugcaguagcaugaucucaacucacugcaacauccgccuccuggauucaagcaauucuccugccugccucagcauccugaguagcugcgauuacaggcgccugccaccaugcccggcuaauuuuuguauuuuuaguagagacaggguuucaccauguuggccaggcuggucucaaauuccugaccucaagugauccgccugccucagccucucaaagugcugggauuacaggcgugagccaccgcgcccagccuaaccuauucaauuucuaagucugcgaauuaagcuucagugauaugacauauauacuaauuuauaauuuuuccuuggauaucaaguuuucuuuuuccuauuuccaguacaaaauaaaugaguaggcaaucuauuuuuuaauuuacugaaaacuacacacucaaauaagaaacuaaaagacuucagguauauuuacaauaugaagaaaauccaaugguguggcugugugaagaucccaauucaacuuauccagaauaauucucuccauucucaaaauuucagaugaggaacauccacagaaacugucucuugccaauaccuuuaguacuggaauucucuauccaaagcaaaggggaacagggacagggagaaaaggacagaaaagaaacucauuuaugauuuuuguuuuagcaaacgaagcaaguuaauaaauguggagagaaauuuucacggaagaaacauuaucuugaaaggauuuauuaccucaucuuccucaacagucuuggcagcuaggaaaaaacagcugauugcaauacaacucaaguauuuuggaugagccuaaaauuuugaagagggaaaaagcaacuuuagugauuuuucaaaaacaauuuaacuuuuuguaacuguuuuaaaaaccuagauaugcagaugagacagguauacacaaaauacuauggaauucaauuaaugugacugccacucauuacuuuuuagaucagagcuaacuuuaagaacaggaaagaaaguuuauuaaaaagcuuuagagcaguaaugaaaggaaggaaaguacacuugcaagaucaagugugucuagagcuaacuuuuuuuuuuuuuuuuuuuuugagacggagucuuggccugucgcccaggcugcagugcaguggcacgaugucagcucagugcaagcuccgccuccuggguucaugccauucuccugccucagccucccaaguagcugcuacuacaacgcccgccaccacgcccagcuaauuuuuuuuuguauuuuuaguagagacggggguuucacuguguuagccaggauggucucaucuccugaccucgugaucugcccgccucggccucccaaagugcugggauuacaggcgucagccaccgugcccggccugagagcuaacuguuagcauuacaauccuagccauaugauauucuacaaaaauaauaucaauuccauugcucaaaguucaaccaaagccaauuaaccaaaguucauuucuauccagcagaaaaaaagcuugauuuagaaguuuuuaauaaauaauauucccaaaauuaaaaaauuuuuuguguauguaaacauuuuuuaaagcuaauugcuugcaaucugggauaucugaaaaaugccuacuuuuaucucagcaacaaguccacaucacuccucccucccucucuacuacaucuaaccuacuuuucacagauaauuccacagaaagaugaguuuaaaguuaguguccuuucuuggacaguacauuuuucaaaaauuauuagugaacacauuguuguaguuucuaucaugaguuucuugcuguguuuauuaaacauuugaaacaaaguuggagaaauuuguggaacaauuagagaauuuugccaaauaucucauuuuuucauauuucuuauuuauuggguccugucauguuuaguaagugucuuaagaguagaaguuugagcagcuauucagucuuacacuccguaauuauuuggcuucuauucuguauaccuaauaaagcauuuaauugacaguucccccaguuuacauauucuuuugcauacuaaugccuacaaguuuaaauacuaugcuacuuuuucaugccuugccauuaaauaaaugcucauuuucugcuuuaaauauguugagggccuauuuacuaacuugacacagccaaugacauggcaauggggacaauauaaaaccuaauuauuuguaugcugucauucaacaaaaauauaccaaaguugcuuuaugacaucuuguuauauaccaaaguaagcccguagaaagcacuuuguuuuucagaaagccacacaguauggauauucaauaaguagugacagagaaaaacgugcaauaggcuuauacuuuauucuagucugauuccuuguccaccucuguacaccaauauguuagaaaaugacuaaguauucugcugaugcuauacgguuugugcuaaaaucaagagauaaaaaauuucauaggcuaaaaaguuaugaauacuuguaacaaaaagaaaauuacagaauacuauuagaaacacuuccaaaaacacuucugcuuuuuaaacaauaguagaaagccgggagugguggcucaugccuguaaucccagcacuuugggaggccaaggcaggcugaugacuugacgucgggaguucaagaccagccuggccaacacggcaaaacccugucucuacuaaaaauacaaaaauuagacuggcaugguggcacgugucugcagucccaacuacuugggaggcugaggcacaaaaauugcuugaacccaggaggcagacacacuccagccagggcaacagagcaaaacuaucaaaaaauaaaaauaaaauaaacaauagcagaagacaucaccaugucuucuuauggguacauacaucauucuccagcaaaguucuccacuucuuucuaccuuacagaauguucacuaauagccucuaguuuagcauacauacacucaaaugagguuauauguaagucuaucuuaaaacacuuaccuuuacgguagcuaaaaaccuauccaaaagacugcuagccagagcaaauguuucuggguaaagguugaauugguacuugaguuuggccagccauugaauuacuucaucucucugggauggagaaacauucuauaagggaacaauuuugaaaacagaagacaaaguuugagcuaucaucaagaguauguuuagaauucucucucauaaaagguuagguaauacuacaaaauauauuuaaaaauguuaagguuauucaaaaucuaucagacuugagacacaugaaauaaaacuuuauguauuaucacauuuaauaucaauauccaauauucuccuacucuuuauuaaaauuuucacuaugucaucucaccaaauauccauaguugaauuaaauuuaggugcucagagaauauaacauuuuaaaguuuaaguaacacuauuaucaacugauaguaauuuggaguuaaguuaccccaccucuuaagauuaagaaaauacagugaauuucucccgcagcaaguagccauuaacuuaucuuaggaaauauaaaugaacuaugauaauggaaaugauagcccauuugaaaaacuaaaaucaauaguaauaaguaaaagauaccagggacaacagaugaauuauacacuuagagaugaugaaaaaauauugaacaggaaauuaaucugaaguaaauuacuauuuugaaaaauuuccacaaacacaaaacauuauuguuuuauuguuguuguaagccuauugaguauaagcuuaauuuuuagcagggacacacuuuaaaguaauagugauuagaaaacuuuuacucuugaguuuuggagucgccauuaaaaaaauaaaaccgguuguuuauuuugggaacauucaguauucuccuuacagcucuuucaaacuguaguuucaaacaguuugaaagagcuguaaggagaauacucaaauaauauguaggaagauuaaaacaacaauguuuuguguuuguggaaagcuuucaaaauagucauuuacuucagguugauuuccuguucaauauuuuuuuucaucaucucuaaauguauaauucaucuguugccccugguaacuuucacuuauuaauauugauuucaguuuuuuaaaugggcuaucauucuguuaucauaguucauuuguauuuccuaaguuaaccauaguaagccuacaaugguauggaacacuagaaguuauuccucauaucuagcuguaauucuguauccaggcuacuuuaagaucuaguucuggacuaaggauccauaaaaaucccugagaaccaaguaaagccaaucacaagacuucuggaugaagaguuaagcauucaagagaaauuaaauuccuaucaagaugagcuuuuauccaaaaugccacaacaaauaaggaaaaguaauguuaacuaagccagccaaacacaucaacaaggaaauaaauucccaggagagguaggugauguuauaaucugaugaaacugggaaggcuuuuagggagaugaaaggaacgaugacuuacaguagcuaugaaaacaagaacaccauuaacucuaaccuucaguuagagauacaaugugggguaugggagaaaaaaaaaaaucccugaaugacagauuacauuaaauaaugucacuauuugguguuuggcauuaaacaauaacagaaacauacaauuguaagaagaaucacaaagguaacauacaaaaaaagagaauacaguuauauggagauuaucauauaguuauaacuaaaugacauaacuaauguaaagcauauauauggaaugcaaacguacucaaauauuaguucuccuuucccaccucuaaacuacccaauucucuaauaaugucagaaaaacaaauuuacaaaacauuaucuaugaaguuauuuuaaacacuguuaacaauuagucaugaaagaaaucaugacaauaucuuugaacuuuaauauuccauauacuuuuugagacagggucuugcucugucacccaggcuggaguacaguggcacaaccauggcacacugcagccucgaccucccagccccaagugauccucccaccucagcauccugaaguagcuaggaccagagguacgugccaccaggcccggcuaauuuuuuuuuuuuuuuugagauggagucucgcucugucacccaggcuggagugcagugguucaaucucaguucacugcagccuccgccuccuagguucaagcaauucucccugccucagccucccaaguagcugggauuacaggcuugugccaucacgccuggcuaauuuuuguauuuuuaguagagaugggguuucgccauguuggccaggcuggucucaaaucccugaccucaagugaucuacccaucucagccucccaaagugcugggauuacagacgugagccacugcgcccggccuaauuuuacuuuuuuguagagacgaggucucacuauguuacccaggcuggucuucaacucccaggcucaaguaauccucccaccucggccucccaaaguguugggauuacagguguaagccacuauguuuggcccauauaccagauaguaaaauuuaacaacagggccaagaaaagcauuccugcauagccaauguuaucaucacuagccaaaaccagcaauaauuuuuuuaaaauccaaaagauaacaguuuaagaagacucaauuuaacugaaguaauacugagucuaaggucacuuuuucaaaucaauucaaauauguacuaaacaguaauaucaucaugacagcauuacaaauaguaaguucugcgccuaauucauuucauuccuauuccucuaaaauaaagaaugagagagaaaaagaaaaagcccaaaacaguauuuccugauuccaucaggugaacuguuucucauauggacugcuuaaauaggauuagaaggauucaguaguugaacaaauaauccuaaagagaauuuauaauggauugaucaaacaugguaaaauauagacugcuauuaauauauauucuguauauauauuauauuccacaugcugcuagucuucuccuuaaaauauacaaccuccccagcuuuaaacucuaaaagguucaccauuaccuaaaagauuaaguacaauuccccagcauggcauacaaaucuaugaccuaccucuucuuuguuguuguuguuuuuguuuuuuguuuuugagacagucuugcucugucacccaggcuggagugcaguggcgcaaucuuggcuaacugcaagcuccgccucccagguucacaccauucuccugccucagccuccuggguagcugggacuacaggcacccgccaccacacccagcuaauuuuuuguauuuuuaguagagacgggguuucaccauguuagccaggauagucucgaucuccugaccuugugauccacccgccucggccucccaaaguguugagauuacaggugcaagccaccaugcccggcuaugaccuaccucucuaaccucggacaucuuccaucacuuucugucuuaaacuucaugcuguaauaguaacuucuacugaugauccuuccuugccccugguauuuuacguuacugcuccuuuguucauauugcuccuacugacuggaacgcacucccuucucucucaccugccuuauuauguaucucuugagagcuauuuugauguuacuccccgccagauacuuuuccugauaauucaaguugggcugaguaccuuccuauguucccacagcaucucauuacaccuguuaaacguucaacauuuuuuuaaaaauuaaauuucugggcauggcucacaauuguaaucccaguacuguagggggccaaggcaggaaaacugcuugagcccaggaguuugaaacuagccuggguaacacagugagacuucaucuccacaaauaaaaaaauuaggcaugguggugcgugccuguuaccucagcuacuugggaggcugaggugggaggaucacuugagccugggaaauagaggcuguagugaacugugauggagccacugcaccccagccugggcaacagagcaagacccugucucagaaaaaaaaaaaaaauuaaauuuuuccuuuuggcuuugaugaaguaggaagcagcaaaucuaaacuccaguugagaaugacuagaaaagcuguuaacaaccucuuuuuaagauuccuuagaguucuaaaauucuacugaaaaucaucuguauaucaacaauuuguggcaggguuuuaucuuuguaaaucaaaagcacuuuggcaaaauaaauugagaacaucugaaaguaugugccacuuugaccaguuucaauguuuuccccaaauucauguaacaaaauuaucaugaacuugaaaguacuauuacauaauauaaaagaaguucucugcaagugccaagaacacaguaagguaccugaaugaaucauaaagaaaugauaaucaccauucacuuaaaugcuuacuuugagucuauuauaugcaaguaaacaaaaaugacaccaccauaccccucagggaaacucacagucaaaucaccagaaaauuauaauacuuugugcugucauaagggaagcagaguguggcagaaacacauagaaggugagugacagcugcauaauauucuugccugaccacacuguccuaaauuuggggauaggggaugcaaauuaaacaagaauuaugugagagacugacuucaaaauauaguuggggcaggggggaaguuagaaggaaacuggaggaaaaaggcauaagagaaagcuuaaaaauaucuuacuuuuccauuuuuaccaacacuucaaaaccaaauuagaaaagucagagcaacaguggaaagggagguaaaaaaaaaaaaaaaaaaaaaaaaagccagucccuuagaggaaaauaagaguuagaacuagaauagagaaggugcugggugcgguggcucaugccuguaaucccagcacuuuggaaggccggaucacaaggucaggagaucgagaccauccuggcuaacacagugaaaccccgucucuacuaaaaaauacaaaaaauuagccgggcguuguggcgggcgccuguagucccagcuaauggggaggcugaggcaggagaauagcgugaacccgggaggcggagcuugcagugagccaagaucgcgccagugcacuccagccugggcagcagagcaagacucugucuccaaaaaaaaaaaaaaauagaauagagaagugucccuggggguuacccuggcaagcaacucaagccccuauagccuuuuaccccuauucuuaacuccuauccccaccagaccaaggccacccaaauuuuacaaguauuaaauauggcuucuacuuggcauuacuaaaggcaaauccuuaagaaguggaucucucucagaaguucugauacuauucuguucucugguauuaccacaccaguauucauuaaaucaccuacagaaauaggccagauuugggugugguugcucacgccuguaaucccagcacuuuggguugcuggggcaggaagaucaucugaggugaggaguucgagaccagcucggccaacauggugaaacccugucccuacuaaaaauacaaaaauuagccagguaugguggcgggugccuguuaauuccagcuacuugggaagcugaggcaagagaaucacuugagcccgggaggccgagguuacagugagccgagaucaugccauugcacuccagccugggcaaaaagagaaaaaaacuccuucucaaaaaaaaaaaagaaauaggucagauuauuugguaauauagcaauauacuacaaucuagguagaauaucaccuucaaagaccaggcuguaaaaauauauuauuguugguuacaugcugacuuaaggagauagcaggaggaggaaaggaaugguccuacaagcagcuauaaaaaaguuuugaggcucacuagaaugucacaacauaagggcaggaauuuauuuucuccuguuguauccccaauaccuagaauagugccuagaguauagcagauacucagcagacauuugcuaaaugacuugaauucccaacuaaucuaaaaaucacacaugcgcgcgcgcgcacacacacacacacacacacacacacacacacacacaaaauaucacaggaagaggacuaccuuaggaaaaggaucgaauuauaauuuuuuuucuuuuuuuuuuuuuugagacggagucucacuuacccugucguucaggcuggagugcagugacgugaucucggcucacugcaaccucugccuccuggguucaagcaauucucauaccucagccucccaaguagcugggucacaggaaugacucaccacacccagcuaauuuuuguauuuuuaguagagaugggguuucgccauguugaccauggcuggucucgaacgccugaccucaggugaucugcccaccucagccucccaaagugcugggacuacaggcgugagccacugcguccagcccaaauuaucauucuauuacuuauuaaagucuugagcaaauugggacuacugaguacuuuuucaaagaauuaaaugagauauuaaaugagauagcauauauauaaacacuccucauucaaguuaacuaaucaguuugcaaaaugacaaguaacaguaaaugaagaauguauuucuuuagcuugugggaaagaauaaguaggaaaaauuagaauugaauuaaaaaggcauauauacuuucaaaaccaauaagcaaaggauagccuaaaacaacacacgaggaacuuacauauuugccauucauucacucaugcauauuaaaagaacauuugaccacuauucuauuuuccaagcaccauguuagauauuaaggauaaaagacauauaagacaucuuauacaauaaacuuuuggaguggauaaaguucacaguuauuugugaaaaauaauuauauaugacagaaguauaaaaauuucuaaaagaaaaacuaugcagcuaacaguaguuaagagaccagcuggcuaucuucuaaaaagcuuccaacauugguauuaccuuaguaauucacaugaacuccuuaccgcuaaugaugaaagaguagguuuuuaguugacuaaagacaaugguaugaagauguucagccucuguggcuaacuauaaacuauauaucuaaagaagguuacuacuguuaguauagauuaugaugaaagaaaacaaaccuaacuauuuucccaaagcuguaacucagauaacaacaaaacaggucaacaaacaaaaacaguuaacucuuguuucagaaagaaaaggccacagcaggagcaggaguuuuuaaaaaagaagaggccgggcaugguggcucacgccuauaauccuaccacuuugggaggccaaggcugguggacugcuugagcucaggacuuccagacuaggcugggcaacauggugaaaccccaucucuaccaaaaauacaaaaaauuagccaggcaugguagcaugcgccuguagucccagcuacucaggaggcugaggugagaggauugcuugagcccgggaggcagggguugcagugagcugagaucaugccacagcacuccagacuggaugacagagugagacccuguuacacaaaaaagaaacagggagagucucucaaauacagcacauccuuaaaugguacacacuccuccaauguagugucaagauauuauuauguauggcaguaguauguuuauuucuaauaaaauucaucugucuuaagagaaaaaucauuaccugauuugaaggcauuuuccgcacauucacuuuccacaucugugcuucccuagugauugccuuuuccaacaggaaagacaaucucugguuuuccaaaggcccuggaaacuucaugauauccuuuggaucugccugcuacccagcuugcuguagcuaccuacagaaucaaguaaguuuuaaaauuaguuauagaauaaguguagcauuauauaaaguacuaauuaagcaacucauaaaacaaaauaagaaugcuaugaggcaguauaggauuuuauagcucuuuaaaauaucguauuaaaauaccaaaauaaucaguuaucuaaaacauucacacuugaaaucugaaauucaguuauaaagagaauaaaaacaaggccauguaauugauggaaccuuuggacucugaucaaaacauguuauuacuguuucaaauugucaaaacuuugucacuggcuuuuuuaccaggaauucuuagaaguaguuauuccaaacauuccucuuaaaaaccuaaucagauaaggaccacuaacauuuuuccuucauuaaaaagaaaauauauuacauuaaauccuacccauucccacuucuucaguaugaaaccauacccuccaguaugaaaucaucuuaaauugcgcuuccaauucaguauccauuagcuacacauguggauauuuaacuaugagcugaauaaaauuuaaaaauuggccaggcaugguggcucacgccuguaaucccaucacuuugggaggccgaggcggguggaucacuaggucaggaguuggagaccagccuggccaacauggugaaaccccaucacuacugaaaauacaaaaauuaacugggcaugguggugggcgccuguaaucccagcuacucgggaggcugaagcaggagaaucguuugaaccagggaggcagagguugcagugagcugagaucacaccauugcacuccagccugggcaacagggugacacuccgucucaaaaacaaacaaaccaaaaaaaaaaaauguauuucuucagucacaauagccuuacuucaauaaccagauguggcuaguggauacuauaucggacagugcacaaaaggaacauuccuauuaauacaguaaguucuacugaacagugcucaccuagaaagcuccacaguacauugacuagcacucuaaaaugagcagcaugucuaaauagcaaguuuagcagugcaagacaacauagaguccaagagaaaugucucuagguuuuauguuuauauguauuuggaaacaagagucccacucuguugcccagguuagaguacagugguguaguggcucacugcagccucgaacuccuggguucaggugauccuccugccucagccucccaaauagcugggacuacagaugcacaucaccaagcccagguaauuuugugggguuuuuuuuuuuuuuuguagagaugcaguuuugcuauguugcccagccucacgcaguccuccuggcuuggccucccaaagcacugggguuacaggugugagccaccgugcaggcuucuagguuuaaaaaaaaaaaaaaaaaaaaaaaaaaaaagaagcaaacuacagacuugagguuugacuguguguagaaaauuggauuaagaaacugcuaaagaaugugaaaagguggcugggcacgguggcucacaccuguaauccuagcacuuugggagguggaggcgggcagaucacgaggucaguaguuccagaccagccugacaaaacauggugagacccccgucucuacuaaaaauacaaaacuuagccaggcaugguggcaggcaccuguaaucccaguuacuuggaagccugaggcaggaaaaucgcuuuaacccaggagacagagggugcaaugagccaagauugcaccacugcacuccagccuggcgacagagcaagacuccgucucaaaacaaacaaacaaacaaacaaaaaagaaugugaaaaggcuuagcuggauuuguugaaagguaagcaacuaaaaagguaauuaacuucagaaaaaagaauuuaagaaaguaauguaucacaauauuuauacagcaauaauaaugaaaagacuggauagggaucgcaauaugauaaaacuacauuggcaggauguggagacauaacuauggauauuggaagaggguaaaauaaaagccacgucuuuacauuucauaguaggaaauucauaaauaucucaaacugaaaugucaaaaaacagcagcagagcaaguuguuugaaaaugugaugcuaaauaacgggacaaggaggaaagaguugggaguaguuaaccucugcagaguaagaaaagggugagaaaggccuagcguaggagaaugcuguuuuucauuauaaauuucacuaacaauuugacuuucucaacuauguaccuguaaacuauguaucuguauuacacacuucagauucaugggcucuaagaauuuuuuuaaauauccagaauuaacauguaaaaaguuccaauuuuuuuaaaaauaaaaaauuuggaaaagcaaaaaauagcaaaccacuucuuuaauuuccacauucuaucccaacuccagcuacuauccuccuuccuauguaccacuccacauaugcuaccuauuugcuucucaacuuacuagagacuaauucugguuaacucaauuaugauuuuguuaauuuuugugucuuuaaacgccugaguuuuugcaaaucuucuauaauuagcauaaaauaucuucauacuaagaugacaagggguaaauagagaggaaaaagaacuaauauuaauccaaaaagaccuaucucaaagguaauuucuucuaaaaacucuugauucuuuaaucaugucauaaagcagcuuucuguuaacuccccaacuacguuauaaauuccuggccaggcgcagcggcuccggccuguaauccuugcacuuucgaaggcugaggaggacagauugcuugagucaaggaguucgacgccagccugggcaauguggugaaacuccaucucuauaaaacauacaaaaauuaggcaggcgugguggcacgugccugugguccaagcuacuugggaggcugagguugcagugagccaaaaucaugccacugcacuccagccccagcaacagaaugagaccgugucuccaaauaaagaaaucccuaugcagucacaucugccaauaucauuuuuauauauauauauuuuuuuuauuauuauacuuuaaguucuaggguacaugugcacaaaguucagguuuguuacauauguauacaugugucauguuggugugcugcacccauuaacucaucauuuacauuagguauaucuccuaaugcuaucccuccccccuccccccaccccacaacaggccccggugugugauguuccccuuccuguguccaaguguccucauuuuuuuuauuacucacuguguccacagcacaguacuucgacggaacagagacccaaccaauuguuccaguuucaaccacuggugccccaaacaaaaacacacaaccaaaaacucuacccccaccuguaccaacccacugugugugggguuuugguaccuucuuuuuuuugauacauccuuguucacaacuuuaaccuaccaaaaucuaaucucuuucacaccaauccuuccaaucuuugaagggugcuaucaugcucaccaauucaucuuuuccauagcugaaaacuucgauagcuccucacgauauuuugccucuucuaaauuagcuuuaauuuuaccauaaauacagucuaaaaucaugggcuuuuuuuuuuuuuuuuugagacaagagucucacucuguugcccaggcuagaguguaguggcacgaucucggcucacugcaaccuccaccuccuggguucaagugauucuccucccuuagccuccugaguagcugggauuacaggcacacaccaccacacauggcuaauuuuuguauuuuuaguagaggcagguuuuaccauguuggccaggcuggucuugaacuccugaccucaagugaucugccugccuuggccucccaaagugcugggaguacuggcaugagccaccacucguggcccucauuagcuuuuuuuuuuuugaagaccacaccucgguaucaauucagauauaauuuacggucaacaaaaacucuuaggagacuuucucagguuccuuguuaagccaguucuaccccuaccugccccaacccauugugugcgagguuuggguacuuucuuuuuuuuuuuuuuuuuuugacacauccuuguucacaacuuuaaaaauauucuuuauaaaaaagaaaaaaggucauccuguuauauucuaucccuguugcauacugcugagauguucugagauuccaauuuuguugccuuggugccuuucucagaucuucaacaauuugguaggcaagcucacuauaauuucuucuaaugcagacauaaguauuaacacuagaaacggaauguaggccaggugcuguggcucauuccuguaauuccaacacuuugggaggccaaggcaggaggagcuaucgaaguuuugggaggccaaggcaggaggagcccaguaguucacgaccagccugggcaacacagugaaaaucuuuauauaaaagaaauggaauguaaaccagaugaccaucugacaagagauauuuagaagaaacagcuauuugggucaagauuagacuucauagguucuaagguuucuuccaaacuccuauuaaaaaccuuaaaacuuuaauaauucuuucacgccauuagcuacaaccaaauggauccaccagccuucacaagcuaucccaacaaccgacugucacuagugacucaaguuccuucacuagguuucaagauuauuuuuaggggguuuagaugguacagaaagagacacauaaaguagaaucauguaaaaagaaguaaaucagguucaauggauucccguucuccaauugccuauaauuaaagcccucaguaugacuuucaaauauuuauauuguaauaacuuuuuuuaaaacaaagguaucuggucaaagaagagucacaggggaaauuagauaauacuuugagaugagugaaaaugaagauauaccaaaacuuaccagauacaauuaaagcagugcuuagaaauaaauuaauaccugaaaaugccucuacuaaaaaaggauaucucaaaucaagagccuaaucuuccaccuuaagguaauggaaaaagaagaguaaacuguuccuaaagcaagacagaagcaaggaaauacuaaauauuagaauggaaauuaaugaaguagagaauacaaaaacagcagugaaaagucaaugaaaccagaagcugauuguuugaaaagaucaaaauggacaaaccuuuagccagcuagacugaccacgaaaauacagaggacaaauuacuaaaaucaagacuaaaaagaagacacuaccuaccuuacagaaauaaaaagaauuauaaaggaauuuaugaacaacugugugcaacuaaauuggcaauuuuagaugaaaugguccaguucccagaaauacaaaauaccaaaacuuaggaaguaaaaagcugcacuggugagaugauuccaaaaaaacaaaaacagaaaaaaagaaagaaagaaaaaagcugaguauuuguaaaaccaaagauuuaaacaguuaauuuuuuuaaagcacugccaaagaaaaauccaugcccagauggcuucacugguuaauucuaccaaccauuuucagaaaaacuaauagcaaucuuuacaaauucuucccaacuuauucguugaagccaguuauuacccugcuaccaaaaccagacagacaucacuagaaaacuacagauuaguauuucuucugaauauaaaugcaaaauuucucaacaaaauacuagcaaacugaauccagcaauauuaaaaaaaggauuauauaccauaaccaagugggauuuguuccaggaaugcaagcuuguuuuaagauucagaaaucaacgcaauacauuaucaauaguaaaaaaaagaaucacucuuugcucacucuagagaaagcuaacaaagaaaaaguaaaacgagguaaaauuuccuuaaacuuuuaaaaacaggacagaaggcagggcaugguggcaccugcuugugaucccagaacuuugugaggcaggagaggagcacuugaggccaggaguuugagaccagccuggacaacagagcgagaucccugucuccaccaaaaaaaaaaaaaaaaaaaaaaaaauuuaaacuagccaggcaugaugucacacaccugccuguagucucagcuacucaggagacucaggugggaggauuacguaagcccaggagcuugaggcugcagucagcuaugauuacagcaccucacuccagccuggguaacaaagugagacccaaucucuuaaaaaaaaaaaaaaaaaaaaaaagaaaagaaacgaaacugcaauaccugacccucaacuagauccuguacuggaaggagacaaaugguguaaaggucauuauugggucaaaugagauaauugggacgguagauuacacaagucaauguaucaaaugcuaaauuuaccaaaauugaaaauuuugcugugauucuguaagagaauauuacuauucuugugaaauauuuagcaguauagggucauaauguauguuccacauaaaagaacaaaagacaagacuaguaagacauacuaugauacagaaagcaugggcuuggcuuuucuuuuacugacagugcacaagccuauuuucuacggguaaagcacauuuugaguugaauuaauaaauuccgcuaagaaaaugcaaacauuuaaaauacaauuuuaguuuuaacagaacuauauaguuauguuuuguuacuguaugccuauuguugguuacauccaacuuugcaugcuuuuuuagaaaagcaagaaauaacaaaagacuauuuuaguuggcauauuccacacacaucaaacuuuaugccaguuucacauuucuccucccauccucucaauugcugccgcuucuccuuucuccacgguuaucaaauagcuuaaugucugagguaauaguuuauaaaaggcuuacuguacagcauaacuauuacagauauacauacagggcccccugcuccucugaggaaaagugcugcacagugcuggguauacaauauaaacaacuucacuaauauguauuauuguauuugcuaucaucaucacaccaauuccauuaauaauccuguacuagugcugacuucugaaucuuaguuccucuucugaaaggagggauuaacguggccauacaagaaacugaaguucuacuauucccuccuugacuuuaugcacuagaaacaaugaauuaaagguauuugcaauuccaaguguaugcucuuucccaaucucccuggcuguacaagcacugcuguuucaacuugaaauguccucuagcucauacuucccuuccuaaaguagccaucagucuguaagacucucuggauuugugcaguugugcccugccuuccaacaucuguacuuggacauaauucuaccuuuacauuuaguugcuuugagacuauugguaaacuugccuuuccuaauaaugaauucuuugauguuaaucuccagaguugagcauaugccuaauagcuucacuuguaaacagcuuaacaaguaaaagcacugagugcuuacuauuugacuaccuauuguucaaagcgcuaugccauauuaacucauguaauguucccacaauuugaugaaacuguggaaagcccuuuuuuucuaguuuuuuauuuuucuuacuacacccccauuucagccauaaagcccauuuuaaagacgaagaaacauacauaggaagaugaauauucauuuuuaauguauuacacaaucaaaacaaaacacggacacacucagcuuccaaucuugaccaacacacaugcuaagcuccauucuaaccuacuaggaugucacauuaccacauaaacuaccuguaacugcagaucauuuuuacugaacuucccuaacacaugcugacuguauuagucugcccuucaucgguaucaagaaauuucuaguagaggggcucagaaucucucggagauucucuggucccagauuagccaaucuacaucuauuccguccauuauuucuuaaucuauuuguccaauccuuucuauuucaucugccacaaaugaccuggaaaagcuagcagcagauaacacugcuauuucaacaaacucauuuucaggacagagaccacacagcguagaaucagacuuaauucuggcuacuggguuuuagccgcguuaccuaaggagaaaguuaaucuuguggagucucaguuuuccucaucuguaaaaugaggcuccuacuaccagccuuggggggauuaagugaauugcaagccacuuaggagaaugccuggcagauaauaagccucaucaaauguuguuauuuaacgucauuacuguaaugcucugcugcucuaagucgaguggcuccccacugacagaauaaaacauaaacauuuuaguucaaaccccuucagagucugaauccauccuaccucccgaaacaccuuccacuguuuugauacccaauugucaacuucugccaaaaggaucuguaacggagcccccuagcuccagcggaggcuccucuguccuccuuucaaauuccaguuauuuaaucuagccuuuagagcacaacucaaaucucaccucccccggauuccccccacccacccgccccaagcccuggguaacguugcccucccccgaauuucacagcaccggagguucaccccauucauuuggcauucagucugccgugcaaaguuaguaauccuccugguguccccggagaaucguucaaccugaggguggggguguguccccuucuuuguguauuaacacgggcucguagagccuccaacacgcacuauagaguagcuaauuugccgcugccacaaaaaaaaguuacucgcugacagaaaaacuggcccgaaaaggaacacaguagugccguuuucaagugggcaggugacgggucugucugggccggagaggacgaagagggcggccccgagguuccccgggcugggggaugcgggagggugggucuccggcgagcagcgcgcggccaagggcgcugccacgggggcggcgcggggggagcagcggggccccagcgcgucgacgccggccgcggagacgcgucgagcccccgcccccgcccccgccccucaccuucuccuccucuuccuccuccuccuccuccccggcagagcuguaggccucacaguggugacgcggggucauccgggggcccguuaccaccucauucucauaggcgcgcggaggcggugcgcgcgggacgacucggccaacugaggagggagaaag

SEQ ID NO: 17606 - RNA, 2051 nt, Homo sapiens
gaggcaagaaaaccugaaccagaggaaacucaaaucuguuacaauuauguaagaguuuuuaauggcacauuugcuugaaguuuuguugcuguaguuguugcuguuuuuaagagugacccaauuguguuggaugugcugggcugggguuauaaggaugcuguccaugucacaacugaguuuauuuccuugcuauuauucauucagauaccccuggucugaaaaagggagucugacaaauuuaucagcaccuuccucacuugcaguugguuacaaagcucagagaagcugcagucauucucuuugcccuaaagggacugggaggacaggcagggaagaaugucagugagacagcugagaaggcaccugcacucccucuccaacccagagagaugcaacccaugcacucucaacucugucuuucaggggcccuuucuagagacaggcaccaaaugugaagcacuagcaaaaauucuaccacuacuaaagguaaucagcuugacuuugcuuaauuaaagguugacagcaucuuucaaagcacugacuuuuguuuguuuggguuuuguuuguuuugaggcaggggagggagacacaacucaugacaaauaauauucucaugcacaaccaccaucggcaugcccugauuuugacaaauaaaacucuggggagagguaaagcacaauacaacuuccuaguucucacaacuguucugucagaaggaucacccucuuccuuagacugaucacuggcucaggcaguaucagcagcugacaggugaggcagaguuuagacacugguguuucccugccuuuccugaagggaagaaacgacaugaugcuauuccaggcauuacuuuuagugcucucuaacuuguauuuuuaaaguaaaucauuuauaaacuucaguguuuuaugguuaguaaaaguuaccugugugguuaauucaacucauuagggcccugauguggaaaacuggcacagccccagcaagucugcuaacuggaccacucccaggggaagggugugcuggguaaguacucacuucugaaguuuagccacuugcuuaugcaacauacauuuuccaaaacauacauuuucauggugaaaaaaaaauucugucaaguuuguuauuguuguuuuuaaauccacccaggcauuuuauuauuuuuauuuuuuguuuuuauuuuuugagauggagucucacucuguugcccaggcuggaguacaauggcaugaucucagcucacugcaacuuccaucuccuaugucaagcgagucuccugccucagccuuccaaguagcugggacuacaggccugcaccaccacacccggcuaauuuuuguauuuuuaguagagacagggcuucaucauguuggccaagcuagucucgaacuccugaccucaggugaucugcccaccucagccucccaaagugcugggauuacagguguaagccaccacaccuggccaacccaggcauuuuaaauaggcauccuguugcuagaaaaucuguauuggcuagugcaagauaucuggaagcagcuuucaacgugcuuuacagaaagaaaaaacaaauuagaagacuucaauacuuagaguacuuuacaugcaaagaagaucuauuagauaauuuuaagaggaaaagacaugguaagaaaggaaauaugaauuagaauccuacugcaaucauagcaaaaggaaauccacucucaggcugaagauggaggcguucuacauuauaaacucuguuagcacuaguuacaucucuggcuuuaaucugccuaauuaacaccccaguuucucuucaccauuucucccaggaguacaaucuuuaaaaucugucagauuaauagacugcugugacaacacuuuuuaggagguggacaccauaauuauuuacauuuuuaaaaaaagaaucuuuuugcucuagaauaaauaauguguuaaguaaaaggggaaagagcacaucuauuuucaacauuacaggcaacuaacugcacuaugcucuaaccaggagcuuguuuuuuccuuaaaaaucaaaauaaaggguuuaa

SEQ ID NO: 17607 - RNA, 3602 nt, Homo sapiens
agcagcauucaaacugggcuccaggaugaaaugaaaaagucugggaugaugcauaacucgagaugucagaaaauaaggaacgaaaaggcaaaugaugggggaaagcacccuaggaagggacugaugagugcuuuaaauuugugccagaagaaccuaguaacacgcaacccugcuuguaaaaugccuugagagcacagaguuuguaugccaaaagucucucaugugagaauaaagcuuauuugugcacuagaacugacuauuuguguuggacugaaauggacuggaagaaagaaaggaaaauagauuaaaaaagaaaaagcagcagugggaggccaggaccagaagggaacucuucaagaggaaggccucucuuuuauagcacacagguaucagaucugggguggcccuaccucucuucauugucagucccuucuucccugaccguggaggaggucccuggccgagugaagcccucucugugcucuaaugccagcaugacugaaagagggcuaugggaaaggucaccagggaggcugggcaauucuucaugucaaaggaucugaaccugcgguggccugaggcacacugaucaaucuguuuccgagaggcagcugucagucuuccugggguuacuuucucaggggugggaccccagacacuguccccugggcucuggggaagcaccacaccauucagcaguuuuucggguguucuaucacaucccauuaggagguacugauguuucugaggcagauuuucaaagugauggcaucugggaaacuaaggcuuaaguuaaggggagagauuuuauaaacuuacgaauuaccagggaagggucagagaacuuaacauaagguuguugauguuuagaaggaacugguugguuauucugaacuuaagauuuucagagagaaaugcagaauccuuaggggauggugaauccggcccuagaauuuuaauacuuaauacuuccuuagggguuacucaagacaauuacuccuuaaagggacaguuauuuccaagagagcugauaucacguacuuccugcuuccuaggagcaaggaugaacaagcagcacugugcuggucuggggagcugucuagaguugcuuuugacuguugcacaaugccuagucuguggacuucuuggcuguuaagaacauuuuugguacacauccaugacccuccaucuacaauuccaaauuccaaagagcucugaaagccaacucuucagguggcaauauauaaacuucuuggguauagaacuugacuugauuugaggcuauucauagucuuuauuuauccuuagugugaauauucauguuucacugaauuaauaugucugaggugcucuccuuggguaguaugugauacauggcuaauacaucuugcuuucuaaacuccaaaagguucugaauuccacaacacaccuggccccagggguuuuggguaaggagcugugggcuuauggcugccucuggcuuaagaacugcugggccagaucucucugacuaaauccaaccccagauagucacacggauccauuaaaguggagugugugagauaucuggggcuagggaagagcaaggagacaggaguagccaucaggaccaugguggcugaagagauggaaguggcuacucuuugaugugacagacugccuuugguacucuugaggcuugggcucaaugcugcuuuuacugauuucuccagcucuggguaauggcuccugaagauaaacaggccagcaccaugagguuuagcuggagacgcuggacugacucuuggggaaucaaguggccuggcuagaacccgaugccacugauggcuguaacugccuacuaaguuauaaauugaauuugacugcaauugggacgaagacuccuugaauuucaaagcacagcucugaauucaaggagucuuugucccaacugcaguuucuaucccuaggaaaguuugaaaacucauguacauuucucuaccauggcagcauccacagcaccauuagaagcugugugucuuuccaacuagauucuaacuucuuugagcauggggaccacgucuuauuuguucccauguccuuggcucuuagcacaguguuuggcacacaguaugcauccaauaaacacugugaauggaugaaaggccugccuaacuaagagcuacauuugucuuuguccugacuccuacaucacaaacagauaugacagaaugcagcuggauaguuacauggagcuaggucauauaugcaugagagugcugaguauggauaggagagaauguagguauauuuauagaccccaauucgacauuuauuuuuaaaauuagcuucuuuaaaaucaccaaauuuguacuaaguuuaacuuacacugccugccugaaguagagaaagaagguagauuguugaugggaagaagggguggaaaacucaauaaaaugucuuauuauguaaugaugucacaaggaguaaaagaauuuuagagaugcaaagaacuucagaaaucaccaaaagccuauagcauuuaugugguugguccaaagacauauauacaucgucacgaucaagacugggacucacacuaugucuccuaauuccuagcuugucacuaauucuacacuaaaagucagacuaaagauuuagggcugucagcauuccauaggaccauccuccuucucguggcacuuccuucaaauggaaauuuuaaaaauguaacacagcaaaaccucauaaguacgcccaucuaugauaaucuguccaaccugagagauuaauaaaugaaaaacuuguuuauuaaucaacuagcaaaaacaagcaugguuauuuaagaaaaucuguuagcauuuacaaauacucauuuacauaucagacugacugcuuaccaaauuaauuaaugugaaguuucacuguguauagaacaaaccgacagacacauaagaacacuuuagauuauugcaagauguuuccagaagcccacauacuagaaauguggaaaccaaguuuuucagggaaagagaaaauacuuaccaccgcuagcacuuccuucucuuuugccacgggagcccccacugccaucucugccugacuuuaugcgcuagagcaaagagaagacaaguuuaaaagaauaagugcuauuccuucaaaguugaauauagauaaagguggauuuuaaaauuaacauuacuacauuacccuuaggacuaacccaucauaccugagaguugauucuauagaaaaaaaaaaaaagccugaguuguuuuguaaguggaggguucaagccuuccccucuaaggcucuugagaaaacucguauagcacuuuaauucaaaagugcagcguaaccuuggcuuacacaaacaacucaaaacuaaacaguauuuucuugaugugaacauucagggcuuaaacaugaucuuuaguuuaagggagggaugggugaggaggggauaagaaucuacaaaagggccauuucuugccauuaguccucauauacaaugguuggaccugaacuauuugaggguaaaaaaaaaaaaaaaaaaaaaaagguaagcugaguuuugaaauucaauuuauaaaauaaaaguaugauuaaaaccucacaaaaga

SEQ ID NO: 17608 - RNA, 6241 nt, Homo sapiens
gacuugaauuaagccaguguucuugacacccacugggccaagagcauuaaaacaaaacaagaccggagaaguuaauaaacacagcuaaagacaaaauuggacaaaauaaaacaaaagaaaacacaaagugaauaagcauccaaucaggcaaacauggacacaaccacccugaaaaggucuagccguugcaacucaguggcauccccaucaccuaaaaaaugguaguggcuucuccccaccccagugagcuaauauucaacauucugcugaucuuauaaguauuauuugguccaaucugaagaaggucuuuuuaaacuaaaacuagucuaaugaaauuacaccucaggaauauggaggugaaauuuucuauuuuuaguauuguaauaggaucugggcaaauuuugcaaauauguugccaucuggauaaaaguuauuaaauauagaugccuuuuuacuuaccaaggcauuccuuucccacuccucuuuaguuuuaauaacuugauuauaguuuugucauggcgcguggaccuguccagucaauuguguguuucagugcccuuugguaaagagacuguacuuagcacacacacagauacacauaauucacaacagcugagaaagcuugagggaucugggaaacacaaaacaccaagaacaaugcaaaacaaauagauuacugcugcauaucacuucaaguuuuuuaaggggaaaaaaaaaacaccuaaaaauaaaugcaucaaaguauuuuuuaaaauacagaaacguguacuucuggaugacugauauuaauuuccuuccuagcagucuuuucaagauguuuuugcuuccccuuaauugugacucaaagcuaaucaaauugagagaaauguaaguuauggcccaaggcccugcauucacaucuaccuaacaucacaugcacagguuggauguaauucagaugcuccaguuuuguuaacuguuaauaacacagaauuauacaaaguuuugcacagcaucacauguaaugacacauaugcuauaugcaaucagguagaaaaaccguauuugcagaaugguuuaauagauaggugucaggaacaugguggaagcagaguuucaugagugcaccugugccagaguccucuaccugucacugugcugugaaaguacugcaaugaguggaguuucauaugccugcuguguauaaauuagcuuucauuuccacauuguaagcuggcacacugaauuaggggagccuggcagcuguauaaaaauccugauuaagagaucaaacuagaggaucuaaagugaauuuuuaaucucugaaauuaaauucacuggcucccaugucuggauaagaauuauugccccuaaugccccaacgugcaauagucugugugaaucagugauucacauccuuuaaaauaauuauugcuuaagcaagccauuuagaguagauaugggcuauguggcuggauagaaacacacucaaaaaguuagacuagacggaaacaagccuuucauuucacugauaaaccuacauaaauacacgaucgaaaggggcaacagguucauagcagcuaacacccuaaaccaacucugaagcaucaagacgugguuucuuacuaaaacaaaucagcuguuuuuguauuuuccucuuaaaauuaaggcaaugaaauggcuacaguuccuaagguuauuuuuacggaacaaaaauauacauguauuuuccuccucaaguucaggcaucagaguaugauuagugacuuguauuacacaaaaccugcagcacuggguugaugugagagagagagagaaaagaaagagagagacagaaagcaagaaaagcaagaaagcaagcaagcaagaaagcaagcuaagaaaaagccaacaaaccccuggugauguuuccccuuccugcugaauuauaaaacccaaucaucaaagggaggaaaagcuagaaagcacaaaaccucuuaagaguuuucaaugucucuuucauugauucaaaacuuuuggggugacgaaagggagaagcuuauuaacaugaagacuccugggcccaacaaccagacauucugacucugaaggucuacaguugggccuaagaaucugccuuuucaccagcuccucaagugaugcaggcgaucuauggagauuuugagaaacacugccuagcauauauccauuucauauuuaaugacaaaaauucuaaacuuuggcuagccaccuauguuaaaaggaaaaaaggcacugcauauguauuucguggugcccauaucuguuugcacauauauggaauuucauuuugaaaauuuuaaaucaccauucagaaucuaaaagacauauauaugacagauuguggcuaacacuuaacagcagaagcugaugccaaguugaccucuccuguuucacuguauuacauacauaucaaaguuucaggcucuccaaaauccaaaauggccaaaugaacugaggaauaggacaagacucaagucaacuuucagcaauucagugcacuuugcagaaaggaucuaaauuaagcauaaaguucuguuguuuauuuuacacaaaggagaccaccaacauuugccauaaauucuucuaaacucuuuaagaaggccaucuucugcuuccgauccagcguaggaggagugcugcuugcagugagcuuguugaaggcaucugcuaaucucugguaaauaacugggucuugcugacuugauaguaauguuucgaccaguucagaauauucagccuauugaagagauaaaguauacacaaguauccuccuuagaauaucauacaaguagaucuuaucaguuacuggacugugggguucuaaaaggcagggacacauuuuuaagaguuaacauuuagaauaauucagcauuuaaguacuacuguuugaaaaccuuuuacauggauuaauucaucuaucauuuacaacaaugcuucgagacagguacuguuucuauucccauuccagaggugaagguuucgacacucagugaggugaagugauauggcccagaucaagcaagaguccaccaaucuagccccaagacccaugugauaaucaacuuuguugugcugccucuucaaagcacauuauuccuauuuauguugcguuugacacauaaucuaagucugcaauaguuccccagagguuaauagagauaucugguccacccaguucugaggacagcaaugugcacaaagacaggacaggcaggagucuuuugggaggacggggcggagaaauauauuccagugccuucuccaaguggagcagggcacucugaaagcuccaaaccagcacugugcccagcagcucuuagagaaagggcaggaagaggacuuuaguaaauauaggaauaugggaaauuuucuguuuuuaauacucuauuauaaagccuuauaaaggaaaguggaagaaggugugggcuuaagggaaauucaaccaggacagagguaagcucucaaaaaaagcuggccuggccaagcauaguggcucaggccuuuaaugccagcacuuugggaggcugaggagggaugacuguuugagcccgggaauuugagaccagccugagcaacacagugagaucccaccucuacaaaaaauuuaaaaauuaggcaguugugguggugcacagcuguagucccagcuacuugggaggcugagaugggagaucgcuugagcccaagagguugaggcugcagugagccaugguugcuccacugcacuccagccugggcaacagagugagauccugucucacugcaaccucuguuuccuggguucaagugauccuccuaccucagccuccuaagagccugggacuacaggcaugcaccaccaucccuggcuaauuuuugaauuuuuaguagggacaggguucugcaauguugagcaggcuggucucaagcucccagccucaaucaauccacccaccuuggucucccaaagugcaaaaauuacaagcaugagccacugcaccuggcaugcuguaauuuuucauuggcuucuugggauaucaugauagaccaaaauggugaaaccaaauguuaauuacauuuggaaaagaaggauaaggugcagcaucccaauccccaaccauggagccagaguggcuccccuaauugccuuaucaaagggacaguccuguucacaggggaccaaguauaaucuccuaucauuucccuacucaugagaaaugguagagguggcaaggcaugguggcucacaccuguaauccuaggcacuuugggaggccgaggcgaguggauugcuuaaguucaggaguucgauacaagccugggcaacauggugaaacuccgucucuacaaaaaauaagccaggugugguggugcacaccuguagucccagcuacuuggggagcugaggcgggaggauugcuugaggccaggaggccgaggcaggaguuagcaguaauugcaccacugcacuccagccuggguaauaauaaagugagacccugucucagaaaaaaaaaaaaagcgagauaguagagccucuggggccaggcagcaaguaucauacuggccauuccugaaaccugcucuuuccugcaguguguaaauauguuaaaagagagggagagagagaaauaaaggaagagaaggaaggaaggaagaaaggaagggaggaagagacaagaggguggaagggaacgggggaggaaaggagggagggagggagggagaaagaaagaaagaggagggaggaaggaaggaagaaaggaaagaaaagaaaaaugaaagaaaaagauagaaaaaagaaaagaaaaagagaggaaggaaggaaggaaggaaggaaggaaggaaggaaggaucagacaagacgacuaccuugcuaguaagcaacaaguaagacaaaugacagagaaagggcacagauuugagagcagguaccaccugcaggaaguggcagccuagggcagagagcaagaaaugaagccccagggcaccuucagcuuagggcacagauguuacgggaagucuagagaaaggaggucuuuaaauaguauggaagaccuccucuaaacccuuuuuuaaagauggaaauaaaacgccaaagcuucuuggccaugcugggagguauauauauauauacguguguguguauauauauauauauauauauguaccuuacauauauauguguguauauauaugcaugggagaggaaaaggggaaacagaggcagcaaacuguucaauacgguccuuuucauaaauuucacaggcaccuauucgaucagaaguggggagacagguaagcuagccuaacucuucuauuaaccccauuaucagugaugcuucagaaucuuuaaaagaucaacaaaaugaaauaauauacuguuuucuauaauaugcaauaaaauacugucuuccauacugucugaaggcagacucuuccuugucugccauccugucucccuuacaaaaaaccaugaguucuucacacacccauuauguauuccucauuccuagcacaguuguuuaaggacaggcuuuggggcagugaccauugcaaaggaugguucauaaugguggaggacaaaaaauaaaugcuuugaacugacaaacagcugucagauaaacacaaacugacaugugaaagcuaauaaagaagcuaagaaauacuuccucacugaaacagaacugaagcacugagucacagauccuauaaggggggauuaaugacccaccaucuaucucaacaaucucuuugcaaaauagaaugagaagaguccccugaaaagaggcauguccaguaccuggugcaaacacaccaacguguagaaagcuucgccagccgcaguggucaucucuguguugugcuuuugcaaaaccagcauaucaaaaaccagcugaaauuacauaagacuucuaaauaaaaacauaggaugaucauauauccuccagucccuccccaguccaaaaaagaagaagagaggguugguuguuauucuauuuauuaaaucaaucugaaauuuuccuuaauguuuuaaaaaaaauaccuuacagauauugcuacuugcugugguaucugaauaaucaacaauaucaaauucccucaauguguaccacaucaauuuccaagaacacaaaaaauagaggaugagaauguguccaugaagagcugaucuccagaaaaaaacagugaacaggaagucaugguuuccuugcccccgaaagaauggaagcauuuccucauuugaaugcagaauuaugug

SEQ ID NO: 17609 - RNA, 6241 nt, Homo sapiens
cacauaauucugcauucaaaugaggaaaugcuuccauucuuucgggggcaaggaaaccaugacuuccuguucacuguuuuuuucuggagaucagcucuucauggacacauucucauccucuauuuuuuguguucuuggaaauugaugugguacacauugagggaauuugauauuguugauuauucagauaccacagcaaguagcaauaucuguaagguauuuuuuuuaaaacauuaaggaaaauuucagauugauuuaauaaauagaauaacaaccaacccucucuucuucuuuuuuggacuggggagggacuggaggauauaugaucauccuauguuuuuauuuagaagucuuauguaauuucagcugguuuuugauaugcugguuuugcaaaagcacaacacagagaugaccacugcggcuggcgaagcuuucuacacguugguguguuugcaccagguacuggacaugccucuuuucaggggacucuucucauucuauuuugcaaagagauuguugagauagauggugggucauuaauccccccuuauaggaucugugacucagugcuucaguucuguuucagugaggaaguauuucuuagcuucuuuauuagcuuucacaugucaguuuguguuuaucugacagcuguuugucaguucaaagcauuuauuuuuuguccuccaccauuaugaaccauccuuugcaauggucacugccccaaagccuguccuuaaacaacugugcuaggaaugaggaauacauaaugggugugugaagaacucaugguuuuuuguaagggagacaggauggcagacaaggaagagucugccuucagacaguauggaagacaguauuuuauugcauauuauagaaaacaguauauuauuucauuuuguugaucuuuuaaagauucugaagcaucacugauaaugggguuaauagaagaguuaggcuagcuuaccugucuccccacuucugaucgaauaggugccugugaaauuuaugaaaaggaccguauugaacaguuugcugccucuguuuccccuuuuccucucccaugcauauauauacacacauauauauguaagguacauauauauauauauauauauacacacacacguauauauauauauaccucccagcauggccaagaagcuuuggcguuuuauuuccaucuuuaaaaaaggguuuagaggaggucuuccauacuauuuaaagaccuccuuucucuagacuucccguaacaucugugcccuaagcugaaggugcccuggggcuucauuucuugcucucugcccuaggcugccacuuccugcaggugguaccugcucucaaaucugugcccuuucucugucauuugucuuacuuguugcuuacuagcaagguagucgucuugucugauccuuccuuccuuccuuccuuccuuccuuccuuccuuccucucuuuuucuuuucuuuuuucuaucuuuuucuuucauuuuucuuuucuuuccuuucuuccuuccuuccucccuccucuuucuuucuuucucccucccucccucccuccuuuccucccccguucccuuccacccucuugucucuuccucccuuccuuucuuccuuccuuccuucucuuccuuuauuucucucucucccucucuuuuaacauauuuacacacugcaggaaagagcagguuucaggaauggccaguaugauacuugcugccuggccccagaggcucuacuaucucgcuuuuuuuuuuuuucugagacagggucucacuuuauuauuacccaggcuggagugcaguggugcaauuacugcuaacuccugccucggccuccuggccucaagcaauccucccgccucagcuccccaaguagcugggacuacaggugugcaccaccacaccuggcuuauuuuuuguagagacggaguuucaccauguugcccaggcuuguaucgaacuccugaacuuaagcaauccacucgccucggccucccaaagugccuaggauuacaggugugagccaccaugccuugccaccucuaccauuucucaugaguagggaaaugauaggagauuauacuugguccccugugaacaggacugucccuuugauaaggcaauuaggggagccacucuggcuccaugguuggggauugggaugcugcaccuuauccuucuuuuccaaauguaauuaacauuugguuucaccauuuuggucuaucaugauaucccaagaagccaaugaaaaauuacagcaugccaggugcaguggcucaugcuuguaauuuuugcacuuugggagaccaagguggguggauugauugaggcugggagcuugagaccagccugcucaacauugcagaacccugucccuacuaaaaauucaaaaauuagccagggaugguggugcaugccuguagucccaggcucuuaggaggcugagguaggaggaucacuugaacccaggaaacagagguugcagugagacaggaucucacucuguugcccaggcuggagugcaguggagcaaccauggcucacugcagccucaaccucuugggcucaagcgaucucccaucucagccucccaaguagcugggacuacagcugugcaccaccacaacugccuaauuuuuaaauuuuuuguagaggugggaucucacuguguugcucaggcuggucucaaauucccgggcucaaacagucaucccuccucagccucccaaagugcuggcauuaaaggccugagccacuaugcuuggccaggccagcuuuuuuugagagcuuaccucuguccugguugaauuucccuuaagcccacaccuucuuccacuuuccuuuauaaggcuuuauaauagaguauuaaaaacagaaaauuucccauauuccuauauuuacuaaaguccucuuccugcccuuucucuaagagcugcugggcacagugcugguuuggagcuuucagagugcccugcuccacuuggagaaggcacuggaauauauuucuccgccccguccucccaaaagacuccugccuguccugucuuugugcacauugcuguccucagaacuggguggaccagauaucucuauuaaccucuggggaacuauugcagacuuagauuaugugucaaacgcaacauaaauaggaauaaugugcuuugaagaggcagcacaacaaaguugauuaucacaugggucuuggggcuagauugguggacucuugcuugaucugggccauaucacuucaccucacugagugucgaaaccuucaccucuggaaugggaauagaaacaguaccugucucgaagcauuguuguaaaugauagaugaauuaauccauguaaaagguuuucaaacaguaguacuuaaaugcugaauuauucuaaauguuaacucuuaaaaaugugucccugccuuuuagaaccccacaguccaguaacugauaagaucuacuuguaugauauucuaaggaggauacuuguguauacuuuaucucuucaauaggcugaauauucugaacuggucgaaacauuacuaucaagucagcaagacccaguuauuuaccagagauuagcagaugccuucaacaagcucacugcaagcagcacuccuccuacgcuggaucggaagcagaagauggccuucuuaaagaguuuagaagaauuuauggcaaauguugguggucuccuuuguguaaaauaaacaacagaacuuuaugcuuaauuuagauccuuucugcaaagugcacugaauugcugaaaguugacuugagucuuguccuauuccucaguucauuuggccauuuuggauuuuggagagccugaaacuuugauauguauguaauacagugaaacaggagaggucaacuuggcaucagcuucugcuguuaaguguuagccacaaucugucauauauaugucuuuuagauucugaauggugauuuaaaauuuucaaaaugaaauuccauauaugugcaaacagauaugggcaccacgaaauacauaugcagugccuuuuuuccuuuuaacauagguggcuagccaaaguuuagaauuuuugucauuaaauaugaaauggauauaugcuaggcaguguuucucaaaaucuccauagaucgccugcaucacuugaggagcuggugaaaaggcagauucuuaggcccaacuguagaccuucagagucagaaugucugguuguugggcccaggagucuucauguuaauaagcuucucccuuucgucaccccaaaaguuuugaaucaaugaaagagacauugaaaacucuuaagagguuuugugcuuucuagcuuuuccucccuuugaugauuggguuuuauaauucagcaggaaggggaaacaucaccagggguuuguuggcuuuuucuuagcuugcuuucuugcuugcuugcuuucuugcuuuucuugcuuucugucucucucuuucuuuucucucucucucucacaucaacccagugcugcagguuuuguguaauacaagucacuaaucauacucugaugccugaacuugaggaggaaaauacauguauauuuuuguuccguaaaaauaaccuuaggaacuguagccauuucauugccuuaauuuuaagaggaaaauacaaaaacagcugauuuguuuuaguaagaaaccacgucuugaugcuucagaguugguuuaggguguuagcugcuaugaaccuguugccccuuucgaucguguauuuauguagguuuaucagugaaaugaaaggcuuguuuccgucuagucuaacuuuuugaguguguuucuauccagccacauagcccauaucuacucuaaauggcuugcuuaagcaauaauuauuuuaaaggaugugaaucacugauucacacagacuauugcacguuggggcauuaggggcaauaauucuuauccagacaugggagccagugaauuuaauuucagagauuaaaaauucacuuuagauccucuaguuugaucucuuaaucaggauuuuuauacagcugccaggcuccccuaauucagugugccagcuuacaauguggaaaugaaagcuaauuuauacacagcaggcauaugaaacuccacucauugcaguacuuucacagcacagugacagguagaggacucuggcacaggugcacucaugaaacucugcuuccaccauguuccugacaccuaucuauuaaaccauucugcaaauacgguuuuucuaccugauugcauauagcauaugugucauuacaugugaugcugugcaaaacuuuguauaauucuguguuauuaacaguuaacaaaacuggagcaucugaauuacauccaaccugugcaugugauguuagguagaugugaaugcagggccuugggccauaacuuacauuucucucaauuugauuagcuuugagucacaauuaaggggaagcaaaaacaucuugaaaagacugcuaggaaggaaauuaauaucagucauccagaaguacacguuucuguauuuuaaaaaauacuuugaugcauuuauuuuuagguguuuuuuuuuuccccuuaaaaaacuugaagugauaugcagcaguaaucuauuuguuuugcauuguucuugguguuuuguguuucccagaucccucaagcuuucucagcuguugugaauuauguguaucugugugugugcuaaguacagucucuuuaccaaagggcacugaaacacacaauugacuggacagguccacgcgccaugacaaaacuauaaucaaguuauuaaaacuaaagaggagugggaaaggaaugccuugguaaguaaaaaggcaucuauauuuaauaacuuuuauccagauggcaacauauuugcaaaauuugcccagauccuauuacaauacuaaaaauagaaaauuucaccuccauauuccugagguguaauuucauuagacuaguuuuaguuuaaaaagaccuucuucagauuggaccaaauaauacuuauaagaucagcagaauguugaauauuagcucacugggguggggagaagccacuaccauuuuuuaggugauggggaugccacugaguugcaacggcuagaccuuuucagggugguuguguccauguuugccugauuggaugcuuauucacuuuguguuuucuuuuguuuuauuuuguccaauuuugucuuuagcuguguuuauuaacuucuccggucuuguuuuguuuuaaugcucuuggcccagugggugucaagaacacuggcuuaauucaaguc

SEQ ID NO: 17610 - RNA, 1024 nt, Homo sapiens
aaccaggaagcucuuggggccucccugggccagaccugcacccgggaagccgccgcaaggcuucaggagccccaggucgccccaaggccgcgccgcaggauugaacaaagcggcgggugcagcaaccucggcgcuuccgagcgcguucggggccggacgcccggcguccggcgcuggcuccagaaaggcggcggguguggggcgcagaggccuaucucgcgcccuagccgcggcccgcgccccgccgcaguccccggggacgguacucacacacgcagagcuccaccacguacgcguaguaggaccagacgaccacgaaggugaugaagagcaccggcacccagcccacgacgcgcuggcagcagcgccacagcguccagggcgccauguuccgcuggcggcugccgagccccgcgucccaccguucuggggagcgcgggagccccggcgacggugacucggacgcuccaggcggcugcugguccagcucccccgccuccgaggcaggacuugugggagcaaaaguccgaggcgccgccgggacuccucccgucccggcgcccagccaggccccgcccccaccccacaucccgucgccccccuccccccgcguccguccccgccagcccgcccgccgcgggccgcgggccgcccccggucuccgcgucguuggggcgggguuuccgcggccggggaggcggugagggggcggggccgcagcucgggaccgcccauggggcguggcggggcuggaugcggacaggcugggcggacgcgggaggccggggaaggagaggcgaaaaacacgcccuugauggaugagagggacaggggauagcuuuuguggaucgagacucaauaggggagggagacuauggaaaugauuccuuagcugauuuguggaucuuggcccucucuguguacagaacucgcuccacugggguuccugggacauugaguaguuggggcacuguuucaaacaugacaaggccauuccccacucagugugcgaagaaugcacauu

SEQ ID NO: 17611 - RNA, 1616 nt, Homo sapiens
ucauugucuccuuuuaaagagguggauaugucucucaauucugggacagagggaccuacagggcuccugccaccugccccacaauauggaacaccaugcaagaaacuucuuugacucaugugugucugcccagcagaaaaaacugccccaaaugagguauuuacuaaaggaaacuuucugugcuuuggaaacagaguugaaacccaucauaccuugguuacugauuacauggagccauauaaaccagggcccuguuguguccuuggaaacauaaccaaaccuacuaguaaacaccuguuuuaagaagcaccugucaggaugaggcuaggaacggcugcaaaguacuggucugaggcagucagcaugaggcugguccucacucugcaucuacaaguuuugggccuuugagcaagucacuuaaccucucucauuuucaguuucaguagcugacuaauuccuguggaaacacccugacucuacaaguucacaacccuguaucagugcuaucacuauucgaugcucauguacaguagacacugcaugugcguguucaugacggagugaauaauugggucaacaaacauuuaccaugugccaacugcacauaaauugcccugccuggucuucaagaaauagaaaaauuauaaagccaaagacucugacuccaaaaaauuucaucuaacaaagagaccagcaggaauuacaauucugggcaaaauaauguaagugcuacaaagggauacaaacgagaaauguuagcaccucccccaucucugcgccauccuccagugucacuuuugcagacuccaugcuguauguuccaacauccuuacaauguuaguaccuguaccagcuacguuuuuuaaagaaaaggucaauuccuuuuguuaaaugcaagcuucuugaaggagauuaauuuuuucauggcauucuuuuuuaaggaggcauuuauuauggucaauuauucuugauguuuuaaaguaucuugaaagccaagcaugggggcucacgccuguaaucccaacacuuuggaagggugaggcuggcagaucacuugaugucaggaauucaagaucagcccggucaacauggugaaaccccaucucuacuaaaaacacaaaaauuagccaggcuugguggcacgcacuguaauccccgcuacucgggaggcugaggcaggaggaugcagugagcugagaucaugccacuauacuccagccugggugacagaguaagacuccaucaaaaaacuucuuuaaguauuuuuauaauacucaaacaguuuagauuaagacucuaaaaguaauuaucagagccaugccucuaaacuuucugauaagaacaaaagugaccaauguuaaugaauacucuaauccccuggccaaguguguaaucuaacauccucucgaaauuucaaccuggcagcguauuuuaauugugacauuugaagggucacgugaccuaaccugccugcccuuccuuuucugaggcuccuauuuaucccucaagacccauuuuaaaugcuaccgcucaaccuccccaagcaguuauuuaaacacuccucugggaugccaaaacaucuguccauuccucuacuaugggaaauuucacacugc

SEQ ID NO: 17612 - RNA, 3390 nt, Homo sapiens
cucucucuggccucaccuuacuuccuguaccaggagagaugcucaucaauagugagaaagaguugaugggauuagagucuggaagugacaaccucuccugaaccugaacucauugauuucuucguuuuacaaaacaguguucuugaaaaaaauaaacaaaaaaaggaaauaauacaacuaagaacuccaaggucuaaauuuuaaccagcuguaucucauaacaacagaagcugcaauggccaacauacgucauuuauaaaacgccaacuuauguggauggggauugggauuuauuggccuaaugcaaagagcauauaaaaaaugaguagggaaaagacuacuguuuguguauauauguaauuauuacauauauucuuaaaugauauuuaauaaauaaucaaaugauuaaauaauauauacuauauauacauguuauauuuauauauguauaugcuucuccaaauuucuuuuugcuaaaaagcacucagcugggauuaugaaaucagaugucaagauuagaauauuagcagucacuuuuuaaaucagaacacagaacagaucccuagacugagcuguucccagaaaaaagguuuucccucuccccagaccaggcagguaggaaugucugcagagaucccuggacacacagggaccccugccaagcuuuuccugcucuguacauuggggaaggggacuacaagucagcccuggugguaugggggaggggagugguaccgcagugacaggaauaaugccacuguccugcugagugggaaaggagagggcagaacccggacucgaaggcccaccuguggagugggucugagauucccagccugugugucucggucagcuugucuauuguuaucagaugugggcugugccgcagcaucugugacuucaucccgugguggcuggagucugggauaaaagucaugguugucccaaaggugcaggcaaacuccaccccggggagcuguugugcuugcauugcugggcugcugauagacugauugagugguggcguguacuuuugucacaagaaccauaaccacaaugacagccacacagcauggaccuagcgugugcucagcucuggacaagacauggauguaggcagacaugcuuccugccugcugggcuuagugcaccaaugcuaaggacagacaugaagggcuugggaaaggcaugaagaugcagggagucuaggagagaggauaagaaaaacaagcauuuugugguggguugaauugcguugucguuuuuagaggcauuucgugauccaugguugcgcucccgugaagagcgagucuagagaaggaauccgaaggugggugagaguugagggaauuugaauuccauaauuacgacucgaauuucugcaaucagcucgcggcuguguugccugcuccugccacaaaaacgccaugcagcgccgagccaagucggauggaaguggguuaggguauuauauaagcccuugcgggagggaagauggucuuuuauguguguuucuuuugcagcggcggcggcgagcgcggcucagguugauuuagaauacgggugacaguggccuggcgcgagcccacugcugacgaaagcggcuuaucccgcgcgguuuccauggagacgagccggagccgcggcggcggcggggcugucagcgagcgcggcggagcuggcgcguccgugggggucugcaggaggaaggcggaggccggggccgggaccgggacccucgcggcagacauggacuugcauugugacugugccgccgaaacgccggccgccgagccgccgucggggaagauuaauaaagcugccuucaaauuauucaagaagaggaaaucggguggcaccaugcccagcauuuuuggggucaaaaacaaaggggacgggaaaagcucggguccgacggggcuggugaggagcaggacccacgacggacuugccgaggugcuggugcuggagagcggcaggaaggaggagccgcgcggcgggggcgacagcggcgggggcggcggggggcggccgaacccggggccccccagagccgcagggcccggcgggggcucccucgccagcagcucgguggccaagucgcacagcuucuucucgcugcugaagaagaacgggcgcucggaaaacggcaagggagagccuguggacgcgagcaaggccggcggcaaacaaaagcgggggcugcgggggcuguucagcggcaugcgcuggcacaggaaagacaagcgggccaaggcggaggccgcggaggggcgcgcgcccgggggcggcuugauccuacccggcucgcucaccgccagccuggagugcgucaaggaggagacgcccagagccgcgcgcgagccggaggagcccagccaggacgccccgcgagacccagcaggugagcccgcagggggagaggaggugcccgcccccgccgaccgcgccccagcgcggagcugccgagaggcagagggccucgcgcaccccggcgacaccggcgcccggggagaggacgccgcggggcaucggcgcgccgagccggggcccggggagguccgcacggcagaggacgcuuccaggacgggggccguucccguaaagacggucccccuugucgacuccgaaggcggcagcggccgggcgcccgccgccccagacccugccucugucgauccacccucagacccgucggcagaucguauuuguuugauguuuucugacgugacuucacugaaaagcuuugacucucuuacaggcuguggagauauuauugcagaccaagaggaagaggcaggucccagcugugacaagcauguccccgggccaggcaagccggcucugucuaaaaagaaccccggcgugguggccuaccaaggaggcggggaagagauggccagcccggacgagguggacgacaccuaucuacaggaguucugggacaugcucucccagaccgaggagcagggacccgagccccaggagggcgcggcuaagguggcagcugcgcuggaaaccaagguggugcccgagacccccaaagacaccagguguguggaagcggccaaggacgcguccucggucaagcgcaggaggcucaaccggauucccaucgagccccauccuaaggaggagcccaagcacccggagaaggagcagcaggaaggcguccccaacagcgacgagggcuacugggacuccaccacgccaggcccagaggaagacagcucgagcagcgggaagaaggcgggcaucccccgggauagcuacagcggggacgcgcucuaugaucucuaugcugacccggacggaaguccagcaacccuuccuggagggaaggacaacgaggagacguccucccugucccgguuaaagcccguaucucca

SEQ ID NO: 17613 - RNA, 2671 nt, Homo sapiens
uaucauucauucauccaguaacuauuuauugagaacggggggcugagacauguaggcuaucacuugaaggcuaagcaggucuuggccugaugggaaagguuaagggggagcaggauuuucauuuuucaggggagggccauggacccaggugugggguugaaggguuuggacacagaugugcaugauggggaaagcauggacaagaucugaggggaagggauggacacagguguguggggaaggcauggacacaggugugugggaaaguauguauacaggugugugcaguaaagauauggauacagguauugggggaagguguggaaguggaugugugggaugggcaugggugcaguagugugugguugucagggcacgugggaagaggaaaaagaugccgaauuuguuuaauuugaauucuuaccucugaauuuuuuuuuuuuuuuuuuuugagacggagucucacucacucugucgcccaguuuggagugcaguggcgcaaucuuggcucacugcaacuucugucucccagguucaagcgauucuccugcuucagccucccgaguagcuaggauuauaggugcacaucaccacgccuggcuaauuuuugaauuuuuaguagagaugagguuucaugauauuggccaggcuggucucgaacgucugaccucaggugauccacgugccucggacucccaaaguguuaggauuacaggcgugagccacugcacccaacccugaauuucuaauauacuucagcagcauccucacuucucucugcuguauggccaguuggaaaaagacccccaccaauguguuuccuucucagaggcugcccuggcauguccuugcugaguccuucccgccugugucuagguggcccugugaggcucucaguuaguguuugggcgucucagcccuccuggacaggaggcagcugccagcauguggggcuccaucucugcuccucaugcuuauuccugcgugugccagcacuugguuugaguauucgguauguuggauucaacacaggcugccauuuuaaugucaugcuuuugaaaucguugugagguuuucuuuugguauuuccuaauuauuuuuuuuuccauuucaaauaagaagaaaagauaguguugaaugauaccuagauauuuucauuccagcgguuuuuuuccuagucucaccuacacagguuccagugagcucaggaguuuaccuucauguccguggcacagcccauaauuacccuucucuguccagggauguauauuugcaucuuuccuucaacuuaugaagugaauggaggggaaauguacaguuuuaauugaguuugaaguagcuuucaucugaccagcccugugcuggagcgugccucuucuucugugagcagaggggcuacugcgugggaaauggcuaaaccgccugcuuugucuuucacugcagcccguggccacccaggagcccgaugugcaaggcaggugugagugccaggacggcauuccuggagaugaaggccuggagcugcggucugcggacucggcagugcccguggccaugacccaggcugccgugcggcccugggcacccugccuggagaacaugaccacugccccaaacggccucgggccaggccccgcagcccccugugcaggcucggaccugaaagacgccaagauggugaccucccuugcguguggaaauggagucuguggcugcagcccugguggcgacacggacacccaggaagccaaacucagcccagccaagcuugugcgccucuuuuccaccagucggaagaggacgggugcccaccccgagcggccccacuccaugguccugguggggaacuccuccacauggaacacccucgccuccuuccggaaaaugggauccuuuaagaaacugaaguccucaguccugaaaggaauucagagccgagaggggucaaaugccuguucaaagggagaggcuucggagcauggccugggaaaguccaucccaaauggcgcugucccaggagcccaggcaagcaggggcucccccuuagcaccgggaccagcauguggugcccucaggccagcagaguggggcacauuggauggcuccgaccucgaggacacggacgaugccuuccagcggagcacacaccgcucccgcagccuccgcagagccuacggccugggccgcaucugccugcuggaugcgccccagaaccaugcgacacccacgauagccacuggccaggugcccgccgugugugagauucucgugagggacccugaaaacaacagcaugggcuacaggaggagcaagagcacggacaaucuugccuuucugaagaagagcuccuuuaagcggaaguccaccuccaaucuugcagaccucaggacggcccaugacgcacggguaccacagaggacccugagcaguuccuccacugacucccaaaagcuugggucaggaaggaccaaacgcuggaggagcccgauaagggccaaggacuuugacagagucuucaaacuugugagcaaugugacugaggcugccuggaggagggagaguccuaggaguggggccccauccccuggagaggccagccugagacuucaggcacacagccggcugcaugacgacuacucccgccgcgucuccaggagcacugagcaggaca

SEQ ID NO: 17614 - RNA, 1358 nt, Homo sapiens
aaaagacauuuauccagcgucacgaucagacuauuacauuuagcaaucaacagcauggggugcaaaaaaaaaaaaucuacauuaaaacccuuuguuggaaugcuuuacacuuuccacagaacagaaacuaaaauaaccuguuauacaauuagucacaaauacaguccucgaguuuuuugccuauacacaugaguauuugucuaaaacaugucuucuuuguagcagcuaggcccugccaccacugugcuuggcugaguucacaaaucuguuguaaccuguagcuucccugucacuucucuggcucuccucuccugcuaagcuuuguuuccuaauuaaaaucuucugccacugccauagcuacugcugcugcuggaaccgccauagccaccuugguuucgugguuuugcaaaguauuggccuccaccgccaugggggccagagcuucugccuucaaaauuuccucccuucauggguccaaaauuugaagacugauuguuguaauugccaaaaucauuguagcuuccaccaccuccaaaauugcuuccaucauuaccaaauccauuauagccauccccacugccaccauauccaccaccaccacggcugccaccaaagccaccacgaccacugaaguuuccuccacgaccgaaguugucauucccaccgaaaccaccuccacgaccaccaccaaaguuuccagaaccacuucgaccucuuuggcuggaugaagcacuagccaucucuugcuuugacagggcuuuucuaacuucacaguuguggccauucacaguaugguauuucugaaugacaaucuuauccacggagucauggucgucaaagguuacaaaggcaaagccccuuuucuugccacugccucugucagucaugauuucaaucacuucaauuuuuccauacuguucaaaauaaucucuuaggugauguucuucagugucuucuuuaaugccaccaacaaauaucuuuuucacaguuaagugggcaucuggucuuugagaaucuucucuggagacagcucucuuugguuccacaacucuuccauccaccuuguguggccuugcauucauagcugcauccaccuccuccacaguggcauaugugacaaacccaaagccccuggagcgcuucguguuuggaucucucauuaccacacaguccgugagcguuccccauugcucaaaauggcuccucaggcucucaucaguuguuucaaagcucaacccuccaaugaagagcuuccucagcuguucgggcucuuuaggagacucugacuuagacaugacggcagggugaagagagacuuuaacgaugcuucuucggcggcguccaagggcagaaaggaa

SEQ ID NO: 17615 - RNA, 17004 nt, Homo sapiens
ggucuugagaugcggaugaaguggugugaaggguugggcuuuuuuuuuuguuccuaaaaaugcaacgaacaaaaaaaaaaguacaacaauccaaacccaaccaucuuaauugcacggcagcuuaacugggagacuuucuucccgggcggccccacccgggaccgcgccgcuucagucgagcccaccgucugggcaaacggcguccacuucccggagccgcugcccagccucugcgggggggcuuugggcgggcgcaggacucuggaagggagaaaagcccgcagcccggcccuccccgucccaggcggcccgcgcggguggacggcgggagcaggcggcgguuggagacgccggaaggaacgcggucucaccacccggcucccuccgccaaggcgaggcgcggccggggaggcgggacacaggcgaagcgggacggggaggcggggccggaggugcaggcggaggcgggcgacggggaagggagggggagggggaggggaaagggagggggagggggaggggaaagggagggggaggggggaagggacgggaggggagggggaagggacgggaggggagggggaagggacgggaggggaaggggaagcgggagagggaagggggcggagcuagccggagccgcgaguccauuuuggggcugugcuuggcgcguaccgugcggucccuguaguuggaggacgggcggucgcgcggccuuucccacuagccggaggucggagauaaguacccgccgcccggcuccucucgggaaagcggggugguccucgaaccuucagcgaggguggggaguugcccaggucagcagggaucugcguggguugggggggcuggcgaaggccgucugagcuccaguccggcagcgcggcagaaaccagcggggcacugucaugggccuggggaggagcggccugcggagggcgccggggcagugugucugugguccagaaaaccugcuccguccggagccuuccuggccccgcuaccagcgucuccacauccccuagaaaagaaaagacgggugugggccuuagguuacagcgcgccgccagcguuugguugcauggcgccgggggagggcgcccuaaccgagaagcugcuuaauacaaagagcuccaggcuccuggcgguucaccaggucuaaacagccgggcuuuauuugugggggcgauugaaaaaauugagggucaagauuggggugcugugcaaauaaaugcguuaauacuguucuuuuucuucuuucuuugcaguagccucuaguucguuagucaaaacgugaaaaaaaagaccugcuuugcccugggaaauaguaacccugccaaauacaucagcuuguaggagacagagguaaacuacaauaauuuuccuguguuaucuuuuuuuuuuaaacacccaauuucaauaggcccuagaaccuuccaaaauggaacuguguguagaauacguauguucccauccacuuucauugguggucuuuguucuuugcauauuuuguuaaaacuuagaaaaacagaauucacguuuagcaauuauuuaugugguauuuaucuuaaauauagccaaacauucauauuacaaaggaagaaaggggcuuccacacuuuuuuccuacuuuuuuuucccuucuccuaugcuuagugaauugucaggcugcuagggcuuguagaacagggcuugaguuuucuagagaccuuuauauaauaggcacuuuaaaagcagaauuucauuuacauaggcacuccuucuaguagaacuugauggagcuguuaaccggcuauacuuccuucuugcacaaugggagcgucccuaucccucccuaaaaauacguuuuuuuuccuuucucccagcuggcuuacuaaaccucccugggaaguccuuuccuaaaaccgggcuguucuguucauucuauacauuuaugauagguuaucuggccuuaauucugucacagcuuuuguucagauaugcucauuuucaugacacugcuuuguaccugauaccuuauguaauauuuguuuugccuugccuugaaaucacaguucaaguuuagaaccuuuucuugcuugauacacugaugcuccaaaauaacaccuuaaauguguagaguuugccauauguaauuaaaccuuauuuauguuuguauaguuucguaguuuauggaauucucacacaucacacaggaguugagaaauuacuuuuaggcagcuagaaaggguaaaagaguucucgguggaauuuuccuuuaauaaaaagcagcuccuggccggugacuuugggaggcugagguggguggaucacuugaggucaggaguucaagaccagccugaccaauauggugaaaucccaucuuuacuaacaauacaaaaauuagcugggcgugggggugcgugcaccuguaaucccagcuacucgggaggcugaggcagaagaaccacuugaaccgggacgcagagguugcagugagccaagaucgcgccacugcacuccagacugggcaacagagcgagacucuaccaaaaaaaaaaaaaaagcccccaaaccauuuauuuucuaacagaaagccugaaaagucaagcugcaagcaaaaauaugcaggcuagaagcuuuuauauguaaauguagccugcuguaucuggaagccagguacauucaauaugggguuucucacucccuuuuccuugucacccuaugugggcgucugggccgcucccuuuuccuugucacccuaugugggcgucuuggcgaucacuagguaaaaccacgggugcaggugucauggcggccccagguagaagcuacauuugcauaacaaaaaauuagggugggagggccagucuuuagacgggcuauguaaaugauucaccuggucaaaccaguccccugggcccuauguaaaucaccaccuccucaagccucuguacaaaaucgauugcguuucaccccaaacccggagacccucucuugggugauauuucucagcgugaggaaccuuucccuauuaaauuuuccgcuccuaaacccacuccuuguguguguccauguccugaauucuuucuuggcucgagacaaccacggguguaucccccaggcaauggagccauuucauuaugagguaaauacuauaaaaaucauuuuuaaauuuuuuuccaagagaugggauucucaacuguguuccccaggcuggucuugaacugggcucaagugauccuccugcuucagccuucagaguagcugggacuacaaguguguggcaccauucccagauauaaaaauccuaauuuuaugaaggauaaaacuggugcuugaacacagguacucaaaagcagguucugugcuuuccccuucacuagagagccuguuaaaccuaguuuguaaaaacugcaaaauuuuagaagggauuuuagagagcuuaugauuaaaccccuucauuuuaugaauaagaauacugaguucuugagucccuuucuagauauugcuaaggucuaagaauuagaaaacucaggcugugaugccuaguuugcuguguacaacugaugagucuccacuucuugagugcugggggugucuuaguuuuuuugacuccuaaaauuagguguuuagaugauuucuaagaugcuuuuaagcccaguauuucuauuccuaccccauaacuuuuauuaccauuuauugccuauacauauauauugguaagacacagaugcagacuaauguuaacugccuuaaacuuuuauauuuuaaacucggguagguaugguaacaagugugucuuauuguuuuuuacuaaguccuauaaaacuaugguuuuauuuaagguuaggaacugcauagagagguggaccacucuaauacaucauugguuagaguucauaaagugauauaaacccuuucuagagagaaaccuagucaucuuuucaacagccuuaaaaauguccuuacuguuugacccagaaguacauuuaaaggaauugucuaaggaaguaauuagagcuguggagcaagacuuuucucuauaagguguuuaccuaaauguuacaauaccaaaaaaacacaacaacccacaaacaaaacaacacagcaacaagaacaaacccauaaaugagcaauaagaaagcauauccacaacauggacugucauguuuuucuagaacauaucaugaugggggaaaggcauguaauaaaauaaggggauaggauacaaaauuguauuaugcuaccaguucuguuaaaaugugugcacaugcacggacacaugggauuggaauaaagacaccaaaauaauaguaguggugauuucuugcugaugugauuauggguggcuuuuucucucuauuuucugaauuuucuauaauaaaaacuaauuuuauaauuuaagaagacacaaaagcuaguugcauggauaacuucgguuucaguauggugucaauauuuuaugguuuuaauugugguaagaacauuuaacaugagaccuauccucuacacagauuucuaaguguacaguacagugguguuaacuauagacaugagcagaucucugaaacuuacuuuuaugugucuuuuauaaacuauuuaucauaccuucuagaauaacagcaccuggccgggugcaguggcucaggccuguaaucgcagcacuuugggaggcugaggugggcggaucaccugaggucaggagcucgagaccagccuggccaaaaugguaaaacccugucucuacuaaaaauacaaaaaauuagcugggcaugguggcaagugccuguaauaccagcuacuugggaggcuaaggcaggagaaucacuugaacccaggaggcggagguuccagugagccaagaucacaccauugcacuccagccugggugacaagagcaaaacucugucccaaaaaaaaaaaaaaaaaaggcaggaaagaguccaggcuaaacuaugguauggagaagagaaugaaggaaaaggaaaaaguuuuucuuagugcucugaacuagcgagguaaugagugaccugguuuauauuucugagaauuucaccuuagucugacaacccuuugugaacuuucugaguaagugaacuuaccaagcuagugaacauucuguacuagcucuauuuugccuugucaggaucucugcuagaaauaucuuggaaauuuuaacuacuguuuauucuaggauaaugccagaaaagguugguuacuuacugucuuauauggacacauagguaacuuuuauauuguuugcaagagccacauaacaauuauuuuagauacuauauguaauauauuaauuuucauuuuuagagguauugaaaucugauauuucuuacuuuguccuguuuugaucauauauaugccagaggugcuauguguaauacauuaauuuucauuuuuagagauuauaucugaaaucugaucucuguaucuuacuuuguccuguuuugaucauauaagucaccgggacagucucuaaaagaaugaagaguaauaacacauugauacagaguauuuaaaauaaaaacuuuguaaauacuuuucauauaccuuuuaaaauagcuauacaaaugaggagagaaacuaguauguauaagugguuugucagagguuacagacugagagccagacaaguaugucagucuccucacaggucuggauucagagacuuccaguaauacauuaaaaaaaaaaauuuaugaaagaugaaaccauaggcugggcaugauggcuuaugcuuguaaucccagcacuuugggaggccaaggcaggaagauacuuguggccaggaguuugaguccagccuggccaacauggcgaaaccccgucucuauuaaaaacauaaaaaugagccugacgugguggcaggcaccuguaaucucagcuacuugggaggaugaggcaggagaauugcuugaacccaggaagaggaggcugcagugagacgagaucgcaccauugcacuccagccugggugacagagcaagacugucucaaaaaaacaaaaacaaaaacaaaccauacuacagcagauuaaacuucuuaugaggcuuauauuuagcuaauguuuucaaaguuuuacuuucuaaacucaauaugguuuuuuaauaauuggcucuuuaguuuuuccacccauuuuauugugaaaauguucaaacagagaaaacucaagaagaauauuaaaguauucuuacauccucuaccuagauuuuaauaguuguuaauuagacccuuacuuaguuucaagaaaacauuuauuaauggaucucucuuuuuuuuuuuucuuuuugagauggagucucacucugucaucuaggcuggagugcaguggugcgaucuugacucacugcaaccucugccgccuggguucaagugauuuuccugccucagccucccgaguagcugggauuacaggugucugccacugcucccggcuaauuuuuguauuuuuaguagagacaggguuucaccaucuuggccaggcugaucuugaacuccugaccucaugauccaccuggcucagccuuccaaagugcugggauuacaugcaugagccaaugcaccuggccuaauggaucucauacuacaguauaguaaggugcaguggcucaugccuguagucccagcuacucuggaggcugagaugggagaauauaguacacuauuugaaaauaagauuaacuagugugcugagaggaaaugauuuuuuuuaaugagccauuuuauuauaggaauuauuucaaaguaacauuuguggcugucucaguucaguaaagcuuagcauaauuuaaugucuaugaagugaguuucaauguuugcugucuagccaccugauagauacuuagguacuguuuugaaauucuugccuucaaagaugccucaaaacaggauggaaauuugaguuaaauccuuaagauaaaagcgugauauauuuauuggcuuuucuuuuuguucccuaaugggaaaugaaaaaaaacaaaaaacauggguaauauuuugaacaacuuuauauugcuaacagccaguggaauuuaaaaccuuaguaggaaaguuucuuuuacuaauagguuuuauaaggagaaaaugaacuuuuguuucagagugaaugaaugaguacuuucugcaguauaaucauuuuggguugaucucuuaaaagaauucuagaaggaagaaguccaauacauauauauaaacucuauuaugacacguuuacuuuguaaguauuggcuuuuccauuuuuauuauuuuagugguuguguuaugguucucauuuauagaagcuguuguugccagauacuaauugagguaggauucauaaagcacuuuuuguaauccuucuucuuuguggauagcuugacaauuuguucaaaaaaauaaacucauaguggugguaugcaacuuuguuaaaaauaaaacuguaaaucaaaaagugaauuucauuguauguaaauuuaaaaguauguuagaaaacaucaauauggcaggagaacaaguuugacuuuuuuccgcaacuagugucuacuaccaccuuucuggauacuuuaaaaaguugucagcuuuuaaaauuguugguauaaaacauuugggaaguuuuuaauugguauuugugcuucaaaauuuaagacuuuucuaaguauucagaaauauucaaaggaagagaugaauuuuggaaaacuuguuugccuuuaugugcuuaaucugacuuuaaguugaaauuugaacagugaauaauaauuuuguuuacauaaaguuuuuugacuucuauauuaggaaaaaaacuagcuugaggccaagugcaguggcucuugccuguauaaucagcacuuugggaggcugagucccgacugcuugagcucaggaguuugagaccagccugggcaacaugcugaaacaucaucuauacaaaaaaaguacaaaaauuaacugggaaugguagcauguaccuguaguaccuuacagcuacucaugaggcugaggugggaggaucaccugagccuggggaggucaaagcuacagugagcuguguuagggucacugcauuccagccugggcaacagagugauacucccucaaaaaaaacaacaaaacagacugggcacacuggcucacgccuguaaucccagcacuuuaggaggcugaggcaggugaaucauuugaggugaggaguucaagaccagcccggccaacauaaugaaacccugucucuacuaaaaacacaaaaauuagccaggugguaguggugcaugccuguaauccgagcuacacgggaggcugacgcaagagaauugcuugagccuaggaggcagagguugcugguggggagguugccagugagccaagauggcgccacugcacuucagucugggugacagcccgagacccugucuuaaaaaaaaaaaaagggccaggugcgguggcucacgccuguaaucccaacacuuagggaggccaaggagggcggauuaccugaggucaggaguuugagaccagccugaccaacauggugaaacccugucucuacuaaaaauacaaaaauuagccgggugugguggcgggcaccuguaaucccagcuacucaggaggcugaggcaggagaaucgcuugaacccaggaggcagagguugcagugagccgagauggugccauugcacuccagccuggguaacaagagcgagacucccucucaaaagaaaaaaaaacaaccagaaaccccgaaaaagagguggaggggauguauccuuuuuuguucaugucaaaggaguaagcuggguugauuacuucagauuuuguguuagccauacuuuaagauuuuguaaguuauuuugcugugaagaguaccuuuuauuuaugauauuaaaggcuuuaacuuaaauuauccuucaaaacuuuggaggcaacaaagaugucuaccaugguuucuuggaucagguauuagucacuuguggaaguggucacauaguuuugucuuagagaaaguuuugauuauaaagagaaggcauaggcagggcaugguggcucacaacuauaaucccagaacuuugggaggccgaggcggguggaucaccugaggucaggaguucgagaucagccuggccaacauggcgaaacccugucucuacuaaaaauacaaaaauuagccuggcaugguuguaggcgcguguaaucccagcuacucggggagacuaaggcaggagaaucacuugaacccaggaggcggagguugcagugaguugugauuacaccacugcacuccagcaugggcaacagugcaagacuccaucucuaaaaaaaaaagagagaaggcauaaaacuaaaggaagaaaggaagaagagaaaaggaaauauuuaguuuuuuuuuuuuuuuugugauggaguuucacucuugugcgaucauggcucacggcaaccucuggccucacggguucaagcgauucuccugccucugccuccugaguagcugggauuacaggcaugcgccaccacgccuggcuaauuuuguauuuuuaguagagacgggguuucuccaugugggccaggcuggucucgaacucccgaccucaucugcccaccucggcggccucccaaagugcugggauuacaggcguaaaccaccgcgcuuggccagaaauauguagauuuuaaagugaaugaaaauaagaaucuuuaaauuaucaaccaaaauuuguaaguuaagucacuaaaaaugaaauuagaggaucuauuguaauuuugaugcaauuuuuuugaagauacuuuccaaauaguauuuuuuccccucugguucauuuuaagagcuguauguugaucaugaccuugggaugacuguuuauuauuucuaaguuuuccugugugugacauuuuccuuuucacuuuugaucacauuuguuugccugaaaauucuucuuggccccugucguuguauccucaauuuucuucauaguuucucuuugccuuuggugcccuuuuucuccuccucaucccacccaaucacuugguauauucuuuguuuucuucuuauuuaauaugcuuggauaguauucucuggaaguauuaacauugcaaggaugaguaaauuagguuucuuuuauugaguguugcccuuaccacuuuccuguuucuauugccuucucaaaaaucuggccuuuguguagaauucuuaggcaaaagaugauaguaauggaagugaaaaguguggagcaggacugggguuggcagaucaucaaaaguuugacuucauuguucugaaaguuugugugucuuacagcugugugguaaucucuuucagaagacaaacuaaguugagucuuuauagccauucucuuuccaaugcuuuucagagguuauaugauuugucauaucacaaaggauuuuucagaaaaaucagcuaauuacaccuuuuuuugcaauaugacacuaaauuugagacagaauaaucuuugcuuuaguucucccuauguuauguauuauaaauacauguaucuuacaaucuacuauaaaaccauaaacuggcugggcgugguggcucacaccuguaaucccagcacucugggaggcugaggugggcggaucacccgaggucaggagguugagaccagccugggcaacauggugaaacccugucuccagcaaaaaauacaaaaguuagcugggcaugguggugggcgccuguaguucccagcuacucaggaggcugaggcagaggaaccgcuugaacccgggaggcagagguugcagugagccgagauugugccacugcacuccagccugggugacgaagugagacucugucucaaaaaaaaaaaaacccaaaaaaauagggcccagcgugguggcucacgccuauaaucccagcacuuugggaggcugaggcagguggaucaugaggucaggaguucaagaccagccuguccaagauggugaaaccccgugucuauuaaaaauacaacaaaauuagccgggcgugguggccggugccuguaaucccagcuacucgggaggcugaggcaggagaauugcuugaaccugggcagcagagauugcagugagccgagauugcaccacugcaccccagccugggcaacagugagacucugucucaaaaaaaaaaaaaaaacgccaggcacgguggcucaccccuguaaucccagcaguuugggaggcggguggauugccuggggucaggaguuugagaccagcuuggccaacauggugaaaccccguuucuacuaaaaauacaaaaauuagcugggcgugguggcaggugccuguaaaucccagcuacucuggaggcugaggcaggagaauugcuugaacccgggaggcggagguugcagugagccaagaucacaccauugcacuccagccugggugacaagagugagacuuagucucaaaaaaaaaaaaaaaagccauaaacuaauuaacccugcaagcucagcuuguccuuuaaauacuguuuaccuucuagauauaguccagucauguauggcuguugaaauuacuguuaaaaaaguauucgcuuuuuuuuuuuugagacagaguauugcuguguugcccaggcuggagugcaguggcgcugucucggcuaacugcaagcucugccuccuggggucacaccauucuccugccucagccucccaaguagcuggaacuacaggugccugccaccacgcccagcuaauuuuuuuguauuuuuaguagagacgggguuuuacuguguuagccaggauggucuugaucuccugaccucgugauccgccugccucggccucccaaagugcugggauuacaggcaugagccacccgugcccggccaaguauucacuuuuuaucauagauggccuaccgauuaagucauauguuauuguugauaaugugauauuguugauaaugugauaugugcauauaucccugaguaaacugaauguagaaauauguaguacucuuugguuuuacaacuauagagaugaauguauauuuaaaauaaacuuguggccugaugcaguggcucacaccugugaucucagugcuuugcgaggcugaggcaggaggauugcuugaggccagcuaguaagaccuggucucuacaaaaaaaaaaguagccaggcgugguggugcaugccuguagucuuagcuacuuaggaaucugaggcaggaggauugcuugagcccagaaguuugaggcugcaguaagcuauaauuaggccacuguaguccagccuggacaacagagcaagacccugucucucaaaauaagaauuaaaaauaauaaaccugcauugagaaaugguauugccuguauuagggaucucaaauauuuuggucuuaggacacuuuuacacucuuaaaaauugagaauccuggccuguaaucucaguguuuuggcagucugaggugggaggaucacuugagcccagcaauuugagacuagccuaggcaauauggugagaccucaucucuacaaaaaaaaacuacaaagaaaaaaaaaauuagcugagugugauggugcgugccuguagucccagcuacuuggagguugaggcaggaggauggcuugaguccaagaggcagaaguugcaggggacugagauugcacugcuguacuccagccugggugaaaaagcugucucaaaaaaaaaaaaaaaaaaaaaaagagaaucccaagaacuuuauguuuguacugucgauauuuacucuauuagaaauuaaaacaauuuuuaaaaaauacucacguaaaauaacaaugauaaacccauuacaaguuaacaaauaauuuaggaaaauaacuauuuuccaaaacaaaauuaagagaagcauggcauugcaauagaggccuguaaugaauggcuauuuaauagaagacagcuggagucuuuugucugcuucuguauuuaaccuguuggaauauauuauuuugguugaaauaaacgaagaaggcugggugugguggcucaugccuguaauuccagcacuuugggagguggaggugggacgauugccugagggcuggauuucuagaccugccugggcaacauagugagacccugucuauaaaaaaauccacggccaggcgcgguggcucacgccuguaaucccagcacuuugggaggcugaggcggauggaucaccugaggucaggaguucaagaccagccuggccaacguggugaaaccccguuucuacuaaaaauacaaaaauuaccugcguguggugguaugugccuguaggcccagcuacuugggaggcugaggcaggagaaucacuugaacucgggagguggagguugcagugagccaagauagcaccacugcacuccagccugggugacagagucagacuccgucucaaaaaaaaaaaaaaaaaaaaaacaacaacaacaaaaaacacuaaaacuaaaaauuagcaaggcaugguggugcacaccugcagucuguaguuacuugggaggaucucacuugagcccaguauuucaaggcugcagugagcuaugaucaugccagugcacuccagcuugggugacagagugagacaccccaucucuuaagaaaaaaagaaaagaaaaggaaauacacaaaaaucuaggcuuacacagauauguaguugguaaaggaaggaauauuauuuaaauagccuuuucagguaauuuaaucuuuuuuuuuuuuuuuuuuuuuuuccugaggcaaggucucucucuguugcccaggcuggagugcaguggugcuaucucggcucacugcagccucugccuccugggcucaagggauucucauaccucagccucccgaguaguugggacuacaggcgcaugccaccauggcuggcuaauuuuuuugguauuuuuuuuguagagguggaguuuugcuauguugcccguacuggucgugaacuccugaggucaagcgguccacucucugcagccuuccagaguguuaggauuacaggcgugagccacugcucccagccugaaucuucuugugauacuauacaaaaacucagcaagugcuaguuucuuuguuggaguauggaaucugaaauuguuuaugaaccuguuggucuuucgugaacuucaaauggaucuuuuacccaugccugauuuguaacaugcauuagugacuugaaauaguauucacuguguuuugcagaucuccaaauauugacacauuucauuauacaguacuccuuuccccucagaaaauccucacauucauuaauaucacugcccaucucaucauaaaagucuuuaauuaaugggaagcugucaggcucauaaauaucaaauguuuuccaaaauucuaauuuuuacauaaaacccagccuuuucauuagcaagagauacugucaauuguuuucuuugaaguagcaagcucauuuuuuuuccccagaaaaugucagguagcuaagucugaauagccauaguuuaucauuuguucuuucagaagguaaaaaugguguuccaugaaaaaaagcagcugguuuaacuugccgcucuucacuuaagugcuuuuucuccagacaacaucugccgguaugcagaagugcuuugugcguacugccuauuuugucacgcaauauauuaaaaaacuguacacaggcucaagacuuaauaaaaugaauaauuuuuacugcugcaucaagaacauucuuaagugaaaccgguacuccaaccccaauuuggguggugaugaagaauacaauucagcgcuucuuacagcuuugcucgaucccuccuaaggcuucagcagugucuacacaccauugcuuuuacaccauugguacaaauguugacauggugcaaaaagcaaguaacaucuuagugucauuacgaaaauaguuuugaucucacagaugcccugaaagagggacauccagguuucugcccaccacauugugaaaauugaugauucuagauaauacaaaauggcuucuguuacuguucuggugguuuaaaaacaacaaaaaaccucauuuaguucucuaccuagaagagugaauugcaacucucaucuugugcuuuuaccugugauuuuaaaaauuguaaucuugccuuugaaacaaaaauaugccaauucauaauaaagucuacaugagaguacauguuuggauuuauauuucugugcuucuuucuuuuauauaacauaccauuucauauuugugggcccagaguaaagagcucauucuguuacagacacugaauagccuuguuuuugucaguagucagcucuguuuuaaaacaauugcuuggguccugcuggcucaacuugcaguuguccuaguccugagucuugucuuagccaaagacuguuguuggaaagcccacacaaaggccuuguguauaggaugcccuacuauuaaaggagcauguucuagucucaguggauuaaauuugcuuuggugugcauucccuuaccaaauuucucacuacuuuguuuggcugguuauuucagugaaaaaucauuuuaacgugaaggcagauuucuucuaauuauuacauaguccuaguggugacgguuauuggaguaaaauaauuuuuuuuuuuucugguaggaugugauggagcugcuugaagaagaucucacaugcccuauuuguuguagucuguuugaugauccacggguuuugccuugcucccacaacuucugcaaaaaaugcuuagaagguaucuuagaagggagugugcggaauuccuuguggagaccagcuccauucaaguguccuacaugccguaaggaaacuucagcuacuggaauuaauagccugcagguuaauuacucccugaaggguauuguggaaaaguauaacaagaucaagaucucucccaaaaugccaguaugcaaaggacacuuggggcagccucucaacauuuucugccugacugauaugcagcugauuugugggaucugugcuacucguggggagcacaccaaacaugucuucuguucuauugaagaugccuaugcucaggaaagggaugccuuugagucccucuuccagagcuuugagaccuggcgucggggagaugcucuuucucgcuuggauaccuuggaaacuaguaagaggaaaucccuacaguuacugacuaaagauucagauaaagugaaggaauuuuuugagaaguuacaacacacacuggaucaaaagaagaaugaaauucugucugacuuugagaccaugaaacuugcuguuaugcaagcauaugacccagagaucaacaaacucaacaccaucuugcaggagcaacggauggccuuuaacauugcugaggcuuucaaagaugugucagaacccauuguauuucugcaacagaugcaggaguuuagagagaaaaucaaaguaaucaaggaaacuccuuuaccucccucuaauuugccugcaagcccuuuaaugaagaacuuugauaccagucagugggaagacauaaaacuagucgauguggauaaacuuucuuugccucaagacacuggcacauucauuagcaagauucccuggagcuuuuauaaguuauuuuugcuaauccuucugcuuggccuugucauugucuuugguccuaccauguuccuagaauggucauuauuugaugaccuggcaacuuggaaaggcugucuuucaaacuucaguuccuaucugacuaaaacagccgauuucauagaacaaucaguuuuuuacugggaacaggugacagauggguuuuucauuuucaaugaaagauucaagaauuuuacuuuggugguacugaacaauguggcagaauuugugugcaaauauaaacuauuauaaaaucuguuucaaguaugcaguuuucuuuuguuagaaauuguuagagaauagagagugguaauucagauuuggucaacgauucuagucacauauuuuccuccaaaaguauuccuuccaaaaauaaucuauacauguucaaauuagguagcauaaagauaaaagugaaauuuaguaguauaggccugaaccuuuuuuuguuuaaaagagugcuuuugaaauaagcauccaccccaaaugu

SEQ ID NO: 17616 - RNA, 5209 nt, Homo sapiens
ccuaaguguggcugaugguagccucuaguuugaagugagggaagaaugaguagucaggaacuggucacuuugaaugugggagggaagauauucacgacaagguuuucuacgauaaagcaguuuccugcuucucguuuggcacgcauguuagauggcagagaccaagaauucaagaugguugguggccagauuuuuguagacagagauggugauuuguuuaguuucaucuuagauuuuuugagaacucaccagcuuuuauuacccacugaauuuucagacuaucuuaggcuucagagagaggcucuuuucuaugaacuucguucucuaguugaucucuuaaacccauaccugcuacagccaagaccugcucuuguggagguacauuuccuaagccggaacacucaagcuuuuuucaggguguuuggcucuugcagcaaaacaauugagaugcuaacagggaggauuacaguguuuacagaacaaccuucagcgccgaccuggaaugguaacuuuuucccuccucagaugaccuuacuuccacugccuccacaaagaccuucuuaccaugaccugguuuuccagugugguucugacagcacuacugauaaccaaacuggagucagguauuuuguacuuugcaguauuucucuuguauaccaguuugugauguuuucucuaaaaacuugaaguuccucaggccuguaacuucuggaaaagaugauuauucaaaauaauguuuugggguaaccaguggaguuggguagaaugaccaaauaauuauuuuccaaacugggauacuuuuuagagugaaaggggcuauuauuaggugggacaaaaggaauaaaugaagacugcccagaaaaaacugagacuauggacauucaaaucaugggagaaaauaauuuuguagauuauguuccauugcuaaugaauuugacuuagaaaagaauugccuuauuuuuaagagauuguuucagugguucacauaaaggcucgcucacugguuucucuugaguuccuuacacacuauauaaguuguucuuucaguuuuaugauucaacuacuguuuuuccuucagcugacuuuauuuuuaaacacccuuaaagacagauauaucucauggcaaauuugguauccuguuacagccuuggcucuuaaacaacucaaaauauugggauaggcugucaguauguuaaggauaguugcuccugagucaauucuucacuuacucccucuguuguucuuggcuggauccuaacgcugauuuccacucugcugucacaaacauuuuuccccccguaaaaugucuuaaugcuguccuaccauuauuuuaccaacugugaaagcuggcuuuaauuuuuaggaggaaaagaaaagccugcauguguucuuuauugguaucauuuaaaauauacuuuuuuuuuuuuuuuugguaaagguaggcguauuuuaagauauuuucuuaacuugagcaguagccaacaggaaggauaccagugucucucucucuuagcgacacacuccuuggucuugcuuaccaacuggaggacacuagguagaauaaccgaguaugacaauucuuaauuguuuacauuuuauaacuuccuguccuucaaaagaguuugaaaugucauuuugggaaaagagagccagucaagcuaguaggcugauugugaagaaaaucuaauaccuuaucuuuaucucaaaccucuguacaacuuuauuuucauugaugggauacuuuaacaaaaaugaaauuuuuuuugguuuuuaaaauaugagugauuaugaccucuuuggggaucaugcuucaaaaagucagaaaccuagagacaaaacugucauugauuuuuaagaagaaacacacuaggucaaaagaagauguccuggaaauaugaaguacucuuuaaaaaccaugcauuuggagaaaguaauuguuuccuugaaaaacaugauuaaaaacuaaaacugggauguuccuguguguacacagugccaaaugguuuucccuuuuuauguuguguuuuagaaacagcacgaaaguuuuuuccauuuuaaagugagaaaacauuauauuuagacuuccauaauuccaaaaucagaagcuauuuuuaaaauuagcauuuucuugcaucaccaaaugguauucaauuguuugaagcucaaaauuuuuaccauuccauaaauguuugugaauuuuuagacagugccaauuuaaaaguagagauagccaaucugaauacggugaaauuauggggaucucuggugauugggaugaaaacucuggccuuaaaagguccacuuuuaguauauaauugccuaauuagcaaucauuuuuauuuuuugcucacucccuggucugaaucuaucugucuauucagauauuuuuugguagguuuggaaaauggagaagugagccuaauuggugccuaauugucugguguaucauucacuuuauucaguuuguucuaucaauaugauuuaccccucaagguuaaccuagcagguugcucaguuauuaucucucaaggucacaguacuagaaauacuuggcuugcaucuuucagaugccauucauguuaucaagcucaaauuauaguuggucacaggauucuaaagucuuuauuugacuucuccuuuuugaacuggcucaaauggaaaaguguaguugcuuuuaaauguuaaaaauaaguuuaaacuuuauauuucccauugguuuccccuauuuuguccuuucuuugugugcuugaaauauuuuauuuuucaguuuguccucauagggaaucaaguauuuuagcuaggugaugucuugcaaguacguuccacuuuguuacaaucuacuaucuguauauacuauuuguaucuuaauucuuuuaugagauguucuguaacauuuuucucacuuugacaaauguuuuuagacuguacagucaagaucuggcgcuuggggguaaguggaaugauuugcuaauauugagaaucuguuguaucaaacauaauaaacuuuuuuugagaugugcuuuguaguuugguaauucuuagauuuuacuauugguuucuuugcuuagaaugaguuucuaaaugugaacuacaaaaaccacucuacuucaagcaugaucauuagaagaagguuagggauguccccaagcaucauuuuaucccuuaaaacuacagauaguuuagguuucugccugaacuaaucuaaguuagcuuuuucuucacaucucauaaacuaauggugggaggacacaaagagcuuuaugaaaacauuuuugauggcagauaaggacggagucauaaagcuguauccaugcagauguguuaugcugacauuauuguuauuauugagauggaguuucacucuuguugcccaggcugguaugcaauggcgugaucucggcucaccacaaccuccgccucugggguucaagugauucuccugccucagccucccgaguagcugggauuacagguaugcaccaccacaccuagcuaauuuuuguauuuuuaguagagacggaguuucaccauguuggucaggcuggucucaaacucccgagcucaggugauccaccagccucggcuucccaaaaugcugggauuacaggcaugaggcacuacgcccagccuaugcugacauuauuaaagccaacagauagcuaaucugaaaaguucaugugcauuuuuuucuuuuuuucuuuuguuuuuuuuuuugagacggagucucgcucugucacccaggcuggagugcaauggcgccaucuuggcucacugcaagcuccgccuccucaugugcauuuuucuugaauugguucuguguacugcauuuguucuguggagcaccucagugaauagaagauuuugcccuuuccacucuccagaggcuuuugaccccaaguugugcucuuugacaauggagaguuauugcguaaaaagugacaauaaaaucuugacauuucauaucugcaaaauuucacuuaaaaaaagguaaauuucauaggaguaagucgcaaaggaaaauccauaaugucagugcuaauaauugauaagauuagaucuggaggggaaauuguaagugcacagcauucauuaaaauauuugauucaaucaacuaauuaauagcaaauucaaaacaaaauuggaaauaguuauauaaaaauuaauacaauuuguuugaucaaauguuuucuuuagaaagugaucucucaaaaauugaugaguguugguuuacuucuaaauauggaauugaaaugacuuucagaaucacagcaaggucucgauuuucagcaccugauuacugauuugguagccuagcacgguggcucaugcauguaaucccagcacuuugggaggccgagauggguggaucacuugaggucaggaguuugagaccagccuggccaacauggugaaacucaaucuuuacuaaaaauacaaaaauuagccgggcaugguggugugcgccuguaaucccaccugcuuaggaggcugaggcaagagaauagccuaaaccugggaggcagagguugcugagagccaagaucacaccacuacacaccagucugggugacagaguaagacuccaucucaaaagaaaaaaaaaaaaaaucacucauuuggauuuguaaaguaaaugaaauuucaaaaaaaaaaucugucuugagaagguaugaugccuuugagguuguaagucaaauuuauguguauaguuuugcuaguuauuaaagggaugcuuuauaauuaagcuucuuuuuguguguccuagguauguuucuauaaaaccugauaaccgaaaauuggccaacggaacaaauguccucggcuuacugauugacacuuuauuaaaggaaggcuuucauuuggucagcacuagaacaguaucuucugaagacaaaacugaaugcuauagcuuugaaaggauaaaaagcccugaagugcucaucacgaaugaaacaccaaaaccagagacuaucaucauaccagagcaaucucagauaaagaaaugaaguugucuauccucuuuuaaagagaaauugccauuuuucuuguuucauuacguauuuagggcauacauguuagccaaaucuacacucagccuaacucuuggcuucaucugcugccaugccgucucugggcaaccaggccccaacugugcuuaagccauaaugccugcugcucucuagacaacuccauguacuuggugcuuugg

SEQ ID NO: 17617 - RNA, 2318 nt, Homo sapiens
agcuauuaauuuuauccaguguauuuuucaucuuuagaaauucaauuuagguauuuuuuuuuugcaaucuucuaugucucuaauuaacucgucuaugaggauuguuguuuuuaaagccuuugucuaucaauucuauuaucuuguauauuaauaccccucuuucaguaauugauuuuguuuacucauuaugggccauauuuuucugcuucuuugaaugccucauaguauuugauuagauggcagacauugcgaauuuugucuuuuugggugaugaguauuuuguauuucuauaaaauacccuugaacuucauucuuggacacaguuacuuugaaagaauuggauacuuuuaggucuugcuuuuauaauuaguuugguaggaccaguccagcaaauaguuagggcugacucuucccuacuacuaaggacccuuuugaguacuaugccuaaagcuccaugaauugugagguuuuacagucugucugggaguaggcacaauucaagacccugaggaaguaugagguacugcucccucgaaucuguuuagauggguuuucuccuggcuuuuggguaguuucaucacaugcaugcacugauccuacuuaaguaggacccucugcagaucucuggggucuuguuucuuuuuagcccucuccuuuccugugugcugaccugugaacccuaaccaccuuggugucucuggaauucuuagcaucaucucuucaauucagugagucagcuaggcuuuacuggguucucccuuucugcacuguggccuggaagcucuuuuaaagcaguaagcugggcaaucauagggcucaucucauuuguuuaccaucucucagggacuacgguccugcauggcuugugugcagugccuugagaauaguuguuucauauauuuugucugguguuuuguggguuuuuguuguuguuguuguuucagaggguuaauugaauuccuguuauuccaucuugguggaaaguagaaaucucaauuuuuuuuuucuguagauacuuaaugucacuauuaguuuaagaaaaaauggucguauuuuaaccauucauggguaagccaacuuguaaaauaugucugcucuauuuaagcuuaugaagaucugaaguagaguaaagggagugggggccauagaaaaauaaaagagaguaaaaucucccuucuuucauucuuucucuuuugcucuuuugguaaauuguugcuaugcccccuuacuaaucagagccccauuguucuuuuugguaauaggaacauuuuaagaguucugugaauaugccacucaaaauauaugaagaguguuaccaauaaaauugucauggucuuuauguuuuaaucuaugugauaaaaacuugaugguuuugguacaacugguuaacuucucgaaaaaaauauuuaaauuggauuuccucuuaauaucuuauacccagauauaguccagauagguuaaaaauauaauuucuaaauauuaaaugaaaauauaggcaauucacagaaucuuaagaaaaggucuuucuaagugugauacaaaggauacaaccauaaugaaaaagaucaauaugauuacaugaagauuuuaugucuuuuauauggcaaaaaucauuauaagcaggauuaaaaacauagucgauauccuuaguauauaaagauaccucacaaaguaguaaaaaaaaagccaaauaucccacugggaaauuaggcaaaggauaguuguguaaaaaauauagguuucagguaaauauguuuacaaugcuguacuucauaauaguaacaauuacaaauuauaauacucauaauaauagcuaucauuuauuucauguuucuauuugcuugauuacguuaauguuuucaguagauuggcuaauuugauacuuugaaaaacaaguauacuauuauugucaguuuauaaauggcauuugagacaggagauuaagacccuugcccagggugacaaagcuauccaaguggcuaagccaagauuaucacccaggccuucugauucuagaccccugcuucucaucauuccucauagcaauacauuuaaacuaccugaaauucaacugcaacuugcagagaaauugguaauuugcucaagaucacaacauuuguaagugauaaauugaguuaaaaaucuuacaaaagucauauaaguagaagaaaggaaaacaggguaaaguaaggugagcaacaaaacagcuguguguuuuaauuuuagauauucacgguuuauuuucagaauauuuaaaagaugcuucaaagaagaugaaaaaugggcuaauguuuguaaaacugguuaaccccuguuca

SEQ ID NO: 17618 - RNA, 4269 nt, Homo sapiens
uuaauugcucuaugcauuuauuauuagcuauuauuaaugcagaaugagggaacaaaaagcucacaaacacucuacacaauuucacaagacgcauugcaggggaaaaagugacugagauggaucaacaguaugcuaaggucuugguggacgcauuccugggggagguggaccuggaaaggaaauagaaacauugagaaaaagaggauacacauauucaggggccuggcugaaccaucaaaccccuaugcucccacucaccucuaaugccugguggagggggucucauucccggaggcggcaugccuauuggcgucccucgagcagggggaagcccaauuggugggcccauggguggucucauaccagguggaggagccauaaugccuacagugaaaaaugguagaaauaaaggccucauaaaauggcuuagaaaaguuagaauuuagcccaaauaaucccuaaagaaaugggccagacaacaaugauagagucaaauaacuucuauaugacaauuacucuucuaugucuuucauuaaaaaccaguaucuagaagaaggaagcauauuccccaaauucuuaggcucucaggcugugucuuaaaucaguaagcuaucucucaucagagauucaaguucgucuucguguucaccaaucccuuaccuggaggugggguugcucugccgacgggugggggcggagugccccguccugguggguacuguguuggggcuccagcaauacuggcagucgcagcaacagcagcagcugcuacagugccucuucccuguggagucauuaccugagaaggcagggcgggaaacagucaaagcgaugcaaaccuucacauuauucaaacacagaaaauaaaugagaaaaaugaccaauuaguuacaaacaacuguugcaauguacuucucucauuauucccauguuuuuuuuugagacaguuucacucuugucacccaggcuggaguguaauggcgcaaucucagcucacugcagccucccacuccuggguucaagcgauucuccugucucccugccugguagcugggauuacaggcacccaccaccacacacagcugauuuuuguauuuuuaguagagauaggguuuucaccacgugggccgggcuggugucgaacuccugaccucaagugaucugcccaccucggccucccaaagugcuggauuacaggcguaagccacugcacccggccuauucccauauuuuaaaaacuaaucuuaguacacugacauccaaaaagcccuuuggucuuuucaacugugguauauccaugcauucuguucacucaccacuaguggcaaguuacucuugccaagaguaaccuggguaacuuuaaucacccaaugaccauuuuaagcagcuaguuuuauucccuuccucccauauaucuguguuuugguuccuccuaaaccauaugcuguuuacauuguaugacacauacacuuagguuuuuaaaucuccucggccuccggcuuagucauauucucccaauaauauaaaacccucugcugguuccucaccugcugggauggucccccaacuccucggacagggccugccaauccagcaggggccuggggaauuggcacaccagcugguacuccucuaccagcugcccuaccaaccccagggccuccagcagcuccagcaagugguacccgagcaaugccagucugaaacaagaaaauucauagccuaaaaucaaacaauuuacaaguucucaguauucuuauucaucagagaucacuucucuccaccauuuucccaugacaccuaucucauauuaguucuguguccaaaugaacaaacaagcaaguauaccauggagguaucuuguguauaaaaugcacauuauuugucaaauugugaaaacaccucuuuuauaaacauaccaagcaaacaugaaucaccaacuccuacccuuaccuagguaaugcccagcacauagaauaauucaccaaaaauccccuaaucccgaauagcauaggcaaccaacaauugauauuaagugccuggcacauuuuauuugacaauccauguugaacugugucugcucuacccugauuucagacaucucacauaauaugaugucccugcaaauuaaaguucuguccugcccuacaucuuccuuacaucuuugggggguggccccuccacagucauggauaccaaguucuccccacgcagcaacaccagacccaaaacccgcuuuucuucacgcucugguugcuucgcauucuuuggccuacaaaucagaauuaaauuuuagugagauaaauuuuagugaucacucacucaucaaaauauuuauacaaccucaaguaucaauuaagacaacugaugcuaaacauuuacugaguuaucacugaaaaacaagccaaaaaauaucuguaaacacaguuaauauacaaggguaaauagugaagcuauuuucuaaucuaacuuuagucuuuuacagaauguuccuuugauguuacacuacaacaagacuaauuucuuuugugaaauaccuuuuaagaaaaacaaaauugaaaccuggguuuccacauuaaaauggaaauuucuuuaaaaaauuacuuaaauaauuaaaucauaaugacaggugacacagaacugaaauaaugggaacagugauaggcaaagagaggauaccaaauggcaaccauaucccaacuccucaaccaugaagaacaacuguucuucuccauuucaaccaagauuuggucuaagacugcugcagaagccaaccaauuaauuaauauagcauuuuucucaauuuuaaaaauaaauacgaguauucugaccauagcauauacuuuuacucccaguaauaaauccaugauuguuuuacaaacuuaaaagaguucagaugcagacucugaccuaauucagagaucaggucaagagguuaaacaauagacuggcucuaccauaguuucccuaacuacuucaguuacccucggaaaucccuuacuccagcucuggccuucccuucccacugccucuguguccaacccccauuugcccaaaucagccuuacuugaucuuucugaacucaucacaaucacagaggaucaaauucauaugcuugucaaaagccuuaaaggugccaaugaagauucggccaucuugcaggauacaucucauucuauagucaaugugcugcagcaucuugcuacucuugccaacagucuagaagcaguaagacaagagucauguucagcuugccaacacccuagucuucuaaucuucuccuguuucuucuccacccuuacauaaucuaagccugguuuccuuaacuaaacaaauauucucuccuuuuucaccaacauucuuccauauuuaguauggcucuuuggaggaccacaaaggauuaugaaguauuuuuucacaucucaagaaccaauuuucaccuccuuacaggugauuauccuucucugugacgaugcaugcucuaaacuguccacuccccuaaguaaaccaaaccacaaugauguaggguguucucucucuccagacugcuuuucucuguacuguuaaugccaaaacccuuccauuuucaaagcccucuuuauuucuauuguaaucugaccugagaguccaucaucugcaggacaguccuucaccacugguggaaucaugaccaaaaacuccuguauuuucucacaucaugaaacauuucucauggccaggcacaguggcucaucucaugccuguaaucccagcacuuugggaggccgagguggguggaucaccagaggucaggagccugagaccagccuggccaacacagugaaacccuguuucuaauaaagaggcugaggcacgagaaucucuugaacccaggguugcagugagccaagaccgcaccacugcacuccagacugggagacagagcaagaccccgucugaaaaaaauaaaaauaaaaaaaucagcucaucuucagcugauacucaaugcaaugagaauccauauccauggauguauccuuauuucuaacauucagaacccaagaucacugcacaugcuggcaaacuauuucuuucggcccuuacagcacauuucaacccucagccuuaucauacagcuuaccaugauugcuguuccaccaaauccaauguccacaguuaaaacuugaugcuucugaagaccuaggggaaggcuauagauaaagguaugacgcagguucuccuagaaacaaugcaagcugggcagaagcuucaaagaguagauggagccug

SEQ ID NO: 17619 - RNA, 1568 nt, Homo sapiens
ugcaaauaaauucucaacaaacuugucauaaaauauauuuuuugaauauucagcauuugagguaugguuuaguggguuuauacaauuuaaauggcuuauauaauuauuugaaaugaaaagaaaaccuagucagccagaaccaauuuggcaauuuuuccaugguaugaaggcaaaucaauuaaggccaaaacguugaaugugggagagauaguaagugacuuguaugagggauuacugcauaauaacguaacgcacaccuuacuggauucuccauauauauuuacauuaccagagaacaguggcccuagggauguuuaagcacugcuuauaauggaaaaagucagcuugagaaguaaacguauaucagacuacagguaauuccucaucuugaagccaugcaacaccugcaaaucuggauuuauacaaaaguugcuaauguguuucauaaagauuuagcaugaguaacagacucuuggugcauuuaaaauaugugaguuccagaaaguagauuugcauacaccuuuucaacagcacauuucacuggaauggaugaggggcuucugaagaccacuccacuaccugaauuuauuuggaucacugaggaagagcauuuguugggauuacagaauuauaggccauuagacaucauggguagguagucuuaagauccuucaacuuucaaaaaccacagucuaaggacuauauucaaaugacaagagccgcacuguauacugcuuucugcagugaccaugcugggucacgcauccuauguuucucauuuuuaaaugauuuggaacauuuuagccagcauuuugaucacacagauuaauaaugcuguucuccccaaaacgggaaacuuuaccugaaacgcucuccugaacaaacaccagugcacugccagccucacaugauugcaugggagcuuuaauuaacgcuggagcccagcaaccuuggcuuuuccugccuguuaucugcuacugucacaccgugaaugguauuugaaucucaccucccucucaccucaguaagaguauguuuguuuacagccccaaccucagcaaugccaaaggcuggcaucgggggcagugccaagcugucccuggauacuauuuaccuuugaggaagaacagcauggguuugccaagcucaauucccaggcuggugcuccuugaauuaaucauggcacaguguucaucucucuggaaaugcccacgccagcccagacacagccucagaguccuuuccaacacgacccuccaggcagcaguuaccaaccaucagucuucagcugaagcuucaagucuuugccauccuuguaaugacagccuuaggccuugccccaagcauucuggacucucuaacacucagaauuguaauguaauauucugcucuaauuuaaauuuuuaaaaauauagucuccuaauucaggauaaggaguaagcaaacuuucugaaaagggcuagauaauaaguauuuuaggcuuugccagucauauggucucuugcagcuacucaacucugccacuguaguaugaaagcagccaugaguaauauguuaaugaaugggaa

SEQ ID NO: 17620 - RNA, 26161 nt, Homo sapiens
acagguuuaaaaaacgaaugcuaauagaacaacuggagaacuucuuggaugaaauucaucgaagagccaaucagaucaaccauauuaauagcaauuaaaagaaaauagaauguggccacuuauuucacuaucuucuucaaauacaaaguaaauacaagacuguugugaucuugcauucauuuucugacaugcauuguuggcuauuugaaauacuaaaagcaaaucuacagauccuuuuuccaucauuuuacagugaccuuuucuucauuuugguuuauuuuuguaaugugaaaaguaucacucuaaaaaacauuuuuaauuuaacaaacuaaaaauauuccuccaaaucucuugcuugucauugacucuugcgugucaauuucccucagguucuauuuucuuaaaccaaccuuuaaaauugucaccucuguuaagguugaacuuugccaaaaaaaaaagaaguuacuuuguaauuuuuggggaaaaaagcacauacauuaaaacuagguaauguuuuguauauacaguuauuuuggauauauuauuguaaguuguacaaauguauuuugaagaauauuuaagaaaagcacuuuuguuauuccaucaauaaaugcucuauuuuacucuugugugguuuaggaaauaaucacauuuaaaguaaucauuuaaaaacauccuaagauaauggaauuuuaaaggccuugcuuuuuagcauuggaaaaauacaccacuugaaguucauguuuguuaagccuaacuguaauuacauguuacauaaucugcauugccuuuuuacuauauguucguaguuuuuguuggccaugccaacauacucccauuucugccuagauuaugggaaugacuuuguauggggcagauagacagauacuuuaaaagcuauuuaaaaagcaaacaacuuuggauauuauugguuuccuuacuucaacaccuuuuccuuuaucacuaggauuguggauggcacgaagcugaagcuguuagggagugguagguuuggaguacaguacaugcucugaaauaucuagccuuuagcagcuucaugccaugcuugcaaaagcccacaacaaauuggaggccuccuuguucugcucugcuguucucacacuuaaacucuguuuuauuuauaagcuaaauggaaaggaaacaccuuuaagaugacuuugcucauuuugcauccccccugaguuucacaggauaaggaaaaccacgcuauucauucuccacccucaauucaacauggccuagaguauccguacugaggaagcaaucuuauggccugacucacucaccauucaugaucacugcugugccuuuuagugguuugggggguaagcaguagaaaagaaggucaaaauagauuuggauuaagaguaggcaaaauaaacuuauaacauuuaaaaacugaaguauuuuuagguuuauaauauugaaaaucacauacccuuagcuuuuuacacuuuaucagacauuuuuuuaaauuucaaggguauagcaaaaugaaauuauaacuuuaugaagaaaagcauugaugaaaguggagaacaugcauuuagucuaggggauuugaaacucucccaauacugaagacaaacccugucaagaaaaagaagaauuuaauauuauauaguauuuucauaugcaguucuuuaagcuuuguuuacuucuauacaaauacuuuuaaguaaugcaagauaacauuuaauagauggaauuguuaagguaauugccuguagucacauugcuaaauucauugagaguuacacaaaauccagaauauauugucuguuccuaaauuauauauauuuagauucuggaauuacuaggaggaauuagaagucauucagauaaaaauucauacuuaacaagaguaucuaggaaagagauucagcccaucccaauauugagcagcuuuccuuaucagaaaguuuuauuuucuguuucacagauugcucaugaccuuuaauacauuuuucugaaugaacccuggagggaggugagaaguagcaguuuuguucaucucuucuuuuuguccuuuaucucucugccacuguucucaccucauccuaaaaccuggucaggaggguuugaaaccuaucagaacuaaagguuaauaucucaucucccucaggcuuuuuucauuuaaaaaaaaaauggguauauuaguuaaauuagaauacuuguuguagaauuauugucaaaggggaagggaaauacaucuaggggaaacaucaugucuuuuaggcccuuuaugucacugaaugacuuaaggcucgacaaaugauauucuuggaaaguuuaaucuugagguuuucaaaucuuuuuuuuuaaugucucccauguuucucauuugcugauugauucauuaguugcucuuaguaagauuugucaguuggaaauaaugaaggcugagacucauuucuaaacucuuccauaaccaucaccagaagagcagccacuguguugugugauguaggcuaaugccucccagauagagguaaagucacaaggacuauuagaauuccaguggauuguggaacugguuuuggauuauccuuauauuuucauucugauuacugaggcaguucugaaaacuccuaccauugaaauaguggugugucuuuuccuuguuuaaggauuuuacaucauuuuuaugcacuugaauuccaaaaucagaaucucucuuuuaccuaucaaccuuuauuggcuauuggcuuuuggcaaugaccuuucuguucaaauguaguccugucucuuuguuuccuuagggaguagaaccuguccuuuuucucaucuuucauuuuuuugacguguccuuucuaagagaaggcucucugccgccuguucugggugauaagugauauuuucaucuaaucguuaugugguugggaugaucauggugaaauacuaggaagacauacucuguugauggacuuuuucucuccaaauaaucccaaauagauuauuuucuagugaaugguuuauaucuuucucgucacaaaaauguuccuuugauuucuagcacaagguacagcaggaugcaaaugauucucagauaaaaugauguugacaguauuuccuuaacaauuuauguaaaacuaugcauaauuuucauucuaacuuuugacauuuuucuccauaaauaaaaguaaugccugauguuuaguuaaaguagauccaccuuugcuugauuuuauuagucuuguucuauccuauuucuuuuuaauacacuguuuagacuugccaacaacucuuaacugagaaucucuuuuccuuccuaggcuaaguaauugugagugggggaggaagaacauuaagagaaauaaucuaaagacuuuguucaauauugucgaagccuaagaauauuuguguguccuucugauguacugaggcuuugccgguaccacaccaucuuuggauuaccauaagguuauguaguaggacuuaaaaguacuagggcaaacauuugauuuuugagaaagaucaacagaacaguauagaaauccaggugcauucauuagaauacuaggaucacaagaggacuacucugguguacucuagugaccugaaaaaacucuaaaaugauaagaaagcuaggggacaaagggaaaaaagggcaagauuuauaauuuauuuuacuuucaugauuuuuccaagugucuucagaaguagaaaccuauagcauuaaaaaaaaaaaucuacauuaacuauauaugagcugagagaaugagaagguaaaaaacauggaggauaaguuuccuuuguacuuacgaaauaguccccuuucuuaggauagaagauagcaacuggguagcuucugaagcaccauaaaaacagcuagaaagaaugcuuauuuuugaggggauaguggacaaaugagcccuuguugcuagagagacacugauaaauuaucugaauccugucaaaaaauacuguaauaccuguguuagguucucucaggaaauagaugaauggccgaucugcuuuaaaaauaggaauccgagaccuuuucaauaacaacagagcugcaggaaagaaagaaaaauuccauugcauuuucugugcauuuuuaagaaaauaacuauugguuaugaaguaaguuaauuuuuuaagaaaucaaagcauccuaauggcauuugauuguuuacuguugugaugggggugcagaugggaaaauuaaagagaaaagaugccauuuagccaauccugucuccuguuuucaacacauuccauggaauaaauuccuuauugaagguaacuuucagaauuauuuuuaugggauggauaucucuucuuccccgucauuuuucaaaaacuuuuuguuuucuuuaguguuccuuuuuaaaaaauacuacaccacaccugaacuuggggguuauggaaagauucagaagugugaagauucaacuagguaaauuucagaaagguagauauggguaagcagugugacuggguauucucugaacauaccuguggcuccagaugccuuggugccuuccuccaaaacuucaaucuuggccuuguggauugcuucagaaacauaaaagccaucuuggccuaaccacagaaaaugauaaaaaugugaguugcucauuaacauuuuucuaacacauuuagaacacauucuuuaaaaauguacuuacaaaauuuauaguauccaaugcugcuuacuguguagcuagggaaagaguggaaaauucuguuuuuguuuuuacuggaggcucagguagcuguuuggaaaauucuuaagacucaauauguuaccaaacuuuaauuuguuauauauauuuaauuuguuaaaauauguaaucgcucccaaaauaauauucagagcacugccccauuuuuucagugguucauuuucagaaaugauucuaguuaaaacuacaaucccuccuucagccaguauuuccuaaacuucagugaucauaggguauguguuaaaaugcagauucuguagcccgggaaucauuuucaccaagcuucagagaucauuucccuugaaugccuuuuuggacugcacuuuaagagccacuuuuaaaugacaaagucacagguuuuuauuacaggcuuuauugaggcacaauucagaguaauaugaaugugucuaguguugcaugacuguauucuguauacuuagguguaucaguuaugcaauuaauuugccucaugggcuagaaucuacaaagcaaaugagagguuaguauaaauguucuaugugcuaacaguuucacagauuauaaguuuagcaaauaggacuaagugauaauuuagaggaauuggcugauuuuuguaagcuaaucauuaaccauuuuuaaacagcuccaaagaugaaaggauacuugaugacacaguaaaaaaugaaagauuuagaaccagaagaaacuuaggaaaucauucaguccaauccuuucauuuuagagugagcugugaacucaccugagaucacacauuugaaaagcagaguugagaauauucugauugaaagcccacucccaucccaccccucuccuccauucaaacacugccgccuuucagaaaguguaugcuagucagcuccaacaugccacugggagguaucuguggcaugaauguuaaaaugaucaguuugaugaacacauauugugugagggagcuuuguuucaucuuagacuaacgcuuaaauugguuuguguuugucacgcacacacaggagauagcccaugaaugccaugagagaauaaaaccagaccaaaauaaagaauaugcggcauuccauccaucuuguaagaugugcacaggauguugggaguuggcuauauucacuguaaggaacaguuauuuuccagcaucagugaaggggacaggaagggccagaggaaguaaaaaucaauagaaacauucacuagugucacuuguccuaaaaucagcaaagaauuugauuuauuuuagcaguuggucuuuuucucuagggucuuuaagaaacaaauuucacuaucaauaauuagccccucuuacuagcuaauuaagcaaacugaaaugcagugccaaaguuacaaagagcuuuaggguuaaagaaugguuauuugacagucaugagaggcuuuuacuaaucuccgagacuucaugacuauauaggauggugucugaacauuuuaaaugaauguuggugaaauaagcagagauucacuaugaaaccccuuaucagcuaaaauacaguaaaugugucuguauuagucugggcaccuuggcagugugagaaaugagaccaguugauguggaugagucugguuagaugggccaggcuauuucaguauuuugaaacugcaacugaagaguuucauuuaaacaguuucucuccaucagacuauaggagugguccaauaauugacauuuauauguuugcacagccauaaaccaagguccauagccuaugucaugccccagcaucagcaucuuuuaaauuuuaucucugguaagaguugacauuucaaaagaccaacauaugcgauaaaaaugagaauaugggagucaucuaugguuuugcauuuuuccucccacuugaucuuguauuacagauuccuauuauuuuuuauugaguagcuauugaaauauuacagaacuaaugaaaugaaccuagaagucaagcacaaagggauucuccuggucuuuuucuacuccccugaaguguugacagcugcuuagugccauugagggacauacgcccuauuuucccaaaaguuguucucaagauuguuuauagguggcauucuguaaaaggguuccaugauuaauuauaugugggagaugcuaaacaguuuugcacuuuuguuuucaguaggggacuucuuagagcugcuaaucugcuaacuuuuauagugaaucucuacaggacaauuauaauacauagcguuuaaccauagaaccacccacaccauucucugucccagauuuacaggauuagcauuuugggaacauacuuugggaaacuguagcccaccauaaacucgcuugcuccuacaauacaacauucuauauacaaagcaaaggggugauacucuuccuacccucccuccuggcauacucuccacucuucuuccauaacaucuucuauggguuuuuaccuuccuuuuuagacuauuagcuccuagaagcauaaaugaugucuuaaucauuuuaaauauuucuuugcccaacuuacauuaaaaauacuugguacauuaauguguuuaguaaaugcuggaugaauuaauaauagacaccccuuaccacuauacgaauggccuuaauguucuuuaaccuuguuaaacuuguaaggaaaugcugauugguguuuguagaaccauaaaggcguggcauagaaugggucaucugcaagucucagccaaaugauuguuucagugcuuuguugguggacaccguuauucuuuguguauggcuggucauacucaaaagguuaaaagucuucaaaacaugacguuguauaaacauugugucccaacauuucauccucagcuucucauaaaucaggauaaacauaucauuugcuguuucuuuugucuuuacaauuauuugcuguagccaguguuaguggcuuuuaaaauguuauugccagaacuugcuucuaguuuaucuuuuucaucuugucacuuaguugcuaacacuaaguguuagggagagggggcuagagagagaaacacauagcacccggcccaggagagggagagagagugcuaagaagaaucugaaauggccuuugaaauuaggcuaugguuaguugcuuucuccauuugucuccucuagcccacucugcaccucuuucuauugcaauucugaccagacaucugguguggcauaaguuaacuuacauaacuuccauacucaaccaaacaacucugguuuguucauuuaagucauaguaacagagaacuuguacuucuuaccgagcagagauuggaaacuaccuacuuauaaaagccaagaacaagacaguuucuucagaguuucaaguuugugcacaaggaguauuuuguggacuaggaggcaugggucuauaucaaagccugcugauccuaaagccagugggauugcuuaagaagaguaucuuuagcuggcaucuucagugugagugaaacuggaauuacucuuaaaagcugcauaacaucuaguaucaaggagacugggggggaacuacacucugguuucagcugggccuugagauaauauugaaugaguccuuaaggcagcaaaaaaaauauuugaugccaagaaggaagagauaagugacuuguaaauggggaaagagaauuugaguaaaaugauucugggcuuugggaccgaaaggccaaauguuugcuguggugguuggaguuccaucaguaguacaaaacugcuugguaaucccucguaaacuggaagaagagaggagaggccaguauuuucugaucacuuacucucuggcaaggucucugcugaugucauacuauaaguaaaugauuuuguuucuacaauuaagauguguggugagugguaguuaccccauuuuaggaaugaggaaacuauuuguuggagagauuugguggcccugucucuagaauauuaaguugaaagcccauuugggcagagaagugguuagucucuugauuauguuuaaagaaggacauuaagaagcaauaauuugguuggcaaucuuuuucuauaaagggccggauauuaaauauuuuagccacugcaagccauauggugucugucucaacuacucaguuuugcugcuguagcaggaaagcagccauagaugauuuaugaaugaaugagaguggcuauguuuuaauuaaacuucacaaaagcaggugguaggccauuguuugcugaccccugcuuuagaggaacaaaacuucaugagagaaaauuaacagacuggcauguuuugucaguaggaaaugugaaugcaagcuucauacuuggcacaugauaauugcuucauaauuauuaaauaagccagaucugccugccuaccuuucugcugguuugagcaaauauaaguagauuugaauagcguuaaaaaaaaaaaaaagguuucguaucaaaaaagguacuuuuaaaacuagguuauuuauuagaucuugccagaggaguuuguggaccuuggaagccuuuaccaauaggggagcuacaugauguguguuaagaucaguccuguuugaggacagaggguugauggcacauuaggauguacuuuuaggacauaaaagggagagcuuuaggaguuaugaagggacagucaguaagcccuagugauucacggaauacagugauguagaagaaaauacagcgauguagaagaaaauacaguuuuuaacucugaucaucaaaaucaccagcaacaacagggaugccauggcugagcucuggaguugcaagaagacacugguuagauuuugcacauuaucaaacauagaauucucuuaaguucuucaucccuugcucuuuccuugcccuccaaucuuuucacuucaguauuccuccuuugcuugaaaugucagauuaugccugugucaguaaggaaaguuucuguuugagucauuugaccaagucaacaguauuuacuugguauccaacugugugccaagcaucguuguggacacaaugcccaaacuugacuauugcuuugcuaucucuuugcguguucaggcaaugaguacagagcugguagauuuuaaacucuguagaauagauucucacuccuguguuuuauuugauaaguaacugucaaucuggucacaucuaaagcccaaaccaagacuucucuuguggaucaaaaucucaauuuuccugugauuccuuaagaaggaagauucugagccaagauuuagaaaaguccacauuaugauguucuagaauucaaaauagugauuuucaagcccuucagguaagggaaaugucaaggccaauggaaauaccagcuacaguaucaucuuugcacagauaauuuacuauccagaguagaaacaaaccugagccuuugaguuggcaauaguuuagccaauggugucuugagaggauuguagaacauagguucuggcauucacucccuguuuauauuugauauaaauuuccuauaauaccauaagcaaacagcaccuauugauugguaguagcaauucaacuuugugcaaagaaauucaaugugguugguggaaaggagaacauuuuaaggcaagguuguaagaguauggguaauuugaaaaaaggaaauuggacagaugagggaagguuucaagacuagcuuauuagaagaggacagagaagguauugggaaggagggaggaaaaggguguagaaacaaagggugacugaagcugaugggacagcaggaggucauaaugaagaaucuauugcugcagcaaugccuuggguacacuccuagucaugacgguuagagggagggucuguuuacugugugcuguggacauugaccccauggugaaggucgucucugaaaaccaugauuaaggccugaagaaacaucccuuccucacaagaucuaacccaaauuugacuguuauuagaagcaacacauucuuauauaaaacagagcaccuuucuuauucuuuuacauaauguugacucugaaaugagaaucccuuaaucaaaguaugauaaaacugccccaaauacacggcuagaacguuuggaagaagaaccguuuuuaccugaaauuccuuucaaguuagcuuugaguggaucaaaaagaucggugacuccccaagaauuuaaaaugcuuuuuaaguugaauugauuuuggauccuaaaccuaaaaggcaaaaacaaaccaucaacuuucaaaauucucacucaauauacuuucauacacaccacaugaaguccaaaaucccuaacuuggaagucaggcuggcuccaccagauuuauuuccagcuucaucuuccauggcgccuucccauaagcccuaaucugaccacacagggcucuuccccaccucuguacucuuguuccugcuguucauucuaagucuucccauugacuuugauugucuuuuaguuauuauccauuuuucaguuguuaccuccuccucuuuucuucagcuauuuugugaccuuugguucuuaaagccccauuaauaccuuguucugcucuuacgauauauagaacauucugcuuccuauuagugucauuuauguuauuguaaacuaccugagaaaaguggcuaucccaauucauuuuuuaaacacuuuuuuuuuuuuuucugagauggggucucccuauguugcccgggcuggacucaaacuucuggccucaagugauccaccugccuuagcuucccgaguagcugggacugcaggugugccccacugugccaggcuccaauucauuuguauuucuuaauaaaaauuaauauuuaaugagugcuuacauuaugcuagauacuauaagagcuuuauguggauuaucagacauuucaucuucauauaacuauguuauuauuauccucauuuuacagaugggaaaaucaagacuuaaagaguuuaagaaacuugcccaagaugacauaaugaguaugugauggaccucgauucaaaucaagccugugugugugcagagcccaugcucuagucaccuacauuuugcuaccucccaucucguguggcaucucacauauaguaggugcagaaaagaggcuguugacuaauugccuuauugacaauuaauagaguauuuuauuuaauagaguguuuauacuggauaaaauauauuuucauauuugcugugugcacuuuaugccuuuggagcacagugggaaaagaauggaacuuaaagccuugguuuuccuaguaaacccuuugagcacaaagaaucacuacaccaauuuuauauuuccccagggacaaggcauuuaaaaauuuacuguugaaggauacuuuaaaagggcugcugauauuauuuuucuuugaaaauaaaaaagaucaaaauggaaauuagauggucuuuuucuauaaauaauacagaacuugcaggagaguaaaaauauugaacaagaccauuuaauaucaaaggucuucauugcuauacaagacaguaugacucauacuuuaaacaaaaguaucauacuuucucauaaagguauguuuugaaucuucagaauaguuuccaaaaaagaaauauacuuucuccaaguaugcugacauuucuccaaaaaacuuuuggacuaucucuuacgaaauuuucuuaaguacugaaaacacauccuuuuugaaaacucuaaaugcugaaacagugguuaugagcauggacuugggaauccaaugccugaguuugaauccuggaucaaguaacuaccugcaaacuaguuacuuuaccuccgugggaaguuacuuugcuucucuuugucacaguccucacuugugaaaugaccauaauuguaaugcguguuuguaggguuguaaagauuaaaugaaugaauccuuguaaagugcuuggaacaauccccagcacagcccaugcacuuauuguuaccauugugauuuuuaaauuauuuuucaauuauguugagaaagaguuaauuaagggcuauuugaaacuaaauaugauuaugguggguaauaaaacuggauaauaucauuuuucauaaacuaaaaacaucaguaaaagugagauaugacuauaaaagauuagagugauugucuuguauggcuaugaaggcagauccagcagaaaugcuacaaaaauaacuugaguaaaaaaauacccuuuaccaauaccagacaaggauauuacaagaaagacaaauuacagaccaauauaccuuaugaauauagaugcaaaaucuucaacaaaauacuagcaaauuaaauccaauaccauauaaaucucaccaugacaaagugggauuuaucccaggaaugcaaaguggguucaacauaugaaaaccaauuaauauaauauaccauauuaauagaauaaaggacaaaggccacaucaccaucucaauagaugcagaaaaagcauuugacaaaguccaacacccuuucaugacuaaaaacaaacaaacaucaaacauacaacaaacuuuggauagaagguaacuuccuuaaauugaugaagggcagcuacaaaaaccccacagcuaauaucacacauuacaguaaaagacugaaaacuuucccccuaagaucaggaacaagacaagaauguccacucugaccccuucuauuucacaugguacuggagggcgaguaggacaauuaaaugagaaaaagaaauagaaggcauccagguuagaaagaaagaaguaaaucuaucucuauucacagaugacuuggucuuauacauagaaaacccuaaagaauccacacacacaaaaaaaaaccuaucagagcuaauaaaugaguucaguaagguacagcauacaagauuaagauacaaaaaucaauuguguuuguauacgcuauagaacaaucugaaaaugaguaaaaauuaaaaggaguaaaauacuuagaauaaauuuaaugaaagaagugcaagacuugcauaaugaaaaccacaaaacauuguugaaagaaacaaagaaagaccuaaauggaaggaaagauauucugaguucauggcccagaacauuuaauauuguuagaaaguaauacucaccaaauugaucugcagauucaacacaaucccugucuaaaucccuccugcauuuuuggcaaaaauugacaagcugauucuaaaauuuauaugaaaaugcaaggggcccagaauagcuaaaacaaucuugaaaaagaagaaaguugaaggacucaaacuacaguaaugaagacugugugguacuggcaaauauacaaauaucuaugccuauaggauagaauugaaaguccagaaauaaacuuagacauuuaugggcaauugauuuugacaaagaugccaagaaaauucaguggaggaaagaaaaaucauuuuaacaaaugauauugggacaaagggauagauacacacaaaagaaugaaguugaaucccuaccucauacuauauacaauaauuaauucaaaauggauuaaagaccuaaauguaagagcuaagccuauaaaguucuuggaaaaaaaacauacaccuaaauuuuugugacccuaacuagacaguggugucuauucaauauaauauggcaucgaaagcgcaagaaacaaaagaaaacauagauuaauugagcuucauccaaauuaacaacuuuugugcuucaaaggacaccauugagaagugaaaagaaaaaccacagaaugacaaaguauuuacaaaucauauaucuguuaagguacuaguauccagaauaaagaacuauuacaacucaauaauaaaaagacaaccaauuuaaauaugggaaaaaccucugaaauagacauuucuacaaaaaagacauuucuccaaguacaugaaaagaugcucuaccucauuagucauuagggaaaugcaaaugaaguccacaaugagauacuacuucacaccaacuagaauggcuaaaauaaaaagauggucauuaacaaguguugacaaggauguggagaaacuggauuccacacacauuacugguaggaauguaaaauggugcagugacuuggaaaacaguuugauaguucuucaaaauguaaaauguaggguuaccacaugaccuaguaauugcauucuuagguguauauccaagauaauugaaaauauauauacacaaaaaaaugugcacuugauuguuucugguggccaagaaguuaaaacaagccaaaaugugucuaggcacucaaauaucuauaaauugaugaauagguaaacaaaauguacuauaucaauacaauggaauauuauucagucauaaaaaggaagauaguauugauucaugcuacuaugaaccuugaaaauauuaugcaaagaagccagacacaaaaggccacauauuguauaauuguacaauauguaauuguauaauuucacuuacaugaaauucucgaauaggcaaaucuauugagagcaaauagaucagagguugcugggagguggggaggggagcugggagugacugcuaauggauaugggguuucuuuuugaggugaugaaaagguucuggaauuaguagugaugguugcacaacuuugugaacauacugaaaaccucugaauuguguacuuuaaaauggugaauuuuauaauaugugaauuauaucuugauuuuuuaaaaaagaaacacuccuagaaaagcauaaaccacacaccaugauaaucagcagcuccugggaggaagggcaaaacucauuuugaauaugugggaucugguggauuuuaagaagauauauauuauaucuaauaucaaaacaugcucaugcucagccuucuauguugaccuaauaaucaaauguuuuauucauuacauacauauuuggcauuauuagucuuucuugugggacaucauaugauugugguuauaaacaacccuuaacacauucuugguuuucuugauuauuccuuuaguaugcuaagcgucccucaugaagauuaacagucccuaugcacuuuuuuuauuuauuuauaaauaaaagguuacuuuggaagcuagacaccauaauucguccagaaucuacuagugcacugcuuggugaugucuaaccugaaagcacaucucauagucacacaauuuugcauugcuacccacagugugcaaaauuuuuuugcucuuguuaaacgaaaaaugccugcugacugcagagcaagucauacuaaaagaagaaugagugauuugagagaaugagagguaaaucccugccuaaaagcugacuuugugucuaccgugauccaaaguuuauaccuaaaucuagaccuaagagaguuuuuacuuuuuuuguuuuguuccccaaaggauuuaaagcuagcuuaaaaacaaacaaaaaaaacuugguuaguuuuacuugugaaauaacuucauuuuccuaaaaaccucuauccuccuuggacagcagucuugguagucuuaaggagauuuaaaaaaaauuaucagaaugagguuaagugcuaacuaauaguuguguuacuaagauuucugccuugccuugccuucccugccugccaguguuuuucaguuuucaaacugcuugaggguuugagacuccuaaaagcagaaucaggacgguggagaguucucaguggagcugggaauuuccccggggucucuuccagggaagaacugcucgaggaugagucccaccaucugucucuuaaacccaaaaagguuguggcgaauucucgcaccagccuccuuuuucucucuacuuuugacacggaacgcugcucuuccuucccuugcugaguuucucucaaauauaauaggaagauuaggguugcuucugcucccucccugagagaucuguugaaauauccaguauuuggguuuugguuugggguccaaauauuuaguuuugagagauacacuuuaccuuagaguuaagugcaccuuuugcccuggguuaugccagaucucacuuuagaccuuggcccuuaacuuacugggucucucuuuguauuuuuuccuucuagugcauagauuuacuuuuaacuccucaagggaguacugccaaggacuuugccuuugccuacuggaagcccaggcaguggagagaggccaaggcaucuaguggcuacuggacaacauuccuugcuuaaugcuggucaaaaaaugguuauaaauuuacucugauuucaaauacaucacagaagcucaucauuuaaagaagcccuaagaggagucuuuuuguaaaguuaugaguuuugcuaauagauuuuguuuugaaaaagcaacauagaaugccaccacuucacuuuuugauuuguauuuguaccuauugggucuucuuaaaggagaguucaccuccauuuagaaagaaugagaaccuucugcacagagacuuaaagugucaaaauuuuaugccuuaauuuggcgucugaucagaauuuuaucuguacuugcucaauuacguaagucaucuuaucucuuugguuuuggaaaaaugacaguuguauacucuuaggaugggauaagauuugggcaacguuccuacaagggaaccacgagcauuuccuuuccaaaaacugguccagccuagggcuggaucaggggguccuggggggcuccauuccagcccagugaaggcagaauaucuugucuuggaaagacucugggaaguuaguucauuucagucugugcugugagcuagccagcaguggcucugaaaugaacucaaacucuagggucacuuccucuuggucuaacuucuggggauacauauuaaacaagucaucccaguggcuaagcacagacccuggaggcagaccaccugugugcaaauccacgcucuucugacugcuggcugcacagcaccugugagggggacucagcugcucaccugggcaggaacacauccauccuggcucuccucaggcuggugguccagagguggauggugcuggcugugagguguggcucgauguggcucaggggggugucuuugucacggggcagcaccaggaacagacucacugcacuucccagguaaggaagcuccagcacccccaccugauggccugcaguguccuggaacugaccugaggguacaguggaucagaggucagcucugucccaggagccaggagaaugaaccagugucggacccugagagaggcuggcucagaggacuggaaacaauaaaaccgagcauccaccucacccucaggaggcgguuucaggccaaagacuguugggcgauauggucauuuuauaaaaauccuagaccuagagucuuuaagauacccucacaggaccagaguuagagguucucuaggacuggguauggggggggggacgauggcacaugcagaaccacauagaguagugcccccuuauccuuggcagauaugcuccaagaaccccaguagaggccugaaccuguggaugguaacgagcccugcauauacuauguuuucucgaucugaugacugagauggcuacuaagugaccaacgggcauacuguagacagccuggggaugcuggacaaagggaugguucauaucucagguggaacagagaaggacgucaggaaauuucaccacacuauucagaagggcgugcaguuuaaaacuugagaauuauuugugaaauuuuccauuuaauauuuucugaugcggauaacugaaaccucaaaaaagcaaaaucauggauaaggguacaggguacuacuguacccgaucuuaaaggagcagccauucaaucccggccuauugugccugccaggguggcaguuugguccaaacucuacuagugcagaaggaaaugucaggcaugaaacugaguuucucuuccacaucuguguccucacuguccugucagagcacacugucccacacuccucucuaaagucuccgggcaccuuagucuuuccuuccgccaugcaugcccaguccagcagauggacccugcggaaacacaucccgaucccuuaggagcagggaccuggccuccucucuccugcccucaggcccaggcuuccucucccuuuagacaaaccagcaggggcagagcucaccguaguugaccucggucguuuggugcaucauggggaccugaaggacgaggccauaggcacaggugaaaggcaggaucugugugucuguggaggagaaucucuuucgccaagugccuuggaaggacauggugcucacaagcacaagcugagcaaaugcugcacugacuugcucccacggccagccaccagggcccucacuggggcccccaccugcaagcaggaaagcaagguggccauggguuaaaugugcauugaaacugaaccgaacccagugugugugcggacaaggagugcagaguuaaaaugcgaaaaugcaggucuuuuugcuuaagguggucucucucuucaucuuacaauaucuuuuuagucuacuuaagaauauuuaauucccugucucagcuccuugugcugucagggacccaaggcaccaggagcugcucucaacuuuuggggacuguugagcgauauggucauuuuauaaaaauccuagaccuagagucuuuaagauaaccucacagggccagagucagaggcucuguagggcuggguaugggggcgacaaugacaaccccugcugggggaugaggguguggagagggaaauggaaagugagaacucagaaguccugacaccugggugaccagucaggggaggugggggcagugagucaucucuggaguuggguugguagaguauuuauuaaaauauguucauugcaaauugauauguguuuauaaccagcuguugcugaagacccugcuuuuuauucuuuucugaacagguugggaugcugcuccugguucuguuuggggccauuuccuaggaauuauuagacauucccuccccaggcagacccuuggaaggaguaugugcugugaugggagauccugcacauugucgcccccaguccccacccugccccgcugcugagcugaaucucucacugagccuuugcuuagaaaacaauauucaagguauggucuuuguagggcugcaguuaaaauuucaugcagugucagaaagaggagcuggcagaccacccuuaaggggauaguuuuugucccagcuguuuauuuguuuaauaugcacacacuuugugauaggcucuguucuaagugcuuuagcaaauccucaccgacuccuccuaacaguucuauuauuauucccuauuucacaggugagggaacugaggcucagagaaguugggcaaggucacauacuuaugaggggugaagccaccauccacccaguuacccaaugcaauguggauugcauugaaauagaacccuagcagcuccauggaaagcuuggauuugaacccaagcagccuggcucuggacucugugcucugagcaacugagccaacugccccuuuuucuuagaggacaaucagccugcacugggagcugcuucucuggccuuacgcccuggcagcacaaggaugugagcagggaauuaaacauauuuaaguaaauugaaaagacaugguaaaauaaaagagcaugagagagaacuuuaucacaaaagauguuaauuuuugcauuuaauucugccauccuuguccacacacuuacuguuuuccauucagucguaguauacauaucacuuccuauucugcuuuuuuuuuuuuuuuuuuuuuuuugagaugaaaucucacuguugcccaagcuggagugcagugacgcagucucagcucacugcaaccucugccuccuggguucaagcgauucuccugccucagccuccccgaguagcugggauuacaggcacaugccaccaugccuggcuaauuuuuuguauuuuuaguagagacgggguuucaccauguuggccaggcuagucucaaacuccugaccucgugaucugcccgccuuggcaucccaauccuauuuugcuuuuuaaccaacacugggucuugaauguucuccacauugcuaugaaacuuuugaaaugaucaaggaugcuggagccggaccaccuggguuagaauccuggccuguggacccugggcaggaggcugagccuucugugccucaguuucuccauuuauagaauggggagaguaauagcgccuaccccuuaggauuauugugagggugaacugagacaaucaacugggagcagugcuaacuaaauaaacuaaacacucaguaaacguucaugauuuuaauuaucuuucauaauaauuacaacuguauaacaugcaggugcugugcuacacugauucacaccucauugcugggcagcgaggcuguuuguaagucucuuucuucaauaacacugagcuaaacaucuuauuguguguaacuuuuucuuaaauuauuuccuuaaccuaaauucccaggaaaccacuuuuuuuggcuccuguugcacuuugccaucacaggugguuuauuauaaaugagagcagagcucagucgggggacaguugcaugggagaaagccugugggguccuccgaggugggaggcucugaagagcacaauucuguguucuugugugcucuuguggcucgugugugugugugugugcccauguguauauuugugugggagagggucagagcaggaagagaggcagaaagggacuuaguguccccuugucauucaaggguaggaucuccuaagaggacagacuucugcuguaauugaagguggccugagcaccauggccucugacaagugaugggugagacucugucucugcagcccucugccuuagccuuguugaaauguacaguuuucuuuuaccugcagucucucuggaggccccuucgcuagucuggauggcggugcuauugggcucacugaggucggcugguuccaggcugcuguuagcccaccaggagacgugcuccacaaagcagggggacaguggcguucccacuugcacaaaaaggcugcaggccagcuccaucucggugccuuggcuggagguggguaguguggcauaaacagcaugcaagaaaucuuucacccuuuugucugugaaaaacaaguugggauaaguugacaauggugagugugaguaaggaguuagcacaaccuccagcacacauugcauugagauggaacgccagcaacuccacucuugcucauaagguucaucuaccauacaaagccaguuugaaaaagucauagcuaaugugcucagaaaucagccuggauccaccaauuaaaaguugggaagaaaccaugcuagauaugaaagaaaucaagcugcaaugaagucaaauagaaaaacacuaccaacauccaguagaugaauagaggauauucuuccuuaauuuucugcuuuaggaagguugauguguguuggaguagagauucuagggcugggaaaacagcagguccagggugcagggugaugggguuucaaacacaucaggagauuuaugugcaauguuacagugacaaugaugggagguggccaggauguugugcugucaauaugucuuguacggggcuuuaaauccauucccacaacugcgugucaugagccugaguaacauuuggauucagccuuguguagaacuaugcuuucaauuugagaaauacagaggaaaaguaagaacuccucccaucccccguuucccuaagacccagcagacagcuuguguuauuaaugucagugaaaggcugcaagaaugucaaggaaauaauaagcauuugagggagucgauagcuuccaccuucguggauggcagcuggacuucuauuuauuuacuguuuauacaggagauugcuuccuucuuuccaugaucaauaguggauuuuguuuucauguuauuauucacaagcugcagcuucuguccucccccaggcaucccauagcuggaacgagggcucuugcccacuggugaguccagacacaguggcguaccccaagcuucucauuccugacacaugcaagcugaguguuuccagaagugaagcccccuugcuuaggcugcuucuacucccuuuuaggcacagcccugcaguuaucuacaaacccucccuguaagacaaaaugcuggguaucuuuuccuccacuaccuggcuccggcugguuuucacugggaugaaacucucacucacuuggggucuguccccucugacacccuucauguugcagaagccaagccaggaggcagcagcagaccccugaguuuccuggcuaauguucucuggaggcacgggaacccagaguccacccuggccaggguccccagccaaacgaggcugcagaggacaauaguaggcagacaucacuuguccacaauauguucacuaccgaagcugcuccugagaauccacaauugcaaaagacugacucagaaucuugaucucaugaaucagccuaacuuaagugcuugcauuugaguguaguaagaaaaaaauggauaaaaacauacuuauaaucagauuuuacucuaucgaggaaggucacauguauuucugagaucacauuccuaggaauguugacugucugcagagaagaauugaaacacuucccuuguccauaguguggugugaccugaggaauggucacagaacucuccucuccaucuuuccacccucucugggccaggggacccacauucuuuuagucagaaacauuaaaauaguagaguaaguuggcuugaagugaauuuuugugugaaaucuuuucucugcccuagccuaguuuguccaugcacauuugcacacaggaagaacauuuuuagaccugccagaauaugcaaugacaggguaaaaaaugccggagguugacuguguucauagacauugugcuaaacacucaacacuccugaucacacugaaugcuuuugacaguccugugaauugagggcuauuauuauccccauuuuauauaugagcgagcagaggcccagacagauuaacaaaggugcucagugucacccagguauaggugguggggcuuuacugcccugcucacccacagggugaagaauggguaggccgggaugacccugccuaggacagcuucauuccacuuugaaugaacgugaggccgcagagcucauagccucuuuuuuuuuuuuuuuuuuuuuuguucugucuuugcugaauuccuagauccuagucuaggaagaaaaauguuaaugugugugaguaucuguuuuagcuggaguugguagauugguucugaggccaggcauugagcugaggcacugagcguaagcagaggggaagcugaccuggcauucgaaagacucaugcugcugccggcaaagccgcucuaaaauacauaauccauagaaauaagcuggcagaucuggcacuggcuagaagucacagauuuauaaaagcagguuggucaaaagcaugggcucuuaaaccaggcagccugggcuugagucccaacucugucacuuauuggcucugugaacuugagcaaguugcuucaacucuccaugccuauuugcucaucucugaaauugggaugauaauaaaauuaucauccucaacagagcuguugugacaauuaauucaauuaauguuuguaagugccuccagcacugccuggcaccuaggaaggcacuaugcuagggugugucaaaugaaacugaaacauugccaugaaaccuauuagguuagaagggaaccuuaaaauucaagggucaccaccaucccaaagucugaaugccuucugucacagaccuguccagugaucacucuuccccaugugcacaccauagggagcugagcucccuaucucccagguagccugagcagcagggugagcuggagagagugagugugaguaugagcagcaggguaagcuggagagagugagugugagugugagcaggagggugagcuggagagagugugagugugaacaggaggguaagugagugugcacgugggcaggccucuuaccauggacaguguaccccagggcaucugccagcugcugaccagugcucccuucugcuccaaacugcaggaucuccagggggagggacacaccagcaggagagaugacaaaguucgucucauuucuacacgcggccacacucugguagaggugaagugcaaacucagucuucagcaaugucauuccuucacggagguggccauuugcucggaggcagcaagagugaaagaggaagagggugaucaggaaaggcggcauggaggcugggaggguuccugcaauucagagggaagagaugcaggguaggcuggaagcuggugaugaaagagggccaugucccacagaggacugggacccccagcucuguuuuuaggggcuagggacggcugagggagagaugcauugagcugucuugguuaccuacccugaggcccagccgucugggcugcagagcugcacccucuuguuucagcauuagaaauacucacugugguccuuuggcagccaaacugugggucugaagaucugcuucggccacuuacuggaugugugacuuuagcaaagcccuggucagaucagaagcaaagcauuauguugggaaaagaaauguaagagguaauccuacucauuguucuugguauauagucagcuuauagcugugcugugucuaucaggaauaauaauaaauaauuaucuacuauguuaaaaaggacuuuguacauuugcaguuaaucaucccaacaaucucacuaguaucuguuauuauauuucaucuauaaagaggaugauugaaccuuugaggcccagugacucauuuguauggggaaagaaacagugcugugacucaaauccuggucuucuaugagugguauauaaaauuuugagaauaccuaugugaauuaaaauauugauacaugaacuaauuguaccucgaauaucagaauucuugugaugcaaauuagucucuaaaaaagaauauuuucacaaagauaguuccuaccccagaaauguacucuuccaaggaagagagaucauuaacuagaaaauaaugcaagaagagaaaggcaaaguaaaaaaauguuuucaacgaccaugccacacauccagccagcagcaguuuuuguuaaguugucugacugugguaucauaccaaacugauguaagaagagguccagagucacuuccuggacucaccagugagcagcucacccugcuacucacgcucacacucacucucuccaacucacccuccuguagaaguuuacaagcaaggccacugagcacgauggugccuauuuuagguaaagguccaagauagaaaacaucuucucuuuuuuccaacccuuccucccuacagccaaguacaaaugcagugcuuggaugaccuugguacauagggcucucucucucucucuuucuuucuaugugugugugugugugucccagcccagggucauuugcaaaacucuuaagccccaggguucucacagcucuuauaaccucccaucucccacaagaacacucucagcaaucagaccuugaugccccugggcuccccaugaacaaaucccugucauggcucaccucgaaugagccacguacucacagacuuuuguaucacuguugcacguuuccuugcucgacucuguucuugugggucu

SEQ ID NO: 17621 - RNA, 1621 nt, Homo sapiens
ccuggguucaagucuggagggaaggagggguuguuuagcccuaacuuugcacuaaaguaaccuuggcuguguaauuuagccaucuaagaaaacgaggggauagacaccccauauguucucugagcucccuugaagaugucuguaugaaagauucucuccuuuucaugucccuuccgugccacuauuccgagcaucagucugacccuaggaguggugacguccuacucagcugggggcugccccucaguucccauagaggcaagucuggguccugacuuggccaauggcccuggaggccgcugagcuccucaggcccauagcgcagaaagugggcgauaggucauuccaggacaagggggcggaggcuccaagaaacuacgacucccaggaggccacuggguucccuccggcagccugggccuggugcauguugggagcaguaagcggccucccgccgcgcuucauuguuaagaccgcuaggccagguagcccgcgcgcaugccaagucacgucccaacgaguugggcggcuuuccuuccugcaggccucuucucuuuccggucuugcugaggcgcuccuuuccccgccccaccuccgcccucuuuucagggaauuucgaaggggcguggcgucuggcaagcgcguccccagggguguguauacgcgcguucacgggagguuaaagagggaggagccuaacccuuggguguguaaggcagagagaagaccgcgaggaacggaaagcgcaugcguccuaguggugcugcagcgcccggggagucgcggaggggaggggugaaaaugggcuugcgggacugacgcacgcgcauugggauaccagauccccgccuccugcuccagguuuccccuccuccuucaccacccucccggaaguggagccgcccucgcgcccaccagcggcuacccccugcggcaggccccgcccacacaggcuccgccccccggcgcuccgcccccuccucuuguaguggcgccggcuugcaucccaggucguggcgguuuuggugccugaagcagggagcgcggagucguucccgagagaggcggccaggcuaugcucgccgguuuccggcguuccgcuccggccagccagagucucugucucaaccuguguccgugcuccagcagucuccucagcccggccccgcggcgcgguuggcggcggcgccccaggcgcgcccccuccuccgauggcggcggagauccagcccaagccucugacccgcaagccgauccugcugcagcggauggaggggucccaggagguggugaauauggccgugaucgugcccaaagaggagggcgucaucagcgucuccgaggacagguauggacuacugccauucggccgcgaggaggggcgggacgggccgacggcccucgagcccgcgucaggggcugugccuucacgucggcgcgaguguagacuugcucccccaaguuuuauuguaaugcgcauccugguggugccgguguucagcugcgcgccgccuccgcuguguggcuccgggaagcggagccgggacggcggcgagcgcuccggcuucaccccgggcuggguagugccugcgggagccggguggcccucgggcuaacggug

SEQ ID NO: 17622 - RNA, 8343 nt, Homo sapiens
ggacucacaguaaaggccuuugccaccggguacgaaccuauggccuggcgaacggcauccacguuguaugugaucuggaauuccggcacgugcuugaggaccuccugggccagcuccucgggugugaagcucauggcgcugacauuguagguccucauggaaagggacucagcuggggccuccaugaccuccaggguggcucugaggcagucgucaauguacaucaugggcagucucgugcaggcuuccagguugcacucgaauuugccaugcuuuguggcaucauggaaaaucuggacugcauagucugaaagggaaucccguauguagguuauaacaaaacaaugaaugagccucuuggaucaaggcagcaguucucaaauguucuagucucagagucuuuuuauaacagauucuuaaaaauuaagaaguccagucaagcucaguaacucaggccuguaguccuagcacuuugggaggccgaggcaggcagaucaccugagaucaggaguucaagaccagccuguccaacacagugaaaccccagcucuacuaaaaauacaaaaauuagccaggcgugauggcacacaucuguaaucccagcuacuugggaggcugaagcaugagaaucgcucaaacccaggagagauggagacugcagugagcugagaucacgccaccgcacuccagccugggugacagagcaagacuccaucucaaaaaaaagaauugagaacucccaaagagaucugacuaauguggguuauaucaauauuuacugaaacagaguuaacugagaauuguuuagaauauuaccuuuuuaaacgacaauaagccuaucacauauuaauauguauaacauuuuauaggaaaaaggguauauuuucuaaacaaacaaaauuuacugagaaggauggucugcuguacauucuaaaaaucucuuuagggucuggcuugauagggguccgcuggagcccccaucugcuucuguauccaguccguucuuaucucacacgccacaccaccucuggaaaacucuacaaugcauuugugaaaguagagugaaaaaggccaguaacgucuccauauugauaagauuuuugacccccaagaccccuugaaagugcuggaggaugaccggagcuccccagaucacaccuggagaagcaccauauuaaaaagcagaagcuuuuuaaggccugcuuccaaaucccucugaugcggucaaguaccuuccauauucauucucaggaccacagaugugggaaggauaccugaugugggacuuaugaaacagaaugaguguuugaguccaaaauaauaaucauacuuauguuccuuucacauacacaaugccuagagucuauuuuaauagggcucucucugcguguuaagaaacgagaggcugcugcuugcugggggucuuccuacacugugagucacagauuuguuguugaauauuacguuuuauucugccacuguggguggccaaucccgagcugaacugacaacgcuggcaugugcuacccuuagugaguguaagccaauuggguucacugugcuuuuaaaaugcauaucgggagauauuacagaaaaacucuggucagcauacagcuaaaaagauagcaaauucauuuacuacgaagacaacuccaccuagcaauaagucagucuauuuuuuuuuuuuuugguggguguuuuuuuguuguuguuuuuuauuuuugagacagggucucacucugucacucacccaggcuggagugcaguggcacgaucucagcucacugcaacccuggccuuccgggcucaagaggcccuccugccucagacuccccaguagcugggacuacaggugugggccaucaugccuggguaauuuuuguuuauuuuucauagagacaaggucccacuguguuguccaggcuggucucuggcuggagugauccuccugccucagccucccaaagugcuggaguuacaggcaugagccuccgcaccuggcuggaaagccuaucuaacauauaagagacauaagaaauagaaaacacuuaaccaguuguuccuccuccaggcugggagucagcugaaaugauuccaggauaucucaggcaucagaaaucuaacccauaccgguaaugauaauaccaugaaaaagagaaaacguauucaaacacaaauauuuuaaaucagauagaugcaaaaaaaacaaaaacaaaaaaaaccaaaaaacacccugccuuuuucugaaaucucauuccaugcaguuauauuuaaauacuccuaaagaaaauaaagacuccuaaguuuuuaucuuuuaaaagaaaucaacuuuuaggugguacaucaaugcuguaaaugacacauuagucuacaguaggcauuuccagccacucuuuggaaaggcgccacugaucaucauucugaacgauucagccugagugcauucccacaagcagcacggggaaaagcagaggagagaacaguggaugagagggccauggcuaugacagaacuggaggagcaggcagcaacucgaaucuacuagaguuauaaagauaaagaguauuuugcaguaguucacaccuauaaucccagcacuuugggaugcugaaguggguggaucacuugaggucagaagcuugagaccagccuggccaacaaggcaaaacacugccucuacuaaaaauauaaaauuuagcugggugugguggcacgugccuauaaucccagcuacuucggaggcugaggcaugaggaucccuugaacccaggaggcggaggcugcuaugagcugagaucacgccaccacacuccagccugggugacagagcaagauucugucucauaaaacaaacaaacaaacaaaacaaacccaagauguuugagguuuuagaguuacuaccaauggcuaccaauacuaggagccagaaagaaugguggaguacaagacaagcagcaaaugaagagaucggggcugggcacggggcacccaggaagugcugaguguucccauauggcugaggagguuucaggagcuggagacaccugcuacauggcaaacccagugaguuaaguaagcgacucuggggcugggauccaagaagagguaaaguuccuccagggaugaaucaccaggccuuggaggcaaaacgaaugagaaagcaaacagcaaaucgugacagccagggcacauucagcaauccagcugagugaugcuuacuucucccaugagcuccgcguggaccuuggacaccccauagaugguccugggucucugaauacagagaucggggguuggguuccggggagagguggguccaaaagccccaaucgugcuaggcacaaacaauugcagauuguguuccgcagcgacauccaggauguuaugcaggccugaaaugaacagacacuaucagaaucugaaaacaucucuucuuaaagaacuagaaaaacuggcaaauaaaucacauccagccagagccagaugcuuaccaguuauauucacugcucucgccagggaaacauuugcuucuccaaaggcgcugagcaaagcgcuguaaugaaacagccaggugaugcgguuguuuaccacgaucucccgaagauucuuguaauccaagauaucagaauaaaugaauggaccugcaaggaacauaaauugaaaccacgaacgugaaaaggguugugaacuaaauggaccuuuccccuuucccccguugacuugugaauuucacugguagccacgcaauaacuaagacagcugggcacuaggcagcauuuuucuuacggaagaaucacaagucacaaccaccccgcgccagguaaugacagcaaaugcuccuauaggaccugccugggccagacccuguccuaaggacauaaguccauuucuuucccacacagccuuggagguaaacacauuuuacugauaaggaaacaggcaccgagagguuaagcaacuugccaggaucagagaacaaguggaggaaauggggcugcagcuaggcaucgggcuccagagugggugcuguuccucccagcccuguauacacagaguggcuucacucugcuuccaaggugcacauuugaaaaggaauagagaaacggacuuauucaccaccaccaccaccuugguauagaaaacccacaaaccaugaguuuaucauacuuaauuacacagagguaaaguugaucuugcucugugccaauuuuccccacuuacagcaaacugucacucuuccccauggugagcagcaaaaggcugaugcugaaccaggaaggacugggggcauuacaaaaccuuauuuuuggggcagcggggacagagucuugcucugucgcucaggcuggagugcagugaugcaaucauggcucacugcagccuccaucuagugggcucaagugguccucccaaguagcuaggacuacaggcacgugccaccaugcccagcucauuuuuaauuucuuguggagacagggucucacuauauugcccaggcuagucuugaacucccagacucaagugauccucccaccucagccucccaaauugcugggauuacaggugugagccaccaugccuagacauaaaaacauuuuugaagcaguaaaauccugauuagaagagcuugagaggugugugugugugucuguguggauguguguguauguguaugugcgugugugugcguguauguguaugugugugugcguguaugugugugcauguguguauguguguguaugugugucugugugugugcguguguggguaugugugugcgugugucuguguauguguguaugugcauguguguauguguguaugugcguguauguguguaugugcguguaugugugugugagugucuauguguguguguguguaugugucuuuucguuucuauucuugauuuuuguuuguauucucuccaagucaauaaguuaacuuaaaacacaaaaagacaggaaacaaaguuuucauuuccaauaacaucaaaauauauuauuccaaaaacuucaaggucaaaagaauucuucuguucuuuuaucacuugaacaagcagcagcauuaaaaauauauauuuuuuuauuauacuuuaaguuuuaggguacauguguaaaaugugcagguuuguuacauauguauacaugugccaugcuggugugcugcacccauuaacuagucauuuaacauuaggugugucuccuaaugcuaucccuccccccucccccaccccacaacaggccccagugugugauguuccccuuccuguguccauguguucucaauguucaauucccaccuaugagugagaacaugcgguguuugguuuuucguccuugcgauacuuugcucagaaugaugguuuccagcuucauccaugucccuacaaaggacaugaacucaccauuuuuuauggcugcauaguauuucaugguguauaugugccaaauuuucuuaauccagucuaucauuguuggacauuuggguugguuccaagucuuugcuauugugaauagugccgcaauaaacauacgugugcaugugucuuuauagcagcaugauuuauaauccuuuggguaaaauacguauuuuuaagugaaauaccagugccucaauaacuucucuuugagucauaaauucagcuaugagcugcugcacgcaccaauuucacgagccaccucuuugugccuugaaaauuagagauaaaaauaaaagcaagaccuauugaucucuuaccacugugaaagacaugaucgggggguuuccuuaugucagacaaaaucacacuguccuuuccaaaucguuuccuaaagggaaaauuaacccacacaaguuggcaacaucuagaaugcaaugaguccugugagaagucuuuuaaaauaagaacuguaauuuucugccagccuccaaaucucuacuuccucuucauccucaauucccacaccuucaauucuuaucucucucacacucaggccucuauuucccugcccacgacucucucuucuguuucuccucucaccugacuguuaacccuaugcuugucaccgguuucuucccauuaccccccagaguuuuuaccucuuccucaucauucuucuuaucuucucuccccucuucuuauucucuuaccccauucucuccaaaucccacacucuucccuuccaguuugcaccuguacuucccuugguucucaaacaacuaaaagucaaagugauucacugggagaugugugucucacuuugccuaaguuaggaaacagaaagagagcaaaggaccagucuggagauguuaagucaagggccuacgacaagucugggauauucagaggcaaaauaaaauguauuuuaggcugggcacaguagcucacaucuguaaucccagcacuuuggaaaggugaggugggcagaucacuugaggcgggcagaucacuugaggccaggaguuagaagaccagccugggcaacauagcgagagcccaucucuaccaaaaauaaaaaaaauuagccaggcguggugguaugugccuguagucccagcuacucgggaggcugaggcaggagaaucacuugaacccaggagguggagguuauagugagccgggauugcaccacugcacuacagccugggugacagacugaggcuccaacucaaaaaaaaaaaaucuguaucuauaucuauaucucuauauaucuauaucuauagcuauauauagcaguuauuuagauauaucuuaacaaugguaaggagcaagaggagagagaaaagaaguuuaaaaggcaucccaaugagcuccauauacuuaacaacucagauuuuaaauuucaaguuuuuagggcucuuaccucaaaagauuagcaagccccacucccagcuggccaagagccccuagaugaagaagaaaaaaaagugaagguuuaaugcaaaucuaaacaguucaauuauucccagaauguaauaacugagugagacuaguuuucagucuuagcuaacuacguaaguccuagguugcacugauauaacugcugcuuacuuccaaucuucccaggaacguggugcagcgcuuagaaaugcaaugaucucccccaugcuaggacagagaccaauacagguaacauucguuucagagacaacacuuaccagcauggagugguuccgagaaagaggagaagcaagggcauuagaagagaaaaaucucaugaaagccagacacaggucuggaauuucuuggggcaggaacucaaucuuggccuucauuauuuucaugaacuuugaagcuuaucugcuaugggugacaaaaucauucaaaaccaguaugaacagauucauauccaccucuggugacaugaggcagaaucccauccuccauuagaaguggacugggauaugaaagggaaaagaggcagggagaaaccaagaagucauuugaaaaaggggcagacaacugaaucaacaaggcaccacugagaaaguuaaagugaauagugcagcuucuaguuugaagaauuaaacaugccacugauagaaacgggaggccagugggcuaggagcacauuuggguaaggacaacaguccauuucauuugagagaaacugaugaggcaggaagauauaaaagugggacuuccuguaaccauuuguuaacuugggaauaaaaccaggacacccugaaagaugcaucauuaggggaggugagagggaauaaaacaaacacucggacaacacgaugggugaauccgaggaaaggcagagagggacaucuacuaagcuugaaacuuauuucagcaccagaaguggacaaggcagucaaagaguacacacacacacagacacacgaaaaugagaaggauaaugcuguaaaaccaagggaagaaagccuggcaagaaagagaaagaaguaaaacauguccaucaaacuggagguagguuugggcuggcuggaagugacagaguaaagucuggagugagaaggauacaaaaucaggggcugaacauauuugaggugaggagguucagggagcgagucacuggcaaugaugaccucaauggcaacaaugagcucaagggccaugaugggcucgaggacaacaaugaacacugcagcaacaagucccuugaccagacgcuaacuuaccuucucuauuuccaacaugcaaaugugcaauaacaguuugggauuaaugacucugaguuuagguucaggacucuggccaaggaacagcgugccuaacaccagaaucaauguucuagccccagcacccuccuguccacuagccuucacuccccagacugauccuaauauggaaggaaaccaaguuccagagcagcuauuuggccccca

SEQ ID NO: 17623 - RNA, 18148 nt, Homo sapiens
caucuugccagaaguuggcucagaauaacaggcagcucuccaugcucauccuucccguagcauuucaagguaacuguccaucuccuucacucuagagcaagaagaaaggagaagccucuucuauccauucuguucugucuccugcacuuuguccugugaguggagucaaguuaaaggagcuucuuucacuuccccagagacuccaccaggaccucacauucccaagggcauuguagcugccauuccaucuguucuagggagaacauucaugaacccugaaaggcuguccucuucuccagcugagcauagguuucgcucgggcguacaggcagcagaccugguuuuccaggacacgugccauucaaggccauugggaugggcugaaagguugauagcaaaggucuugaucuaucuuuugcaggaaccuuggugcuuccaucuuccacuugccagucgggugaccacagaaaagagauucuggagaguagaaacuucggucaaguugccccaagucagggaugagccuucuuuccauggagccuuccaaagggcaagccgucugcuacuguguacuguaaauucagagcuucaggagcugaggccuccugugcuugggggaaagguagcugaggagaaagggacaccuucucaccuuuuguuuaccuuugaucuggcugaacuuagcugcccuuaacuucuaguuugcuuaaguccuuauugccuuaauaaccaccuaauaagcagucagaaccaggagagaagccccucccguggaauccauugcaagccuguccccagucuccccacugcugcuaugccugaaaagagccccagccccgucuccaaagcccaggguucgccucuugcugaaagagcaacguucccaggcugaggacaaacccaggacugcucaggcggagagaucccugcccccacguucaccacugacaacccaacuccauccucagucuccguggcuucagaucuggacuccgcacccuccuccaccuccaccucucuucccagagacccuccccacaucaugcucagugcuguuucugaagaccaucuagacuuuuguguucucuggaacauucuacucaccuucagcugcagcacauuucuucagccucuccaccaagcucuuuaaaaugaaaggcaguuacugucuucccuuggacaauaaugaauguaucuacuguaugugcagaccaugucgagaaguggcuggguuaagaaaaaagaggguuuuuguaaagccuguuuauuuuuuuaagucaguuuugagcauuucuauuuuaccacccuucacaugguuuuggggaacccaaauuguaucaaggucucaugccaaaacaagccaaaaguuguuuucuuuaccuuuuuccuccaugcaccaugauuucaaugauuguuucagugucauuuuaaauguuuucuugugacauguacugaugauaaaagucaucuugacaaaaaaaaaaaaaaaagauuuauacaugaaucagaaaguauuuauuucaauuuuguaccuuuccauuuuaauacauuauaauguauugacucaacggagauaauauaaacaguucauuuuaauaacacacguguguguggcuuuuccuuuaugcauggugggggaggggcaaaucaucguggaguggaaaauucuggcagcugaggggcauccauugugagcagaggguggccucuggcugcaccaaaugcuuucugcaccuggaaguuagaaucagcuggcacugagagaagagguguuaaagggaaauugagaagguaaguggguggugacgucuccaggcaccagcugccucuccgacggacacacaccuuccaccagguaggaaaagccaugcacagagcagagcuacccacucccggagccuaaaugcaggcuggcaauuggagguucagagaagggccagguaggggaaaccccaaagaagcuaagacgagaagaagguggagagaaaacucagugcugaaaaugagggucuggagguggggagaggcagaaaaguccuggguuguauuuucucaauguaacauuuuucccccuaaugccuuugcuagaaauucugcaaauaaauccuuggggcaaacuggcuucagaccaagccccauggacauccagcagagguuucuucuugccccauuaggaguauuucucacugcucaauuaggaggaauacagcaucgaauacaagcauacucauuccagacucucccggaucgugcguggcagguggggauggggugaggcuguggcuggugcagggaagagcagggagagccaggagggagggagggcaugucaaaagcgacuguauccagaggguuugauuuaaacauuuuucaaaacauauguggcaaacagcguggugaguguaucucacgacguuauucuccacucuucucugcaugcuuggaccuguuccacuuucaaaaugugucauuuuggaaggaaagggaggaacaacuacuugaaaggaauacacgucaguaugagcccuuucuccucagcagaagguugccccaaaguaccuccucugaggcgagagaaaggagagaggaggagagacagcuuucaucaaauggggcacccaggacucuaggggagagaaggcacguucucaacaaauggcccuuugauccaucucccucaacgucccuguucucuccauucccuuuucuccuucccgauauuuucaauuccgaaucuucuauacccgccuccuggguacauccccuucagggcaggcacccagagcucaggcuugucuuugucagaaaaggaaugccauggagcauagaaacacugaggggcaaguagaggggccucuuucgcuuccuccgucacccgcaccccaccuucagucuguccugagaacacgcgugacuccugggcaggggacugugacuagauuauuucaaguccuaauccaagauguuagaaaggaaucagucaccaauuauaccaaauaaaugccucuuugggccuaagaaggggccaguuuggggacacgucuaccaggaaagaaacagaaagcccccucccauccacucguuuccaaaucucuuuuccaaaccucuuauuaaacugaugaggaaucuucagcuugcagaagguucagcuguuuagagagaauuuugguucugcggagaagauaugggaagcuccuacugguuaguuuaaacuauuaauagaauccuuccuaaauugaauucucaucaaaggcaauuagagaggacucuuuugaauucuggcucuuggggaauuuaggucugggauuuaagauucugccucugugccagcauauaauugugcucgugaaucuggacccugucuuagcccgucugggcugcugucacaaaauaccauagacuggggggcuuauaaacaacagaaacguguuucugacaguuccggauguggggagguccaagauaaaagugcugcuggauucagccuccugugagggcuuucgagucacagacggugcccuccagcugugaagaggcucucuugggccuuuuucuaagggcacuaaucccauuauaaggaauccacccucauggauaaucaccucccaaaggccacaccuccuaaucccaucaccuuaggggcugggauuucaaugcuugaauucugaggguacauaaaccuucagauuauagccgacccucuuuucucugugguaaauggagacacuugggcuuccuugaucccugguaguugggguugcugggggacuauugugagcaaacccugucacugagugaacugcuguccaguuagcacuugcuggcgcgcgcacgcgaacacacacacacauccacagggcuccccacucacagguggcccacccaucugccccugggacuuuggccccagccaucucaucaugcacuauggaggcccguuuggacacucuucuaaagccaaggcaaauggaaguugagcuaccccuuccuuugugcccucucuucuuccucauccugcuuccugcuuccugcuggcucccucuccugcuuacucucucccaggcggccugaucuccucugcacccagguggaagcccauugauuugaaugauggucccuucucagaaccucauugccacaggcagguugcaauugccccugggcgucagggguguuucaccucaucauccccgcccuaaacucagggagaggggcaaagcauuccauguggccuggggccugccugacacccccuuggcugcuagaacucuuaagauuaagucuccuguugcuucauugucuaguggcugucuucauccucaaaagaugucuuccgucuggugcagugagcuggcauuucuuuuuuuuucucagaguggugcugggggcgcaugcacuccuguaaguucacacucuucuccuagcuucccagacccucacuuuacauccaucaaggccuuugccuacauugcuucagggaaagacccaccuucccugcccucccacacacaggcaccaugauugcaaaacugugaggcaggaaugguuguaggagagaggcagggagggcaagggaagccccggagccuugggccaccaucaccuggcuacaggagacaccuuguccuucagagcugcugcucagauccccuccacaccccuccaccaaugcuggagagggagcacugaucuagcccaauguuaaguuuccagaagaggcugcagcgugcacgggacacagaaagugggagcuggucucacaaaugaagaagggaacaggcuucaggggcuccuucgacaugacgucauacuuaggaaaaauauacagcacaaagcaauauuuaaggauuuuuauguacuuugaaaaaaacccaacucuaccugaauuauacucccagaugcaaacucuccccauccaccuccuccugcacgggaaauguggucucagcaucuggggaggagcuuucaaaacuggccuaggaauauggaaaauccgauggauccuacccucugccugggaauaacacagacacagaagccaagaggaggaaagagcacacucggaaaauguucucuuuucuguucguuuucugggaguagcugguccuguauaggccccaaucaagggccuagaaucauaaaauacuguuggauaagguuaagaaaacauauauguuccuuugggaaaucaggcccgauuacagccuagacucccuuauucuccuacuuggugagggaugguccuggauuugcuguuaauguuuaggucuaauuauggcuccucucagcggaaaacauccucacugucagcugcguuuuggcuggagugugaauuuccauguggggcgagcauugccccuccaagggucaccuucccuggaaccuccgagaccaccaauguggucuucccuuccgcgcgcuguccguccccuccccgcgaucugcuucccuuccccgcgcugacccuucccuuccccgcgcuccccuucucuuccccgugcugacccuucucuucccugcccuccccuuccccucccugcgcggacccuucccuuccucgcacugacccuuccuuuccccgcccucuccuucccuucccucaugcuccccuucccuuccccgugaucuccuucccuuccccgcgcucccuucccuuccccgugcuuccuuucccuuccccgagcuaacgcuucccuuccccgcgcucccuuucccuuccccuuccccgcgcuccccuucccuuccucgcgcuccugucuuuuaaccccacaagcacgcgugaggugagcuggaucuucccaagugcccucacugagcaucaggcaagagucacaggugacaaguaaccacuagacaaggaaauacaaacagccgagccuccagggaccuucccccugccugccuucucccggccuucccccugccugccuucucccgcguguucugagcuauuuccgcccugggcccaguggguuggcacagccgccagacaccgugcccaaauccuccauuucucagccucuucccucaauagcuugccggcuuuuccaacuaggccaagagagacgaaucccaccaggccguuucccugccccuuucuguugccucccagaacccuaauucuucuuccccucgugacugaugccacaaauagccucgccuuuuaggggagaccacaacuccacaggggcagccauauacuuuguuguaccaaaauaaucaguuauucaaagaguuccagcucugggaucagaaugccugauuauuauuauaacaauuccugauuauuauuauuauuauuggcucucacuaucuguaaacuuguuaauaucuccaugccucaguguucucaucuuuaaauggggacaauaguaccaccccccucacagggauuuugugaagaauaaauaaaauuacauauauauaaaacaugucaaacaaaaacgguuaaauaaaacuccauaagguuaaauaacugauaacuuagcaauacccaccccuccccccaaccccggggccagcccaccuggguuuccuaaucugccuggcaccucucccuacccacugacucccgccucagccuuuacucugaaaacaucagaggagagugcucagaauuaugccaaaggcaguucuuguccaaacagaaagcucucccacggcuucuuguuucaaagcucagcauucauccgggcuuuguuauauggacagggguccuaggcccagggagaaggaaagcuuaggauggaaacuauuugggauguggccacggugcucugggggcugacccgguuaaacacagacucaucaucacaacugccugcuccuuccuuaacuuacaauccacuuucguacguuguuccccgccgcccccgcccaccgccuccgcuccauauucucuuucucuccauguugcagauacagaaacgaagccucacagaggccggguuaccuccuucccuggggaguggcagaguugugccuggccugcugugggccccagacucaggcucuuccggccacagccccuggccagccugcugccucccgcucccaaacucaacacgcccccuccuggaaagcaaaacagguacucacugacugcagucggcccuacauggagaacuauauggagcucuaguuaacgguggauggaugugccaguccuaggaacagcaaagcaggaggaagagcuccugagacagagagggcacugaagugagugcuaauggcaaggcaggcagugcagcuugcacaaaagcuggaaggaaguucccugcucagaagaccuacggggagacaucagaaaggcaggguggcugaaaucaugaaaaagcaugagcccucgaagggaaugagacuauaaggaaaagaggagaagaccaaacaaguucaggugauagcuaaggcuacacaucugcaggagaaauaauagcaaagggagggaaaagaaaaugcagggaauuaccgggcaugguggcucacgccuguaaucccaguacucugggaagccgaggcgggcagaucaccugaagucaggaguucgagaccagccuggccaacauggugaaaccccgucucuacuaaaaauacaacaauuagccgggcaugguggugugcgccuguaaucccagcuacucuggaggcugagacaggagaaucauuugaacccaagagguggagguuacagugagccaagaucgcaccauggcgcuccagcuugggugacagagcgagacugucuuaaaaaaaaaaaaaaaaaaaaaagaaagaaagaaaagaaaaaugcauggaauggcugggugcaguggcucacaccuguaauuccagcacuuuagaaggcagaggcaggaggauugcuugaaccuaggaauucaagaucagccagggcaauauagugagaccaucuccacaaaaaauaaauuuuuaaaaauuagccgggcgugguggugcuagccuguagucucagcugcucaggagguugaggugagaggaucacuugagcccaggaguucaagccugcaguaagcuaugaucacaccacugcaguccagccugggcaaccgagugagaugcugucuuaaaaauuuuuuaaaaaauaaaagaaaauguagggcaagcagaauauggcaaugaaaggauucaggaaggucaggcaguggcagagaaugagugccaugaggcugggagagaucuuugguauuggaagggaccagcacacuuuggaaggugccuauaucaugacaucuucacucugugaacacuauggaaaagugaggacuuucccacccucggucgcaaaaaacagcguuuuguaaaucucauccuccacuagaagucaaauuuuggagucaggaggcauccccgucaucacuggcuuugggugcgccacguagaguuggacuucaaagaaucauuugcucugugaaaaaggaaguggccccaagcaagaguugacaucagugaaugaagcucuucccuucacuguacgucacuguuaccuggacaugugguguuuacccugauguacgguuucugguaaaccaaacuggaguccaugaccagacuccgggccuaagugaggcugcuucucugccuugagucuaacuccuuccccagcuggcugaucuauaagccugccacgcucguacucacagagagggagagagguggaaagcaagaugggcaaggcuucccggagagacaacucuggcucagcccauuccuuuugccaucacagagaaagccacaucuaaguuuguggcuugugacuuuugccaccgacagugacuuugaccacuagaaaaugugguccaauuggugucuuggaaucugaccccaucaguucaguacauuguuaauugucuaauggaggaguaagcuggaggguagcccacagaauaugucuucuuaaccccacuccaacuucucccaagcuacuaacagacauaaaauguggagucauggcagagcagagcugcugcagacacacuaugugcaccagaagccagggcgucuacagaggacccaaugguggccaacugagugacacuuucaacagcuccgcauucacauagucauccuauaggggucaagugguuuccaaaaugcugacagauuucugucaugggugccuauaauggguuuccagcaugccuuggagugaguagaugaguuggaguugaauuuccaggcaagacacuuauguccauuccaugugcggaccacacuuuccacaguugcaugccccuuuucucaaauuaaugaauagaaguauuuaaacuauucugauaucauaaagaaguaacauguauuuuuauuauuuauaaguuuugauaauauagaaaugcauacuguagaaaauaaaagucuucuguaaugucuuuccccccucugcugaaaauaucaguauuaacaauuuggaauagagucucccccaauuuuuccaugcauauaauaaccauauauguauguauauauagacuauuauauauaccuuuuuuguauuuaaaagugggauuuuaaaaaauggggugcuacaguuuugcaaaugguuuugacuuaauaucucuugcaacaaaguuuuuuuaaagggacuauguauaaauuaacacuguauaaauaaaaguguccuaaaagacuuagagauauuuccuuaaaguaaugccugaugcaaguauuuguacucuauggucauggccuccucuuuaucaccccccucaaccagcaauaacccccggcuagugauguaacaggucacgauucugaaggguucuauguccaaagaaacucccccccaccacccaggagucucucauuuguuaccuacauggucaucaguuguggacagaucaagacaguggccuugguguauaguuaaaaacaaaacaaaauugugugcacugaaaacaggcacaucauauacugaguuccuucuccgugccagcugcuguccugagugguauauaucacuucauugaauagcaaugcauguauugucuuagucaguucaggaugcuauaacaagauaccagagacuggguaacacagucuuauaaacaacagaaauuuauuucucacaguucuagaggcugggaaguccaagaucaaggugcuggcagaauuggugucuggugaggggccacuucucaccauguccucacaggguggaagggacaagacucuccaggaucucuuuuauaagggcauuaaucccauucaugugggcuccacccuagugaacuaaucaccucucaaggucccaccugcaaauacucucacauuggggguuaagauuucaauauguaaauuuuaaggaggaaaccaauguuccaucuauagcaucuacaguaccuuugagguagguaucauugcuauucuuacauaaauggggaaaagaaagcauaggaaauuuaguaaccugcccaaggucaacagcugguaaguggcagaggaagacauacauagaauaugaagaauaagagauggagcagauuaggcaccaagagcugcuuguaauucucaaggcaacuggcaguggccacuugcaguaucaugaggcaucccaugugcucacagcaaccccauggauuagcaggugaggaaucagagaggggacauaauuguaggugucacagccagauuugaacccuuaauuuuggaagucauucuguuaauuacugcagcgaggcaaaucauuaugggaaggacagacuauacccacagagcuccacaggcuguggagugcuuaccuggagggcagcagaagcuagaaagaaagcuuuagaaggggucagggagagccaacagugagacucgggaagccuccuuagaucacuccagaauguccacccauaaccaccgggauagagccccugccugacaugaugcuuucucacuuaggacaggagucuuuagccagcagugcaagucuggagacccucucaaaugggugacuaaaucgguuaccaucccucucuccguucaucaucuugacucccaccucauccccauaccuuccuugugcagguaucugucucccugcccuauccccacugcccucuccucugccaccagcugccccugaaaacauuuuagaauauaagaaacuaaagugucacuaucucacucaaagguuagggaaugcuaguuuaggacaauaaagaaagcaguuaucagacagugaagaaaucagguuuuucuuuugacauaauaaugcuaauuuggauuccugggugugauuuuugauaguugggauuuacagguguucacaguacuuuugugacggccacagcuugacaucacacaauguugacaggaaguaugcacagagaaggaaucucaggccggaauugcugccaggaagccagaaggcaucccuggacugugauuaauauagcgucuucuuuucuucacacugcucuuggcuagaguuugucuucuuugaacuucuauaacauacagaaacuguaagagaaggcaagaaaaaugauuacaggagcccuaggggaugagagcgcugaguuggcauuaacugggcauaggacuuuaacaaaaacauuaucacugacaaauucuucugacccagagacacaagcaacagaaagcugaguuuaaagcacauugcaggggcaacaaccucacaaaaucugagacuuucccccaggggauggguaaauaaacauguugucaaucauccauuuccaguguguuggacuaagugggcaggccuuuuacgacacgaugauaggacugucagagaaagugagaaggucuuagguaggggcugcaggaaaaacccuccauggagugaugagccuucuguuccuugggcaauagcaacuggauugauacguuuggggaguguaugcauaagcauaggagaggucuuccaaaacuucauggaaaggucauauuaugcauggauuucaauuuuuuugcaccaaaauacacuuguaauaacuuguuauaacauguuagaacaugaucuaguuugaggcacuaagacaucaauuugaaagagcccccuuucagaacaacaugaauucugcuaaaauugaagcaagaacaaacaccaaauuuauggugaagcuuggguggaauggugaaaucacugaugcuuuauaaaaaguuuauggggacaaugccccaaagaaauaagcaguuuacaagcggauaacuuacuuuaagaaggaauaagaugauguuaaagauuacaccuauagugguagaucauccacauuaauuugcaaggaaaaaacuaaguuuguucaugcacuaauugaagagggcuaaugauuuacaggagaaacaauagccaaaccauagauaucgcaauugguucaguguauacaacucugaccgaaaaauuagaguugagcaaucuuuccauucaaugggugccaaaacuauugcacccagaucagcugcagacaagagcagagcuuucaguggaaauucuaaacaaguggaaugaagauccugaagcacuucuucggagaagugaaacaggaaauaaaccacagcuucaccaguacaauccugaagacaaaucacaaccaaagcaauggcuaccaauaaauggaaaugguccagucaaagagaaaguggacuggucaaaagccaaggucacggugacgguuuuuugggaugcucacacacaaaaagaugccacaggcugcaucaguugucuuuaggaaaauuagagaaauaacccaaaauguuggugagggaagggugcaggagagaccuacggcaaauaucaauggcagaauuagcuugaaauacauggaaaaaaaaaaucucuucuucuuuuacccugccucccccaaugucuacaauauacacaaaucuacuaaaauuuaagaugcucuuucaaauguuuaguuuuuuuuuuaaacagcagucguucagagcacaugauauuuuauuuuucugcaucaugucauuucagguuuaucugucaucacuaaagaaaaaaaaaaaacauugauucuguaacugccugauggguuucucucgcaggcuaaccagauagaccugguuuaucaagacaggggaauugcaauagaagguuuaauacacauagagcuagcuaaaugggagacuggaguuuuauuauuacucaaauaagcugucccgaaaauucagaaacugaaauuuuuauacaguaguuuggcaggcaggaggcuagggaauggggauugcugauugguuggguuggagacgaaaucauagguagucgaagcucuccucuugcaugagccacuucuuggguaggggccacaagaccagacgagccacuuuacuggccuggguggcuccagcggauccaucagaaugcagaauguuauggucuauuauaaaacaccaaucuuagguuuuauaauaguaauguuaucuauaggagcaaauagguagguuagcagucuuguggccucuggcuguauuauaccugagccaugguggggcuguuucagggaggggcuguuaucauccuuguuuuaaaauuaaacuauuaacuaaauuccucccaaaguuaguucagccuacacccaggaaugaacaagggcagcuuggagguuaaaggcaagauggaguugguuaggucaggucucuuucauugucauaauuuucucacuguuauaauuuuagcaaaggugguuucaauucaaaggcaaaauuugguuucuuggcuuaaaaccuuuacaguucuaauuugccaguuacagacagaaugauucuacuuuuuaaauacuugacuuuuguaaguacucacagcuaguauacaaauuguagguuauuugaaauagucagaguauuagcaauuucugcuuccggccaugauggaguaaagaaacuggauuuacccuuccaccuucacuacaaagcugggaaaaauagacaaaacaaugguuuugagacauugagcaacaggcagugaaagacugcaauccuaacaauuugguaauaaaggaggugagcccuuugauagcccucauuucuggccugaagaguuuccagguugcagcauagggagacggaacucagacagaaccuggaggucucacugagcuaaggugacaacaaucaaggaagcuaggauucuuggggccgagugucagagagaagagaauuauaccaagggaaacuccagauauuugcagaagcguccccucaagucuucaaaugaagauugagcaacacuugcacuggaggaaacuacugggaaagaaccaccagagacaagaaggcagaaaaauccccagagcucacacagggccaaaagcaacuugcguuuccccaguggaaauaauuucuaaacacauggagcaucaagcagaguccuugacaggcugcugcuuuaacaaugggaccagauuauaacuaaacuuaaagacuauugugggcccaucuagcaaaacuuacacaaaaggcuugcaaaggccacauuuuccccaaaggacuuaacuaucccagaacaaaauauuugaaggaauacaaaagccuucagcccccaauaaaguaacacucacaaugucggauguaaaauaaaaagguuaccaggugugaaagaugcaggaaaauaugacucacaucaagaagaaaaauguaccaaaaaaaaaaaaaaaaagcauuaggaagaucaaacaacaacccauaaccuuaccaacuagauaugguuuucagugaagaauuagaguauuaccuuuuagacuuuaauuuaauauguauuuuuuaauuacugauauuaaaugaacuaugaaugaucaacuugguguccuagagauuuuuuccccuuuacguaucuugagcacuuucucauguguauuucacuuuucugcuuguaagaaucaacauucacuuggcuuaccuuauguaaugggagguauauuagaaguaugaaaaggaaauaagacucucagcuaaaugaaccaagguaggaaaaaagacaaauaaucggaccucacagggagugaaggaccaagagugcagccaggcucugcaagcaaguucgcuggggccccagggccucuccagagccucaggagaagcuguuagugaaugaguguucccucugaugcucugccuuagggagaucuagcccuuauuaucucagucuuccuucucuucauacaucuuuuggcuucuuuuguuguacagaauggcuucuggccuggaucauucaaauccguccuacaugccugauuaguguugccuagucuagaauuucauauaaauggaaucauauagcauguacuucuuccacugagcaucauguuuuugaaauuaauucaggggccagcgaaauuuuucuuaaaggaucagacaguaaauauauuagguuuugggggccacacagucucucccaacugcuuaguucugcugguguggccagaaagcagccaaacaauagauacauuaaugaguguuuaucuauuguuuagcugcuuucuggccacacuagcagaacuacguacuugggagagccaacuaccuguguagaaaaaaaaaaaaagagaaacuacuuuacccuugaguccauucauaccuuugcucaugucauggacuguuaugcaaagaaaggucuguggaucauugguauccacauuuuuagacccuguuauaaaugcagaaucuggcucaugccuguaauccugaaacuuugggagcugaggugggaggaucacuuuagcccaggaauuugagaccagccugggaaacauagggauauccugucucuacaaaaaauaaaaauaaaaaaauuuagcuggauguuguggcacaugcccguagucauagcuaccuaggacacucaggugggaggacugcuuaagucagagaggcagaggcugcaguaagccauggucacacuauuaugcuccagcacggacaacauagugaggcccugucucaaaaaaaaaaaaaaaaggcagaaucucagacucacccuaggccugcugaaccagaugugcauuuuaacaugaucucugggugacuggcgugcacagucaugucugugaaguauugcccaagggagucugcugagacacugaaggacaagauggaauggguuacauuggaucaccuucuuuuaacaagugcaauuuccacuccagcuggccaguuaaaauacaaacaagauucuguaauuuuuuuuaaaucccaaacuuaauaauauucuuuuucaguagaugaucuccauuaauauuucauagccauauagaaugcugggguugaaacaaaauaggaaaccauccugcauucaccaaaaggcagagucccuucuacaauauuccucuguggccucuaacugagcguuuccaggagacaccucauuguaacagaagauccaacgauaacuaaccauuuaccaccugaaccauggcaacaggccauaaaugucugcuucgaucuucuugaccaucuuagagacaaaauuaccuuucugaaaucauauaccaacacaggaggugcuugaaaaacucugauuuccgacuaauucaguauucuccauucuauauaacuaccuuccacucucucuggcauaauccaauagaucugcuaauuauccuaagauuuuugugauccugccuuccugaguccagugcccuacuuuuaaccuuguucccuaugucacaaugucacagcuuuccugccuuggcugggaaaauuccauucacuugccuccccucacccccucaguauucacugauagcuauaagcauccuuuuguguuucuucuaacuuuuaugaaacuaggguuuaccuuuuucauccagauuccuaguuaaagggagaauuucauuguaaacaagaaucuaguccuucaauugcuuuucuuggcaccugaguggugcucuuuuuaccuuccuuuuauguaggaaaggcuucugugugcacugucaccugaaguuuacuggagagucacucacccaaaaacaugucuuuaccauacuuaaaaguguuauagcuaagagcuuauuagaacuccccuggagacagggauacuugaauuaaauuuugcaaacaucuauggagccuuaccauacucacauuauuuugcgaggugcugguacgaauacagaaauggauauaauaaaggcaaccuuccagugugugcacugugguggagaaaauaaauaaaaccuuugccuuguugaaggcaucccauuauuuaaagagguaacauuuuccccacaacuauuuuguguggggucccacaaaaaaaccgauagauagcagaccuaucuucugauaucuaucuacuaucuaucuaucaucuaucuaucuaucuauuuaucuaucauccauuuguuuaucuaucucagaaagcagagguaggguacgaggaagagaugggacauuacaaugcaaaguccuccccuccagccaaguuuuucaaacuccuuguccauacaacauccaugacccuaaguucagcucuuuacacauuucuuuuccccgugaggcugagcugcuugagggcaggucacgucuuuccacuacccuucuugccggcaccuagggcuuccugauggagacccuacagguaauccacgugagcuuaugcuccgcggcagacacgcccaggcgggcuuuacucacaucaauagcuuaguacgcacacucccucuagccaaugagcgaauacguacuccuuucuccaccucccgcagggcggccaccgcccccucagucccucuuucucccgucaccuccccagguugccccgcccugcuccgcccccucgccgccgcgugcucgaggagcgagucgcgcgcuacugacgucaccagcacgcgccccguccgcugcaguccgccggcgagggaguuacgcacguccugauucuccuggagucuccagcccgcccaguggccgcagucacccagguccagaggcggcgguaucacaggcucuccgacaugucuaugcuggcugaacgugagugucggaagcggaggcccgacccaggcgcguuggugaagaugccgggugacgcgcacggcagcccggaguggcugggagcucggguugccggcgcgccuggcgcaugggaucgggggaccggggagccgagcccggcucugauuguccugcucgccgcagagcuccccgaaaguuggccgcaggucugcuagugaga

SEQ ID NO: 17624 - RNA, 74728 nt, Homo sapiens
agaguuuacaaaaaaauuuauuugugucugagagccacgauugagaacauuaaaaagguccuccugggaauguaacuugggggaaauguggcgagagggcaggacucggcagcccaugggcaugccacaagaugcgcccaggcgcucuggggugaacucugcugugacuucaggccagaggugucugcccccgcagugcccugacagcugaguggucggaaggccccggcugggaaggauucauuuggaaucuuucuucuucuucuuuuucacuagcguuucuucuaguguagcguccucugcuaucucuacugguuuuugcagcuuuuucuucccucuccucuuuuugggcuucagggugaagucccggcccucaggcggcugcacaugguccccugcauccugagcagaggccuuggaacucuggucccagcaggggccucugagcugcucuucugcuggcgcgcucuucuucuuggccacucgcuccugggccucggcccucucgggcuuucccuccgugugccucuuggccuuaggcuggagguaacuuuccacaucuuuaccuguggccucuuuauuucuuuucuucccccuuuuacguuccaccugcgucucagaaaugucagacccuggaacuggaaccuggggcuuguucuucagugcugccauccgcuuggcaaaguacuccuggauggugaaggcgcugguugucgugguuucguucuccucuggaguggagggacuggcaucgcccuauggugggcagaagaguuaaaaggcagguaagcaucaacuguucaucccucaccgcacccaggaggcacccacacccggcgcucacaccuggcacccacacccggcgcucacacccggcacccacacccggcacuuaggagacaaggcugagugacacgcucccuuuggccucucucccuucuggucggccugaacugcaggccgggagcaaggcggccacacacuccggcuggguaccagguggggugguagaugacaggcagaagcuaaugucagaagggagcaggcaagccgccucgauggaauucugaguaaaugucucccuagaaacaaguguuguggugacuaagcucccagaaucucccaucagaaacagggacacugguguuccagagcuuggugauuuuguuagacaccgauuucaucuucauuauggguuacaugggccccuguguugaucuagaaacuuagacgccaucuggauagguuaaccuuccaugaggacaggagccgcauuccacccuggaaccuggcuugccaggggcacccuuucucccccaaagguggagcguggccgcucuggcagcugcuccugaagggagggcagaguggagacuccgcgugucucagccuccucccugaaccaacaggccagcuugggggcuucuuucccucagcuggggguggggaguagagaaaugcccccuccuucccuaacaaaaacuguauacucgggacuguguuugggcuguuuuuaaaugugaguuacucacacauaacagcugggauuaggauuuuaauuuuaaaugaguauaucucauugucagguaauaucugcuauaagaaaaaaugugaaaaauguauauaucuaaaaguacauuuugcuguaaagcuugagaagcgagagaaaauuccuaaggggagaggcugggauaaagaaugaaaugcuggaaucgccauuugggcugaggcuggcaguaaggugaggaggagugccugugaggcaggaagugcuuucggguugaagacuauaaggaauaugcucggagucaaaucaaugucugcagcaacucugcccacagagacucuggaaauaagucauuaagcaaucaugcuaaacuuagguuuucauagucacccaacuucuuccuucauacucauuuaucucacaagaagaggcuggguguucuacgcuuucaugaugggagggugggaaacggcuccugaauaaagaaaucuccaaaucaggauucuacuaaugauccuaaacuuggcuggcaagguucugcuugugcagguaacugaauuacaaaccaccuauaaacagacccuguauugucucgacacagugguccucaaaagccaccucaguggaauccaagauaaugucccaguugcaguuccagcagaaucgauauuaauauguaucaauggacaauugggccuucaguggcaagugccucagacagcuuucaccaagggguacauuaaaaaaaaaaaucauguggucaauucuggaauuucaaaauaggcagaacaugaagaauaaaucaacugaguuuugggaagcaguuuuaauuuuaucuauuacuauucaauuugugcuggaauuccauagggugauuuugagaaaaauaaaaaaaaucugccucaggagauuugucuuuuuguucuucaaauguugaaaaagagcugaaaugcugcacagcagagugaaggaucuucucaaggcucucccggcacgagccaaucccaggcucaugaacaagaaagauccugccucccaaagacgggcacccucacagccacagagacaggcucggugaccaggcacccucacagccacacagagacaggcucggugaccaggcacccucacagccacacagagacaggcucggugaccaggcacccucacagccacacagagacaggcucggugaccaggcacccucagccacacagagacaggcucggugaccaggcacccucacagccacacagagacaggcucggugaccaggcacccucacagccacacagagacaggcucggugaccaggcacccucacagccacacagagacaggcucggugaccaggcacccucacagccacacagagacaggcucggugaccaggcacccucacagccacaaagagacaggcucggugaccagacacccucacagccacacagagacaggcucggugaccaggcacccucacagccacacagagacagacucggugacgacggcuggcucguuuaugcaacagaagucucacugacaguuucgcagcacuacaggagccugcagucugugggccacucuuuuggaauguauuuuugaggcuggaacucagaucugagucgaauccuaugacuccuuaccuugcucaucuauuuauuaccuugugaauuccugauuuuaaucaccggaacuaauugcugguauuaaucacauuuuuuauuaucaggaaauacaagaccauuuuugagucacuuguugaauucagcgggucuucguaacuccagaaaguaaguaugcucauaugcucaucaucaacuucugggauguaaguuuaauaggcacgggucacugcacaggcuuggcagggcauggagacaggcuagagaggggccagcacccaaguccuacuucuucccagcaaagugcuggccacacaaugacuggcuagagagagcugcuuaaugcggggguagccacccucccacaucacagaaacgugccuauuuuacaagaccauggacucaaaggaaaaauacauugaaaaucugacuccugcaggagcaauggccaggacucaucuuuuauacaccaaagucggagacucaguuucacugcagagauucuaauccugcuucugcauucuugaccauggcaucacauaaaaauagauacaucuuuucaagaaaacuaaugcuuuuacaucuggucucuaucaaaguaaacaaguauugagaaaacaaguuacuuuuaagcauuuugaaaugacaauaacuugcauuuucccacauuuccauuaaacacacaauacaccucaaaaaauaaaauaaaaaaaaauuuaaaugcgacauucacugcuucauaaacguugagaaugucuguuugcuaacugugugccaaaaccuaaugaaacaaauuuaagaguaacuugaaaacuucugguuccauauaaaauacuaccaagaaauaugguuaaucaucuugccaaaugugauuuaagcucagggauucgggaaaugucucucucucuuuuucaaauuccaaugcuugcuguucagcuaaaggagguuuuugccacuaauggcaaaaaccgugauuacuuuugcaccaaccuaauaaaauaagcaggacuggccuagucuguucacagcaagccucacaguccucucccuuccuucagcgcuaaugagugcaucacaugugucaaaaacauuugaugacugacuuucccaaaugguaagugggccuuaauuucuacccaaucaauaaguacuuguggcuuugaacugagaugacucuggagcaccuguuccccaguucacagagcccugagaguuuaaagccaggcccaugggaucacccugcucaaucauuugaggaagcuucacccaaagugaucaggccuggguguccugaggaaggcagcuaucaccaccgugccaggcacuugacaucaaguggcaucucagccaacucuugcugcaaccugaggagaggcguccucuccacaucacacaggcagagagugagacuccuagcacuuaauccgcagaaggucucacagcuggaacacagcaggagagagacagcccuaaggcugccaggugcaaagcccuugcucccuguaccacaggaccccgacuccuagcucccaccucauggacugccuugucaccuuuccucucucuucagaagccaccccaaaacuaaaguauguaucaauugaccacauaauccagagacuaaggucuacacucaccuaaguugacugaugcagaaaaaauauccacagaaauaguacuuucaaaagagaaaaaaacuacaucauuuugguuugcaauucauauaaauaaaaaacagccugaagccaggcuuaaaagaguuuuauaauuuaucaaacuagcauguacauucacuugaaaaaguuugacuguuuuaaagcacagaguaaaacccaaguccaaaccuuccacccaggcaagaagcccucuugggcagaugcuggacagcuuccaccuggacacugccaauauggaaagguggcugcugugguucucugacucaguuuccucaucagcaacaggucaauucaggugguucaugggcguacacugugugucacgauuagagcuggagaaucuuaacgccaucucuggcaauuccgaauuaucacugaggagaaaacaaagagugggcacaaaggcaagcugacccugcagagagucccugcggguaucaauuacaauacaccacaguccucuccggucccugaaagaugccugaagcuacauguaucaacucuucucggaugucuacagaauuaaagucuguucugcuucuuuuaggauccuccaucuggagacucugcagcuacaugagugaguaucugcgcaagauccucugggcucauggaggacuuugcucuugugucauucaaacauguauacugagauggauuauuaguacaaugcccaaauagagaggauucuccauuauucucaaaagaaucuuuuggggcaaggaaaugaagcaguuugcacagagaccuuagugaagugccagaagcagaugcaccuuacuacagaaucccccuacuuaugaucaacaugccaguccaggaaaugggcuucaaaggcaagucuuucagcucgccagccuugcucauacaucacuacugaucuuaagugacaggaugauggaagcuuucuuauuuccacauuaagacacggaggucaugcugcaacaguaauccuucaaugaacuuuguuaacaaaguagacucccagagaucaaggguaauguauuuagcaacugggguugugagcccugauggcuauugccugugaugaacaaaugcucacugccaccacagccugucugucaucagccugugcuggguuagucugugaaaaguuaagaaagcuuggcaagugagugguuugacagaacauucuguaccuuuuccaaacuuuucaguggggcaguucugacaaacacaaauuaugucuucauguaucccuucagguaugaagugacugugugugacuccucaaaacaaagggauuguggagaccccaccgucagcuguguguguacuuuaaacuccuccaacagaaggggcaggaugaacugacccagucacucccuaugcuggccuacgauguucuuccacauccccuguacacagucccgugcaucacuuucuugaagaucaagugugugacugcuuccuuccacaaguccaaucccaagugaacauccuuucuuguuuauuccccauaauagcaacuuguugcuucuauuuucuguauuuguuuaauuugcuuugcuagcaucuucccaaggaaacaaguuucuugaggacaggggccauuuauguugcauuuguauucauacaauccacaaccucccuaaugaggaacaagguacaguaagugcucaacaaaggcacaaagacaccaaacccagcuggaccaaggcugugaagagcucccaccaccacccacuggccccaaaugcuuuguguuugucaguacgaacuugucugcacaucaggcaggucuaauguccagaaggggugugggaggguaagaagagaaucagcauuuugagugcagauuccucccauccacaugaaaccacccccuucucaucagauagcaccuucccuugccucgugaugcaaacugcuucucuaacuacugcagaguacaucugagugucgucugcugucagccaguuccuuccuggcccuuagcaauaaauagaaacucaguccagugauccauccauuucuccuucugcucugucauuccacauguuaccacaguugccuuggaggggacaagucaauuggaaaaaagcaagguacugugugguaugggaacugccacguucuuuuugugggauuaguugaacacaagcaaugccaguagagacugaacuguucuugcuaaagaagagaacuguucuugguaaagagaagagaguucucgugcauaccacauacaaagguaagcagcucauuuggagaacagcagugggauggaaguuccaccagcagccucugguagcaagcugugaaggcacagccuacauuauaucuuagcugaaaacaaccugggcaagcugauucuagggagucauugaaauggguuugccacugaaggcugagcuaggcagugauucacggccguucguuggaaagccugcccugagccacuauggcgggcggcccugcucuucucucuauggaaccucugugguuucaugcuuuuccuucgugguuuccauguaacugaaaacacccaguguuuuauugaugaacagcuauuuuuacacucacaaaaagcuuuucaagugugaaaucuuguacauuuuucaagacauucaucgcucacaucuggaauuaggcuaaacgcaccaagucucggcaaugagcagccucggggaauuugccugggagacacaaucaguuuuagcauuagcaaguaucacaagagucaaaaacaaauauaaaaccccauugacugaagagaguugugauuugaagugguauuaaaaagcaaagauacaauaacagaaugagaauuaugcagcaacucaauuggaaaacacagaaauugugugugcgugcacaugugaaacagguguaagaaccuguggcauguauuagaagcccacucugcagggguuccagaggguucucucuagaacagagacuggugaacuauggccgugggccuaguuuuuaaugauuuuuuuuuuuuuuuaccauuucuaaaugguuaggaggaaacaaaaaacuauuuuaugacauguaaaaauuacaugaauuucaaauaccaguguccuuaaaguuuugaauuuccucaguaaaaaucuuguaaaaauuuguuuucuuucucauuauacaaguacauacaauaggugcuaaguaaauauuuacugaauaaauguauuauaaaaucggcucugugacugugaauacaauacggcugacuuuuggaaguggcaggugcuuuuccagugcacacacacaauauaccuuuauauacacacauguacauauauacacguauggaacuggaggacgcugggcuuugacaaaguccucaagcucugucuccugccaacgacagaaugccuaccuuucugaacugugucagcaagcagcagagaggcugcuaacugcugccugcuuuugaguagcaaaagccaguaaagaaaaaauuuguuuaaaaagugaugugacaucaaagagcacucucagcaacccaguaaguaugcagagauaccuuucuaauaucaggcaucagaacuccgcuuggaaguuacaaacucagacacaccggacauuggagaagauaauacgaacuagaagggacagaauagcuuggcuggacuuuaguagagaaauacacagaaugccaaauuccucauaugaaggccaaugguaacagagcuguuaauuuuaugucuuuuuauuuuuauuuuuucccauaugccuaaccagcuauuccgauugccacuuauuaggaaaagccgacauaaacauguuuuaaaaggaugguucucuauggcaacagcuucucaaguaaucaacaucaggaucacugacaagagucauccagccucuguggaaaaagaggaaagagaaagaggagcaggcuuccugccucccugaaaggcccucaggcucggaaagcugcagugacaaacuuucccgacacacuggccauggaagauaaacgaggcuccuccagagcuggagaugaucaaugugacacaggccucaacuucugugaaugaugucuaaaaauaauccaaauugacugcauuuuauaauuccaggucaaaucguucucuccccugcucuccagaggcaggacaaacagcuuugauaaacagcugagacccagcacuggccucucacagaacagagcagaagcuuccagaggguucugucucuuccaucuuuauuccacaggaagaggugaaaauugcugaagaaccaugacaacucaaauguaggcuccuuacuauagaaagcacagcaguucuugaagauucuauuaaauguaaaaucuucuaauuucuaaaaagaauaaggucuuuuuuuuuuuuuugagacggaguuucacucuuguugcccaggcuggaaugcaauggcacaaucucggcucaccgcaaccuccgccuccaggguucaagugauucuccugccucagccucccgaguagcugggauuacaggcaugugccaccacgcccagcuaauuuuguauuuuuaguagagacaggguuucuccauguuggucaggcuggucucgaacucccgaccucaggugauccacccgccucggccacccaaagugcugggauuacaggcgugagccaccgugcccagccgaauaaggucuuuuuagagaauaaaauauucauuuugaaacuaggaauaggguaugcauaguuacauggaauaauuaaguagucaugauuguuuauaaaagaaagguaaauuaggugaauauaguugacuaacaaaaaaagucucgucuuucaauucuuauaaacuacauaaggcuaauauuuucacauacucuuucuuucaccagaaaucaauguagcaaauaaaaauauuugagaaauauuuuuaggaguaaauuuggcaaagcaaagucauucuauguuuaaaagauaccgaaauuaguaagaauaaauaaaauuccgaaauuagucauguuaaaagaguaaaugauauaaaauaauacaucagacaguguucuuaucacaauaaaaaaaaggcaauauaccggcacaacuuauuuuuagcauagacaaaaacuaaacaacaacaaaccaacuacaaagccaauucuacucaagaaaaacccuaaccaguuacacugagacuguaauuccaaggagcucauaaaaaauaaaaauuguuacugcuauuaaauauauaauccuauaaccucuucucuuguuuuacacaagcuguaaguuuuuauuuuauaaacaaaaaauauauugaaaacuuaagugaaaaaguacaagaaagacugucucccugcauguucagaauccaaaaagguucuugaagcaagaccugccucgcuggcaacaaagcauuguuugcaguucugaacccacccaaccaccagaaauucaaugcccuccagcaugcugcuucucaaacuaucagggguaaaggauuaguucugucuguuuugugguuuuuuuuuuuuuuuuuuuuuuuuuuuuuugccuuuaaaaauuuugaauccauuacaggauuacagggcaagauuuuuauaaaguuaaaaaaguuagcagaaaaaugaaguuuuaaaaaagacaucuaaaacccaaguccuaaaauauugucaaacuacuagaaaagcuucuaaaugcuuacucuuaauuucugucuuuaucuugucuauggaccauaauuugaguggcacugcuauaaaauaucagcuagcaaaggacagaaaacggguacucaauuuaagauaguauaaguggcaaugaccuggcugucagaagauuggaagcacaacugacagaacaugugaucuaggacaagucaccggccuuuccaggccucaaaugcaaucauuugcaagacagggaaauagggcuccucaguaacuuuuuucaacauaguuuuuucacaugacuuucuucaaacacaaucuuaaacagaaggccaaucuguacaacaucucaggaagcuuuggcugcagcggggugggggcaacccaaagcucaugucccaacccuccccucaaauccccuuguaaaagccccuggggaugcuagaacucuauggaauccacuuugaaaaucaacagcuacauuuuuaagguccaucacaauucuagcauucauuauagccuagauaaguccauagcacucaguaaaaggagaaggcaaaagcuuucgagaauaaaauuggucuugggcugggggcgcuggcucacaccuguaaacccagcacuuugggaggccgaggcagguggaucaccuaagaucaggaguucgagaccagccuggccaacauggcaaaaccgcaucucuacuaaaaauacaaaaauuagccgggugugguggugcagccuguaaucccagcuacuugggaggcugagacaggagaaucuccugaaccugagaagcggagguugcagugagccgaagucgugccacugcacuccggccuggguaacagagugagacuccgcucaauaaauaaauaaauaaauaaauaaacaaacaaacaaacaaacaaauaaaaauuggucuuuaacauuauauaauauauauaauucuuaacacugucauuaaccuuuggaaugucagcaauuggcugucagaauuguacagccaaccaauuucuuccaaaaaugguaacacagaaucaaaacugaacucccgccucaagcugcuaacuggguccucuugaggcucacaacggcugaugaugaccucaggcugcccacucuuccagcucugcgucguaaggucaggaagggaccacgaggaaggggaagcaagggaugggauggugcugcccagaccugucaccagagucgccacccugcucccuucagacuacggcuggagacgcuggagacgcagagcuuugccuucuccgccaacccuucccccacacugcaacccaaagaaaggucccccuucuuccuguuuucaugaugucacagaaggaaaaucuggggaggaauguuauuucugcuuuccuggcaagagagaaggacagaaggaaaaauaagccaguguuuuccuccucuucuccugcacuagaccauauguaugucaguuucuuacuaucacaaaagcucuuaaaaccacuugcuucaucugucaacaaacaaaaagccaaaucuaauccuuucaggccgaacguguccuggugaagcucuaaccaaacaaaacagcccagcaacuuccaacccuuggguguguuggcaggcccugcccucacccucacugcuuucucauuucuucuuuaugagugucuuauuaugaaguuauguuugcugaucuacaagacgacauaaauuuuuacugguacuaaaacaacucucaaaaagucaggacccacuuucuccuuucuggcuccucuagaaagcagaggcaggcccaagccccguuugaaguccuugcugccgggagauggccaguuuaugucucuuguccuaggacaggaaaaggaugcacucucggcaccaugugcuagagcgagauaagaccagagauucuguccucggcaccuuaucagcuuuuccugccacuuuccagagcagacagcaccauggcuggcaaugaacgaagcuaguugaagggggguugggugugcgaguggcuuggggacugcagggagugagguaggcaggguguagaaugagaaaaggaaagagaagagguucuucguguaucuuaaaaugguuugguccccccaaaauugccuuuuuuuuaaaaaacacauggauuuugcaucucuguuggaacuggagcaacuaggagagauguuuuuauaaggacuuccguucugguuagaaugaaccaccacuuucauugcuucgcacucugcccgucacugccuugugcgacuggcuccugggcacguagcacaggauggaucugcuaucagauacuccguggaaagacugcgggguccagguugcagagcgggugccuuccacaggcacgcaagccucuaucugcacacccagcaaucuccuggggccaggacacacuugcucacacgggauaauccgccucacagugcaaaggaacaagggaggcuaugggacacuccuccaaauacagacgaauggcaucgaugagcugcuuuguucuccaacaaauaacaucugugaauccaaggauuacacucuuuagaaacccuggucuuugggggcuggguuagggagggggugaauauaacucuuggaaaaaaaccuagacuaagcagggaaauuuuaacuuaguuauggacucaguuauugauaaugaacucaugaaaguucagguugaguaucccuuauuugaaaugcuuaggaccagaagaguuuccgauuuuugauuuagggauauucaaccuggaauaucaauauaaauaugcuaaauugauauuccagguugaacaucccucucguuuuugcaaauuguugucgaugaaaccaaaucauuuguccuguaaaguucucucauaaucagauuuuugcugaauguauccccguggcauagguuaacacauuucucugucucauguaucuccuguaggguucaagugagaggcagccuuacuuucuaacggagcacuuuuccaaugccagcauguuguuuuaugaaaaacugggcuggauucauggucuaaguaaguuugggaaacaaaccugugcuauuccucccuuugauucacaaugcauaucaccaucugagacacguggccgcuguuaaacuucagaauggcccacauuuauuugauccuggaacccuuuuugguaaacacccacuggcaucccaugaaauuagugcucugcugaacuuacuuugaaagggcuauuuaaacagauaguuccauuaucuggauaaaaugaguaguucucuuguuaaaucucauaguuaaaucuuuguuuugucccagauuguccaagagggugggcuuuuacccauguaaguuuuugcaaaaaugacaaaagcauagcagggaagugaaaagagggccuggcaagcaucccacuauggacgcuagcuugcagagcgccucugggaggagagguuagcucuuucccagcuaucacaugauugaaaugggaaugucuguuccuagguuuagaaaaauuacgcuuccauuuuggaauggaggguagcggagaaauaacauauccuaaaugaugccaaguauggauguauuuucuuuguuuacuuuuaagacugccuacaaucuagccguauuuuuuaaaggauuauguguaagcagcaagcccugcagagucugacagugagaugaccacugugaagaaagauccugggcgucagguuccacuuaaaggccgugcaaaguucaaaccacagaaccaagaauaaauguauaaaauaacgaagugaauaaaauauggaacacagaagucaauggacauauaacaaaaucaaauucaaaaaagcaauuucuaaaagugaaaugaaacaaacuugauucugcaacuagcuggugaagagccacacaaaaagaaauuccagaugacugaaaacauaauaauuuaacuguauagacugaaugggaaauacauaaagacaaaaagaacugccacacacccaaaacaaacccucugaaucucucucucucuuuuuuuaaaaugaucaaguuauuggcauuacucuguaacuauuguguguauaaugggaaauaagcaaaugaguacugugauauuuuaaugcuuuuauuucuggaaccuguugauuccaggaaacuuacugucgggaaguaaagauaaaagaugagugggguuaaguacuugugguccuaaaucuaaucuggcaauaugacuauaaacucaggauauauuuuaucauaaagaaauuauaguuuuauacauguaacaaggccuacaaaugaagaccaaucuaggaagaaaugaacaaccccaacgccuagacugugucgcuaaauaucacuuaccacaaagaaaggaaucagggagaaagggacgacuccaaguguggggcagaaaauguacacaguggaccuggaaacucuuacacuagauuggaaggaagcuauuaaauaccacuuagggucaucucaacaguacucaggucauuaucuguguauagagauaccagagauuuuuguauguugaucauguauccugcaacuuuacugcauucauuuaguucuaacaguuuucugguagucuuugggguuuucuacauauaggaucaggucaucugcaaacgagauaauuuuaauuuuuccuuuccaauucagagaucuuuuauuucuuuuucucaucugacugcucuuaauaguacuuccaguacuauguugaacagaaauggcaagaauggacaucccugucuuguaccagaucuuagagggaaagcuuucacacuuccccccaucaguuaugacacuaacuauggguuuuucauaaguggccuuuauuuuguugagaaauuuucuuucuguaccuaaauuguugagaguuuuuaccaauaaaggaugcugaaugcuuuuucuguguugacugagaugaucacgugguuuugucuuuccaucuguuaauauaaugcauuacauugacugacuuacacaguuaaaccagccuugcacgccaaggauaaaucccaaacaaaugaaaaccuagcugaaaaagaaaccaagaaaacaaucccauuuaugguaccaucaaaaaaaaaaaaucaaaauacuuagggauaaauuuaacauaggagguaaaagaccuguacacugaaaacuauaaaacacugaugaacgaaaaaggacacagauagauggaaagauauuccaugcuuaugaauuaaaagaauauuauuaaaauguccacaugacccaaagcaauauacagauucaauguaaucugccaaaaucccaacggcauucuuaauagaaauagaaaaaacaauucuaaaauccacauggaaccacaaaagaccucgaauaacugaaguaauucugagagagaaaaacaaagcuggagacaccacacuucuugauguaaaauuauauuacaagcuauaguaauuaaaacaguaugguacuggcacaaaaaacagacacacagaccaauggaacagguuagagaacugaaauaaaucuaaacauuuauagucaacuaauuuuugacaagagcaugaagaagacacaauggggaaaggauagucucuuuaauaaauggugcuggaaaaacuggguuucucauguaaaaaaaugaaauuggaccuuaucuuacaacauauacaaaaaucaacucaaaauggauuaaagaccuaaacauaagaccuaaaaccauuaaacucccagaagaaaacacaggagaaaaguuccuugacacugcuuuuggcaauaauguggauaucacaccaaaagcucaggcuaccaaagcaaaaauauguaaacaggacuacaucaaacuaaaaagcuucugcacagcagaggaaacaaucaacacaaugaaaaggcaaccuacaaauuagggaaaaauacuuguagaccauguaucugauauaaaguuaauaucugaaacuuaaaaagaacucaagcaacucaguagcaagaaaauacauaaccugauuaaaaaaugggcaaagaugcuggacagguauuucucaaaagaugacauacacaugaccaaaagaugcucaacaucacuaaccaucaaggaaauguaaaucagaaccaucaugagauaucaucccacacccauuaggagaguuauuaucaaaaagauaagagauaauaaguguuggcaagaguguggagaaacaggaacccuguacacugcugaugggaaugcagauuggcauacccucaaagaaaaacaguguggagguucccaaaggaauuaaaaauacaauuacuguauagcccagcaaccccucuucuggaaauauacccaaagcaaaucaaaucaccuugugaagaugccugcagucccauguucaccgcagcaguuugcauaauagccaagacauggaaacauccuaagugucuguccacaggugaauggauaaagaaacugugguguguauguauguauacaguggaauauuacucagccuuuaaaaaggaggagauccagccauuugccacgacauggaugaaccuagaugacacuaugguaagugaaauaaaccagacaggaaagaaaaacauugcaugaucucacugauaagauggaauagaaauagagaguaagauaaaaugugguuacuggagcagggugggggauagaaauggggagauguaggucaaaggaugcaaaguagcagguguguagguccccacacuguaccuuagcucucugcacuucagaucuaagguaugguguggggacuguggcuaauaacaguguacugugucaggagguucacuaaaugagauuacaccugcucuugccaugaagggaaaauggguaacuaugucacuacauauauguaacucauaacauguacagcuuuaaauauacucgauaaaaaaaaaaauuuuuuuuuuuaaguacucagaggccaggcgcaguggcucacgccuguaauccuagcacuuugggaggccaaggcaggcggaucaucugaggucgggaguucaagaccaacguggccaauaugcugaaaccccgucucuacuaaaaauacaaaaauuagcugggcgugguggcucacgccuguaaucccagccacucaggaggcugaggcagcaggaucacuugaauccaggaggcggagguugcagugagccgagauggugccacuacccuucaaccugggcaacaaagugagaucuguccagauaaaaaaaaguacucaggagccagacucccacuggguagaaauggaaaauuugaucaccaauaaagauaauagcugcaaugcauugaaacgucaaacauuucaauucacgaacaauaaaaaaaggaaaacccuccagucaucuuuggagaaugcuagagcaccuccucauuuggaaauugcuaaauaaaggauauaaauauuuauucugucuuuccuauaugcacuguuccucagaguaaucuacuaauaaggggaaacacacauuccaaauuucauucuaaaaaugaaagaggaacagaaagaaauauggagggagacuccauagauugcaagaaauuuaaaagauauaucaaccaauuguuacgugugacccuuauuugaaucuuaauuccaugaaaauguaaagaaaacugaaauuuaugacauuuaugaacauugagcuuugaacacuuauuaauaguaugcaauuacuauaaauuuuuauagaguauaauggcacuggaguuauacauuuuaaaaaagaaccucuuaaccuuuagagauaaauacucaaguacuaaaauaccuguggaugaaauagugauuucugggauggauuuguuucaaaguaacacagaaaggagaagugucuggagcacuuacagacuagccaucaguguguuuguuguuccccaaaaggaccugugcuuucaagaacccgugucuuugcagauauggucuuuuuuucucucuggaaagccucugaaccugccaguugcugcuccuucaagacacauacaaagguuaucuuccuugaucucugcaagcugaauccagcgcugcaucacauaugcccccaguccucuggcacagcacucaaggccuuugcuccaguugacugugaaugucccagacuuccugaugagguugugaacagggauuauaccuuacccauuuaaucaucugucaugcaauaaugcuacuggguagcaagaaaaacaucugaguuaaguaggaaaaggaauuggaggggagagggaaacaggaagaaaaugauuaaaguacuauuacucagaacuaugaaauaaugagauauuacccugaagggagucauucuaagacuauagccuuguguaaagacacugagucaauucaagccugauccuaacauuuuaagacacagaugacuagaaaguaggcucuguuuaugaaucacuuguaacuucaacucaaagacagcugauuuuauucacuaauguuaagaaggugccuccacaguaugagccuaacagugguuaaagccuuguaagaaucccuauaaagagucuaaacuaaacucugaccaaugaugauaaugugucaugcaucaugauuaauccaauuuagaguaucugagguccauuaaaaaacaaaauaaugugaaagucaugcuucugccuguauaauaacacacagaucuccauagcagggaggacacaggggaugagagugaggaggcugaucuaaaacgaaaugacugauuuaacuaaaugaauaauaucacuguuuuacuuuagaaagcacaucacacauuuuagaagacuuauaaguggcucuccuuaggaucacaaaguaagcaggcacacaaauccaaucuaaaacuuuuaacaauuugggaaucggaauucgauacauuauuuuaaagcugauacucuacuuacaaguuucagcgcuaccuagaaauaaaagaaaacuaacugcacugauucccaaagucuacucaacaauuuccuauaaaagcuauguuccuuuuagaaagggugcugacaugaaauguucagauuuacuuaggcaaaguagcuuuccuaaguuagcuuuucugcuugcagaaaaauaaaccucacaaaaccuaguuuacugaaaggcauaaaguaaguuuaagcacuuguuaaaaagcuauuuggaguucaggcccacaaaaugcuucaaaaccagucagguaaaauuuaaaaccuccaugugauuuuaagagucagaacgugaauuaaaggagccuggacuaaaguuaggggacagaggugacugaaggggggaugucauuaaugcuaguacuuugcuuaaagcaagccuuuuugaugcagaaaagauaaacuugucaaagaacaacagaugacaaaucaaagacuaaagcauuucagccucgugcucuuuggcagagacugcccgcuguucgaagacaugcaaacucugagugaacuuccuagaggcucagguggcuucagaaaagaauuaacagaaccuucagaaacagaaaaaccuaccagcacucugaucccuaauaaacauaaagagcguaucauuuaaaucuuaccaaggaaaaaaacuucuuuuuagaaaauucccauaacguuuuaagcuaguucaagauuguguuuuaaacagaaauuucugguuguuacaaaguaguuccaauggaauuauauaagauuacaauuuaaagacagauaagcaucaagagauauucuaaacuacacuuacagcuauuaaggaaauccuacuaacuucaagcuaaguuuaagcugcuucuugcauuauucuauggaaggauuggcguagcaaguuaacccaucagaaucuuauuuuaauacuuuacuuuagaaccagucuacgaaaagauaagauucuuagacuccauccaaucaugcuucggugauaaauuauccaaaugacuuaauuauaaacaguuugaauuacaaagaacuccuaaggcacaggaaaauguuuauuuaaauuacuauaaaaaacacuuucagguagcuucaagcaauaggauagcacucacuuauacaaacauuuguuguacuaauuacaauuaguucuuauuauagcaaucccacugggacaguuugaacaauaagcugggguugaagcuguuuuuuccucuagaacaaaaguucucaaaccccaaacucaaauaagaaagaucuuaaauacaaaugcuuuucacaacacugaacuaacuuguguggaaagaccgauuuuuaaguacccaguauguggaggucuguugcuuguguauguauaccaacauauacguguguacaggaccccacuccauguaaggaacaaacacuacauacucuaauggaacacaaauaguguacugagaauaguucuuuucucuuuagcuagacaaguguuuagguuuguuacccugaaaaucaaauuaaagauggaaggauuagcuaccugaaaagauucuggacugcguauaucacuaccagauuaagggaguuuauguggcgagcgcagagcuagaccacggugaguaaaagggaggcagucacuuuccucacugaggacauccagguuguauguggauccacuagugccuuugguuuauaauccuucauuuuucacauuuucaucgauucaaaaugccuuguuaucuuaaaaaauuauucuuaaucauuuguucacuuccuugccaauauauuuaaagagacguuacauuuuaggugaauuucuugggacugacaaaccugauaauugaacaucagaguuaggucuauaaacggcaucaauaccuuccugaagccaauacaaaagugaagaggccuuccuauucucuugcaugguuggcucuuucuacaacaccaaguagcguggcugucuugguaaacaggggaauggugccaguaaaaguggggaguugcacgguucaaacgugacauuuccuaagcaaggggagccaagacagugugagcagaacuauaacccugagaaagaaagaaaaagucccaagucucagcguggcugcagcauaggcaggaccccuccagccuacuuuaggaaaauuaagcgugagcuacgccccagaagggcucaccccacaggguuggacccugugacuggucaaugcaggggcacaaagacucugcccccuccaaagaucuggggcaguugggaagagcucccuguggagucagcugaaaacuucaguguauacugcaggccaaauccucucccuguguaaucuugcuuccucccucuugcucccccagaaagcaguccugaaagcacuccuaggaacuuucugcaggccaacucccaggaaccaaccugcaaacugcacuugcacccagcgccucuccccagacagcccucagcuaguggcagauugcaccccacuguggaccccuaauggggagcaugucuauucgacugucuuugaacauuuuuaagacucccaaguagccccccgaucucagugaauuaucucaugagggaacaauuacuguguguguggagggguaggcaacaaguauucugguuguaaaacgacauacauuuuaacaguuugacucuuacccaauuuuucccaugagcucuguuauuuuuauauuuuuguaaaauauuuuucaugaaugcauaaauagcagaaaugucuauauuugauauauuauauauauaaauguauuuacauauauauacacacauacacauauuuuaugcacacacacacacacguuuguuuguuuuuuuuccaagagacagagucuugcuuuaucaccaggcuggagagcaguggcgcaaacacagcucacuguagccucgaauuccugggcucaagcaauccucccaccacagccccccaaggagcugggacuauaagugcauggaccaccacacucagcuaauuuuuaaauuuuuuguagaaaugggaucuugcuagguugcccgggcuggucuccaacuccugggcucaagcaaucccgcuucagccucccaaagugcugggauuacaggcgugagcuaccaugcuuggcugacauaucuucuauuugacauuaguauuuugaaagaguuuacaauauuauuaucuuucagauuacacuguaagcuaugugauggcaagaaccauuuaccuuuugguaaaaagccacacaagggaaauuaaggauaaauguggauucagcagggaugguaaucuaugugguuaaagugagucaguguacggucucuuuacgaagugaauacauuaaagcccacugggaaggugaaaucaacaaaauucaggacaugggaaauucuguaagacaaggaauccaaggugacuucaacaauaaacugcaaagaaaaaagagagaaggaaugagaaccuauugguuaagaaagucugaaagacauuaucaauuaaucuauaauauacagaccuuguuagauucaaauacauauucaaaguaaaaaguuauuagacaacuggggaaacuugaacauugacuggauuugaugauacugagaaacugugguuaauguuuuuuggugugauaacaguacugugacuguguguuauggaguccuuaucuuuuagauauauaauacauacagauaggaugaugugauguguaggaauugcuucaguaaugggaaagaggggugggaguacagcuggaaugaggcuggccacgaauugaucauuguuaagcuggguacugggcacagacagacuccuuuauuauucucucuacuuuuauacacauguaaaguucuccauaagcaacaguuuuaaaaagugaauguaggcuagacacaguggcucacaucuguaaucccagcacucugggaggccaaggcaggcagaucacaugaggccaggaguuggagaccagcaguugaagacauggugaaacuuugucucuauuaaaaauacaaaaaaaucagcugggcaugguggcaugugccugcaaucccagcugcucaggaggcugaggcaagagaaucgcuugaaaccgggagguggagggugcagugagccaagaucgugccacugcacucuaccuuggaagacagagcaagacacugucucaaaaaaaaaacaggaaaaaaaagugaauguauaucuauugguauaauaucauuagaguucuuccuggaguacaguaaguaaccuaaggcaucugugucuaagugaaaguggucacagaaaguggccuaccugaagccuggcaguuccauuauccuaggagaaaucaucguggacucuugcagaaaaacaaggcugagaggaagccaaccaaggcagaaaggugaccccaucugugcgcugacucagacagcaaagcgguggguuucccuuaugagaucauggauuggccgccagagaccgcuacuaauguuagaacaggguuuuucccugaaagagucacaauuccucucccuggcaaaacaggaacugguccuaacaggaauauuauguaauaccagaacugaggagcucaggaaaagcaggaugaggguggggguggggauugaagagcagagcccuuugugggagcgugaaagggacaagcccaguaccggcuuccugccagccuccccuucccuccugcugcagcgccuucccucacgggaugagcaggcaucucauaggcagacagaacauggagcaggaauaaaagacucccaccuucuccaaggcugacgguaacugaccauguaacuacaguguaacugaggggacccugcauagacagaagaugggccagcgagaugaggagccaugcuggacgagcauccuuuuuuuccagauguaauaagguauaagugacagaggaagacucuauguuuaaggugugccaugugauguuuugaccuacauauacauagcaaaaugauccccacagucaagcuaauuaacacaugcaucacuucucacaguuaccuuugggagugaugaggacaccuaagaucuaaucuauuagcaaauuucgaguacacaguguguucuuauuaacuguggucaacauacuguaugcuaggucuccagaacuuacucaucuuagccucuguccagaggggagcucccuugcaauguagacagggcaguggucagaggaguagcauuuuaggaauguccucaaauagcacagggaccauaaacaacacaugucacaggcccaguggcagagccaaaaacgcaagcugcuaaagagacaaaacguguucaauuguuuuucaaguucaguauuguccguauccgaugacccugcuuuugagacagacaggaaggguacacaccacugagaccacacacacacaccuccacgugcccagcuuuucacugugguuaucucuggcuguuuggaucauggauuuuucccccuucuuccuaauguacuauguacaggucaugguuucucuagaguggacagguacugcuuuuauaauuuaaaaauauuugaaauuaaaaacucacaccgaaaaaacccuacaagccuagggcagagugcucucucugugaggacaacugcauucaggaggccaggaugcugucacagccaagcggcagguccugacccucaucucgacaagacacagguggaggcgccgucugcacucacucucaggacucagguucccuccucaucccuuucccuuccagaagguccccaugcuucucucaagguuccuccccaacuacaccccaccggcuugugucuguaagcgaucuaacggggcugaauaaaaaagucuuccagcacagcaaaugacagaaaaaguguucaaaugagaacaaaagaggcuuuucaggaagucacaacucgauggcagagaaggcucugacaugcacugaugaguacaugaaagaagugaaggaccucacagcaucaggucagauguggaggaaaaguuaacagcacgagcgaugagaugacaggcaagccagggggaggaagcaagggugagccagcagaggcuucacauccagagcugcucccaucugcacgucugcccugccgugcgcuccucucccaggagccgugucaccauccauccaagcugucggagccucaacugguccauacugucagcccccaaucccagggccucgaccucccaacaugacuccaccaagcugccccuuucucuuugggucuugccaccacugagcagcucaggcugaggcucaggcucgggcucuggcauccucuggaacagcgaccucuaccugccugccucagucuggccccuccuugcccucuucauucuuagugcuuuaucucugcugcuaaagggaucuuucuaaaaugcaaaagcaaccagccccgucccauacuucaaagccccagaagcucucaaguacacgcaaaacaaacagucuauacucccugcagaugucuaaugggggcucucagggaaaaaaaaaucccccucccucccccaguuuuuauugagacagaguaucccaccguugccucggcuggaguacaaaggcgcaaucuuggcucacugcagccuccgcuucccaaguucaugugauucuccugccucagccucccgaguaacugggauuacaagugcgcaccaccacaccuggcuaauuuuuuguauuuuuaguagagaugggguuucacuauguuggccagucuggucuugaauuccugaccucgugaucugccugccucagccuuccaaagugcugggaugacaggcaugagccaucaugcccagccaaaauccccccuuuuuagauccucagcuuauuuuucaacacccaccagaaaagucaaaauuaauucauaacaagacucuguuuuucaacauccagcugcagcuaaagcaucugaagccucuagugacucccgucccuccucgguggaagcacacaucgcaaaugcucaguacacagcauccuugggucacugcaggcacaguaugaagugaccagcuuagggauggcagcugcuccaggcuccuggccgugacgagggcugaggggaucaaccccucggaccaccaacaauccacuuguggcaugccagcugguaaacuccaacugagaauaaaggggacuguugaaaccugcuugugaagcuacaauuagaauuuaggcuucagugcaaaguuggaaacauagcuauauucuuuuaaaaggacugguggguuauuuugguuuggggagcuccagcccccaucuuuguggcggcugcugaugugcuugggcgaucugcuggcccccuggcuuucuagagagagucugacuacaaacuauaaacccuggaagagacgccagggugguggcggcaaccucucuccagcacugcgcgaggcaaaggacuugcauuuggccuguggugcugccgcgguuccugccugggagcggggagacauccugcccucuuccagguugacaagaagcgugcagcuuuugaaggcccugagacccccaggacaacaugccccaucucagucucuccacagaggugccaguuacaccuggcagugaugagacucuuaacucuccgugcuggccaggaccgcccccucucucccgcucaggaccagcaaggguagcgcuggagcuugucuguauuacgaucagcuauuggagucugagucucuggauaaagguccagcuauuuagagaccuagagaauuauccucucauuggaugacagcaggccccgcagaugcgcuggccucgcucucccugcacucuccgcgcuggaugggccugcagcugcagguuccucucugcccucuuuccacuucacguccgcacccacugcuacuucugcuugaaaauccuccugcaucuucucuuacugacccuuuuguccuuuauggacuagcaaggacaacaccuccuccaggagggcaggaacccaccugagagggagaugccccgggggccacgugcacaccuugccuccagcucaacaguuaaccaaaccgcaucaaaaucauugaccgucccucccccgugacgcugugcgcucccugaagggacagacugugccucuucuucacaguccaugguuaagagcgccuggcacccgccaucacucaggagugguucugggagaaacagaugaaguaaagcaguuuacaacaaacagaaauacucucaggaauggaauucaugaaaggcuugcagaugguacaccacauacacgccgccgguacucuggcaaagguauuuuuagcaucuugagauuaaaugguuguaucuauaggugacuguaauaggaaaaaaagaacuacuucagggacacgauuaauugcugugaugugauaaacagcagucuacauuguauuccucauggcauagcugucaccugugugaauuacuuagcucauaauguuuacuauguuaguuagugugaguauacacaauacaccaucucauuaucugagaugcccccuuaccucucccagucaagcagcuuucauuuccagguggaagcugaccgcacacugcaccucagcccuuguccagacugucuuguugccacuuccauggauuugcuagauccugcuccaaaugaacguguuucccggcgugccauucugacccucgcuaacaucuacugagugccuacuaugcgcgaacacucugcuagggguagauacacaugaugacgaaagcaugaucuuccgcuugaggugcuucaagaaguguaagcuugaagagcuccugcccccaagucuguaacuccuagugucugcauccucuaaacuauuuuaacaagcauauuaucuacauaaugcucaauuaacuggucuacaaaccaaauuauuauugacaaguucuucugagccaagaguuaugcuccugagcuuaguuugcccaaauguuuucaccuagaccagggguguccaaucuuuuggcuucccagggccacgcuggaagaagaagaauugucuugggccauccauaaaaugcacuaacacuaaugacagcugaugugcuauuuaaaaaaaauugcaaaaauaucucacaacauuuaaaagacuuuacgaauuuguguugggccacauucaaagccgcccugggcagcaugcagcccacccgccaugggcuggacaagcuugaccuagaccauuaccuuucuaccaaaaagcuucuaaggaauuaaugcuaaagaaaggacacagacguccgcuggaacgggggcauuuguuuuaauuuuaauuauuaaaggucauuaauuucaauagccagaaaaaaaaaaagaccuuacuugaaaaacaaaaguauagugaauuuacaaaccauuuugccucagggaucucugucaaagcagcaacaugaauacacuuaaugcuguuguaacaaaucaugacaacaugagucacugaggagccucuuaguauauuccuuaugaccuguacagauuuaacucaagauaaacuucaaacaaauauugcaaugaguaucuaguaacagauucaaagaggcgacaaaauaauuccacugggguguguaaaagcuacgcugcucaacauagcauuugugugagaagauaacuacauucaaagaucaggaauguuuuuaaauuugaacaaauguaaacuguuuuaaaaaauggacuugcuaguugcuaagcaggugucgucaccagaauaacucucuucauuaauuuuucucuucaaaagugagaacguuaugaaguggcagugaagggguauuuuuagaaaugggcucagaugaaccaaaauauuaaugcucaaucacugguaaucuaucacgauuaaaauuuuaaauuacaauuuuuuaaaaauaaaauuuuaaauuacauuuaaaacauacagaucuuaaaauuucaaauauuuccguuaaccuacacagaaaaguaacuuuuguuuauucacaaaaaguagcuucaucauauauugacuuaaaauauccgaacaguauuacaaaguaaaaaggagcaaacccuucgccuguugcuaccuuuuuuuuuuuugagacggaguuucgcucuucuugcccaggcuggagugcacuagcgcaaucucagcucacugcaacaccuccgccuucugguuucaagugauucuccugccaaguagcugggauuacaggcgccugccaccacgucuggcuaauuuuuguauuuuuaguagagacgggguuucaccauguugaccaggcugaucucgaacuccugaccuugugauccguccgaucacgaggcuucccaaagugcugggauuacgggcaugagccacugcgcucagcugcuguuacuacuuuuaaaugagugggaagaugcguucaaauuagacuuuuacggguuuaaaacuaaaauccgagugcauguauguuuuuaagauuccauuuuguuuuuagugacaucaauauaacaagugcucugaauuccucccaggaacagaaagaccauuuaucuacuguauuuauucagggcaagcuucccaucugugucagacugagagauuuaacauugcugaagaaugcagguggugauaaaggagggugacgcuagaaaugaacaccucacguuuccaaauacuuuuaaaaaggacaaauauuauacucaucuagaaaguggguaugcauucagagaaucagaagacaaaauccaaaagcuucuugacuuuauaaaugcaaaauucuaagauuaauucauucaaaaaacaaaucacuugguugggugaaaauccuaauaucgaaguaagaaaauucaccaaaucuccagggcuaaggauuaucaaaccucugccucugccaaguucaguucauagcaaugucuuugaccuggcuacaaacagagggcuuggcuugcucccaggcugucuuucuuagcugcucuaaucaaugaagcagaaaggguccuuucuaaagaugccagcaaaauuuuuaacaaucaacgucaccuuaaguaaaaauuaaaagucucucucccccacaccaagacggaguguugcucugucgcccaggcuggagugcgguggcgcgaucucggcucagugcaaucuccgccucccggauucaagugauucuccugccucagcaucccaaguagcugggacuacaggcacacacuaccaugccuggcuaauuuuuguauucuuaguaaagaugggguuucaccauguuggccaggcuggucucgaacucuugaccucgugauccaccugccucagcccaauaaaagucuuuaacuugugacuuuaugacuuauuuuuauagucacugcuuguaagaaaaaaucccaagacucucaaagcauacuguauuaccuaaauagguaaagucaaaaguaaagugaucucacuuuuuaaaccaaaaucucuguuacggaaugccaaguauuaugacaguuagcaaaaaacaacaaaaaggcccuauucacaaaucccauuugauuuuuuuuuuucaugaugccuaagcuucugucccauucaacugaacaaagcuuuguauggaugaauaaaacagagccauugcuuuaguugccuaaaggugguuuaagacaaacuauuaucgucacagaagaaagguacagguguuucaaaaagcgaacuggcugaugacuuugcaggccaaguggugaaagagcuuagagauuuggagaaccagucaguucaaaugauaacgggaugggagauucugaaaagcgcagauaaugacuuagaagagcacagagaauaucugcugagugcauggaaggagcuugauuggcucagauaagagaggcuuccaagggacugugagcaaaacccaagaaacagggcagcuugggggaaaagaacuuccaucugaagucaaagacuccaggcaugcgaaaggcacaggauccccggggggaaauggacaauaaaagaggugcgauuuguuuaauuucaaccagaguagagacacccgcaagaauccgaugaguuccauuucuaccucucguauccagccuuuaccauuaagacucacucagccaucagcucccccuuccagagagcagcuugggaaagggaaugaagaacucucuaugagaggaggacugagcuggccaggcaugccuuccgggcugcuguucucuuuguuuaguucuauucugauaauagauuuccuuuaaaagauacaauguuuaaaauaugggaaguccuagaaaacaaacuugcucacuccagacaggugauaagaauccauuacucugcccacauuuuuuaucugcgauuuuuuccccuuaguaaccuuguguagcuuuccucaacuuauacuaagagcuguuaaaaaaaaaaaggguuccagucaaaaaaguaacauuaaguuuuagagaugaaccauguucauuaccauauaaaaggcucuaagaaggaugcaaugaaaaaaauuguuaaauaucuacauguuuaaucuguguuucccaaauguaucugagcaugugacaaugacaacuaucagcacuccccuccucccaacccaaacaucuaccagcaacacugaugguuccaaggaacacauuuugggaaacucugcccuacagcaaugcugacaguaagaaccaagcagaagaaacagccccacagcuugaauggaagcugauccacucucugucuccccuacccaguaacacacgugaaccuccaguacaguaaagcgggugacggagaguguugcugccguggagggagaagggccugguuuuucagcaggggucuucacgcucacuagucugagucuucagccagguuacuuuaaccuuugucagcuuccucaugaguaguuccuaccucucaggguugguguuucagggaccuagaaggaaacaguguuucaaccgcacucuaaaaaccaaaagcucccucaaauacaaggcauuacuguuguuaguaagccacugacugugugacagaaagggugugcuggaagacacuucuacugcacuuagcucaagccugcuagcagagccucaaacagucaacaguggccucuccugaucucaaaguuuugaacacaugguuauaggagacaauauuguuguuuaaaacaaaaaaacagaaacaacuuucuaaaaacaaacagggccuaagucauguagauuacugcagcuucaggaauauauguaagccacuauuuuauucaaaauaaaaagaggaccccugaaucagauucagaagaaaccuaagcauugaggaccaccaggggugccugaaauucacuuuauuucuagcacuucaucaucacagcaaaagaugccucaaaccaccuuuucauaccuucauauaauuugaagagaaagaaaacagcuuauuuucagucacagagauguauuaacucauaauucaaaauaauuuauucaaaaauuugaauuaggaaaugguacagcaggaacuagugaccucuccacugucugauggagagaagaaaucuacacuaacacaaccaugucaggagaaucucagccaucuaccaaugcaugcaggugggacauucuaaaugaugagcuaaacaguccuuacuacuucacucuaucagaaauaaagcaaguauucuuaaagaaaauaaugaaguacugaacugacuuuucaggaguaacagcuacacuagaagugaggaauagacggggagacagauuccauccuggaacugccccauccacacacauguuucugggauguuuguaggacacggguaggcugccuuugaauaaacugcucagccaacauuuuugaaaacuuaacugcauuucuuuuagaguccauguggccuggguaaugcuuauuaaaugcccacugaagugugcguguaugcauacucacaugugugcugcugaaauaaugagagcagcacaggcuccagccuugagaaauuauuacuucaaguugacuuccaggcccucccaaauccauuucccucaaacguaauuggaaacaaaucagaaugagacuguggcaacauauuauuuuuaccaguuuuuaacuagcacaugauuucagaagucaauaugaaguuacacuuccacuugauauauauaaaagaaaauauaacaguggaaauuacuaaagaagagaaaaauaacuucuuuuuaucagucaaacauguagccaggacuccuggggaaaaaaagccaaccaggcaauucaaaagcugcaccgauggccguuuaggaaagucucuuggcaguaagccagguaaaacuaaacucuuuccaucuccuccucaauuacuuuugcaacucucucaaaagguagagacaccuuuucuaaauucagaaaaggugaauuauuuucagucuaauggccuggucacuguuucugaaauuacauaccauauuaccugggagcuuguuaagaaugcugauuucuagugucgagccagagccuacaauaugcauuucuaauaaguccaccgggugauucugccagcuuagaacuggaggcggugaaucaauuacugcuuaguagcuccuccugguguuaguuuuucagaaaauaaucaguuuucccaaauugugcacaagcagcaaugauuugauauuagaaaaaugaguuuguacucacguacacuuucacagcaaggaaauuagagguaagaacccuuccuacuuucuugggaaacugaucaucuguauuauaauauuuaaauuuuauuucaauaaaacacaguauuuaaaaaaagguuuucuaguuugucaauuuuuuuuuucaguguauuuggaaucuauaucuggacagaguaccugcaaaaaguaacagauucacuuaaauaauuuuauuauaaacauaaacuuauguuuuaugcuguuaacuauauuugaauacaaucaucaauuuaagauggucucaacagaacuguugagacuuuaaaggguguguucaugcuucacguguuugcuguugcuuuuacaagcgaacaguucuccuugaggccccgaggccugacaguugcuggggaaaugaugggacagacgugucugcuccuguuuccauccuucuucugccuggcucugccauuucucuuacucugcauucuagaccugccaccaaagauuccaguucauuccccaacacaccugcuuggcuuauggagguccaacuucaauacgcuuugaaauggacaggugagcggccugacugggagaaagcauucgggcaaaaguggagccacucagaccacauuggugaccacuccacagcagucuaaucccacuuacugucccucucuaaacuggggugcaguagacagaaccacaaucccugcaugucugagugacgggacaugacacagggccauuagguaagaggagccgcuggcaggggaucaagggaggacaauguccaaggacuacagacuagaacauggaugcugggaauuuuacugggcaaaguagguuuuuuccaaguuagggccacuuccaacaaagcugaauagggaacauguucucaaccacggucugaguuaguccuuacugggcuauuugucauuccacuagcugacugcuaaggcucagaaagguuaaauuccugccaaaggucauaugacucacaagggcagagccgagacugcgauccaggucugcgugaugacacaucccggacucuuucuacuacaccacaccauucuugcaucuguuacugcuagucuuuaggauuguuuuccuucucaguuuugauggaaauaacauuuuuucuaucuccacugucacuuccacaaagugagaccuugggugcaggaauauuaccuaacaagagucugauguacagcauuugguauuauucuuaaggauucaugaacaagaacacugcguauguauaaaugaacuuguccgacuuaagagucaaccuguugcuaaacgacacugaugcaaucagauguuaccgcagaguuuuaaauaaugucaaugauaauuauuuugcgauucuuuuacugaaagagcuguuauaaguaacuuggguucuucuuggucaugaucauucuaaaacaauagaauggaguuuauuuacaugaucugacugagaauaaacuuuuuuuuuuuuuuuuugagagcaagucucacucuguugcccaggcuggagugcaguggcgugaucucagcucacugcagccuccgccuucuggguucaagcaauucuccuaccucagccuccugaauagcugggauuacaggugcacaccaccacacccaguuaauguuugcauuuuuaguagagaugggguuucaccacauuggccaggcuggucuugaacuccugaccucaagugaucugccugccuccgccucccaaagugcugggauuaccggccuaagucacuacgcccggccaagaauaaaguaaaauuucuuaauguuacacuagccccaaaugaaaaaggacagcacucucuucucuuugcuuucccaccucagaccauaccacuugauccaggcgcucagcuuacaggacccaaauacugaagcaugcagaugacaaaucugucccaacucuccuuucugcaagauggacacugagucagugugagauggcggccccugggggagucccuggcaucagucucuucagcuuucucuauuuucuuaauagauggauaauggaguagaagcucuauauuuuaucaugaucucagcaagauaaagaggaauauauuuuaggaagacacugcugguagaaaaccgaauuccagaacacaaaaaccucagugaacucuucuucccaguaccacagauuaaucacgccuauccugcagaaagggaaggaagggggaagugaauagaggaaagggauggauuuccaaugauggcuuacgaaagcgugcuuccaacuccccucccauaugcuaaaggaggagaggaugauggugccccagcuaucugcuuagacuuacuuccuccaagaaaaugaugacugcacauuugcuuuaugccuuaaagagucuccaaguacuuucaauccauacaauuucaucaacugcuaaagugagcauaggcugucauccacauuucccaagugaggaggaagaagaucagagcagguauggugugguccccucgccuagaagcaaaaagcuggaauucucucugcccagcucugaagugggcaagcuuaaccucuauaaaccucaguuuccuuuucuggaaguccagggaagaccuagauggucuuuuccagcuauaaaauuuccagugugauccaaagucacacugagggcucagugacagagcugggacuugagccuaaguuucugacuuuuaaagcaaucagaccuuacagaacuacagcaaaccaccucuaaugaaaaagaauuugugguaucauucuaaccuggcuccuggaugcuuuaaaccugugagcaauaucucaagaauccagacugccaggagaacagauuugccuaaaagauaaaggaaccuccaucgcugaccacggguaucguccuggccccaugagagagcuugucacaggaagugucaaggaaaacaugaaaugcacaagcaccacuggaaugcagcaaucucacaguacugccccauccccgcaauggagaagcagaagaugcaaugcaugccguacaagugccagcuacauccuacugacaaacuggaagauguacaaagaagaaaaagcaaagggcccaaaugauucaaagaaaugaacaaguuaaaaagguaguuugggggacggaagagcaaagggaaaaaaaaacuuuagcauaaucaagaacuuccuuggaauaagucgaaaagccugcagcauucaaugccagggaacucccuccccuggaacagagaauugcuuuagggggaagcucacaaggcugaccgcaccuggggaacaauugccaaggagacaaacuucugugacuuacacacagcaggucacucauacacugauacacucaugacauucccuuggagcacuucaccccacagacaagaacaagguugacguguaugaagacaaccugcacucuggagacaucaaucaaauuuggauaucccaggccuggaauagcuuuguacuccacuccaucaucuuaugauuuaaaaauuacuuuuugggcuugcucccauucugaaacuccuaucucuuugccagaauccaguaucaacaaaaaccuauugguuacucugcauuccuaaaucuuccuaacugcuugcuacucucaaccuugauuuccccacuagccaggaguacacagagggcaggggcccgguggaaccaggcacucuacugcuucuacaccucacuucggucccaugggaucugggcgaagaucucuaugaagggaauguaccagaccuccagggugggggauggggugcucugcucagaggacuggggaauuauauuccaguaaagaaccaagauauggauucuccugggacaacuaucuuucuucucuuuguuugcuuccagcccugacuucuacuaauauuaguauacacagcaagaagacuuauugaaaggauuuaaggaagaaauaaacuaggacauaugagggcaaaaauaaauuggacacuagcaacuucacacuugcaggaugaccaugacauugugaacuucaaugucacacaaaauuaaaccauucuguggugggacuaaauaaauauuaaagaacauauuauuaguagauuaaaaaaacuuuuuuauugugcaaaaaauuucaaauauacaaaaaaaauuagugaacccuaauauuccuaucaacaauuaacaaaguuugccacauuguuacaucauugcuuuguucuuugcugaaauauuuuaaggugaaucccagacaucaagucauuucauccugaaugcugcaguaaaaaccacuaaaaaguacggaaauuuccuuacacaaucacagugccauuagcacaucuaaucaaacagacaauaauuucuuggcaucuaaugcgaucuaucaucaguuuccucaccagcucauggacgucuuuuuaugguucaaaucagcucuuaaauaaagccuacacuagcgcaugauacuuguaucuuuuaggguuuuucuaguuaccacacccuauucuuucccacaaucccauauuuuuuucauuccacugacuuauuguagaaauugggucaauuguuucgagcucugucccacauucuggauuuuuguuuguuuccuucuaagauugcaucucuauaacuuauauuuucugugaaugaaaaauacuucuagagauuugauuagauuuagguucagcuuuuuggcaggaagaguucagauuuauacugcauuaugucaggagcacacaaggucugcuuguucuacuuccgugguacuaaggcugaaccauaaauaguagguucuuuauuagacugaaaaauacucuuuuucuguugaaaacagauuuacuaugaaagugaauuuuguauaacucuuaguauaguggauaaugugucuggauuuuaguaggaaggagaaacuuaauucuuucauagggcuaucaauuaagaagcaaggaaaucaaccugcaauguaaaacuacccuugauucccaugaguauuaaagaaguucaaauuagcuaucauuuuaacuauaccaacgaacucauauaguuaccuaguuaccuagugagcaacuacuaacgacccugagccagggccuaugaaaguacaaagccauggccucugucauaugggcagaagaggaagacacacacuguugaaaggacagcaugccaggcagcagacaguaaucagcaaauucagaccaacgcagagcgcagugagaggcaggauggagaugaggaaacuuuccaugaagaugucacugcgguguuagccgccgggggcagugacucucaucaccagagccuagaacaguaccuagcacagaagaauuuaauaaaaaccugccaaauaaaacaaugagccagaacgugcucaggggccugaaagaggcagcagcagagugggugacacagagcugggugagaagagccccgggagguccguaccaggagccagcaagcaucggcaucagggaagcagauuagcgugagcugggcaagggucugguguguguguuaagggagcugcaucugucauacgcugggcacugcugacaugggacagcagcauuggagaagagccgauuuugagaauaagcucucaaaacgcucugaaaggaugcccugcaaguaggaaacacuggggccggggaggcuacuuaggauuacaauuuaggggucauaaugauuaggaaugguuucaucggaaggaaugaaaaagcaagaugaaugcuggaggauuaaaaauacaaaauuagcaggcccugguaaugucaaaagaaaaaaaaagaaaucacagaucacacucaagauccaacaacucuagcuaaguaagauauccaauuauuaaaaaugugcuuagugcuuguacuuugucccccacaacccuggguauggguuuaaucuacucaacaucauucucauaugaagugacccugccuauacuuuaaucaaaaacucaagaaggacccccgagaagacuugguuugacgcuacaaagggaguucacaccucggaaugaagugaagacugguggcacucagcucauuccucuuuucucuuccacaucacaaauacaguuuccacuaaucuuucccaauaggacaauuauuauuacuaagaaaggcaaaugcaauaggugaggccugucucuccuggcagaacaccucacauucuuucugugggaaaggaaaauggagccaggggcaaguuaccugaccugcugcgaccuccugcagggcgugcuuggaggaaccauccagcacagacagccugcuggcuacaggaggcacacgcaaaagacauccacgucaggguaauaacaaccagcauguauuuauggagguucagagcacuuucugcaacccaccccauguuucaguaagauaaguuaggaauggcauauuuccaugauacacuuuagacaaccagaguacucgaagauugaugcuuaacuugcaggaagaagccauacuagugcugaguggguggcagagcacaggaagaagccacacuagugcugagugggugacagagcacaggaaggggccacacuagugcugagggaggaggcagagcacaggaaggggccacacuagugcugagggggugacagagcacaggaaggggccacacuagcgcugagugggugacggagcacaggaaggggccacacuagcgcugagugggugacggagcacaggaaggggccacacuagugcugagugggugacggagcacaggaaggggccacacuagcgcugagugggugacggagcacaggaaggggccacacuagugcugaguggguggcagagcacaggaagaagccacacuagugcugagggggugacagagcacaggaaggggccacacuagcgcugagugggugacggagcacaggaaggggccacacuagugcugagggggugacagagcacaggaaggggccacacuagugcugagggggugacggagcacaggaaggggccacacuagugcugagugggugacggagcacaggaaggggccacacuagugcugagggggugacggagcacaggaaggggccacacuagugcugagugggugacggagcacaggaaggggccacacuagugcugagggggugacggagcacaggaaggggccacacuagugcugagggggugacggagcacaggaaggggccacacuagugcugagggggugacggagcacaggaaggggccacacuagugcugagggaggaggcagagcaccaucuccuucacugcacagugggggcuuucucaaccuucuucaggcuuggauccaacaagcugcaguaggagcucauggacgcacgugugggggagaggucuccaugacaccacggccguacuuaaauacaacucauaaggaaguaaaucugaggagcaaacagaguaaguuuuuguguuuucuguuuguguuuuaaaaugggaaugaugccaggucuaagauuugaaaaaugcaaccauucccaccccccucacauguauugagaggaaacaguuuauaacauuguggaaaugauggaugagaaaaggguuuguuacacuuuugaauugaaaggguuuucucuuagucuuucuccacuccuuuccuucaauaacgauuugcugaauacccugagccuaauggcccaaccacuuuccagaguggggaacagcagccaguguuuccucuacaagagaaacaugugagggaacagaagguauaaccccuggaaaaacugacccccagaggcucugccggcaggcccuaggaugcagcggagggcaggggaggcgcuccugacaggagggaggccagggcauguaggaggaccuccccacuaguccaccagagcccacguccauggccccagcgagagggcuucucuagagaagccaagccccagugacagaaagacccgccaacucugacaucuggggguucccuaaggaaauggcaaacuccccaucugagaaggcugccucugcaaacagcuuccaaauggcucuucauuaauugacuguuaaauuacagcagacggcaaaggaucaucggacuaugugggggaaauccucccucaugaagggagcaaaccaaaaccaaaagaaaagaggaacucagaggaccaagacaggaaaacaaucugcgaaugugugaaaaacacaaugccuccagaggccaaggaacauacgguuguauccgugagacaagaacaggacauuauuaaaaaauaacaaugagauaguaagacauagcucuugaaaauuaaaaauaugacagcaaaacuuaccuuauaauaagaagguuggaaaauaaaaaucaagaaaaucccccccccacccccccccccaccaaaguagaacaaagauacaguaaaauuggagacaaaagaaaaaucugaggaggaauucaagaugucagugcuucaacuacuggcuuccugacaaaacagaggggaaaaaauuaugaaacagcuaauguuccagaacucaugaaaggauaugaaucuucauacugaaaguucuaccaagugccuggugaauaaaaacgcccaaccaacucauucccauaggguuuuagaaucugagcauguuaagauucuaaaaccuucugaaaaugagauaaacaggucugugcuaaggacuaaaauaagaacugcaacaauggcuaucagaagacacuagaguaauaccuucaaaaugcugaaggaaaaugauuuucaacucagaauucuauacccagaccaucugccacaguauuaauagagauuuucagaccugugcccuuuucagaaagcuguggaagaugagugaggacacagaggagcuaaaaggagcaaggcuggggaaaaguccaggaggccagggaaauggccgagccagcaccuaguccugagggagccgggagguggaaaucuuaagagagaggucuccugggagacagauccagcugacagaugaucugaugcagcugacacacugaaaguuuuauauuaagaggcuaccaaagagucuagagggaaaaaacaaaaucacacagauauacagaaugcuuuuguuucccaucagaaaacaaccaaaaauuguuacaggaaauguuauuauuguacacuauuuggcuuagcaggguacgauauuuacauagcaauaaaaauauaaaccccaaauaacaaauucacuaaucauuauacaauacaaucaguaguuugagugguguaaaggcccagaucuuaaucuaccaaaacagaaguccacauuuuaaaaauuaugacauggaaaaaugucaaugcaaguuauuauuguaaaauaugaagguaaauaccaaauaacugaggaagaauugaaagugcuguagggaggaggcuugugagguggaguggcaaggaugacuacagaaugcucuuucuuuaaaagcuguuuggcggagcuuaauuuuuuuacaucuaggugcguauauuacuuugauuaaaaaauaacaagcauuuaacacauaaucgcuaucuaugagucauuguucaaaugcuuaaugugaucucauuuaauucugacaacaguccuaauagaugauguuacuauuaucccuguuuuaagauacaaaaauuaaaguacagagagguuacauagcguguccaguagcgcagugcuagcaacugauagagccaagauuuuaacucacgcaauguggaccagaagcuggagaucuuaacucggaaggaagccaggaaaagauaauuucaucuugggaaaaacaaucugauuuucaccuauugguaaaccuagauagucaaaaccaaucggccuaucugacaugaauaaguaggaagcauuuauuuucucauaucuaaacuccuauauuuuucuaucaacaacacaaaaacacagccuaaaaagcaagagcagcagaaaaggaaaaguuggaaaaaaaacugcagucacacaaacuguaguuaaaaaaugacuaaguuuccuugauauaugaauuuguuggaaaaccauuuaucaacagccuguuucucucuagcagagucccucaagccgagagccaugucauuccccuuugacugauuaauuagccaaucagaggacauuuuucauugugagguaugaugguuuauuucagcuaauguuuggucucuaauggcgacacauuaaagccaacucggcuauuuuagcccuguggagugaccaaaaggaaagaacagaagauaaaucaaaagagcucccuucaguuccccuucaguccuuaacaaaaccccuaaggagcaaguggcuggagggaagauccucuaccaauaaagagaaagaacaaauaaaagaaaggcacacaugucuucaagcgaaagaguagccuuccuguuucugaagagcaauaauuuaucuguugauuuacagaccacugacagaacaggccccaaaagucaauauuuagcucuucuuccuuuuaucaaaagcugugcucaauagaaaauauagcucuguaaugcuucuuacucacagggcucauuuucccugcacucugaauuagaagaggcugugaguaacccaucucaagcacuauucacaccaaagucacuccagccagccaauaucccacugcacuguggguucucuaagcuucuuaccuguuccuaugcugugagggcacugaaaacacaaagaagugaaguucaagaggaggacagauaggaacauucacacauccaggacaagaagcacaucuucaacauguccacugacagcacacucaucaaagcggcucuaaggagcucgucuuugcuaugcaaucacacacuuuaucaucaccauccucguucaucauucuaauuuuaugaaucuucgaaguuguguuagucuguuuuuguauugcuauaaagaaauacgugaggcuggguaauuuauaaaguaaagagguuugauuuuggcucacaguucugcagguugcauaggaggugugccgauggcaucugcuccuggugaggccuugggaagcuuccaaucaugguggaaggagaagggagagccagcccaucacauggccagauggcaggaggaggugccaggcucuuaaacaaccaggucucgugugaacucagagugagaacucauucauuaccaugaggauaucaagucaugcauaagggauccgccccaacaacacaaacaccucccaccaggucacaccuccgacacuggggauuacaauucaacaugggguuuggaggggacacacguccaaaccauaucagaagccuucagacaagacacuacuguuuccuuccuucccaacugauuuaacgaugacuuccacauugcuaguuauauuccuggaccccacuggcauuuguguuggaggccgggacaagucguggcucaugcugcuuuugccuuuugaugccuuguccagccagagaacuccuacccuucaggccuagcucaacuuccaauucuucugugugucugugccuccugacagacucagugagcaugagcagcucccuuccuguguccccagauuguucaaggcauauuucaacagaugaauucaauucagcaagaaccuuauugagaacccacuccaugccaggcauaauucuagauaugaggaaauauaaaaauuccugcccucacggggaucccagucuccuaagggaaggcaagcagucaacaagggaacuaccgagcaugucagcaggugcucacuacugugaaggaaaacaaguaaccaaaugucuguacuuccacccaaaacugcagagaacaugguauuagaaggucacugccuuagucauuacuuaucuucaacaucaauuaaacaaaacugacgcguuaggauguccucuaccacugcuguaauggcaaaauggcagacaggagucacuucacuagaggacuuugagaaggacgugcuucucagcaaugacccuguucacucaguagguuuauauuaaauauugugacuacgcacacacagauacaauuuucucaguuccaaaggauguuuccuauaaguuauuauuggccauuuuaaacugugagaguguuggugcugacugugacgacaguggucucaacagcagcagcagcuaagcugcacugggcauuuaccaugugcugggcacuucgcuaagaguucuucauggcuuauuauuuaauccucccuggaucuuuuauuauccccauuuacaaaugaagaagcuggggcucagagagguuaaauaacuugccccaaaucacacagucuucaaacuacucuugggcucaaaugcaggcauaugaaacgagaucucaagugccuauucacaacacuauauggcccugaaccaguugcccuuuagaagaaaccagaguagaacauucauuagaugaccugauuuccucauucuacuggcucagaugguucuaccagguauauauauuugauaccagguaucaaugucuaaucacagaaccacaggaagacaaauccuaagacagccauuucauuuaucuacacaauaaaccauccugacacucaguggcuucaaacauaucagccauuucccuguucacccuauuucuguggguuagcaauucgaggaagggcugggcugggcaguccuggcucagggucucucacgcggauauugucaaaagguggggagagcuagcaaagcggggagcuggccaggcaccugcuccccaggcaagcucggggugccugcauaacucacugaucauggucucuccacgggggcuugccugggcaccgggccuccucauagcuuggggcucggggcagcuggacuauuuacaugaaagcuucaagagcaaguguuccagccaacgaggccucagaagucaccuggaacccuacugcuagacugucuuggcuacaagcaaguuccaggcccaccuggguagaggggagggggccagacuccaccuccugguguggaggugguaagggcccacuuagaagagcauguggaaugagagguaucacugaggccaucuuuggaaaacagaaucugcuacacaaacaaguaacucaagacucauuuauagauaacugaguuuacagauaaaauuggaacacccuacccaaggugaagguaacuucaccuugacacucaacaguugcaguuacucuuuaagucuugaaucugcuaagacagaugacuugcuauuuuaccugaagucuauuugaucucuuguuuggacacaucaagagccuuucacauucaucuacugaauaaagcgcauaaguagauaaagccaaaauugcucaaguauguaagaaucaagaagaauccaaguaauguccucuccuuuguggucgaggaaaacguaaaacuucaagucaagacuuaaaccuuccagcaccguuucaaaugugaucauuucacguguucucuuuacuccagaaugagagaaggucagagcuggaagggcuugaaugcauuuagcugggacucuugccugguaccagaaccugcacagggcacucccaaggagacgugcacuguggccagcagcucugccagcccaugcaggcugcuuccuuuuccugaguuguuaccuuucgaugaauuucaucagucagugcuaguucuuccuuuguccaaacugucacccugauaaccacacccauuucuuccaucuguuucugugcauaacaugcuuuccagacgccacugucccugaaggcaauucccugaacguacuccuugaaaacaugacacccaugacacccaggcccgcacagagccguucaagcacagucaccugugaggaacacaagcuacaagucuguugcuuucagcaagugggcacagccucccugacaccgcccagccucccugacaccgcccagccugcgcucaggacaggugcgaccagacacaauuuggcuuagguuaaacuuguggucaggauacauguccuaccuucuaacuaauuuucaucuagcugcuagcaaauuagaucuuucuagaaguaaaugacuguacauaucuuccuaagcuuucaccuuaaagcagugaaaauguuuuggccaacugucccagcucacagugaucauuuugaaucaggauucuguuaucaauggucaaaaugaugacaagaauuacugaagucaucacuguugggaaaaaaugaauuuuggaacucaaguguauuaauuggcuuguuugugggcuuauaguucucccuaacuacaagguucuuaauuagaagauuacuuugguguccagauguggaguggggggaggguagagcgauaggugcaggaagggggauccaccuccuauaaaccccucuugaaaaucaccuaaccauaaauguuggguaucagugugaaaauucagaaaaggagaaacacccuugaauuaaaaggcacuugaaaaaugaaggcaauaaagagacucuucucagugaucuuccccaugaggaacuuaaggcauugaauccaaccagaaaaaugaaugguccaaaauaccucaugaauuccaccaagcaaagcagaagcgucugcucggaauucauuuucagacuggauaaucagcaagcaauggggaaaaaaaggagauugacagagacgagaaaggaacacaaacugcaaagaagucaugcuuugccucaaaaagcaaaagccagcagaagaauuucaaggaaaaugauuauugauuugguauccugggagagugaaacucucaugaggguucuaauucaaucagguuagagaggugaagaaaaggagaauuauuuugccaggagcccaugccagaagcaugcuagacagagaaacgaagugagaaugcugguaacacauucuccauccucacucugguuucggaguauuuucucuagugauaaggcucaauccggaaacaagcuggagagaggaaggaaacugggaaggugggggagggaaaaaaaugagagaggaaaaaaaaaaagaguagcaggaaguucaaccagauaggaacugauggaauuuguuuuucagugucuccaacuucaaauugcaaaccaagugagagaagacacacgcuuauguacacaggccccggcaggcaccggucagcacaaguaccugcugcaggucucaaggggcccugggaaucucaauucauuaucuucgaucauuucuuugucuccacagaaagugcauacaucuccaauuuaggugcacuccaaaccaguuauuaucuuccaaaucaauauacaacaaagauggugggaaaaggaagaacuuggaaauuagaaaugugcaaccagccguccccacacagaacaguuuaugagaaguuuucugagcaacuggcaguucgugaugaucuuucaccauugaagcaaguacuucugaauagccggauucagcagggaaacagcgccuccugacagcugcugugucuggaggaaauacgaagcaccaaugaagucagaggagaguccuucaagcaguaggaaugcuuuaucuucugagcaaugaaaaacagccacagcugugaaaaacuauucuagagugaaaugcaaggucugaaagccaguuucuggcaaauuggauugauuuuuaaaaacauaaaauggugugagcaaacauuuauucaauaauccuuucucaagaauccacaaguagauugugcauggcguagaauguagauuaugaguacuuccuacucucagagaagaaauacuuauuuauuagaacguuucaaaaggaaaagacauuucaaauaucaaccaugaugcuauacaaaccaugauuuuuauggcaacaaaguccauuuuuuaaaaagagaagaaugaugaggcuucaacugacugaaucccuaccacgugccaagcacuggagccagucacaugcuggggacccaggaaugagaacaaaaauccucucuaagguguucgcuagccaguguaugccacaaaugaaaaaguccacauguaaaacacagugaagcaauuucuucuuuuucuucguuuuuuugagacagggucucacucugugacccaggcuggagugcgauggcgugaugauagcucacugcagccucaauccccuagacucaagcaauccucccaucuccagccuccugaguagcugagacuacagguggaugccacugagccuggcuaauuuuuuaaauuuuugguagagacgaugucucacuauguugcccaggcugguuucaaacuccugagcucaggcaauccucccgccucggccucccaaaauguugggauuauaggcacgagccacugugcccagcuagcaauuucuuuauuagacgcaaaaaggucagagagaggacagaaagcaugauuuaaguuucauaaacauguccuagaaaucuugcauuuagcuuggauuguuguuucgcuuugauauaauuuucuuuuaauuucuauacauuauauucaaaauaauuaagagagcacauucuuuacuuggcauaguuuguuccacuacacaacacaaaguucauuccuacuaugcgcacaaagaaaauuuacauuuuaaguaauuuuuuuuugaaugaagacuuuuaaaugcauagucuuagauuuuaaagcuucuuuuuggaccaaggacaccuucgaaaauccaaugaaagcucugcacaugggcccacacauguuuugcaugcaauuuaaaggaggucacaaacucacuauagugaguguacccugagauacugccaacaccaugagcucuccaacaccagcaggcuacagaugacaaaacuggucacgauaccacuuuguacuuacauaucacuucacaguuuaacauaccccugaaguuauuaaguaaaugauuuaaccaauuggagugaacuuuaaagacaucaaaugauuugaucucuacaaggaguucucuaaagacucauaaaauagaaaauaacacugagcauggcuaagugcaggaaguagaucauggaaacgacaaucggccuuuagcacuggguagugaccccugcagaucugagcagccucagcaucaaacggagagaccauguggucuguacacacgauauuccacuccuaaucagacgauucugucggcagcugugauugucagggucacgggcgguguuggagggguaugcaacuaugauugggguuagcacaagggaggccuuggugguaaugaaauaguucaggaucuucacugagauaauaaugguuacacaauccacaaaugugauaaaggggcacagagcuguaugagcagaugguaccaaugccaauuuccugguuucaucaugcuguacuguaguuacguaagauguaaccacuggggaaaaccagaugaaggguacacagaaccccuuuacuaucuuugcaacauccuguucaucuauaaaaaguuaaagaaaaaacccucaugacuauuaaucaagggcugcagauguuucuuagauauaaauacauucagaucauccaguucaauagagagacgaaaaaauacacaagcaacacaacaucuaugcuccagaugcucaagcucuuucuuaauucagccuccagccaauaaggaagucaagucguucuucaggcuggccuggacaccuggucacaugcuugucaaccccuaacagcucaccucugacuacagguaagguaaagaaguuuugaaauuuaaaccauuauuuuccacaaaauagcaacagccaaucauuuucccacaaaguuacgauacagcaucaaccacuggugucucuggugaagcucaacagaagcugcuaaggccuaacuaacccccuucaauguagauuuuuuguuaaaugagaaagaguucauuaacuucggcaggacugcuguauuaucggagaaaggcugauuuuggaauuggacggacacagauuuaaaagcccacgugugccauuuuggagcauucuaacaauucucucugugccucaguuuccucacugcuacagaggagauacugauauuuacaugacgggauugcugugaggaugaaaugagaaaaauccagcacaggguuuggcacacaggugcuuaauaaaauuggaauucuacgauggcagucaggagcuguagaaauuaaaaucaguaggcuucccuuauugcaagggugaugcuguuacccaagccaagaacaugguuaacgccaacguucuggaacucuggaugcugaagacagaucagcaucggcaccuaacuagagcacccacagagcuacugcuaccuuaguggcccgcacuaccacgguuuccaggacucuggagggaggugaccuccagcaacaccuuggccucugcaaugccaaauauaaauccagaccgacggagcuaugagagucaagcgaagcaacaacauacaacauucccgccaacugaggaugggagccgaaagagguuguauuuucaaacaaaucugaucaaaguccuccugccuuugacuauaagggcuguuguaacuaacaagguuaagguuucuuagcaauagucuacucaaggaagguaccgguauaccucaauaaaagcaaacuuaacauaugaacauccacaaggaugucaaagauaaauguagaggucauuuugcuuuauagaaagauacucuguuugucuuaaaugugauuacauuuaaauagauucuguuuucugcacacaugcaggcaugucaaaaggaaaauacugccuagacgcgaccuccucaguguggcacacaggucagcagcaguaucaccugggggcuccucggauggggauguacaggcucucagcccccgcccaggcuuccugaguuggaaucugcaguuugacagggaagaccuguacacacggcaggacuugaggagcucuguccucaggguuacucacgacccggaagccagaagcucucaguacagcugcauggcaggcuauccccguguucucaacccucgcuccuuacugaacgucagaauaacugcugcaacaauuggggaggaauuaaaaaaaaauuuuuuuuaaauuuuucuccuuuuguaauauagauaccuggacccugaccgaagauuuaauuuaaucggucuugggcagaacccuggcauuagcauuuguuuaaagcucauuaggcaaugccaggacgaccuuguugagaacuauggcuacagacggagagcagggccugguagaagaccaccucaccaacagguaggaccuaaauuuaucacuggaagaaaacacugaacuggaagagagagagagaugugacuaauggaaaucucacacaaaacacgauguugcaucaagguugaucaucucuacacacacuggaccaaaagagauuuuccuggggcuagcauuagggaacugcuuuugaagcuccucaaacacagguggaugucucacuuuaacaugacuuagcuaccaaagagucaaguaacaccacacaguguugaaaaccucaaggcacccaacacccaauaaauucucaaacagaaaucugccagaggaucagaaaccucugaucucuuacaacuaagagcuuucugcaccaaacacauaaauucucuuaaaguucuacaaaagcccacaaguaacauuucccucccugaucuguucaacuguacauuuucauagaggguguccgggagggcaaaggcuggggguggugggugagcagcaggcagaagagaggaucaacgugcagggauguggaaacgccaguacagaaggcacgugagccccacggggcuggggagauggggguuaucucaagguaugggagggacguggaguugauacaaaggcucagggugugaucguggggugggggcagcuguugggcagagcaaaggagauggaguucaagaggcgcgggacuggaauucuaguucuuccugaggacacggagacgacugagagagucaaggaagagggguuggagaggaggcugggauaagccagaggccauguccuuggugaacaaggaagaguggcguaguccaggucucacggugagcacugagggcagagguacaaccagaagccagccugucugaccauggcucuuuccagcagccccuugugaaggagcagccggcacggccggaugucagagcggcuccucccuagugaccacugccuaucccgugacucagcauaguccgcgcaggcaccaaagccagguauccuuucccagccugcugcuuccaucugcugagggugcaggggcagacaggggcuaaaagacccaggaauucagucccaaucugcacagggaaucaucuaaugagacuucuaaccacugguaauucuggacucccuaaaaauuauuacuauuaagaaacaaaccaccacccuagaaauaaagauuucugucagucuggaaaaaugccaggaaucaauaaaccaagucuucuuuuuuguucuauggucaccaagggcccuggcuacaaaccaauaaaagaucaucaguacaacauaccagauuagcugaguaacaguggucacaaccauauauuccagauuuucucagacaaugccaguucuaaauacuuuuagccuguuaucuuuagaaauccauaauccuaauauaucucaaacuauauccagggcugucucuuacacuucaaaacagcacaaaaaauucuuugcaauauuauacagcccaauuuaauaauuagaauaaauuauggaguucauuccauugaggguguaguuuagucaccccauucuuuucuucuaguuguaaggcaaauaauauuguauaauagaggaaauacccaucaaacccccuuauagauggugcugaucuagcgcugucucaaaugcuguuagaaugggacaggcugguucuagagaaugaaggugacaugcuuccucccaccuccauuccaaguggaguaaugcaguuugagcagaacagacaaaaucccuccccuucucggccauggaagagauauuuuccccucugauuguaucggcaauggguguucuuccccaaguuuaaucuaguccucacaccaaaacaaaaagaacaaaagccaaacaccagaaaacacuuauucuuuuuuuuaaagauuccuuauaaaacauuaucuacccacuaauauuaugaaaaggaucauaucuaggcugugcaugaagccuccaaaguguuuuggaaaguuugucagaaaaguacuagucauagauagaaacaguccuauacacaggugaaaaucagacaguauuaaagcggaacacggaaacuguacguggcuuuauaccucgggagucuucuuacucugucuuuucccaaaaaugcagucaagaucuguuuugcuccgagaugacagauccuucccuagaaaaacaaugugaugcuuuucaguaagacuguucuuccuaaaagaaagagcgcagacaugaacuaugcagcaccucaaaggaaaauggcuuuugggaaagaaagaaacaauuuugaaacuacugacuuucuacccacuuuuucauuacaacucuuucauuaguaaacaaaauuaauuaaauuuuaaaaccaaguaaauguuuuagaaccagaacucuugacauucucuuaauuguagaaacaaccuagagcauacugacugcaaggaaagcuaaauucuacagcucacccuacucccgcuaugcccucaagaugcaauuccugggucucuggguucuucauuuaaaaauagaucucauuugcuucagagacaugagcuacuuacuuagaagauuacgaaauacacaugaaaaaauaucacuagauacacagcuccagaccccacauaugcacaugaaugagaacguaucauauuugacacacaggaucuuaauaauuaacucaacaaauaaaaauuuuaaaagaauauauguaaaucaaaaauacuguaaaagggugacaggguuucagauuuuucuucuuaaaauguucuuuacugcucuagcuauauugucucuaaauaaaaagcuacauagggagaguaggaaauuaaauggcucuaugguucuuauuuaaaacacuaaacucuuuaauuucaaacccccaaaccaacuaauuuaaaauucacuucuuuggaauuuccacuucuacccaauaauccucugugagcaguaggccaaaucuagucccauuugucaacggcaugguaaaugcauuuuaaaauguaacuacuccauguaaaggcuugaggcucugggcgagggagguucugggucagacacaggaaugugagucucacgcuggaagccgaguuccaccgucacagacucacuugucuucuugguuuccuguagcacacugccuuggcaaaguaaugucaugacccagaagguucuaguucacuaucacuggggcacuuaaauaugauauugcucagugacuccgugaaauuaaaaaaacaaaacacucuucaauuuaaugcaaaaccaggugccaaaaccaguuuccuaggcagcaguaccagaugaaguggcccaggcgguaugaccuguuccugccaggagggcaggcuccucugggcucuggcugcugcucuccuuccuaccugagcuugacacuaagcccuccugcuuuucauuuaugauuaaauaggaccuacacaaaaagacccaaaagaaaaccuacuuaagaauagacgaugcacaccacagauacggcagaaaaugaaccgggaaaguggggaagaaaacugguuguagcgggaagagguggacaaacucaucggagguguagagauguccucacagcuuugcugccagcacaacccauuuuccaaugcaaagcacaguuuguacuucagaaaaggcagcuguacuuaauucaaaauguguacuggccaucuaucccuaaccuauccucuggaauagagacacucuagaaaaugcaaauuaaggucucuucuauagcaauuugacuaaaaggaaugcuggagggauuaaggaagagaggguacaugcgagaucacaguucuaaaacaugaugucaaaaugugaacacacagauucaaaacagaucugaaagucaaagggaaaacugucaagcugguagagacaguaagcuauaucaaugaaggugcaaaugugucuaaaguuuugaugauggauucuuguaucagaaauuuuuagccuuuagcaaaguucacuuaaguaaauguagaaaccaggauuguuacaggccuugcucuggauuugaucuggaaaacaagaacacagagaagaaagaagagucagagaccaguggaaaggaacauaaaagguggacaaaaaggugaagauggaagugaccuugagauaguuacuaauuaaugguccugauggaaagcuuauaaacaccaggaaauuauggccgcuuuugaauaaauacgacaaauuuaaaaagcauuuaaaaagcuuauuuguuugaguucugaauuauggucaaaucauacaaaauacuguugauaaacuuagagaaaacgacaaugaagaaaacugaauaggaaacaucuaucuggauuugguucaucuauuagucuucaaugcguaacauuuccagaaccaguaagaaaggccuccaagagucaaacugaaaguuccugcaaggaugagcagguacuuucaaggaagaacacucuauuuagguuugcuuuagcuguuugucuaauaaucaugauuaucaguuucccagucuaucagaguagcuacugggaagggaggaacauuacugcuauagucagacacauuuacaauaccaagaaauacacaugggaggcaacuaaaacuuucauugacacgagaacuuaggaaucaagaugauuuggaaacaguuuagcaauaacccaacaagcuguauuagaacugaggcucaaaaaaccaacucuauggaaaagcagaguugagcugccgagaguaaagaagugaagggcaaggaauauguuugcuaaaauaaaaaaacacuuaagguuuauguagguagcuucaauaguuuagaaaauucauuugcauuauucaaucaagaaggacaaauaaaaugacauacuuuuauuuuuaucuuuuuaaauggcaaacacacagaacuggcagucaaccgagggcagaagauaaggguaacuccacuaaaagacaccauaaaccaggaaaguggaaagagucagugugagugacacaggucagaccuaccaggugcuaccugauauuuauuuaaaugucaaaagaaucagaagaggagauugaaugcuccucacuaccagugugcaacugaggggcggggcugacugcgcugugaauaccaauucuguauuucccgaccaggaagccgagcaccugcacaugcguuaggcauguaguuuccuuguuucaguagcauauaaaauagcccaaacucucaaaaggauuaagaagucugcaagauucccaggauaaagcugcacaauuacaguuuaugcaacuuucauccaacaacugcauaacugaggggaggaagcacugcucuccugcucuccugccaacgucucaccauccagucagaaaaccucagaaauggcuuuguaucgauugacauuuuccccucugcagauauagccucuaucugcagagaccuuuugcauuaaaaaaaaauacaaaaaacuacaaaccaagcuggaguugagccuuuaaauaaguaugauaaaacugacauuuaaaauuauacaauaaauuagcucaaguuagaauuauaaacucaggaccagggaaaggaauaauuauauaucagaacuaaaacgauauaaccaaccaggugcaguggcucacaccuguagucccagcacgcugggaggcuaaggcaggacgaucacuugagcccagaaggucaagucugcagugagcugagacuguuccucugugcuccagccugggcaacagagugagauccugucucaaaauaaaaauaaaaauaaugauacagcugauauuuaggcaguagcaaauuuuacaacacuauuugcuacuguaaucuuaguagaguaaaauuuuaaucuucacucuucccaagcuauguacaauugcaucuuccuguuugauuuccuggacgauacaugaguugcaauaugaaucauccucaucaacuaagugaaugaguuacagucguuaucagcauacccacuggcgaaaaucuuuauuaucuacaaugcugaaaaagcaaaaguuccaugaaaugggucauuucuaauaaaucauaaaacagaaccuaccuuagaacuuaauagucacuuacaaauguauccacauuuuacaaaagaggaaacugagucugaagggaaauggguaggugacuugucugagcgaguaauggccagagugagauuuucugugaucuaagauaguccacccuagaggaaacuuuaaaauaagugugcaccgugauuggaaagcuagcugauaaaccauucuuuuccucacucccuggacuuuugcuuccuucucccuuuccuacguaggcccagucugcauguccuucccgucuccacuccagcucuucucugcaaucugacaauagauccgagaauccuucuguucugcauacugacucccucuucuccccaggcaaggcuaauagauacagaacccucgcuggaagacagaaaacgaaggcacgaggcacucagcggucucacagggucacccagcaaaggaguggcuuaacuagaaauagaaagcagaugcucccggcauccauuagauuaaagcagauuacagaggcuuaucccagccucagcaaaugcuucagaugaaaucaugcaugcagucuggcaucaaaggaaaauuagaagauucuaccuguaaaagugaaagcguaaaaggcugccacaucauccgaaaguuacaggucacugaguuuuauuaauuugcucugcaacagcaccuucugugaucucuaguuuuucucuacagucuaaugaaagaagaaaugcuauuucagggacuggguaugaagugagcauguacccucucuucaaaaggacugagggccaaggaagccuguauucuguuccauagcacgcugggguggagaagaaccccagucagaagggauacgggcgacagccaagaaaguuccaugugagagaaagaacggaggaagcggaagagccacggcugcuggagagggaagggaggcccagccucucccugcacacaauccccaauccacucagcucugccacggccucucaccucaaccaaacccagcccucacuuuugggcuccuggcccuaaaugaaaagcaucaucaauacuucagaguaguggggauuccagcucccacugcuauccaggcuggcuguacaaguuaagagcuucccagcaaugcccugauacgcaugacauuccuagaagaccaaagcagagaugugcuguuccuggcauaucaagguagaaacacauccaaccucccaggaaagaaccaucaacagagacuagauauuacagcaucagcagcaucaucacgcuucuuauguaaacuauguaauaaguagguuucuaauucaugauacuguucuacagacaaacuggggaguugguucuauuagguuaaauugcuucuuuccaaugcaagaucgccaccuaguggcugaagacaacaaccgcaugcacaaaugauuucacauacugggaaggggcuagggagguggugaugaaggaauaggaauucucacccaggucucaaacggcuuuuuacccgacuuggcaaugacuauggaaugccuacgcugugaaauggagaaauuacguggaauaaagggucaaccagggagugugcuuuaucacacuggagguaucaauauagagcauaauucucuaaccuggcguauuaaaagcuauuuaacaccaacuuucagcugugaaaaaacaccaugcagcuaaaaauguugggcaagaaauuaaaauuauuuucugaccuagcuacauaaagucccguuuuccucuaaauauaagcugauuccauuuuuuagcucagccacaggacuuguuuacagucuaaaaccuaaucugggucccaucucagaucuccuagaucugaauucuaacaagauccucaggcacaccacagucaaugcgaagacuccagcgcuguuucacagcaaugcagucggagcuguccauaaagcaugaagucgcuauuggcccagagcuaaaaugcuucaagcaacucaggacaaacacguagauuucaauaacaaguaaagaaaugcuuaaucuuaccuuuugugaauuucauauagugaacacgguuuuuggagauuuuggacuuuuccucaaggcuaaaagauuucuuuuccuucuuguccgaggaaucuuuaaaaaagaugaaaaaaauacauuaaagucuuucuaauccaaucucauuuauucuccuaacaguggauagucuugaaagaaaauuuuaggagcccuaucauuaaugauugaacucuuucauucauuugcucugcaacagcacccuucugcuggaucucuguuuucuuucuaggagucaaaugauuagaaauauuuccuuaauuugcauacuauggaucaggccaggcugcccuccagaaauuuagaaaauccuugaggaagaaauggaaacuuguguucacacaaaaccuagacacaaauguucacauuagccuuauucaucauagcaaaauaccaaaaaucacccccaaguccuucaacgugugaaugcaugaacagcugagcaaccccugggccauccuuacaguggaauaccacuccacaguaaagagcggcggccgcugccaccgcaauggccaaaacaaacuccagggcauugugcuuagucagagguccaucuacaaacauaacauaugacuccaucuacagaacauucucgacaugacaaaacuacagagagagaggacagaugaaugguuucgaggggacaaggaugaagguacaguggguacaaauacaaagaugaggcaugagguugcugugccgugguggccaauccuguaucuucaccauugugguugcugcaugaaucugcacuugugauaaaauugcacagaaccauccgcccauguacaaaugaauggagaccaaaaaaagaugaugaaaacuggcuaagguuuguggugcaguugacaguaacaccaaaugucaacuucccgguugcgaaaagccacagcaauguaaugucucuccacccugggagaacagggggaaagacguucaggacucucugaauuauuuugcgaauuccuacaagccuguaauuauuucaaaauaaaaaguuccuuuaaaaaguaaauaaagguaagacagguuaaaugaucaccuaaauacagaucagagaugacgauuaggugacgcauggaggagcagcaauagcuccaagccaccuuuucaggguuucgggaaggacaacuggaagggcaaaaggagcaggaacacaccauugaggaagacauccgagugguaacgccuuugacggaagggaaaaugugagccagaaaguagguccuugccugaaagguugaucagagcagguugaucugggguuagagucaauuauaaauuagcuagccaccugcauucucucaccuguaucugcuugucaaguucagacagaagagugccacagaaacgaucauaggcagaagagagacuaaauuuuccuacaguuuuaagaacauucagauaugagguuagagaaacuggaaaaaaagcagccgggcgcgguggcucaugccuguaaucccagcacuuugguaggccgcagcaggcagaucaugaggucaggagaucgacaccauccuggcuaacauggugaaaccccgucucuacuaaaaauacaaaaaaaaaaauuagccgggcgugguggcgggcaccuguagucccagcuacucaggaggcugaggcaggagaauggcgugaaccugggaggcagagcuugcagcgagccgaaaucacgccacugcacuccagccugggugacagagcgagacuccaucucaaaaaaaaaaaaaaaaaaaauccaacaaaccaaccuucuucagaggauauaagagaaauuggaaaaaaagaaacucucacccugacaguggagcgaaacaagcacguguccauucaacaacaugugacugcacugcaaccccucccaggagucacuuauuucaaagguauaguucccuaugggaacuauacagcaggcucgaaagaacgugaaggcagauguuccgcacuugaggcaaagcccagcacgggcucauuauuuccacaagcugaaacauucucuucugcagccacuucccagggacaccuuggauuuuuugcaaagacauccuaccaguaaauucuucucuuuugcacuucauauggcacauaacauuuucaaugcugauguuccaaucacaaaucacagaggaaguuaucagcuuaaagcggcuccuaccgacugcaaguguaugagggacgaggcgcuggacuggaggcuuuccaugaauucuuggauuuccuucccacagccacuccauaagagagcugcugugaugccugaacucacuacagaggacgacacugauaaggcacacccaggaagcccccgcgaugggaccgaagcccaggcagacaugacgcagaggccacauccugaagcaccacgccgugcccucacagagcagcucucucagccuugagagggcagaagaaucaccuggugagcgucucuaccuucucagcaugcagguaucaagaaggaugcgugagcaccgccaggccuugaggaaucacuuucuaucuauuuguucacgugcacucaugccugaaacugcucggagucugacuuaugcaccaaucuggccguccuuucccggguauccccucccacuuuacaaaggaaaggcacaacuuuccucuuaccgggaucaaugagggacaagggaaaauacuguugucaaagcagcaaucaaagcagcuggcccggcccucacaccccuacgcuaacccagcucaucaggaggugcacugccaaagagauguguuuaauaagcauucauuaaaauguauaacagaucugcuaauuuuauucacugugaucuacuaaucaugaggguaggugcaguggcuaaagccuguaaccccagcaccuugagaggcugagguggguggaucacaaggucaggaguuggagaccagccugaccaacauggugaaaccccgucucuauuaaaaauacaaaaauuagccaggcgugguggugugcaccuguaaucccagcuacucaggaggcugaggcaggagaaucgcuugaacccgggaggcggagguugcgguaagccaagauugugccacugcacuccagccugggccacagagcaagacuccaucucaaaaaaaaaaaaaaaaaaaagagagagagaaaauaaaacccuagauucuuuaugaaauccuucagaguaaaguaaauuuucuggccuuaaucgugguuuauggcucuagauuugccagccacacuaucaggaggcuuacagugcugaguaucucugcuugcuuuucuuagauguuauaaugcauuuaguccucacaacaaccuuccaaagaugauacuacugcuuccauuuaaccaaagaggaaaucgagguacagccauguucagcaauuuaccgaaugucauacaaaugaaaagucagaccaggauuaaaauccaggcagucuaacucugguguuugucucuaaaccacugcauucuauuuaaucuccaagucuuauauguucaugcuuacauucuuacauucuuuuuuuuuuuggagauggaguuucacucuuguugcccaggcuggagugcaauggcgugaucucgccucaccacaaacuccgccucccagguucaagcgauucuccugccucagccuccaaguagcugggauuacaggcauacgccaccacgcccagcuaauuuuguauuuuuaggagagacaggguuucuccauguuggucaggcuggucucaaacucccgaccucaggugauccgcccgccucagccucccaaagugcugguauuacaccgugcccagccaagcuuacauucuuaucuguguuucuacugaguucaacugugaucguaaauaucaagauguuuucuguguauaauuaguaaggaauaguguccuugaacuuuacuacuucauagauccugcauuuccuaauaugagucauucaguauuuucagaaaacauuuuccuuaucuuuuucuucugcuaauaaauuauugcccuucauauuaggaccacacacagaacuguuagguuauuucaaaaucaugauccuauggauaaggaaaacuguccaaguuauacauuccaacaaaaaguccaaucugguuagaaaaaauaccaacaaagcaccuuucccuucacacuguugggcucacuuccacacacgucacugcaauaaaccuuccuaugguuagaugugugcugugauuuuaccagguaauuaccagcauauucugcuagcuaccuccaagcaggacugugucuuauaccucugcagauccucacaccuaaacuaguacccagcacacagcucaauaaauguuugcugaacucaagucuaauucauuauuucacuccacaaaauucuuucaaucuaccaaauaucuuuugauuauucacacaugacacacaaggaauagacuguucauaaacaagaauguuuauaaaaaugcuugcagauuacaacaaaauccaauuaaaaaaugggcaaaguacuuagacacuucuucaaagaagauauaaaaauggccaauaagcgaugaaaagaugcuuaacaucagucauuagggaaauggaaauccaaaucacaaugagacaucaucucacacccauuaggauggcuauuaucaaaauuauaaaagauaauuacugguuaggauauggagaaauuggaacucuuaugcacuguugauguagccacuacagaaaacaguacggcagcuccucaaaaaguuaaaaauagaacuacuauaugauccagcaauccacucccaggcauuacccaaaggaaaggaaaucagcauguugcagagguaccugcaaacccacguucacugcagcacuauucacaacagccaagauauggaaucaaccuaaguguccaccaacacaugaacugggaaacauguggugcauacacaccacggaauacuauuuacccuuacgaaagaaugagaguuuuucauuugaggcaacaugguugaguuuggaggacauuaagugaaauaagccaggcacagauaaauaucacauauucucguucauauggaaaagcuaaaagaguugagcucauaaaaguagacagcagaauagugguuauuagagcugcguaaggaaaacagcuauguaggaacagcuaaagauuggcuaauggauauaaaagucccacuacauaagaggaaaaagcucuaguguucuauagcacuguagggugacuauaauaaauaauauuuuauuuuauauuuucaaauagcuagaagaacagauuuuaaaugcucccaacacaaauaauaaaugucugaagugauauauaugcuaauuacguugaugaacauaacacauguguacauuacaaauugugcacagguauugacauaucacacuauacucaauaaauauguauaauuaugugucaacuaaaaauaauaaaagcaaaaaacaaaaaguagauaaacauauuugcauugagaacuuaugucaucugauuucccuaccugugguuuccugcccauggcaaguguucaguucggccagaagcugguuaaaaucauccugaugggcaauccaguuguccugaaaauaucaaagaaaugaacgagagguaagccuguaguuuacuuacacugacugagaugauacauuuuggaaucaaggaaauccagugguuaauuaagaaauuuuaaauguuccaucaaaauacuauuugauaaauuuaaguggauucaagaaauaauauaaaguuaaaaugcucuuuauccaggucaauauuaaaaaggggcuuccuggaagcuuaaggccugauuucaaaugugaaugacuuaucgaucaagucaauauauaguaaauaaucaacaggcaaccugugugcuaaauguuaaaguaaaacauaaugaaaugacuauuuuuuucucacuaggggaaauuccauaguugaaaggacaagaaccaugcgggacaaaaaaaugcucuucuuugcuugguagaauuaaaaucuucuaaugacuugcaucaacuccaauuuuacaaaacucugaggaaggggaggaggaagaaccuuaaguccccugaaucgaugaguucccauuuguaaggugguuaccuaauaaguuuauuauaaaaaaaugaaccuggcuuuuauaagagaaugaagaucucccaaaccagugggaagcaggguuucaguguacgaaucugccuuacucacauucuuagcaauuuuuaagaaugcuuaagguaaaggaauaugaaauagguuuacugggcaaugcuucuucuaagaaaauaaguauaucuguguuaucuaucccucaacaacuacauuugaaaucaacuuuauauaaacucuuucuuuaguggcuaaaaauuuuagcuccgccaauccacuacucagagauacggaacuaaccaaaguaauucaauuuaccuaaaguaauuucccagauucccuaccagauuauguuggcugcaaaaacuuagaaacaaaacuuuucaguuuagauccuuuccaaaagggaacaaugauacuaaaaauaaaaagcgcgguaggccacugacucugaguuauagugccaugcauucaaagcgucaguguucaagaggaaacgugaauaaaaagaagugcugcaccaauggucagaagcagaugaaccaaucaacuuucagauuuacaagacugaagccaauuaugcaaagacacccaggaggcacacacugcugcucacuucauuauugaugguagcuccgagucccaggugguuauuuuucacuugaacuuuaauaugaucuguggcuccuugcuccugagccccuaaacccuguggagauuaaacacagagaguuagaacauuccucucacugauacucagaagcagagcacugcuacaaaacucacagaugccuacggcagguguucugaguugaugauucucuccauuaaauacuuucacaaagcaacaugggggaggacucuaaguccucugcaucaauuagcacucaucuguaagauuuuccagguaaggaaagaucaagugcaaagacccgaaggugggaaaaaacucaguguacugggaaaccucagaggcacccaggguggcuucugcaaauuaaggaaugaaggaaguaggaugacggaggggcuagaucucacauaaccuacgggaggaauuuggauuuuauuuuaaagacaauggaaaaccacuggucuuuuaaggaugacaugaucuaauuuccauauuuuaaaagaucauucuggcugcuguacagcaaaugggccagaggagaaaaaggagggaggaagggaggcagcugagagucugaccagucagugagcucaagugaugacaguggcugaagcagggcucugcccugcauggagaagagacgacuggggugcgggaggcuggagaagagacgacuggggugcgggaggcuggagaagaaugacaacuggggugcgggaggcuggagaagaaugacgacuggggugcgggaggcuggagaagaaugacgacuggggugcgggaggcuggagaagaaugacgacuggggugcgggaggcuggagaagaaugacgacuggggcugcgggaggcuggagaaaaacgacgacugggcugcgggaggcaagagggcggaggaaucaagcaugacugucagguuucuggcuuguguaaguggcagacggugccauguaugaaaaauggggaaaaccugggaaaaauauauuugggggaaucaagaguuuuauaauagaaaugauacccuugaaaugcuuacucaaguggaaauaucaaguaggcuauugaauuuacaaaucuagagcucagaggacagaacuggacucaauauagaaaaaugacaguucccagacuuuagcuaauucaaaguguggcaagggaaugaaugagaucacugcagcaaagugcaaaaaaggggccugagguugagccucaaggagcccuaauaaucaaaagucuauagaaagaagagacagcaacaaauuuaggaguggcaagugaggugaaaagaagagcagaagagacaauagcacuguggaggccaagacagaaguauuucaaggagagaguagucaauuacauccagcacugcugaggaguuaaguaaugugagaacaaaacaagcggcccacugauuuggcacuuagagaucgcuaaagaccucaacaagaaccauuuaaguguagagguaucagcagaggcucuacuggagucaagaauaaauggaaagggaaaaagcguguagccuaguugcaaugucuaugaaagaugcuaagcauggcagcuuaaaugauagaaaguugacacuuauguccaauccuaauuuaucaucauaaggucacaacaauuuuugauuugggaucaaaaucacuuacugauccaaagcauaaguuucuuccagucuccuaagaaggaaguuuuccccuaauuucuaaucucuuuucauagcucagauuuuuuuccgcuuuucuccaaaauaccuuuccuuuagaccaccccaucuucucuagcauccgcuggccaaacuuggaaucgucauuacuccaggcaguguucugaggauccacagcccacuucugcuuccgccgaccuguaaaugaaaaagcauuaucaucagcaauggagaugauacccggaaaauaccacacaaacauacacaugcacaacuuuguguauuuuauguauguauguaaaauaugacauacauuacaauacagaaauuaauucaacacucaacagaauguuagacuggaucauuuauccugauuucccuaauaaauguauauucuagacauauaaguugaccucuuaagauuaaaacugaaauguucccucauaauguggcaaagcaaaugcucaauauacuagagcugggccuuccauacuccgccaucagcacaacugaaagcaccuguggacaccagcauccucaucaccaucagcaguaguagcagcagcauuacagcuuccauugccaugcguuacuacauacaaaagaacaugcaauaccaaggaugcgcuuaaaauaguaaaugccaauuauucaaccugagaccugcuccaaacgcuguacauaauauucaguuuucacaguaccccaacgaguguggauaguaccauugucacuggcagauaugaaaaucugaggcuuagagaaagaaauuugccgaacauccccaagcaaaaaccagauccuuuaaaccaaccuugguccuacuaacuucaaagcuuauauucuuaauucacaacauacaauagucauuaugcucuuggggagagucaacuguacccuccacacaugugaccuacagauaauaacaaucccaucccucucauugagaugcccugaagcccucugaccccucuuugaacuucuagaauaacuuaucuguuucuuaacauccacuguauuagggcuauuuauauccgccuuuccgguuucccauuagaccaucaucuccuuagggcucauauucaugucuuuuuucugaggcuucauugcaagaaguaaaaaaaucacugugcccacagcaggcacucaauaaauaugugaauggaauaaacgauaaaaaugaagaauggaaagaggaagaaaggaggaaagaagagggagaggaaaaaaggaaggaaggaguauaacugaauuaagggaacugcuuugaaucucaucaaagcaacuuuuuuuaaugcauauaaauuacugaucauuaugaacuccaguuuaucacugucguuuuaaggaaaauuauggcaaaaauaaagaacuccaaagguucaaagcacaagaaugucaaacugaaaaguagacuguggcgaaaugagaaauuuggaggugucauuaucauuuaucugccacaucaauauaagcacauugucucaccaucaacacaaccccuccuaccuugcccaucucaucacauaauuaaaaaauaacaugacccccugucaaaggggcucacuguggcacacauaaaaucaauagaggcccauaacuaugcacacuccagcaaaaauaggaaauccuuuacaaauacacaggcagaaaaaaaggcccuuaacaaagcaaaacaaguugggcucgaauuuguaguguuuugcagaaaaaaaaaggugacccaaaaauguuccaucuaaauuaccacuuuacuuaucuuggcaaauacucagcauaacacugcgucugcuaaugaacaacacaccagagagaagccuguuagccaguauucuauaugcaagcuggcaucagugugucagaguucaugugucuaugcagugcuugccaggggucuuugacuagggcuuguacgaaggagacaguuuugagaauaagcucacgcucugcaguuaagaacugcacacgcuucacauuaccuacuuauauaaaacaaacuauaaugccuacacaagagauuagcuauucaaggucaauuccucuccccugggaaaauggcaguuagcuucaaucaaugggaucacaccaguguuuccaaacaaggauguugggggggcgggggguggcaguuucccauugaaaaugaguaacacuggguuaaacuaaauuucauauggaagaaucucccggaaacuuuacuaugcaaaugugcagauccucuuagaggaggccagagcaggccugccaugcuucccagacuucacuugaccagaacccugcuucccuggaacauuucccagcucuaauggcacccaaguuuccagguguggaaaaucaugguaaggaaaagacugccucugagcuguuccaauuggaucaccuuuuacauguccuuuguaauucucaugccacagucuguucugugcucagaucucagcuuuguucacuaacacagaaggccugacugcuauccuuugaaaggccuguucauaacagggaacucaaggguucccaccauucgcagaacugguaagaguggcucauugugccuguuuaugcaaaugauacaguuuaugcugagcaccugcuuuccuucugcgagccaggaauuuuggugccucccagguagagggugucuaugugaccaggccccaggaaaucccuagcaccgagucucucacuagcuucccuggugggcaacauuccauauuugcucucagaacucacuacuggaggaauuaagcguguuaugugugacucccugggggagggcucuggaagcuugacgccuggcuuagccuggacuuugccccgugcaucuuuuccuuuugccggcuuugcucuacauccuuuugcuguaauaaaucuuagcagugagugcgacuauaugcugaguccugugccugaaucccccagcacaucauugaaucuggggaugaucuuggggacccuugacacgaucuggaacagcaguguuuacagcauggcgcugggccucagguagaaugcccugaaucugcagaaucacuauuugggaaguauuuaaccauccucuagcagguacuccuauguggagaucuaacuguaaaugggucugucgggauacuuuuggggcaaauccaauaaaaaccauccacacaacagcucaauaccacaugacuuaugcuaggaucccauuuacucuaaagggcguguugagucccaagagccagaggcagaaguuuuaaacaaucucucaaaauucagagguugaucagaaggagaguauuguuacacuaaauuaaauuuggccugaggaggccuccguacuugaguccuuacauaaggaacugcaaccuacguuagaacuuaaaggaagcgaaagccuaccguaggaguauacucuuauaacauauaagugagccucaauccauuacagcagcuaggcuucaaucacaggcagccaucugauucaaauaaggcaaaucagagcgguaacccuaaccaaguugucgcuguaccucacuuccguuuacuguccauaaauacugccugaccacauagcagguuggaguucuuagaaccgguucuaguucugaaggcugcccaauucuugaaucauucuuugcucaaucaaacucuguauaauuugucuaagguuuuucuucuuaacaacaccaauccuaaguaucuaauuacagaagaugcuauacccauuuagcaaauuacgaaaaagaaaacacaaaaauauuacauauuauaaugacaaggauuugacaauuuggaauaacguugggaagaggagaacugaaaacacucucuugaaaucauguaaucugaauuacugaugccuacaaauagcauuuuacaccucuauacuucagacuuuucaaacuauguucauguucaccaucucacugauuuaaggccaccuagggauaaaaauauuaagagaagauuuuguggccucacaaacacugaucaaaggaacagacauaaaugaauagcagaacuagggccaaagucgccaagugcaugcugaauuaagcaaacaucaaagaauacgaaaaccagaagagaucuuagcuaucuaggcucuaacccugacuccucauuuuuuacuggugaaaaaauagaaccgacggguucagucuaaaacauacucauuucuaugggucuccgcuggucuuacuggcaagaacauaaagauacagagauaacuggaucaauuuugccauuuucuaccucaaugacuaggggcaaauuauuuuccuuugaacgucaauuucugccccuguaaaaucgggauggugccugacccauuucguuuugugcuccuaaguccuccacccucuuagaaaagagagugcuaacagcacuuauuucacaaaaucccugugcuggucugcuugaucuguuaaauaagcuguuucuguucuuugcucacuguacaacucgccaagcaggacccgcuuuucaggaucaaagcaugacugccaucuggcggcaagcgaccuucgcuacagguacaauucagaaguucagcagccucuacagagacagggguuucaccgacuccaccaagugaagauaaaugucaaagguaaacaggcaggacggggcgcuguggccaacuaacaaggucaaaaacgccagucucacuuagaauuacacauuagcccugcacucccucgcuaaguggcugacgucccauauuugagacuucuaacuccuuugcuuuuucuuuuucuggguccaagacaucuuggacaaugugauuacaguuucaagugauccuucugcucaaccuucucuuuuuaaccucaggaagcugagguccggggugggugaagcaaccaguccgggaccccacaaagggcggcggcggggccagucccgggacccgguguucugacccacuucgcacgcgacccagggugauucugagaacggcgucuccgggagacacuugcggucucucucacuagcagaccugcggccaacuuucggggagcucugcggcgagcaggacaaucagagccgggcucggcuccccggucccccgaucccaugcgccaggcgcgccggcaacccgagcucccagccacuccgggcugccgugcgcgucacccggcaucuucaccaacgcgccugggucgggccuccgcuuccgacacucacguucagccagcauagacaugucggagagccugugauaccgccgccucuggaccugggugacugcggccacugggcgggcuggagacuccaggagaaucaggacgugcguaacucccucgccggcggacugcagcggacggggcgcgugcug

SEQ ID NO: 17625 - RNA, 30329 nt, Homo sapiens
auggcaggagcugaagcaaagguggggagcuaccuaccucccccagcuucuuuuagagcaagucuucagcgaacuccacuaaacaaugcaaagcuggggugcacgccaaagcaggcccaacacugggauaacaggagucacccaggacagacccagagaaugcagaauguauggucccuuuauccacaggcucuagcagguauuccgguuucagauggauuugaggacaguuucucaguuuggggucuccacuucuggguggugugagaguuuaggccuugcaugaguagggggcaugggugggaaguccacugucccaccguugucuuggugucuacccagugucugcuguaagacggugcucccugcugcugccucaggugggugggagggaggaguuuucccgugggaccacccauuugcuauucuuagcuugagacagaaagcccaguuuugacuuccacagaggaugaggcccgaggcccgagaccuuuccuccacucgcugcuguggcuucccuccacauuucuggcccugugacucucccaacuccucccgaccccuucauaaauacagcucagcuacacagaaaauauaugucuaccaugcaccacacccgggacuccugcagaugccagugggggcugagggaggagggcggcuucucacacuggcucaggacuccaucaccugaaaugcaauucuucccaaggccacuucauucacuuguggguuuggaaggccucgagauccagcugggccuguccucuccuccaaccuugccccucagaugaugccaggccgccaggccuccucugcuuauccuugaacaaaugccaccaaauagucauggaagucauguggaaguuagcaaggagugggucucuggcacguggcuuggguagaagcuguacccacuugccccuccaccagcucccacacgcacaugugaguacacccauccacgcuggcugugaggguuucugggacccuggugaggcccuagacagaauccgauggcagcucucacacuucccucaggaccauaaugguuucauccauacaguagauauaguuguucacaaguguuuauggaaugaaagaggaaggaagaaauaaaaaauuuaagaaacucccugaaccuccuuccucugucccaagagguauuaggcaguacaucaaguuucuuggggaucaacacaccuggccauggcaucagggugagaugggaggagagucucagguacagcucccagcaaggcugccucaccugcugggggguccuguguccuggacuucucugccagggcugcagaggacugcucugcuccuucugcagggcacccucgcuaagucccccaacccccuaaggcagcugacucugccuggaaacacagacaccaggcacaccucagguggcacaaacuagaaaguagguggcaaaggagagauaggcgggaugagcuaaugacaugagccugccuuauugggcacaaggggugcagcaggcagauggcagagcagggcaggggcagucucgggcuugggaagaggcaguacauggugacccccucacuguucugauuuugagggccacagucaccugucaaaccaacagcuccaggacgugugccgcuauuugcaugagaggcaugacgccccugggaaacagcacggaagcaggaggcuucugcucucugcugugugacuucgaguagguuauuuuccuccuugaaccuugaaacccuugacacaugggaauagcaaaccucaccuugucuuucuccuaggacgucuuagugagagaggaccagagacaccaucccacagcaccucuacucgacaagauagagagcuggggcccagagaugaaagggacacaggcagcaucacacagcagauccacagcaaagcgggcuccaggccaggucuccgaccucugggacagcaccugcccccugccugaguccagacagugcagaugcuccugggaggaagaguuuucuagagggcacauggcucuggguccucuugugggagaccugcgggcuggacugcaugcaaugaagccugugguggaaaugucaggaggaagaauccuaggauacauucuccuuacauggcaugggauuccgcagagggcuuugcugguguguggggcacccucacucuuacuggcuugcccccauggguggcuccaucuucagcggagcucaggcuugucagcaugugaaaaguacccccagagcaaagcucugugcuuagcagagguccacagccaucucuugucacucagaggaaauaauuuggauuggauuuuaggugguagcagguaguuuccaagacagagaccagaugauggcauggguuuguuucuuuuaaucacaagaagucucucugugggugcugagcucaccgugccgcaaggcucaugguuauggguggcugguccccagucagucucguguggcagucgggaccuucuacuuccuugccuucgcuuucuuuccuuugcucgcucuuuggggcuucagggcuuccuccuggccugcguggcuggugauggggggcgggauaggggugggggcguugagguucagagucuucuucugaagcuucagguccaagauggcgaauguguucuggaucuggcgcugcagcagcuccugcaggagcuccaucuggguguggacugccuggcagaugaggcucuccaacuccuggaaggaaaggggaaggccgaugagcagggcuggggagccucgccggauccaguucucaacucagccccuguugcagguacgagaauguguccacuguccauccgucucacccugcccacgggccgugguugccuggaccucuggcuucugguugacuucagccaacuaggggcgggaggucugaggguggggagguccucaucuucuccugacuggcuguggccuggccauggccacggacuauggguagucacauucccugucccucagcccuugccuauaacuaaagcucucuuuuuggauuccaauagucauucccucccuuuucuuuucuugccuagagugacggccaggcuguuugagugugucauuuguucugggcccaucggccagugccauauuuccuauagacccuaccuccuggucaaugcaggcuccaucuggauacccugggcccccaccauccucauucucaccuuucaaaguucuagugguagcuucaugggaggggacaggggaaauugcuucagagaguggguguguccuccacccagccagccauaggaagaauggaaaugcagccacuguccacccaucauguuaaacaggaaacccuguuggucaacuccaucagaguuauagcccacagagccuggauacauggaccacguaacuguguuucucuagguuccuugcccgagcaaccacacagcauaggagcuauugucaggggacacacuggaagcaacugguuggauguagugcauuucuuugagaucuuguauucacuuaaaagauaugcaaaauugugcauuugccccagaauauccucuuguuguuuuuguagaaaacaacauuauuggggaagguugugcuauaagagaaugcgugguguuuuuuguucuaugcccuugagugccccaucucaggugcauagcuggggcacacaguguagggggcucuggcucaccagcuccaccaggcaggggccagcagugccaugcuggaggcugggcggcgagcugggaggagcaggcaggaacagcugugggaagugcagggcaguaggggccacuguggccaugccccacccugcuccgugugcuagagcaaggucccugcagggggccagagacauagacuguugcguggguuuuguugggucuuuauugaaugucuucgugaacuaagaucacauggcccccugaugugcuauuugucuggagacuuauccuuggaugagcaccauccaggcugcuaugcucauugcucuuuagagauuuucgugugugugugugugugugugugugugugugugugugugugugugguguguguguaacccuaaaggaauacuucccagggccauuugcucuucagcugaugauucagaaaucaaaaucccuuggaacucacaggcccugcaacucccccacuccaaugccugaaacacaggcacauacauacacacgcacaugcaaauacuugucucucaaaguauguucagagaugaugcaacaaugaugacuucagugccuauguauagcuaagaaacuaauguaggcuuggccaggcccucaagaagucagcuacccugaggcuggggucgucauggucauugaagagcuggucaugggaaaugcuggcagcuagagccccaguggucuggcagaaccuccaagagggcagcccaaagucugagauccaggcaccggauccuccuaaguccucccugggccccagcuccagccuuugucucccuggucacaugacccuccccaagcuguccccaugucccugccuccuccaucuucucccccauccuaggggcaugccggcucuggauaaucugcagcaguuccaaagcuggagucuuuuuccugccucucuugguggaaucugucacugaccaaugacacagaggaaggaacuuagacuucagggucagccaggccucaguccaaaugugaacucuaccauaugcuagcuuggugaccuuggcgaguuaaaauguucucugcgccucagucgucucaucacuaaaauagggacaugaauuucuaccuuuagucuaccgcgaagcucgugguagacucuugauuccucccugcaucucucccccuccccugugugccacugaggagcucccaucugcagugacuccagcccuggcuggugucucugcaggcccaggugcccacccacggcaggggggcagagccucaccugucucuccaggaccuggccgggcugcgcaggcgcggcggcagcgaacgccuucugcagcgaguucucccgcuccaggcgcagcgccucuuucaggagcagcacgucggcgcgcuucugugccucggccuccgucaguguggccaccugcugcucguggauccacaagucccuguccaugcccucggccagcgggaggggaugggguggcaugcacaccuccaggugggcaacggucaggucgaccugcugguccuggcccaggacauacugguagaguuuguaguggcggaugaaggugugguggaaguagucacagagggccagcaggugggugguguugaaauggccccgguaaucucuaagcuuguuccccaggaucgucacagccucaguaauggagcagccuguaggcacaggggccaagaacagagugggagugggacagagcugcccugccaggcaguggaugugggcucugcaccccgacagccuggucacagagcccauguccccacugcauuuuuaaaaaauauuuauuucuauuuauuuuuuuugagacggggucuaacucucacccaggcuggagugcaguggugcaaucguagcucacugcagcugcagcucgcugcagccgccaacuuccaggcucaagaaaucccccugccucagccuccuguguagcugggacuacagguacaugcuaccaaaccugacuaauuuuguuuauguuuuguggagaugagguuaucacuguuuugcccaggcugaacuccugagcucaagcgauccuccugccucggccuccuaaaguacuggaauuacaggugugagccaccaugccggcccuaacugcaauucuuauuaccaugcauuagcuuuugaaagguaucgaguguaccacguuucuuuuuuuacuugcaguaacuuacacuuaucccauuuauuucuuauaugauuaccccaguauaaucauguaaaugugauuauaugaucucaguauaaucacauuaucauuaccaguauuuugucuuuuuuuuuuuuuuucgaacuccugggcauaagcuauccucccaccguggccucccaaagugcugggauuacaagagugaaccaccacaccuggccaguauugugucuuuugaugccuguuuuaaagaguuacuuucgcugugcuuuaucuuguuucuacuucuaacucuuuaggaaggagaugagaauguagaaaaggaauucccauaagaguggaguaggaggcaguggggcgugauggcucacaccuguaaucccaccacuuugggaggcugaggccuguguaucacuugaggugaggaguucgagaccagcuuggccaacauggcaaaaccccgucucuacuagaaauacaaauauuagcugaguguaguggcaggugccuguaaucccagcuacuugggaggcugaggcaggagaauugcuugaacccaggagguggagguugcagugagcugagaucgagcuacacugcacuucagccugggaaacagagcaagacuccaucucaaaaaaaaaaaaaaaaaaaaaagaaaagaaaagaaaagaaaagaaaaaaaaagaguggagcaggcagugauugauugauacccaggccacugcugugcugguggcucauguugcagaguugggaaaauauuauuuaccccaugcaaaggauuggcucugagggcagcaccaagggcagugcuccuugugggggugacccaucuccccacuucucuccuccucuccccuucacuccuccugcucacgacucuuucaggugcucagcacaguggucagaggcagggcucucccaucaucugcuugggucuugacagaggaggugguucaugaagggucgugacugaauuacaugccuacccuggugagcaaaugagcagacaccaggcagagagauaggcaagucaagggcagcagaagagcauggcccaggcguggagaccuggguucucgcagacaccguccuggaaauguacuguggacuuggccaagccucuucugcucugugacucagugucccccucugaagaaugagggcuugggccaggcgcccaccagaucaugugcuuuggagaauuccacaguuccuucugccgacaaugaaaguaacaugcuguaggcaaggagccgggcuuuuccccgaaguaggggaccugacuuguccacagacuccuuccuuuucucuuccuucaugugagcccuccauggggcccuaugcgguuuccccacccccagcuagagugcuccaugccccuucagcagggacugucucagucuugcccacgagguuguuuugaagucuccccaccccccauucccuucauguuuccucuuggcuggucacugaggcugucuugcucuguauggaaauauucaccuugaaucuccccaaaauacccaggggguggagacaucauggucuugggaaaauauuagcaaaaggggcaccacuccacuuggagccauguuaggaugugcugggagugacgccuggauucuggcaaucucagccuccagggggagggaaggagggacugcuccaucaugcagaaucacagacuggaggcuguacuucuccuuucugucauggcaaaccagcaggcuuggagcccaaggguuacacuccucucgggaggguacuggguuuggaggucugagauacucugucucucuuagauaugacacgggccuuuuucucucaaauguaaaauucagaauagugauacugacuucacaggcuuguuggaagggucaaaugggguaagauguccagcuucguacagagccuaauacaagccagcaaucaauaaaugcuguagaaagaauuuauuucuaccuuugcaaaaaaaaucucuccauuccccuuccccucccccauccagccuucccucuauuccuuccuuccuucaucucuguccaucuuuccauucauccauucuuucacccacccauccauccauucauccaucauccuuccacuuauccauccauccauccguccauccuuccacccacccaucuaugcacccaaccauccauccauccauccguccacccauccauucguccauccauucuuccauccauucauucauccacucuuccauccauccauuuuuccacccguuuguuuauccauucaccuauucauccauccauuaauucuuugaucuauccacccauccauucacccauccuuccauucauuugugaaaggaaaagaaaaacuugggaacccaauucacuaugccaaaagaaaaaaauuaagcugaaaguugaguaacacaagaaacugucuuuucuuugauuccuaagcagguagcuacaaauaaaagguuaaauaucuccacagguagcuacucuauguuugccuuaucuuauacaaagugccaauuuacugagcaagggaggaauacauaauugauuauuccccaccugcuccuuuucucuugcaacauguggauuaccauacccuccuucuuuccccuccagcccacuuuccccuuuaaauauugaagccuucaaaauuaucucuggagaaaggaacggaucuuucucccagguacaucauuaaccuuggcaaaauaaccuucuaaauugauugagaccugucucagauacuuuucaguuuacauauuuauccuuccauucauccaagauuaguuugucaaacggugacugaaccuauaaauuguuacugucuauuaauuacucggcacuauguaagauucuggcaauacuaugacaacaaauaagucauauccccugcucucaguugcuugcaggagagacacaagcagauaaugacagugcauaguaaagaggaacagaguugggugaacaacagcaugggcuucaggaccggguccucuuagagaaggcgaugugugagcugcaucccagagugaggcugagccagggccagagguggggccacuucacagcccagcugagugacagcagaggagcaggcagcagccuggccugggugggagcaaggugaggcuuguugucguuggcaccuaaagguggaggcagaugauggcaagagcugcauggagagguggguggaagacagacccaagggccuuggauggaugccacacuuagaagccagggcucugucuucugggcagugcacagaaggagcagaucugaguggcaggaccuggccguccucggacguagggugugcaagacagaaacuggcacaacccccagguucuuacagaggauguuugagggacagugggccuaccaacagagagaacaccauaugaugagacgcugacgucugacaugaccccugcccucagacagcuuccagucuugaagaggagacaguugaacaaaugauggccaccuguguauucucagcccccagcauugggauuuguguacaggaggggcccaaucaaagucuagagaguaagugaaccagcucuaauaugucaagguggagguguuuauucauuaggucagcaaauacuuauugggggcuuucccugugccaagaauucuuccagguuccagggaggugguugaggaguggggaggaaacacacagauaucuagcucugcacaaggcugugugggguuggcagcacacaugacaggaagaaggucaggaagggcuucccugaggaggcaguaaaggagcugggauguacugggucagagggguuuacugggcaaagagagguggugaagggcaaggcaagagggggagcagcuugugcaaaggcccugugguugaagcaggcauggcccacugagggacugaaaggucggggaggaaggcagugagcaggcuggagaucugcaggcaaggagcugccuggcuggagaugaggcuggguaggccaggcccucaaagccccuagcaugcccugcccuacaggggucccacucccaggaccgccaucuggcagaggcccucuccacugcccaucucccuacccccgauggagucuuucuccagaguacucaucacgaucuuugaucuugugcauuuuacuugugugauuuguucuuggucauuuucccuccacuaucacucaagcugcgagggagcgagaggcggucuuuucuguucacugcugggugccaagugccagagcagugcccagcucccaggaggugcucugcagagaaggagagacuucuugaauggacacaagggaaugggcggccacagcacuuucagaggccauggcagggguaucccuugagccugggaguucaagaccagccugggcaacauagaaagacccgaacacuauaaaaaaaaaaaaauagccagcaugguggugcaugccuuuagucccagcuacucaggagguugagauagaaggaucacuugagcccaggaggucaaggcuacagaucgugccacugcaguccagucuggaugacagggugagagcuugucucacacacacacaaaaggauuuauuuagggaacauucccaugugccaggugcugggggauguugccuguggccaaggcuuucaccauggaggcugcugggcuggcagagcaggccccaaaggccaggcccacccagacauggcagaaggguuuccagcagguagggggugagcggagccagguuccagggagccaauucuggcagcaggaggaacgagcugugucggaaggaagggccaaggccucggcggggaucagccuagggcaggguccaggucuugcuucacugaccagaagcucuuggcugcugcugcccucagaacagcagagaaccccuggccccacacgcccugugucccuuccuguccuuucacucagagcugggcaucagagcgugcaggccugccaucaauuggcaggagcuuccccgcagggaugcagugagauaagaaggagcucugagaggccagggcgucugcacaugccccgugucgggggcaccaggcuggaguccagaggauggugggaaaggccaccccaagcagaggggccaggagcagugaaggccggaagugagaggggcacagcauggcugcgugcacagggccacacccagcuguccaggaggcaaaacuggauucugcggacugagcugggggacccagggcuuguggucaguuuggacagggugguucaugacagcccuaugugccaugugaaagaguugacuucaucacggaacaccaggaccuccaaggauagcguacauaggauuaucaaauuccuugggguuaagaaccugguggagagguacugaggccagacgugagagguuggggccaucccagagggaagucgguggccgcauggaggacagcagaggcugcccauugagggaucccagagggugagcaggcaugaggccaucauuuuugaucagcaagcuggacucugggccugugugugugcgacagugugugagcuucaucagaugacucaucacaccuucucugaacuugccagaaggugcccugcuccuccuccagccuggccuggccugacggagcaugggguggggucaccugcauccugcagcuguggguggcugugucugccucauuggcgaaggccagccucugagcccuucuguucagccccagcagccguacacaaaacccagaucugaaaagagaagucugccaggcucaguagugugaaugugcucagcagccgugccuggguguccuggcggcuuaucauccuggccgaugccccacuguggccaugggcugugaccugcuccuaagaggucauacaaaccaaguguagaccuuguccugggucaacagggaaggagucccugggcugaauucuaacuuucggcccccagacacucuuggcugguucuggguuucagcaaagcuuguuggaagccggcuuaugagacacacuuucuuggccucggaccacacucccugggccucggguugagaaguuccuggugacucagaaaguggagggauuaagucucagggagaagccgcuggcugccgggcggacagaucugugccugcaaguugcucuucaauaacagggaguggcccucauuugcauuggcugcugggaacuuccugaagaugguccccaagccccuggaggccagcaccugcgaggauaugcagcacgaguggaggaggagaggaaugaggaggggaagggcgggggaggcuugcuaggcagaugucagcacgggaagcuccacgaucagggcagaaacggcucggaccagggggcuccgguggcuuccuugggcccucauacccggagucugggcugggcgagccggggggagaugcgccacaccccugcggggcuggaaacggggaaggcugcuccuucugggugugccugagcggguggacucagguaccccgauaaaccaguuugguucccccaucuugccucccaggggcaggaaccaagucaggcuacagcguggcacugcucaccuuucccaauaccugagcgccuaccagggcuggcccaguguggugggaagcagacgaaagcaagggcccagcaucuccacccaacagcauccuucaucccccgcacgccgcauugcccccugcccccuuugugcuccuggggagacuacuaaacuccuucaccccuggcugccggggacuguaccgcccaggugagcuccccucaguuagggagcacccaccgccuugugccaugcaugcucugggucacucggucucccagcucccagcacggugagucuggcacagguaccaaccccucuccucccgggagagaaacugaggcucaaagaggcugagggauuugcucagggccccucaggugguauucagacuccaggccauccagcuccaagcggcuuuggggucuuuuuguagauucuuggagguggacacugcaagggaccuccagccccauuggucacauuuuccaaagaacguuuugcaguagcuguuacaguugacucugggacaacguggguuggaacugcacgaggaaggagucccuaggcugaauucuaacuuuuggccuccagacacuccugcggguccacuuacacauagauuuucuuccugugccacccccaaaacgguaagaccaaccccuccucuuccucccccuccgccucuucaacaugaaaaugacgagaagaguggccuuggugauaauccacuuccgcuuaaugaaggguaaauguacuuccucuuccuuauguuuuucuuaauacuuucuuuucuucagccuacuuuauuguaagaacacaguacauaauacauauuacauacaaaauguaugggaaucgacuguuuauauuaucaguaagcuucuggucaacgguaggcuaugaguaaguaaauucuggaagaguccaaaguuacacauggguuuucaaccgcacaggagguuggcggcccuaaaucucguguucuucaagagucaccuguauaucaaaaugaauguuucacagccagagagacccuuuaagagauguuggauccagggagauuaaauagagcuuuaauaugcuaaugagcucaacaaaauaugcaaaugagcuuagcagaucaccaaaaggcauggagcguuugcaaugcuucucaaaucuauuuggggcaaguagucucucuggaccaaggagcacaucucucuggaccaaggagaaauguugagcuuguacaaucguuuuucucuacaaauggggaaacugaggcccagaaaaaggaugagacuugccuaaagcuaaccuguggcaaagucaggaccugagcuucagcccaggugugaggggucgggaaccuggugguagagcugccuuccccaucaccacucccuguguagggaagggauuggugucuauuucuuuucauugccccagcccuggugcuuuuugauaggucagaaaugucugugaaagcuuggcuggggcacugucugcccagggaagggaacggaggagccagggaaggagacugggccaggugcuguucuugggaguuagcuuuguggcugaccugcuguccacggccuggggacaggcaggauugucaggaagagcccugagagcuugccaccuuugcuugagaccucuucuguggcuccugccugucccgggguccguggucuguugaucuucccaccuccuacugcagcacaaguggucccuucagggugaccccuuuccaaagccaccugguaaacugcagggagaggagagagggcaggcugguugggccugacacucccaugggggaagaggagcagcugcaucccuccugaccucaucaggaugggcccggacuggccaaaggaggaccacgcuggcuggagaugcaucauccuccugcccugugacuugggcaccaaggauucaauagcuguguguucuguucucagccaccauucacggucacacagcagccaccauugcgccuagggaacaccuggacugaagaugggacugaagauggcacugaugcuggggccauuccuugaagcucggcuccucugucaggggcaguaggguaugucugguaugagcacagacuggggauucaggcagaugcaggcuaaccucaggcugcacaacuucaucacuugcagaaguuauuuggccucucugggcaucaguguucucuuucuuugucuuuuuuauuccauuuauuaaaacuggcccaacuaugauguuagaagucaguaguaguuucuggaaagagucagaaagaggcuuuugguugcugauaauuuucuuuuuucuuuuuucuuuucuuuuuuuuuuuuuucuggagguggagucuugcucuguugcccaggcuggagugcaguggcgugaucuuggcucacugcagccuccaccucccacguucaagugauccuccugccucagccucccaaguagguggaacuacagguguacacuaccacgccuggcuaauuuuuguauuuuuaguagacacagacuucaccuuauuggccaggcuggucuugaauuccucaccucaggugauccacccaccucggccucccaaagugcugggauuacaggugugagccacugcaccuggccuggcugcugauaauguuuuaauucuacuuucuaguucuggaugcuguuaaaugggcacacuuucugagaaauaucaagaugaagauuuauaauuuaugcauuuuucucuguguaugcuauaauuaaaugaaagauuuacuuuaagaagauggugacccugaaaaauaaguuauuccuaauuugugcaaugaugauaaaaucacagaaaaguaaacauauuuaaaaauaguguuuaaaagcagaaucuuuucacacuggaagcaguuuuucuaauacaaucucuuucuuuuuuuuuuuuuuuuuuuuuugagauggagucucacugugucacccaggcuggauugcaguggagcgaucuuacucagcugacugcaaccuccgccucccagauucaagcgauucuccugucucagcuucccaaguagcuguauuuuuaguagagauggggguuuugccauguuggucaggcuggucuugaacuccugaucucaggugauacacccgccuuggccucccaaacugccgggauuacauguguuagccauugcgccuagccguaaugcaaucuauuucuauuaugcaagacuuuuaauaaaaaccauugcauauauugauuccaugguauaagagacaugggcagcaguguucuuaccuguaaaauagaggcaauaaaaaucucuaccucgugagauuaggcgacagcaugcauauguggugcuuuccacagugccugguacacaguaaacacucaauaaguaaugccauugucaccgucauugccaucaucaggccucugcuggcauuccuacacagcuggugggcugugugggcuccuggacugaaccugguuuggcagagaaugaagcauggcucuaggacuauaacccuggagacuggauuucuucaaucuaaucccuucuuggcgguugccuggugauucuacucaccuauggugggaugggcgggcacggggccccacccaaagaguaguggaggcucuuucuuuccuggucacucaaacagugaaggggacaggacagcugggagugggcuggguccccaguuauggguaggggaauaggacaccacuuacugcauaacucaacaggcccuugugcuuuauccucuuucuccccacuauugugggugccuccauggcaagaaccugcuagaugggccagacuucccaaauccaaauucucuuuuuauuacuauuacuuuauugaauuaauuaauuuuuuaauaccaccagguauuccagggcggucucccauccaaguacuaaccauguccgacucugcuuagcuucuaagacuagacaagauaggcauguucaaggugguguggcuguagacccaagucuagauucuuguacugaaaagcaugugggugcuuaugagaacgacagggcagauaauggaaaaucuucccagaaagcucuggacaugugguugcugcccagugcuaagcucucaggaaauaauacuaugacuacauuaguguguuauuuuacaguuuuaaagcauuuacauuauccaucaacucauuugguuaucacaaccaaccuaugaaauagguauuugacaccauuuaacagaugaagaaacugagguuuagagcaugcauguggcuugccuacugcuauucaguagcaaaaucaggucucaguccagauccuccaacuccaaggagaguacaacacagccauuuuuuaggagugaauggaagauauaugaaauauacagcacuacaauauguccacuagcauucuuagauuuaaauuuaauuuuucaauuguuguaauauacauaacauaacacugaccauuuuaacuacuuccuuucuuuuucuuuuugagauggagucucgaucuguugcccaggcuagagugcaguggugcaaucucggcucacugcaaccuccaccucccgggcucaagugauucucccgccucagccuccugaguaguugggacuacaggcacaugucaccaugcccagcuaauuuuuuguauuuuuaguagagacaggauuucaccguguuagccaggauggucucaaucuccuuaucucgugauccaccugccucagccucccaaagugcugggauuacaggcgugagccacuuuacccggccgauuauaacuauuuuuaaguuuauagucuauggcauuaagaacauucacauuauuuugcagccaucacugccauccaucuccagagcuuucuuaucaucccaaacuagaacuccauauccauuaaacauuaacuccccacucccccuccuccuggcccuuggcaauccccauucuacuuccugucucuaugaauuugacuacucuguguuccucauagacggacucauacgauauuuauucuuuugcaucuagauuauuucacguaacguaaugucuucaagguuccuccgugucguagcaugggacagaauugccuuccuuuguaaggcugaaugauauuccauuguauggauagaucacauucugcuuauccauucauccauccaugcucacuagggugacuuccacuuuuggcuauugugaguaauacuucuaugagcauggauguacaaacaccuccccaagucuccacuuucaauucuuuuggguguguacccagagaagccauuguugaaucauaugccacuuccaugguugcuuuuuugaagaacugccauauugguuuccuauccacuaugucuuuuaaguuuguuugauaagauacaguaguccacccuuaacuguagcuccaguuuccuugguuuuaguaaccuguggucaaccguaguccaaaaagauuaaguaaaaaucuccggaaauaaauaguucauaaguuuuagauguugcaccguuuugaguggcaugauggaaucugggucaucuugcuccgcccccuguggggaguggaucacuccuuccuucagaggacccccacucucaaugcuacccucccauuggucacuuaggagcuaucuccguuaucagaugggccgucgacguaucucagcguucaugcucaagucacccuuauuugacuuaaugauggccccaaagggcaacaguggugaugcuggcaauucggauaugccaaacagaagccaccaagugcuuccuuucagugaaaaggugaaaguucucgauuucguaaggaaacaaagaaaaucauaugcugagguuucuaagaacuacguaagaacaaaucuucuaucugugaaauugugaagagagaaaaauaaauuugugaguaguggauauagggugugguaccauccccuguuucaggcaccccuugggguuuugaaauauaucucugauggauuagaggggacuacuauaaaccaauauccauauuaaggggaaaaucuacucaaacacuaggauuagaaauauuucauuguucuuuuaaagacaucuuuuuuggucacuugccuagggcucagagggcaagcucaggaccacauguuuuaaagacugucauggacucuuguccacgcccuucucuuuguccauaauggucccccuaccuggucugcuuaggagacuuggccccucacugauccuugccgccauuucucaaggagcuagaaugauucaugugaaagagcuuuggcagaagggacaggcucugcagccagaaagucucaagguuaguacugguucuucccucuauugugugaugauuggcaaguuaucaaaccucucugaacuucaguugaauuagugaaauguggacagcaguacccauccacccaagacugccauggggacuaaaugagaugauaugggcagagggcucagugugccaugucuauggcugagauuaugaucaucauccccuucccugguccuccuggaagcacggggcuccuguccugcugcagucaccuccugccuagcaucgugggagggccggcuccuuagcacgcagggauuugggcucacucugggcuugcuggagaauggggcagaacaggggccagccgguggaaggcucaaagaggcagcuuucagugcaacagcaggaagaauuguccagaagcaccggccgcucacuggcagaguaggucuucucuccagaagugaggaggcauuccccaucagucucacagcugagggccucagaugcucagacaccggaaagacgggauuccuggaugucugucagauggggguuggauccagugaccucuggggcuccucucaacucucauaagcuguggggauuuccguggagcugacggucccuguagccacagcuggggcacugccagugcaucuuggccaagcccugcagcugacucgagcuuggugaggggagcccugacuugggguccuggucauccucauggucaucaucccccagagaugaaagcgacuaggcagucccacagucucagggacacagugccauucccagccugagauguggcuacuccauccucauaccuuguccccucugaugcugggggcuccaaggcugaccaguaaguccagcugauggaggaagaaccugagaaaucagaugugggaagggguccugagagaacguguaccaucugcccacacacagauggcacauccaggccaggacaccuuagccaaagggcacaacucacccugccagguaggccugggccacguaccauccuggagccuuccugcuggggccaggaucccagccucuccugugagcagcucugggugacccaguuaggaagucagcaggugugugaccuggcucauccagguguugcuccgucugcacuccgcagcccuggcccacucgccaugggggucuccugggcugccugcuucucaggccuuccugcaccccuggaugaguggauagguccccguuguccaaaugaaaagucacucagcuggguggaugcugaccuggguucaaaucccaacaccacucacucgaggugcggccuugggcaaguuacccaaucucuccagaccucagugucuucaucuuucaaauggcaccugcgaagccagguugcagugacaauuacagaagcuguguuaaaggccaagcacaugacacacaaggccucccucugugggacggauagucucuugcggaaggcaggggaagguuucuauggccccgucuugauuucugaccuacuuacugucaccggcucacccgaggagugguggccuugcucaguguuacaggcuguacugcucacacccuaguuuacguguugagguccuaauccccaguaugucaggacauacuuggaaagagggucuuuauagaggcgauuaggguccaaugagaucauuagggccagccuucauccaacaggacugcugucaucauaacaagagaaaauguggacacacacagagacgccagggaacaggugcacagagggagaccacaagaggaaguggggagaaggcggauguccacaagccaaggagagaggcuucgggagaaacgagcccugccacggccuugaccuugggcuuccagccuccagaacuaugaggaaauaaauguuuguuguugaacccacacaguccaugguucugugcagcaacccugguaaacuaauacugcacggaggcaucuacaaaaggagagcugcucguuugucccaagaaaugcuccucuaagaucuuaaucuagggccgcuguggagacuuccaccauccaucaaucaugaagucucacuuaaaggccccuccaggucucgccugaggggugucagguucugguugggaaggagggguccuuggaggccuuucccaggcugcagaggcuggcaccuucucucugcuucaggggucuugagaggcuggaggcuccccgaugugagggcgggguacuucagggcugccgggcagaccgugggcauggccaugaguguccccacaagaacugucaugccaggagcuuggaagagucacugccuccugcccgccaaggcugcugugggcaggugucugccuucccauccuaggcuaccugggcagcauuuccuuuagaaccaggaguggccauggguggaacugcagaugccaggaccaugacgcucuucaccaggcacucacccggcugcccugugccuccacugaccggucacaagucccgccuccugccaggccugggauuggcgggccuggccauaugcaaagguucuuccugcuucagcugucuugaaagagcguccaagagaggccgugccugccacgcgugaugaugaugaagggcggagcagcacagaggucagaguggugguggguuggggagguccugcaggugccagguggccacaggugggacaccuccaggcucaguuuccugccaagggaagccugaagcaggggaggcuguccccaccuucccugccuccugugcaggccuccugggcacccuaaaucucugcggcuccucaaggcccccacaucccucuccucuccugagccuccccaggauuagauaaggcuggcaaacugugcccccuuccugugguuuucucccaccaggacgucccaagcuggaagacucccgccccucugugccacggcugguggcuucacccuugacccgggggagauggcuggaugugaucugcccagagcuucccagaggcuggccaagaaggcacaaggaaaggacuccuucuucuggccugguguggagagcagaacguccuggagaggcguuugccaggccagagccagcugaagcuuuugaagaaagggccaccuucccucccugcgccaaggccugaucggacugggagauaaacugcacuggcagcuguccuggcagagcucugaaucacugcugugcaaacaugacccuccuucacugcgacugccagcuuuguuaucuagaaugcaaacacaaugcaaccauccuuagcuccagauuaacaacaacaaaaacaucccuggagaagccgcuuuccaagaugacugaaagcccaguguggauuuuagccaaaacagacagaggacccccgcuccugccugggcugccugcacccacauucugaaauggggacaaugccaggaggcggacagggugggaugcaagguggaaaagagcuggaaugugccagggaccugacuugccagcuacgccagcucuuucugccccuggccgccugggcccccuccugaggacagcaaacagcuuccugcucucucggucugguaggcagcaaggcuggcacccuugugugcucagggccaagcaugagugugggcagcugguuagaguccaggucagagguggucugggccucccuucugcuggcccaugccuugaaacuaucugcaggaugaaggcaagacaagaaaggguguagacagugagcacccugauggccugcgugcagcuccuucuugcccugaaccauggcugcagaggguggcaccuucugucuguuugaugagucuuggacauagguggauguggauaugggaccauccuguguccccuccagccauaugguagcgaacauugauuaagcacuuacuaugugcuggucauccugcugugagugcugcaugucugauucauuugcuccuuccuauaaguaggaacuguuacugcccccauuugacagagguggaaacggaggcacagagaggaaacuaucguucucaaggcuaugcagugucgugaccgcagugggauuugaacugagacuuuuugacugcagaguuugcuguuugcugccucucacauuggcggugcuugcaguguggaaggagcgucacuggggcaagaccagccccucgccgccucugcgcaucuugaacucucugucuccaugggcaucgggaauugacucauuuauuaguuuauucauucacugguuucuuccuucaacuccuauucugugccauaugcaucgcucagcacuggggggucggaggggacaaagauguacagggcgcagaccccucuccggcagcuccagccucuccaggccaggccuuccucacucuccagcugaggacuccagggaggccuguggucugaguggagagagaaaggggacggccuggugaagcagggcaugagaaggacggacaaggcagucaucacagggaaggagccgggccaggcacgccugcagggcccagagaggacgcagacaucacagggaaggggccgggccaggcacgccugcagggcccagagaggacgcagcugcagaaacgcaggugggaggcagccaggccguggcuguggccuggagagagaagcuaagcccaugaggcccaacgcggaggggccaagaucagcucugggugaugcgauccaaggacggggagaggcuuagucaggaggggaguuuacccagggcuggagggcacaggagagaauggaggauagauaacggcuggugacucagagccuaugguccaaaccugcacagugccacuuggaugacaccagagaagaucaagguuagggcugggguugggcagaacuggagcagaaacaacugagcaaagccgagggaggaaaggcugugauuuccacgagcgauacugcaggacuuccuaggccgcugcuguccgggcggggcaugcaggagaccuaaaguuccagguggacaguggagcccaggagggugccugagaccccugcaagcggguguaacauaaaggccgacuccagugcacacuuucagggcuuccucuaugcugaccaccguuccagggccauaaaugaacucaacaagccugugaaguggaugcuguucuugccccacauuuacagacgagugaccugaagcacagagaggcugagggaauggccaaggucccacagcuaggaaauggcaaaaccggguccccagaaacauguagggcucagccugggccuggaggugacggcagcguuugucagugaggagaacccgggaaggaggugcagcuggaauucuacccucggcaucugggggacugcagggcuuguucucgcucucacgagugucccugugcaaggcaguaagaacacaggugcugacuaggacgccaccugggccagccuccuggcucagggacagcaggcaccauccugaauggcaccguggugagccgaggugcaggaggccuggcugucguggggcucugcacccuggggugcugcggcugcacuccgcugccuacucucuccccacugcagccagccuggcauggcugucaggagccagcucuccuggugggucagucacccacugggcagaacugggacagucucauuugucucccaucuugcuccugacuucugaaacaaaucugcaguuugcuuuuuuuuuuuuuuuuuuuaaauuacuuccugguccugccucugguccugccccaucuccugcagugcagggucacuggggcagugcaggggcugaggagaaagggcccuggcacgugucuacugggccucguccuugcuagggcccgucugaagcgggugaccccugacuaugccagguuucuggaucacauccugcucccucgaguucccagguccuugugucuccuaaaaauaaaggugccacucacugggcgcuuccuaggcaccgagcaccaugcugugggcuuuaaggcacagccucauuugauccuucuaacaaucccagguggagagugauccugcauccccauuuuucuagauguguccacagaggcucagaaggaugagacuugcccuagaccacgcacccaguaaagggccagguaagaccugaauuuucccucuggacccccagccuccugaugucuauuuucagccaguuuaauuucaggcaugggaagcccaccuaagagcuuguuucgaguccauguuuguauuaaccaugccucacacgcuuucagaugauacgaaagugagaggaggaacucguaagguggauggcccaggauuaaggcugagcagauuucaggaggaaggaaaggaaggccagucugaacgaggugguauccgugggggugacugugagauccugcagguguauucgaaaucgccauugcacaagggcaggauggggaaaugguuacgggcuuuaguggacugccagccugaugccaaucuguguaccugaugcugauaaagccagugcacccaucggcuauauaaacaggagcaucaugaccaacacaggggaggugguacaucccugaccaccucaccgauugcuguguuugaauccagaugccguauguuaagaauaauacuggcaaacacaaggcuaccuggaugagggcagcaagagagggggcagagguuaguuaggagguggugggggcagggucuaugggaaugaugucauauuaaaauaaaaaaagagguggugugguaugggugguaguaaacacaggcauauuugacucauuauauauagcaucugaagacuaaaauaugguaaauaaugaacauauguuaaauaaauaaaaugacauauaugauuuauggaagcucuagauaaauguauguagcagaaauuuagcuagcauuucaguaaguauuugaguuuuuaaaaagaauaaugaaagguacuaggaugucuaguccaaauggaaagauguacuuagucgcauuauaugaagcccaauaaauaugcucagggcccacacgcugcuaagaaucuggaagacagauuuggagaggggcggaaggcagcuguaggcuagauacaagaaaggacuuccuaaugaugaguguggucauguaaggaaugaagugcaggaggaggagggguucccuguuccuuagggggugucuguggaagcuggaagagcuuaguuggcauccaggggcucccugcagucagggagaggaguuuucugugcacucaguuggugaguccaugagacauagcugugcuguguugauaaggcaugcuccaaccagaagugccgaaagcuccagagcgcccuaaucuuggguugaaguuggguuugcaucaucaucgacuguuuuccaagggcuuggccuguggaggcucugauggggacuugaaagaguucgcuucccaccugcuugcggcugacauuccucuuccugguugucaguguuuguucuggccacgagccccucuagagcucagacaccgggauugaacucugguacucacauguggcugugagcaguggggaggcagggccuugagggauacccugaaggcuccuguccauggggcuagggauggcaggagggggaugagaugucccgagaaucucugaguccagccugugagugaugccaugucucgcucuagccuuuaggcugggaccacugggugggaacgcaggcuggcaggagagaauuggaagagaaccuggcagccgaagagauuaaagaaaggcugacccaggugugccuaaggcugggagcacuggaugccuucaaacagaggugccgugggacauucugugugucugaaaaagcacucgcuguuugguaaaucgauugcagaaugcaagauuugaaagcaguggaccaaucaagagagggggguggaaauggugcuggcccuggggguggucagaaguggugagguuagagaaggacauugagguguugccagcaggacugagugaugaguucugggugccuuaaggauggcgccuugugugugagagacacagccucgugcagccugugugauuggcagcuacugagauuaugaccagaaagccagggaagaccucuaauauaccucacuuaaaaaaaaauuauuauacuuuuuuggaaaauaauuucaaagcaaaauaaauuaaaugaaaaguugcaacaauaguagaaagaaacucuucccaguccacuuaaaagaagugccccacccuacacaccccaccgaagcauccuuucacguguaucuccuaaagcaagaacauucaucaucacgacccauccgauccagacccucacccugaacaugucacuaccacccgguccccagaccacacucugguuuccacaguucucccaauaaccucauucauagcaaaaagacccagacaggccacaggucacgugugaagacaucccuucgccucuuucaguuuggaaagguuuaucagucuuugcugggcucuuauggccuucgaguauuugaagcuggcaggagggcuacuuugagccaugguccuacuuugcuguuuucucuugauuagauucgggccaugagucuuuguuggaaccaucacaggagaaugcuggcugcucacugcgucugaccaggcacacgggauucuguguguggccuuuuacugacaauguccacuuggaucauuugacuaaggaggcagcugucagcuucuucccuguaagaguauuccuuucucuuugucacuacgaaggauguugugggagagguucuuagaaagcauggaaguaucccauuucucaucaagcauccgcccaccacuuucagcacccauggaugguucucaguggaaugaaguaucacugugagggcagccccagagagccugccccauguauuugcuuaaugaaugaaucugcacuucauugcccaagagguggguggagugaccacagcuccucaugccaccagguccuuuucucaugcaagcccugcacagggccagggagugggcaaugcugcuuccaugcacccaccugacugcaucccccaucuuugcgugagcaagcuccaggacucccccggcaccugcagcaaagccagaucuccuaccaggaacaacgugcagcccuucagguccaugaaggguuuuaagucagggaaggugacacauuugauuuauguuaagcaaaaccaaacgaaaacaaaacaaaagcaaacacccuggcuguugugcaaacagcuuggagugguucagauuugcagucaggcagaccaaugaagacucagugaggauguuugggaaggcugaguagagaccuuauuuuuaagcaugugaggaggcccaaugccagggaagggcaggaaggggcccuggcuccuccaaggcugcuggggcuguggacggcaggggaguucuauguguacccaccccaucccgccagccucugcugacuccugcccuggacacaccauaccuuugguuucccuuagcagcucuucugugaacuugaccaccugggccaccuccacccaugggaagccuuugcccacugcaaagaugaugcucucguagaggguguccagcaggaugcuccuccgggagucucucuguucgucaaacuccucccaguucagaagccuccgcaggcgcucccgaccuuguggucucugcagggaaugacaugggaacugcaggguaugauguggggguugcagggcaugauauaggggcuacggggugugauaugggggcuauagggugugauaugggggcuguggggugugauauggggguugcagggcaugauaugggggcugcauggugugauauggggguugcagggcaugauaugggggcuacagggugugcuauggggguugcaggauaugauaugggggcuacagggugugauaugggggcugcggggugugauauggggguugcagggcaugauaugggggcuacagggugugcuauggggguugcaggauaugauaugggggcuacagggugugauaugggggcugcggggugugauaugggggcugcaggguaugauaugaggguugugggguaugauaugggguuguggggcaugauaugagggcuacagggugugauaugggggcugcaggcugugauaugggggcugcagggugugauguguggucugugggaugugauaugggggcugcaggguaugauauggggguugcaggguaugacaugaugguugugggguaugauauggggguugcgggguaugauaugaagguugugggguaugauauggggguugcgggguaugaugugaagguugugggguaugauauggggguugugggauaugauaugggggucggaggguaugauauggggcugcaggguaugauaucgagguugcaggguaugauauggaggcuggagagugugauauggggguugcaggguauaauaugggguugaggaguugagaagccaucucuacuggguaagacacuuuugggguccccacaguggugcuccagagcccugaagaguaacuagguauguggguaccccugggaagagcugugcuuugguuucugggcagcacucccuccuccugggacuugcucuucuucuaggacuuucuuuccucugagaguucucaugcuggccacugcagcccagguuuuguguaccuccagcaggccucagguucugaaauacgaucccuaucccccugccuaaaauaaaauuugacuuuccugagucuacucuuaacugacugcaguagaggcauugaucugacaaugaaauuuauacuacaguguaagugacugaccaagaaggggcuuggugagguaaugcuuuagcagaaggaaugagucuugcuuggugaaaauucagacacacgggcaggccaagaggaaaagguaaacuuuuuucccugccuagaaguaaaaacccauuuuacuugagaguucagcuggcccuucuggaaaguucuuauaggcucccagcagauguaggagaagcaagugccacuuaaaggaaguggcaaaaaaauguuuggggugcagcagagacccacccaccacacgcaagaguguugcuuuccugaggcaagggauccucuggcugggaggaccccaagggacccuggaggaccaaugguggccuuagugacagagggaggccuagaguccuguccucggcccccagagacuccucuuccacugccaccacucuucugccuaaucuagacagcacccccuagaaagcagcagagccucccccaacacacucccugcacacaguggcucgcaggacccucagggucccagaggaggcaggcacagucccucacuucccuucaggcaggaucugcuccuucugggccugcauguggcuugaaaaacagcccacaagguccaggggcugguaagcccuggccugaaguuugggccccacaucucgucacagccucagaggugcugugcugagccgggguggcugccccggggucuccugaagaggcgcuuccagugcccaccucccuaugugcccaggaugagccaguuucuguuuaaaagccacauuuucucuuccuucaccugaaguuggaagacuucuuucacucccugggguguuaagagugccauggccccugcaucugguugccaggagacggagccagacuga

SEQ ID NO: 17626 - RNA, 807 nt, Homo sapiens
cacucuuugucaccuuaagaaaugccacaggcagggcaggcaguaggaagcccucuggcggccuuggacuugccacuuccccucccugacagcugacuaggcagagggcugggacagccugaagcgacccugggaacuggaagagggaaggcgcaaugcugugaagggggaggcgcgaggccucggggguaagucggcugggggcucggucugcuccgugcugccaccaucaaggguugccggccuuggcaaggagccacggugcccaggccagagauacagggccaaccagcuaugagcccacucagccugaagcccggcaaagcugacucugcaaauuugagagcuauuuucugguuccaauucaaacauuacggcugcugaccagugaguuccaauucggugagacaucgauggucguccuggacucacuuaacucuaaaauccaucuuaauaguagauucacuggaugucagaguaggaagggcuuuauagggccuuuucauccacagugucagaucuaaaugccuucggaagccagcaagaaccgucaaugagcgaaggcagaagcauccggccggcgcuguccagucccgcacucuaacugcuggcugcaugcagcggccgaagacuuggaacauggcuagugcaagcugugaagcgcugugaguauaaaacagaaaguuucucaaagaugcaguaacugcggggauggacgguggggaccagagcuaucugcaaagcaggugucuuugugagaagcaucagaauucaaacuuuaaagaaagaaacgaagacugcagacca

SEQ ID NO: 17627 - RNA, 7007 nt, Homo sapiens
cagacgcccgcccaggcggggugggggaggcugcaccggcgcucaggucgccgcagcggcccggcagccgccgcagugaugucaaccgcauccgccgcaguccccggcagcccuaaaacgcgccgcggcccgcggaaaccccagcccggcuccucccgccagggccgaggaggagaggacgcgcggguccccggagucccccacuccgucugccuaagccguggagaccgggaguggacgcacggcggugccuggacccccggggagguggaagaagaggagagggaagggagcuguggagucaggugucgauuugacgcccgcggccgccgaggggacucugcccggcacuggugccgccuggggggcguucagggagcguggggcgccgaccgcugcagaugcggcggcgcgcgugggcucgggcaggcgcccccuuuucccgggauagaaacggauaaacggaagcgcgugugagugugggggugcgaaucgccaccuccggccuuggcuuucccgcucuuccgagcucucccacuucucacuuuccccaaauccgcauuuuccuuggcacagcucuccccgagcacgaaggagagggagguacccgggggcagugagaaugacgugugcuggugcagagggggugggggucugcgggccuggaucuguggacgggcuccuaauccucuuguuuucggaaccgucagcagaugcggcuuccuuuaccugaauaauccuuuaaaggaguaauaauuuuuaaaaaggagcucgaccucagccaaagaggacggcgcacgagauuagggcuugguaaggaaaaauuaaaaggcucccaauucucucugucccucucugccuuccccucuaccccucccccucccuccuccacccuccccuccccucccccuucuuccucauccccugcaauccgcgcucgacgcgaguucacgcgaagggcuggauuuccaggcggcuccgcaacuugcgcggcgcgguguuauuauucauccgagggugcugccuccucaaccuuugccuccugcgccgcucuccuucccccggccgccgccgccagcagugcagucccuccggcacgcaugcucugguucaccaagagggagacugauuuuuuuuaaaucaugcucaucaucaucaucaucaucaucaucaucaucaucacguuccuuaucaugguuaucauuuccuccugccagguggagcgaccaccagcgccggcucgccuccugcgccuuccccagcgaaggcagcaagcaguucgggcuuggccguggcggccgcucccaggaugcuuccugcaccuccagcauccccccccuuauucaucugccuguguauuaucucgauccuuuucauuucaguagauccacugccuuugguugggccggcugaaucgcuggggacugcggccagucucuuaaaaaaggagaacaaaaagccgaagaccuuguguggccgccgggacaaagcaccuuggguucggcgagaagggacgcgcaggagcgcugaacccagaacacgcguggccgcugcggaagggcguccgcccggcgugcggaacgcugaggguauucggauugucuuuuauuugucccuguggcuugcuuucacagugucuacguaggagaggggucgggguuguuggggucucuuuuuuuuucugggagggguagcugaauugugggagaccuagguggacuugacuuggcuuuccugcuacucugcgucuccuucucaagaugcggggguuggaaaggggacaggggacucaaggcuuagaaaagagaaggagcccucugcugccuggagggcuaagggaguagagaguggagauggaggugaguagggaugggccagcccgaagagcacugaggaggagaaggggucuucuccucccucggguccaguggaugaguuuugcugggaaugagaauucgggugucugucgauaggagcgcugagaaauugaugagaaauugacauguccgugcacaugcaugaggcggcgacaggauuuguguguaaacaguguggagagguggaggagggcaugggggugggggcuuaaaaugaugucuuauuguccuuuuggcuuuagggacucucauccucugucucgcccccuuuuuuugacccggggauccagccgcauuauacacgagugaccuuuuaaaucuacguccacccuuuaccugguaaagcccgcugacaguugggggugggguggggagaguguaggggugcucucucccucucucccucccuccgccucuccucccucccuccccccugcacuccucucucuuccucccucccaccucccucgcucccgcccucccugcugcauuuugcaugagcuaucuaggucauuagcauuuuagcguaugcaagacuugacaaagcugaugaggggccagaugggccucgcucuuaugguuuuuuuuucuucuucuucuucuucuuccucucucucucucucucucugucucucucucucucgucucucuuccuuuccccccuccaccacuugggaccugagcgagaggacugcagcaggcgaguuccggaaggcugaauccccaggucccagccccggaccgcggcaacucgccccugcggcacgcccggcccggcugcgcccccacucagcgauggagguaaagaggcggcggccgcgcgcccugccccggcugccgcugccgaguccccgcugcucuccuuguccuucgcucucuucuuccuccuccuaguccccuucaguuuccugggcgaagcagagggcgacauggguggguggguugcugcgcuggggcgagguggggucgauguuguuuuuucauugucuggagcugcaggggaggcgaggcgcggggaaaggggcgaggggagccgggguaauuaacacgggggaggcaccccuccgucucccacuuccacccacacccccaucccuccacccccuccgcuuugcaggaaaaagccuggaugcgaaaggaugggggagaacaaagagccuuuggaagacgucgcuguuaucucauugucugugugauugggggagcugcggcggggaggaugcuguggucccuuccuccggcguuccccacccccaucccucuccccgcugucagugcgcacgcacacgcgccgcuuuuuauuucuuuuuccugguuuucuuauuccaucuucuacccaccccucuuccuuucuuucaccuuuccuuccuuccuuccuccuuuccuuccucaggagaaaggccucucucuccguguucacagcggaccuugauuuaaauguccauacaauuaaggcacgcggugaaugccaagaauggggcuggcugagcaccgugggucggcgagggcccgccaaggaaggagcgaccgaccgagccaggcgcccuccgcagaccuccgcgcagcggccgcgggcgcgaggggaggggucuggagcucccuccggcugccugucccgcaccggagcccgugggguggggaggugugcagccugugacagacaggggcuuagagaugcaaacagacucagggagagaaacagaagcugauucugugacagaagcagaucugugcagcacagaugcggugugcguggggagggggucgccugggagcgcauugcggagugcuugugugugcagauuuuucucugggcucaggacucauuguaugugggucaacaccuuccuccgugacuguguuuuuguucugagcugaguuuuuugguuugcccuuaaaaaaauaauaauuuggcauccagagacuggcagacugccucagggccuggacugcggauauauuguguucugcuugagguuuggggaggagggcaggcgguaggaagggagagggggagcuguuugucacacuuugcuguagagcugagagcaccugacaagcuuaaggaagucguugggcuauguggacaagaaggagccagcucccagcggguucacaagcucuaucggaguugaaagcguggucauggcucuaaggagcaccucacgcccucccuguagcuguuauugcaguuucaggcagagauccaggagcugcagaggaagggagaggcacaauaaccuacauggacccaagggagacauguguuccuuuaaaaaugugaacagaaggaaaaacagaaugugugcaacugggggucugaggaaagacuguuuugaaagaggcugucagggaauggaaaggguuaagcuuuucauccugaagaaccugcuucccaaaucaggccuuccucccaucacuagacccugagcagcagcugguccuagagaccccccucguacugcgcugccacagucucaucccauuuccagcucuguauuaaccaccaagcugcagcggauggggcaagaccuaagcucauuaauuuccagguggaggaaauggaggaggggcaggucccugcaguagagggaggagcagagaaaggaggccaagagcuggauccuucugcccaggaagccugcugcaucccuucccccgagcauggcagaggccuggcuuugcaaggccaaggccauaagggaugcuuaggagauuaauuugauuccugacacaauaaucaagcccuaagagucuccacugaagcuuacugaggacuucuuuccucuccaaagccucagucuagccugcuaaauaaauuaguauucagugaugccuuggaucagggccccuccccggccucaguuuccccaaauauuuauuaaguaccuacugugugcaauccuuguguaauuauuaacucuuaggcucuucauuugcccuccuaaagcaguguuuagagucaggcagagguuaaguguguugcaccucaccuagauacuuccagaaccuucucugggucugcagaauguggcacaaccugcuugcccccgcagagagaaagcugcagugcacauccugcagacugcaggugcugggcugccucuggagucccagaaggcaagcuuggcugcaggacagaaagggagaacagcuucucucaccccugagccuucacaagcccuugucuauuugccguugccuucaaaauauaccucccccgaaaccaguagcuuucugaguccugguguccccuccgcccuuucuggacagguuugggaagaagaaagcagucagugcugggccuuauuggggugugaagcgccuugcucugccccuucugcucacugugaaggccgcuggaugcuucucuuaggcaugguuuaagccuccgauuacuaaaccccuugccccacaaacguccacauugacgagccucuuuuuaguaacugcuuccccguaauuccuucagagguugcuguacccuucgcugaugugcugcccuccuguaaaaccuccagaugccuucccacguaaugccccuuucagaugcuuuaagcugagagcuuaaaccacagguaccauggcugacgccugccagguuucugcugcagauaaucuaugaugggaggggcauauuuuuuacuucauuacuuauguaaacucuuguuccagaaagcuuuaaugugugugggaguguucugggucuauuaggucugugcgcaugggugugggcauuugccuguguccaccgggugggucucauuaugaaauguauguuuauguagggcuuuaauggcugaaaauggcaaagagaugaauagaccacuuggccccauguguaauugccaggccccuucugugcucaaaugagguguccgagugaaggucagcccuucccuucuguauuuggggccuauuuaugccaccaguaauuuuauaagaaaucugaauaguucuccccuuugagugcauuuaacucuuuaguaucuucucucuuaccuauuugagccccucuagcuacagucuggcuuaaaugaaaggggaauuauaugcuuaagaaaaaguaggacacgguugaggcaguuugcugacugaauacgcgaagaaggaccugaugggcucauaugcaccacugccaucacaguccccaucgugaugcaagcuuauaugauucuugagguaacucuaccagauacuuccagauuuagaaaugugucaaaggaaaaauuggugauacucuucuuuccccugccagaaacagcccagaucuccucuuaagcggaaaagagauugaccuucuagcagaggcaaagguaaacuccuguaaguuacuucuguuaccaaagggaggggggcggcuuuugugaauguaugaggagcuuuugccagagagauauucggaggaggggugugcccauaugcacacauauauuuucccgcauaaccguauccaaugcuagcauuuagaggaaggcauuuagccaccaaaaguccauccaucuaugcugcuuccacagagaaaacauuuucucuuuccuccucuugaacuuacauaauauccuccucccauuccaaccuuagaauggagucuucugggggcagcugcaaagcguucucccuaggacagauggagccucccuuuccucaucuacucugugggugguuucagggcccacgagucaacaugaggaguugugcuggugguauguguguuggaggcugggcuggcugauucacagugacgaggaugucaauaauaacaagaaugagaaugaugguaccuaauaaagacuuuuuuucccaagucccaucuacaauucuuucauuggguguuuugccaagucuuucucaaucucaucucagcuuuuuuuuuuuuuuuaaagaaaauguauucaauacuuaauugcaucacaaauguagacauagaagaaaggacuucaaacggaauuuaugggaggcaaugugugcggcuuuuugccuuauagagcuguguagaaggucuggaaugaucuuccagcaccaaauuuagauggccucaaaaaaaaaaaaaaaaaaaaaaaaaucaggccuuauugagggcaaggaauguuccaggucagaaauaaaagugucagcaacucucaauag

SEQ ID NO: 17628 - RNA, 40836 nt, Homo sapiens
auugagcgccgacugucuacgggcggccggggguguguagcccaggcgcgcugggggcgugcugggcgggugcgggggcgcggaggcgcggggggcgggcgggggugugucccgagugucgccgcugggcgccggcuggcaggggcuggcgugcugcuccgcucccuucccgggcgggaauccgggccggguuguggccgcggccgcguacgugagcgcagugucccggggaggagggcaggccggccaggugggcgccaaccgagccucggcgggcggccggagcggagccgggccgcgggccgcgccgggagggcgggcagggccgcggccgcugcagcccggagcugagcuagccguccgagccgagccguccgagccggggaagccgggcgcgugcugccgcucguggcgggccgaggugagcugcgcggggaccuagcggcgcggcagccggggacgggggcggccgcgaacuucccacgccccgcgcgcccgcggcugucgggccggcggccugggggguccgggggucugggaggccggggccgcggcgggcggggcgcgggacgcugcggcagggccgggguggcgggcgggguggcugccgcucccgcgcgucgccuuguuuaccucgcccuccgccggcgcccccacucucggagcccccucccgacuucgggcagucgggacucgccccucgcagggacagggaccggcccgccugccccuccccggcccuuuccggcggggccgcccgcccggcccucccgcgcccggcccucccgcgccccgcgcguuucugccgguuccugcccacuccggccggcgcgcgaggccaggcugcgggacgggcgggacagagggacacacccuccgcccgcgggcgacccgcgucccucccgcccuggcggccaccgcccccucugcccgcacgcucucgcccggucccgccuccgcccgcgccccuggcccuccccggcgguggcaccgugggcucacgcgggugcccggggggggggcggggcugcacagggaguuugucuugugcaaacaauuuccaaggcagcguuuucuucccugccugggagugcagggcucagcgccuucacuuuggaacugacucagagaccuaaagaagcccaccuggccagcgggaaggggggccgccgccgccucccgguuuugggcagcccuggccagcucccuguggccuuggaggacuuccaccgggcaggcguucccaugaugccaggcuaccaggcgcgggggauuccugcaggccggcgcugcuuuucuuagaacccccuuucuagaaaaguacaccuggggguuuugcuucaaagugagugauccacagguaucuaaggccuucuugacacccucccuaggcguuguguaaacagaagcaccuggucgcaaacaccucgaaacacagggaaacauggccauuaaguucaacuccacagguccugucagggagcugcugugcucucagcacggugccaggcccucugggaggugggagaggcaccgaagagaccccaggcuucaggaagccuaggacuagguggaagugauuuaggaguuuacguucaaguuaaugugcaguggcugccugaguuaguggagaugcuggagagggaguauaucagauaaaggaaaaacgagauuggggaagggacuuggaguacuaaguuuugaaguaaauuaugccuguggagaguaacucacccguagggcccaaagacaagaggagaagaaaguaacaggugggauaauuuacaaaguggagcagaggagcagaggcucauaccugucucggggagagaggagacagaagguguaagagaugauucccucccuccagggcuucugcccucauagaggggacagaaggaugucagcaugugaaaucagacgccaagagagggaaugguaacugucaaagugcgaggugcagaaauaguucuguuggagucagagaagggaguugugggcagggaucagucaccaggacuggaggcugacgcuguugagauaggcugugaggugggaaugaacauggcuuuccagagagacaaggagauguccuuagccauaccagggaauguauccugaacaguaggagauagagguggagaggaacaaugguugagauugugaaagucuuagcccuuuuggugauugcaugccacccuguguguccuaaggagacauucaggguuuuugagugagggaaugguguaaugaacaacuguaauggaaggguuuuggaaaguuguguuagggggacacaucagugagcaggcuguuggaguugcaggguggccagaguuugcacugggaucacuggaagugaaaaagguggguuugagaaacauuacuguugaaauaaucuguuuacagggcagggugaagggaugagaugaauggaaauuaauucuugguggaaauugauucaacgccagggccuuggagcugcuguaguugguaacuugagaaaucggaaauguguauuuuggagagaaggaauuggcuacucaggcuauagagaaguuucuuguggcugcuaagauauccagauguuaguguccugcaagcagcuauggcucugagaugggggagcccaggggggacaguguugcagaggcuacagaugccgggagagggaaggggcucagagaaguggggaggcugcugguaauaggggggcagcggaggaugccuuugagugguacucaaggccugaaccgaggggcuucuguuucccucugcugcacugccauucacaugacauugcucgguucugaaccugaaguuggaaaagcaacugugggcaauugggcccugaggaguaugggcuguugauucuucuaaucucgaggguggauuggagguuagaacgguguagaaugggauuugcuaaagacaguaaauugcugggcuuugaaacauuuugaacuuuucugggguggaggguuggaggguaggagagagagagugaggcaggaagacauuagcccuagggauauugugauucccagggcuguuccaaccagagccuggcacccugcaaguagaggggagcuggugcuuuuuuucuugagcucuguucauguugcaagggugacacagggugauuugcugaacaaauuccccaagccucaacuugcaacaucugaauuugaaugaugauugcaaaaaguuguggaaugagcugagaauguaauuacuguuacuuagccuccuuguuucucugaaaugcaagaucagugaacuaguagaagaggacuugggaaucagauauuuuucuuuauagagugugucugauuguccaaagaauaauugcaugaagcaguggucaagcuaauuuacucauuguaaagcagugucuguacuguuuugacugugacuuacauuaagaaaugaaauuuacaucgugaccuaguacauacaaucauguauauaaaaaucuaaucuaaguucauaaaguaccuaccucccuuugcuuggugucaucucugacauuucuauuuucuagucuauuauuuuucauuuaaaaaccucuugucucccacuaaguugaucuaaucguucucuaauggaucauaacccacaguuugaaaaauagagaguuuucgcauucagugaguauuuauuaagcuguuugaagagcuacuguaguacugaagguggaagaaagcaugaggaaggguggaagacuuacagucucuuuggaaagaugagagacaccuugauuaaggagcaagccaagaugauuaaaugccaacauaaagaauaacuaccugugggguucagaggaguggggcguguucugugcugguggggcuuggaaaaacguuuagggacaaggaaggaagucugggaugaacuguuuuuggugucucagggugcugcagauguggggagguauagagugggcaaagccuuggaguuaggaaaguguaaagucuaugauugugugagagagaagaacagaggguucuuguuagagauuagggagaaaucaaguuguuaaagugggcuggggucacauauagggcaaagguuguaaaccgguggccagggaguguuuuaagcauauggauguguucuaguuuggacuacauaaagguguuuaaaaauugggggaaaaaauacagaaaaaucucuggauuugcagcucuuuuaaagagucagaucugguguucaucucaagcugagaaggcuguccccuauggacaggagacaggcuugugguccccgggcuuccuuuugccucaguccagucacuuuccauucuucacuuaguccuguaggcguuuugcuuugcgaccugaguuuucaagagacucgaaugcugggccaggaaauucgggauugcugucaugggcucuggguggccacugaggauuccggguaggaguguggcauuauggaaucugagauauuucugugcaccggauuuguuuuaggcaagucaauagcacuuuuugaggagcugcuggcugggacuuugaaauauuuuuaugaugaugggaauggaauuauagagggcuuugaccuguguucuccguaguaaggcaaguuucaagugaccccaagauuucuccagccuuuccauuuuccgcuucuggcuggcagggaucucugagagugaugucgaggucauaccuuggugaggugugagucacagccaucaggugccauaugacguacaauucucaggagccugguauugauccaaauggcucccagcagacgaggcugauuugggguccagcugaagugacuaaguucaggacucugugaccuagaauagucugauuuaccacccaagacuaagagcucgucccagaugagccacuggugagagagacugacaaauaguacccugauguuuacaggugggacuaaaaucaguuauuuaaaaauacugauccggcuguaguggcucacaccuguaaucccagcacuuugggagccugaggcaagaggauugcuuggacccuggaguuugagaccagccugggcaacaugguugagacccugucucuacaaaagauaaaaaaucuagcuggggcugggcgcgguggcucacgccuguuaucccagcacuuugggaggcugaggcgggcggaucacgaggucaggagaucgagaccauccuggcuaacgcagugaaaccccgucucuacuaaaaauacaaaaaauuagccgggcgugguggugggcgccuguaguccaagcugcucgggaggcugaggcaagagaauggcaugaaccccggaggcagagcuugcagugagccgagauugugccacugcacuccagccugggcgacagagcgagacuccgucaaaacacacacacacacacacacacacacacacacacacacacacacuagcagggugugguggugcaugccuguacucccagcuacucaggaggcugaggcgggaggcuugcuugagcccugcagaagguggaggcugcagugagcugagaucacgucauugcacuccagccugggcaacagugagacccugucucaaagaaaaaguauacugcuuuugaaacauuaacaaaaugaaacugaagugcauuuuaacaauguguggcuaucggaugcaaggauaaccagaagccagcugaaucguaucaaauuaaaucuauuuccugucuuauauggugguuuguuuacuaggccagagaauagugcagcaacuaugguacauuuuggcuucaguaaaguauuuaacaguuuuuugagguaugaugguccuuauuaaaucauaagugguaagacgugggcuggaugguguuauuaauuuaacaauccuaugugaaacuguuaauuauuggcacugaggcagccuggaaggagaucugaaaaugaguacaguaggguucuauucuuggccuugaucuguucaacauuuucccaguguuggcggugaagacagagaaggcgcgcucaucagauuuguuaguggcgcagaagugagaggaauugcugguuuugcagacaaaucaagguucagucgucuagaauuaggagugcaaauuaaaaagaaaacagaaaaaaauucaguaagggaugaauuuaaagucugauuuagguuuaaaaauuugaauuguagcguuuugagauuuucaguauccugauaagauaauaccacuucuggggauguagcugagaccauauccacaauguagaugaugauuuaugcacagagauuauucagagauuuuuuuuuuuaaacucuaguaaaaacuugggaauaaccuaaauauccaauggugugggcuagagguaauaaauaagugaauucugauaucuuuaaaauagaauguuaugaagucaugaaaaauaauguuuaggaauagcuuuaaaauaacagggaaaaauguuuuugccaaaaguuaagggacaucuacagugugacuucaaauguuaaaaaagcaauguguuuagaaaauaauuggaaggaaauacaccaaaauaguauaucaaaauacaaauaccaguugcuucugguuggguugaggcaugcagcuuuuuuuuuuuuuuuuaacguuuguauuauuugucuuuucuaguuguguauguauuccacaguggggacaucugcaauuuuuaaaacuuuuuaugguucaaggacaagaaaggguaaaguagaugauucauucagugauuaaucuugagugccugcucgcugugucaaccucaaggucagaaacuagagucacaguggaagacagagucuuugaccccagguuggcacagguccacugaggaggggcagggcauggagaaaaaaagcguugggauuuuucuguuguucaucaguucagugugagccuucaguggaugaggcuuuuauuuuuauuuguuucuauuuuuauuuuuuucagagagucaugagucuugccauguuguccuggcuggauucgaacuccugggcugaagcgauccuucugccucagccucccaaguggcugggucuacgcacaugggccacugagcuuagcucuaagauauggcuuuuaaaaaauugaaugcaguuuauaacaggaucagaaauucagugaucuaaucauaagaucuagucuuaaugaccuuggcuggucaggugacauuuggacccuggagagccaagaguuaauagggauaugagcaagaagacuugauccuggaaaggagaguaggaugcuguaggauagggaauaacuaaacuguauucaugcauuggguacacaguagcaccuucaaauauuuuccugguuaucagacauaggaaggaggagacguucauuuuuacuccugguguucgaauacaaccaauagaugaaacagucacuuuauucucuguagcugcagauuccuaauuuauggcaugauuacaugauuccuugucuguagaaugaucagcgaucaugcugaaguugauagacuuugagguccccuuugacccgaaagacugggacagcagauuucaguucaauaugaaaaaggauuuucuagcuggcagaucuguccaacagaagaaaugucugcccaggaaguagugagcuuacggcuguuggcgguauucaaguagggcugaaugcuguugauuagggaugcgguagaagagaaggacaggaauuaggccgaccuccaaagucucuuccaauuuagagggucaguuauuuaauauaugacuugucaaagccgaaagacacauagaauaggggcuuuaccuucaguggcaaguauuugagucaauaucaucaaguguguucuuuaaaaauguuuauaaauaggucccagcauuuuugagagacccuucugggaucauuuuagaaaggaugaacaaaacaaaacaaaaaacaggugaggugcauugacucacgccuguaaucucagcacuuugagagacugagguggguggauugcuugagcccaggaauucaagacuggcuugggcaacagagagagaacuugucuaugcaaaaaauagaaaaauuaaccaagcaugaugguacaccugcccauggucccagcucuuaggaggcugaugucggaggcucacuugggccuagaguuugaggcugcagugagccaggagcagugagccgugauuguggcacacugcacuccagccugggugacagagugagaccucgacucaaaaaaaggaaaccaaggaugagaacuauuuuaaguugggucagaacucaguuugugaacccagggcugcugaaaauuaaauuugguccuuaggaaaagcaagaagguugguggugguggggggccgggaaauggccaguaauaaugaacaacacagauugacauguagacaaguaguaggaucaugcuggguguggugucacacaucuguaaucccagcacuuugggaggccgaggcggguggauugcuggaggccaggaguuugagaccagccuggccaacauggugaaaccccgucucuacuaaaaauacaaaaauuagcugggcguaguguugcuugccuguaacaccagcuacucgggaggcugaggcaggagaaucacuugaacccaggagacaaagguugcagugagccgagaucaugcuacugcacuccagccugggcgacagagugagacuccaucucucaaaaaaaaaaaaaaaaaaaaaaaaagugggaucaucaugccacuucuauucgggaugaugacuaaaucaagagggggcuguuagugggugcuggguccucugcuuggccguggagaauguggagugaccuugaaugucuccucccacuuccugucccgcacuguggauuuauauccccaggagcaccuugcucaacagcauccugacaccagugaugagauggagccaucugauugcucuucaguuuagcgauaaagagaauacagggcagaucaauuuaaagacauuuuaaagugggauuuuccaggaaaacauauguuuaguuuauaucagacaauaaauuuguaauuugaauuaaaaaaaauuuuuuugagacaggaucuuacucuguugccaggcuggaaugcaguggcgcaaucaugguuuacugcagccucgacccacugggcucgaggcauccucccaccuuagcuuccuaaagugcugggauuauaggcaugagccacugcuucuggcuuaaauuuuuuuuaaauuuuugcauauguauuacuuauagcuuacauaugaaauuuuuuuuaguuuaauucugcuuaacuuucacugaaauauaugcuuuauuuagaauccgcccugauuauuuaaaacuuuuagauuccucuuccugauauuuuuggauuacuuuuguuguuguuuuuguuguugugcaggucacugcuuggacuaaaucacuuagcaaaaguuucuuagcucugcaaagagaauagagguuuaucucaucuuuggagaauauuguaagaugauuuuugucuccacaugauauaugcuugcauuuuggcauuugagaaaucaguauuuggcaagaaagugcucuuuuuauaugggaugaagcaauuuuggggugcgcugacuuaacaaauggcaguuuuagauguaugugaaaagcauaggcaggaccuaguuauuuagaacuagaguugaaaauuuuuguacauuugaugacaggccuuagucuccuuugucucuguaucauuuaugccucacauggugucugucacaucaacugugcuuguugaauugcugugauuugguucccugggcuacauauaguggguuugggggaaaguugggcuaacaugccuuuuuuuuuuguuuugagacagagucuugcucuguugcccaggcuggaguacaguggugcgaucucagcuuacugcaaccucugccucauggguucaagcauuucucccugccucagccuccggaguagcugggauuauaggcucccgccaccaugcccagcuaauuuuugaauuuuuuuuaguggagaugggguuucaccaugauggccaggcuggucuugaacugaccucaggugauccucccaccucagccucccaaagugcugggauuaacaggcgugagcccggccuuuuuuuaaaaaaagcaaaauaugauaagaaguaauaguucccagcugggcaugguggcucacgccuguaauccaagcacuuugagacuaccuguggucccagcugcuuugagaggcugaggugggaggauugauugagcccagcaguucgagaccagcccgggcaacauggugaaaccccaucucuauaaaaaauacaaaaaugagcugggcgugguggcaugcaccugcaguugcagcuacuugggaggcugaggaaggaggaucaccugaacccggggagguuaaggcugcagugagcugugcuggugccacuucacuccagccugggcaacaaaaagaaaauaaaaagaaaaacaaaacacaaaaaaccaguugucagccuuuuuguccuuugaguaucaggaagccauauacaacucucuuaguaaaaacacccgcauucagucaguggcugcuugucaaagugccggaggaauugaaaacucccucuccucuuucuauuuuucuucugcugaaaaugaauugcucuuggugugcuguucuuaaauucauguguccuguguccauuuuaaucuuguuaucuauuuuuauggugacugucgccaugguacucaugcuccuugcauagcacaacagagauuuccaacgucugauaggacagcucagaguucugcugcagccgggagagaaacugugugugaggaguucuuuuuuaaauugagguguaauuuacauacagcacagaucuuaagugugcuguuuaaucaguuucgacacauacguauggagacagaacauuuccaucaccccagaugaguuccucgugaccacuuccagauaagccccacccccaaccagaaguaccacaaaucugauuucuauugccauaaguuaguuuugcucaguagguucuaaauauuauaauuuugucucucucucucuuuuuuuuuuuuuuuuagacagucuugcacuguuuccuaggcuggagugcaguggcacaaucacagcucacugcagccuugacuuccccaggcucaagccauucuccuaccucagccucccaagcaguugggaccacagguaggugccaccacacccggcuaauuuuuaaauuuuuuuuagagacagggucucacuguguugcucagucugaucucaaacuccuggccuuaagugauucucccaccuuggccucccaaagugcugggauuacaggcaugagcuaccugugcacagccaauuuuguauuucuaaggacucuauagguagugcuuugaggaggaggcagggggugcgugucuguuuaaaaagcaguaaccuaugugguuaggaguccccagugagugaauaauaauguuuuagaguuugugcaaugggauguucagauucuuuuuucucauuagcucaggggauuuggauuuauauuaggaauccugauucccaucugaaagagucaaaaccacagacagcuaggccugguauggaggaagugugauugggcaagggcuggcuuauuagggaacguguguguuguguuggagugcugcagugcuggguuggaagaacuggaauuacuccuaggacaucccuuuggaugaucagaagucccauugacauacuuucucuuuuuucccugccuuuuccuugaacuagcauauaaauuuaacaauccacagaguugcggaguugggcuuguaauauugaaacaagaucugugcugcaaagcccacugcugacuggaaacgcagaugugcacugcugagcucacagccccugggaagcauggcccagauucagggugaaauugcccccaaacauauuauugaaaugcauugaacagggacuguuucuuuucuuuuuaaaaaaaaaauuuaaaugaaaauuucauugcgcaaguuaguacacgaacacauucucuggaggggaaaaaugcaaaacuucugcagcaaucagaaaguuuuccuugaugacuguuccuaaucccagucccuuccccagagguccagcacuuucauggacuugcuguucuucagaugccucacauacucacaucuauaccuauaggacuuacaaaaaguuaagugcauuggcuguggauuacguaaggucucuuuacugaauugccucucccucccucaacagggugcuuggugauaguucccggcuccuaugcaaaggucuccuugauuuuguuuaaccucugcccggucucccuuugaauuagaaggcuacacaaguacuucaccuuucccuaauucaugggcacuucagucauuuccagauccuuuacuguuaaaaacgcugauaccaaaaaacauugcugcacagaccucuauagcaccugugaguuuucucugggguagguacugagaaaguggaacugcugggccguaggguucuugaguuguacauuguaacaaagaugcauuauggggucaguuccucacuuagaguuacugugggacgggggaugccugcccugugcucagacauuaagcaguuauuugaagacaagggggcaggauuuagagugugcuagguggaugcucaccggccucacaggucgcacauaccauugcugguuugugggaaggguugguauugggaagggcucuucugggccuccuaguuaauucuaccugguucccgccccccaaccccugaggacuuugacccguauguugauagugguuguguggaaaagaaucacaggccgaacgggcagcccguuguggacucuggaugggaaauucuaaacucaguucacuuggccuggagaccgucaccgcaccugcgguucuucuccaggcugccuuuguaauccaguguggcuuaaacacucaagcaaagcgugaggcguuuggaagcaugauguucuuuaaaggcaucuagaaugcggccacguggcuguuauuagcaguuuauguuaauuacagaagaauggcaugugccacuguuuacgauucuggccuucaucucuaucucucuauagaacuuguggaaaacaugagaauuaauccuaucagaucaaacccaugcauuuaggagccaguguggcaagggagggaguggcugugcccuucccgaagacagcuuuguggccgguugugggccggugucccuggccaccuggguggggagaggcagaggccccuuugcagccuucacgauuuuacgugcauucaaccucaaaucuccaugcagucuguaaugaagcagugcuaguuggagccuagggcaaccccacucgugcauucauucacuguccaaaugcagugugcacuucauuugccuucacugggguauuccagcauccccucuuuggucuccagcugauguuaguggggccucccuuuucugucauuucaauauuuggugaccaaguuggcauucuacuccucucuccaacuuggcggauucucuuggggcccuccuggccuugauccuuuguccugaagagcgcugccuucuuagcuugcccucccugucacacagcacauuuagguuaaugguccucuggccucauaagucaucuuuuuuuauccccgccggcccugagacagggucucacucuguuguucaggcuggaaugcaugggacaauuacaacucacugcagccucaaccucccaggcucaagugauccucccaccucagccuccugaguagcugggacugcaggcacaugcuaccacgccuggcugauguuuguauuuuuuguagagauggggucugccuguguugcccaggcuggucuugaacuccugagcucaagccauccucugccucggccucccgaagugcugggaugugacuguuuccauagagcucuugcaugguuuucauuuuuuucuuaccaucuauuacacugcccuuguugauguuaaaauuuacuguauuucccccgcauuugcacaaacucuuucugauaauuuuccgauagguuuggcucuucacugcccgggauuuggugucuacuuuuuuucaggucagcauuuaucgcgcacuuuugcuaggcacagugcucaguauccaacaugcauuuucucacuguuuccucucucagaccugggggaucagaaucucuaggaaggggagcuugggaacucuuaacaaaaucaaggcacuucuggaaaaaaaaauucauugccucauuaaagccccaaauuauccucugggauaggaucaauacuuuuucucauuuugcacgugaggaaacugaggcacagaguggugaggucauuuggccaaagucacaauggggaaguuugagcuuuuuuuuaaaacuauuuuuuuuuuugagauagggucucacucugucacccaggcuagagugcaguggcaugauuuugacucacugcaaccuccuagguacaagcaauucucauaccucagccuccccaguagcugggauugcaggugcccaccaucauguccagguaacuuuuguauuuuuaguagagaugagguuuugcuauguuggucaggcuggucuugaacuccucaccuuaagugauccaccugccuuggccucccaaagugcugggauuacaggcgugagucacugcgcccagccggaagucugagcuuaaggcagcccugacuguuugugcauucucuuugggauauuuguaaagggugaaauaagaagaauugucgcccugcuccugggggaucccaugcuugauucuuugcugucauaaugcacauuucccguuccaugccacaaccacuaauaccacauuagccucuuggugacucaaguuuuuaaaaacaaggaagcuuauguggucaucuaguuuggucugucacuugaugcauacauuuccuggcuguacaacauaguagaaagagcauagcuugucugggucugguggcucacaccuguaauccuagcacuuuagaaggccgaggcaggaggaucgauugagcccaggaauucgagaaaagccuuggcaacauggugaaauccugucucuacaaaaaauacaaaaaugagucagaugugguggcacgcaccuguagucgcagcuauuugggagguugagguggcaggauagcuugaaccugggaggucaaggccgcagugagcugugaucgugcgacugcacuccagccuggguggcagagggagacccugucucaaaacaaacaaacauagcuuuugaaaucagacacauuugggcucacauucugaguucugucauuuucuagcuucguggccuugggaaaauuacucacccugagauucaguuugcucaucuguaaaaugggaaugaugaugguauuuauaaucucauggguuauuugugggggauuaaaugagacacagucugcgaaaugcucagcaaguugacuggcacuuaagucuuugauaaaugauagcuguuagaacauuccugaaugcacaucagucuuugaaaggccacggauuacauauaaggguuccuguuauucucuugucacuuagaugugauuuuauuucuugggaacauccuacugccuuuucuucaaaagauucuccucuucugcuggccuugaacuaaguccagucuaccugcuggccugagguggcgggggugugugugucagcccccucaguuguguuccuggggcaggcagaacucaccagcacccggugcugauuuuaucccuuccuucucugaaaacucggagaguaugugccagcugcugucugcgauugaugcacauuuauuuugucacuugggcucagaacguccucaccagugagcagcuucugauuaaugccgccaccccauccauuucaagaaaagcuucagagaguggcaccccaacauccuaagcugggacuggggugaacucucauucagccuguuucuccaucucucuuucgucucgaaacucauucucaugcccacaguuauuggggcauaaagauuccuuaaauggcuuccuccagagaaaaauacguuuaaggcacuuccuuagugguuugagcccugggcgagccccuccuccacuccguuuauuuuccacuauguauuuaaaucuuccccgauggugccugucuucucgucacuaaggcugacuuucuguuuuuggggugaaaccugugucuccuucaaccuccagucacucaguggauuuuuuuuuuuuagauucauaacauauuuuauuuugacuuaucuaacugaugucaaaaauggaaaauguucacauggauauucaucuaacucaugggcuccauucuaaaaacccccuuuuuaaaaaucaggcuucagugucagauugcugaauguuuuuuucauuuuccugagagaugcaaauguucauucauucaucucauuauacaacacaguacauaaauguagcuucagagcguauuaagugcuuuuauacacaagugcuggcuguguggaccaggugguagcucauuuaggccccaaauucauuaagggcagggucugacucuuaggcuucuuaauauuugguuuggugcauggucaagagcuggacccacauguugcauagcagcagggcugauauguuuaaagacgcugggcuuuuucugcucuggggcccuuucccggggguuccggugagucccuccccaggugggucugcccccacccgugugggcgggauuagcucccagaggcuggccaggccccaccugggggaggcuugagggcagggccccaaggcugagauucaggcuugggggaacagagcaggaaagagacccgguaccgaaagugagcggggcaggcaccuagucacauggguaaugggcaggggucggucacuggcuuuggcuccagggccagagcagucugacuuaguguugagcuccaagcauggaacacuggaguugguucauuuugaccagcaagccucuaaaugggugccuugauuacccaccgcaaggagagggcaguugccuuuuuaugacauguuaauuccagccaggugagucaccagguagcucucauccuccugccaggcuccccugccugucgguuuggcauugucagauaaugugaucauucauugaagugacauuugaguuccaaaccaguuuucuccuuuaaccauuucacccucaggagugauucuccuuuguuuggcauugucagggaaugugaugauccauucaaaugacuuuugaguuccaaauaguguuucuacuuuaacuuccuaaaugaaaaaaaaaaaaaaaaaaauuggccaggcacaguggcucaugccuguaaucccagcacuuugggaggccgaggugggcagaucacuugaagccaggaguucgagaccagccuggccaacuuggugaaaccccaucucuaccaaaaaggcaaaaauuagcccggcaugguggcaggcaccuguaaucccagcuacuugggaggcugaggcaggagaauugcuuggaccugggaagaggaggcugcagugagccgagauggcgccacugcaccccaaccuggucgacagagcgagacucuaucucaaaaaaaaagagaaagaaaagaaaguagaguccauguuccuguguuccucugcuuucuucaaggagcgagaauguaggaacccuuuuuguccucuugggauuggcaccuggggcguuguuaggcuuuuaaaacucucacgucuguguuuuauauuuuuggaauggcagcuuuuuuuuuuuuuuuuaauuggcagcuuuugcuuguuguuacugcaagugcuuccaguaaaucccuucuccaugaaacucacucucuuccucuggauccccccaacucacccuccccaggccugagccgcgccuugcugcugggucuccacuuguggggaagagagaacuggaccaggacagcgcgggaaacugacaaugccacugcuugcuagcuuugggauuuuggacaaauaggugaccuuuuugaaccuguguucucagcucuaaaauggggauaauguuguuccuucauauuuuauugaguugcugggaaguugggaaagaagagaagcccccagcgugugcauucaagagaguauaaaccugagugccauucaagcauuugugggugcuuugagguccugugcaggucucuuagaaguuuacccugaagacugcuagaauugcuaguucugugaggcuuguucuccccagggauacucggcuccugguucccucccuccaguccuggcucuggguaaaaugccaagucagcaaucauccaucuccccaccuccuucuggaacugucaugugguuugagaacaguuuaaaucagguuuaaccacacugcacgcugccccugccccaccacauacaugcacgccccagcgccccaugcauuuacaaaaacacugcaggacaacugcguccccucacccagacaucugucagcauaguccugcuuauaccugcuuccuucugucuaccuguuuuuaaggaaacccugucuuggaagcaaguucgaaugcucuugauacuuuugccuucauuuuagggccagcagcagguauucuuucuuauaacacguuuuucuugaaucugggccucuucuuaccgcuggaagaucagcuguuuaagaucagucuaaggaggcugcagucccaucggugccaguagagaggguuguggauuccugagcccucacuaugugccaaggaguguccuaagagcugucuuguguaauaggguagugugaacuccagagagucgugaacaaaggcacugcguuucugagagcaaauggggagguaggugugaaggaaggggaaguguauuuuuuccuggguagagcuguggaaacgcuuuccugccagcagcgcaaacagaaacagucucuuuuacuugauugaaugacuguugugcagucagaccagcaggaauauuuguugaucaggaucguuuauuauuugcuggagagaauuugcuguaagcagaucagaugaccuauuuuuauggcccaucugcuggaauaugaaaauaguaguguuaguugggagucccuucuuccuccuuuccauuacuguauuacaucuauuacuuagaguaauaggaaggcuggaugcucaguuauaggguaugccaucaagaaaauaccagcccugaaugggaguuggacaauuauucuggucccuaucagucuugauauucuaucauuuuaauuuuacugguagucuaaacuauucuacacugaugcaguguaguccaguuuuuuaaaaccuucagaaaaagacaauaauuagaaugcccugagaauccacauugucacacucugaccagcugauugagaacuugaaucaaucaccaauaugcucagugccaugugucugaagcuuguacugugaaaauccuaaguacacaccacaccccucuuaaaaauaggguaacaggaccugguaauuccagagagcuagaaguuuuaagucacggcuuuugaugcucuugcuaaggcccuggcuuucuauugaaagccaggaggaguuuucuccuauuucuucaaagaaaagguccauguaugcuuagcgaagugucuuuuuuuuuuuuuuuuuuaaacuuucuuuggggaagacauaccaggaaaaaaaaggcuugagaaccagccaccagguagcaguuggguaugggaugggacaguuugcuucugccaagguucaaauggugaccugcaaaccaggaggaccauaaacauauuugcauauacuuacaaauaugcuugcaaguacucauggcauuugucagcagagauguuggcuaagaauugcugaaaaugaauucuuugggaaucuuguucuccauggaguuccauugugaaauaagagaugcaaacauucacugcaaacauuuuggccuuugauuauuuauuuauuuagagcucagacgauccuccugccucagccuccugaguaguggaacuauaggcguguaccacuaugcccugcaaguuuagaacaucacacugaaaaacuuaaguaaaaauguuauagauuuaaaggaaaaauuggcacuuuucugauaaaagauaaagaaugauaugguuaaauauuaaccaaacaccuaaaaacuuaaacuguuguuccugcagugauacccgguggagauaauaaaauauacagagagcugaguuuagcagagaacugaagcucuuggcaggaggguuuauaucccucaguugaccuauaaauuauucauuagagaaguagcaagcacccacgcuuuugcaaauaggagucuuacuccaaacuucacccuucuuaaguuaaaauaaaccccacgaguugugcagugaaucacuuugacuuaugacuuguguucuggaagugcugcuaggugauaucauagcucgcugcagugucccugggugguaggagagcacagccaccgugcgugugugugugcacgcacacaagugugggggcgugccuacgugugcugagacaugugguuguccagcaacaguuacaugacaaauagcaguuugcaaccccgaaccacagagagaguuuguuuuacuguucugccuguuccaguuccuuaacugauggcagauguccucauuaagggcuauuagcacaucagaauguguuugcugagcccagaaaagaacuaacuccuuuuggacauggacugaaagauguuaucuaggguagccaaccccuccuguuggugacggcaguagggagugaggaacacaagagggcuugguauccccuuaaaacuuuccugagaagccuucagcacgaguuuguuucagucagggaauuccauaagaggagaauguaaaaucauaaagugggauuuggcuguguguugaacuacuguuauuguuacccggaaauagguguuucuugauuucucuuggcugcuccagaaccauauggcaaacuaggggauggcugguuuauagggaccauugauagcucccaagaaagaacuuaccagaggagugaaugaaguggagauucuggaggagagagguuggaaggaggccaccgcuggaaugguggaagugcaccaggugggcaggacccccggagugauuaugaggcagcaggagguccugaaaagucacgggcggcccagaguuaaccuugcuccuugacccaccuguuggcagaccuuugcugaugcugucauucgcucugaguccccaaagacccuugguuacuugugcugucuaucgaguugcaucuguaaaugucaugagugugcugauuaacacaggcgaggcaucgagugaugccuggugaugcugcccagccuggauuagucuagauuuguauuucucccacuuccauccuauuaauccccaguauaaacuuggcuaaaguuuucccugacuuuuuggguugauuccauuaucccuuugcgugcccugccagagggcaauauguguauaaaggucuuccccaaaccugaacugcuaaaugauuaacaguggcuugggcugcuuaacagggucagauuaaagcguugaccuuuauccuguagguaagaggccaagauccaaguggagaagagauuuuuucaaggaaugaaaguacgugagaaaauggauguguagacuuuuagaucaggagcuauuuuuucuuuuuaucuuuuugagauggaaucuccgccugucucccaggcuggagugcaguggugugaucuuggcucacugcaaccucugccuccuggguucaagugauucuuuuuuuuuuuuuuuuuuuuugagacggagucucacucuaucccccaggcuggacugcaguggugcgaucucagcucacugcaaccucugccucccggguucaagcgauucuugugcuucagccucccaaguagcugcgcuuacaagugcacgccaccacaccuggcuaauuuuugauauuuuuaguagagauaggguuucaccauguuagccaggcuggucuugaaccucccgaccucaagugaucugccugccuuggccucccaaaguguuugggauuacaggcgugagccacugcaccuguccaggagcuauuuuucccaucaagguucacuaacauagggaaaaaaacaccaaguugaugaaaaucaacuuaauugaguguuuuauuuugagagaucccacaccuacuagaaucauggcaggauugugaccucugacaccagacagacgugaguucauacucaaggcugcaguuccuaguugugcagcuuuggcauccugaccucucugagguugucaccucaucagaaauagaagaccauugguucaucucagauccuuuugaggauuaaauuagauacaauuuaugaaagcuaguaccucuuaggcacuuaauaaagacaguuucccuuccuucuuucucuucugcuuuuaaaaauuaagauuugggaguacuauaaauaaagccaaugagaaaauguauuuugguguggaauucuggccaguuaaaggagaaaggggacaggagggcuccagucagaaguggcagguucaccagcuccaugcgaauccggcaggccuggaagguugcaggcacaaacaaaauaggcaguagaaagcagucuuuaaauuaaaaaaaagaauaaggcuuacaaaaaacaucgaccgaguuuguuggccaaacauuucaggcgccgucugaagacugggagcccaggaauuugggaaauacuacccuuucuucauuuucagugguagaaaccccaaacuuccugcucuagaacguggggaggccauuaguuuuguuuuguuuuguuuuguuuuuuggccaagaaaaguggugcaguuucuuucucuggguugaugcugccaucucaugucucuacauggcauugcgacuucaccucuggauccuaucagcccagugaaauugaacugagaguuagaggugcuccauuuuagccugaggcuccaaagacgaagguauguaggugacaguguuuuaaaaaacaguuuaaggccaggcacggugccucaugccuguaaucccagcaucugccugccugcugaggcaggcagauggccugagcucaggaguuugagaccacccugggcaacaugaugaaaaccugucucuacuaaaauacaaaauauuagccaggcgugguagcgcacaccugugguuccagcuacuugggaggcugagguaggagaauugcuugaacccaggaggcagagguugcagugagcugagaucacgccacugcacuccagccugggcaacaaagugagacuccaucuuaaaaaacaaaaaaaaaaacccaaacaaaaaaaaaacaaccaauuuagcuuagguauacauuuuuuucuuuauaguggcaaagaaucuacucuuuacauuugucucccuuuuuauuguuacagugaagcuuucagcgagaguguuauuggauguaguuaccagauaccuaacuaggaauuucugucugcgugcugugacuccaaccuuuuccuuauauuauuuuauuugcuuucuggaaaauucaugguggagauacuaugccaguagauucuaaccuugaguuucugcauaaaaugcucaugaaaaccagcauuuugccccuuuacucaauauuugccaaucuauuauuauucuuuacaauucuuuugccauuuugguuuuguuacuauggagauguuugcgaacauaccuugcuggaaugauuuggaaagaggcuaggauuugggagguguggagauagugugguacccacagaaagagagccuggggggcuucuggacaagggugaaaaggaaagaaggcuuaugcagcuguucaaagauagcuugagcuaagggcugugccacaggugucuucuucaggugggugggaugggaggggcacaccugaguggaauuagccccauaggcacugggggugggguagucagcauugaugcugaggucccuggaaacccugguguuuuauaccugcugugaccccacggcaccugggaugugcuuugcacauaauaagcaaaugagcgaauaguagggaacagaggacuggaacagcagagauuaggaacugaggagccacgugugcucuguaggaggagggcaaccugaauuugcaaagcacugggucugacucguccccuucugccagccgggucaggccugggagcacugcaggucagcugguccccugguagggacccacuucgagaggccuguucagauucuugcaccaacuaccuuugccaucugaacaagucacuugugcucaacaucagugucuucaaguguaagaugagaggaaccugguucauuucuuuuuucuuucuuuuuuuuuuuuuugagucugagucuuguuguguuguccaggcuggagugcaguggugugauuuuggcucacugcagccucccgccuccuggguucaagcaauucuccugucucagcaucccgaguagcugggauuacaggcaugugccaccaugccuggcuaauuuuguauuuuuaguagagacaggguuucaugacguuggccaggcuggucuugaacucccgaccucaagugauccaucuaucucagccucccaaaguguugggauuacaggcaugagccaccacgcccggccaagcucggcaaguuucuguggcucuuugcagcuuugagccugcugagcuugagaaucuaugugcaucagacagacguccucaggcuuugaccgagcaauauuguauccuggaaguugcccuacggaagccgugguugaugugugugugcugagguuuagcucagaggaugcucacugcaggcagagaaguuuagacagcagaccauugggugcagccuuuggguacaauaaauaauaagagauuagaauaggaauggugcauccaccuaggaaaaugcugaguggcuucuaaacauguuuuuauaaaauaauauugaaugauauaguaaaacuuacacaguuaaguaaaaauacaguuuaccaaacaacaaucccauuuuuacagaaauaaaaguguaaauacaugcacagaaggaagccuggccugcugcauaggaagagugggccucccugggaggcagauuccucagugguuugcuuuuccgauuguccuacuaggaauggauaucacuuuuguaaaagggaaggaugcuagaaguugacuuuaaaggguucacuuauuuuaguagacccuuccuggcuccugcuguguggggcucccuccugaaagcuuccugauucccccaggugaugggcagaggcuucaguguccccuucgccuccgcaggagaggagaggcagcagcauggcgaguguccugucccgacgccuuggaaagcggucccuccugggagcccggguguugggacccagugccucggaggggcccucggcugccccacccucggagccacugcuagaaggggccgcuccccagccuuucaccaccucugaugacacccccugccaggagcagcccaaggaaguccuuaaggcucccagcaccucgggccuucagcagguggccuuucagccugggcagaagguagguugaucccaacauggacaggugucccgucuugccagucuugggguagggggcuggggugcccuagugacaggccggaaacucucugggcaccguuuugagugcagaccuuugcccuccagccacagggcaccugggcagcagaucgcccaagagaauaugacauuguuaguagacccagggcuucucuaccacaguguugucuguagaagguggcaagaccuagcaucagacgcugugggcuuuggcuugcucaaaaccucaguuugaaggaugaccauaaccacguuucucuuaaucugucucaguuugcaacuuuagcaaaggaaggcaucucaggcuuaugagaaucagagaacauugcaucuuugaauucccuuuagacacuuuuaagacucagagauguuuguguaguuggauucgguguggauuuccuuuuccagcaucccugccccugugccagggcccugggucugauguuaugagguccaggugccugggguucucuucuguugcccucucaaggccuccuaaaugaggacucuaccucuggcucccugccaaggcuugugccuccaggccucccugccugugagagaagguggccugccaacuuccaggucccccuguugagagguuggccugucucugcaccccugccaccuuguccccagguagacucagcauccuuugagugcaggauaaugagcaauucagaguggcaguugggcaccagcagacaggcagugcauccgggucaaggaaggcaggaugaugagcacagauucuagauucagagaaagucccagaaacugacauguuugcugucugccagucuagagagcugauaaggaucugucuugggaggaauugggccugugugggugcucaggugggaagcgaguaccugggaacaucugcuugaauaaaagaugagugaggcagagaacaugguuuguggcaggcagauccuggcuccugggacguggggugcaugagaacuucagggcgagacccauccagggcugaccacuaacugcugucccucuucccacagguuuaugugugguacgggggucaagagugcacaggacugguggagcagcacagcuggauggagggucaggugaccgucuggcugcuggagcagaagcugcaggucugcugcaggguggaggagguguggcuggcagagcugcagggccccuguccccaggcaccaccccuggagcccggagcccaggcccuggccuacaggcccgucuccaggaacaucgaugucccaaagagguuugugugggagaagaaacuggguuuuaaaagucacguggguagugugguguaagggugugggcuguguugugguggggaagaaauguggugucauuggcaucugggugccaagauauugggacaaaugggacacagaaaaggggaaucuuuuaagaaaaccagaguggcaucuuuucuuucuuuuuuugagacggagucucacucucucaccuaggcuggaguucaguggcaugaucucggcucacugcaaccucugccuccuguguucacgcgauucuuccacuucagccucccgaguaacugggauuacaggcgugcaccaccacgccuggcuaauuuuuguauuuuuugguagagaugggguuucaccauauuuauuggucaggcuggucucaaacucccgaccucuggugauccaccugccuuggccucccaacgugcugggauuacagguuugagccaccaugccuggccgaguggcgucuuuucuuuuccauagcucuauuaugggcaauguaccuuugguugggcauagggcuauuuuuuccccucucaugcuuaaacugaaucaggucauaguuuaugauaagagacagggaagaacuggcuuaaaucgagagucaacaaacuuguuuugaaugggccaaagaguaaauaauuuaggcuugauggacuacacagucucuguccccacugcucagcucugcugugguguccaaacagccaggggugaugcagaaacaaaugggcauggccguccuccaauaaaaccucauucauggacccucaaauuuuaguuuuauauacuuuccaugugucacaugucaagaaauuauauccuucuuuuaauuuuuaaaacuauuuaggccaggcgcaguggcucacaccuguaacuccaccacuuugggaagauugcuugaggcugggaguuugagaccagccugggcaacauagggaaacuuugacucuacaaaaaaauaaaaaaauuagucagguaugguggcuuuugccuguagucccagcuacuuaggaagcugaggcaggaggauugcuggaguccaggugguugaggcuucagugagcaaugauggcaccacugcacuccagccugggagacagagcaagacucugcucuaaaaacaaaaaccaaaccaaaccaaaccaaaaaacaaacaaacaggcugagugugguggcucacgccuguaaucccagcccuuugggagacgaagguggguggaucacgugaggucaggaguuugagaccagccuggccaacaugaugaaaccccgucucuacugaaaauagaaaaauuagcugggcaugguggcgcaugccuguaaucccagcuacuugggaggcugugguaugagaacugcuugaagccaaccugggugacagagugagacugcaucucaaaaaaaaaaaaaaaaaaaaagaaaaaaaagaaaaaaacccacaaaacaaaaccauuuaaaaauguaaaaccauucuuagcuugaaacccuacagaaacaagcagcaggcuacauuggguccacagccugcagcaugcuuaccccuggcuuagauauucagaaccacuggugaaugaagaauguauuuugcuuuagaauuuugugauacaacuuuuuucuaagaauauauauccuaauuucuauguuauaugcuguauguacauugaucuuuuaagauuuaaaaggaaaaucugucgacugaaauugucuuauauacaagaugugcaagcagucacacccuaucccaccucucuguguuugucuaugagugcgaaaaaacacagcagacccaguauuuugaaaccaaauuagagcagcaauauuugugauaguguauucaguggaaugcagguaaagaauuuauuuuucuguucuauggaaaugaaaauucaaagaucauacaaaaacagaggugcuaauguguuucacguuuuaauagucuugguuuagcugcuucaaacccaagucauauuuuggcggaccugaauuguaaggaauaaauuaagacagcuuuuugaaacagaccacuuagaaguuuauuucagacuaacuuuuacuaauacuuuagcauuaacuuguagacagcucuaguuuuacuuccaaauaauguagugauauacggauuuuuaaaaaauuauguguaacauuuuauagaacucugcuguauaaagcauggacacuugcauugggagauuuauuuuagugcuucugguuuauuugcacauuggcuuggguaguagguucuguugacauucagaagcugucagaaugccuuaccauuuuucuugggggaggggugggagaaggugguuaguguauaauuguucccucuuaaauuuaaauaugggacaaggaaaggagguaauuguugugcuuuugaauuccagugggcaucuuuuguccucguguucauuucgagucuauccucuuuccccuaaauaaaauucuccuuuuuuuaagcugcagaguucagcagcaaagucaugggagaauggggcugucucagggcgucacagugggaugagacccagcggcuuauaccggggcugccuaauauuagaagcaucacucagaauggguacugcucaggaagaaggggagaccuucauguuucacugaguuuauaugaucugagcacacacuggcugauuggaguugggggcacuuggaggggacaguccagaaguguaagaugauugugugaaaccagccagaaguggugucucguuuugcaaggaccaugggcccgccaugccaggaaguaacauuucccacucauccgugugaauccaggaagucggacgcaguggaaauggaugagaugauggcggccauggugcugacgucccuguccugcagcccuguuguacagaguccucccgggaccgaggccaacuucucuggugagcaagcggggcccagcuggguucugggcaugguagaggcccacgacaaacauccucugugcagagcagcuaguugccuaugucaccagccuggcaauagaauguccagggacaccucccacuggcaccucugaccggcugcaugccauggaguuagaugcuuccguucuuuuuccucaguuuccucaccuggggaggaguuuccugguacauugugaagaugguugagcaugggacugagcugcaguggccaguggaguaaguucuucaaugggaguggcugagcccagcacuuugguggggucugaaugaggccaauagaggaauauuuaguucacaaaguagcaauaugcuaaauggucuccuaguggccucagaaaauucaugcccucauuccacgugccuaauucagccucauaaauuagugugggccuaugggacaaggacccggaauaaaugagcuaaauucuaaaguaaaucuaauugcuuaauaaaaaccagugauucaacuucaaggcaaauuuauuaaaacaaaauugcuauaguugcaaccccaaaauacuuuaucaauaauaugagggaaaaaaggguugcugaguauuugucaguaguuuggcaagacugguagugaaccugaaguuuuuugggaaauucauggcagggcuggccuacccuacucccagggaagaacuucuucauugguggacaccuaacugaauugcaagcuacuuauaaacuuacaggaaaauauggaguuagcucugagcacauagcaggaggaaaguggccuucauaaguaucccucauaaggaaucucccuaaauagaaauuaaacauaaaggagagagaaaacuuacuuucuugacucaaagucagcugucaaugacuaggcugccaaaggaagucauugcauuaugaggacaccuagcugugaagcuuaguauugcaugccugcucuauuagcgcagccaaauagggaagaggaaaggaguuaauuucuaaguucucaggagaguuuaggagaucuggaugguuggguuaacaguggaaagaucuaggaaaguguccuaaagaaagaaaagaaaauuauugacuccaguucccaucaugaggguauguauaauacaugcauacacaagugcacaucaacguagaagcaucucacugaugauaugccaucauccugacaauuuuaagucccuuuguaaaaaaaaaaaaaaaauugucuauuaaauuuuuuuugaugacaguauauuuuuuaucuuauagcugaagucaguggaaauauaaggcuuccuuggccuaauuaucuugaaguauucugcaaaguguggucuauacaacaaccaaaaccuugacuaagagagucguagauacuauuugcacaaaugccacauagucccuuugguuucugugugguuaggauggcaugugugugugcaugucuauguauagaaaacaggauuauaaauauuucuuaaaaguucacuuguaagcucugagugccgugcauuuguagagcaguacuuuauuuucaugguauagaaaguguauuuauugccuguguccuagaaaaacuuaugaucaaagauggagucacaacuuacacauuaacuuauaacuuauagauaacguuuugcuuuauguuuugcuuucuuugugugccagucaaaaucugccaugcagauuucaugcauuugagccauugugagugguuccuauagggaagggcuaccgcauuuguagggugugccugcugcuugaccugcucuuugucccggaguccugagcauccuagauguugccauguaguauucugcucacugcccuucucucccugaucguuuuccuaucaguggaugugcgugggucuuucaccuguuggccuguuuaaugauucuugucuucugcccugaagguguacccuuuuuuaagcacacauguacauguaguaaucucuugguucccaggaagggacagugauagcugugagacaugacaacaguaucugggcagggaagaguucuuccuccaucucauucuuuuugggugggcugcuucuaggaugugagauguaaggagagccuggacuagaaacauggaaagaugggagccugugccggguagaucccugauuagcauugaaggagucuggacuaugagcaagaggagagaaaggcagcaggauuuuauccuggccacaagggaugugcuaguagaccuuggaauccaggguuagggggcucuguggaacgccccuguugggaguuggggcuuuugaggacagguagcuuuuuucccucucucuugguauuuccacauaucagaauuucagauucuucuauauuauaaauucaccuggauuuuuggccaaggagugagagucuggguugggcccaugcagccugcagaugugcuguuuaaaaacggaagauucuccaugucugcugaugcccguccuccugcucagaggcauucaggagcccagcagcugcuucagggccaugucaggcacgaaagcccccugccaccuugcgaugaccagaauugcucgcagagcuugucuuuccuccuccaaacauguuacuucuugauuaaagcagguuccaccugggcugcagcuagcacugggaaauguugugcacccuccugagaguugcaaaggcugaguuguuuguuccacccacagguuucuauggacuggccuggguuuagaugauugaagagcauuuuucaggaaagcuggucaagaagaccuuuaaguuggcgucagcuguaggaaaaugcucugggugguacccaacacucugggugugccuguucucaaccaggccuggaggcugcagaggcuuugcccuucccccuccccauccccccuuuauuuaauguauaaagugagaaacaggcagcacuuugggaggcugaggccagaggaucgcuugaggauaggaguuugagaccggccugggcaacauagcaagaccccaucucuaaaaaaaaauuuuuguuuaaaaagagaaauuucaguuagguuucucuuuguaugaauccuauacaaagcaaacuugcaguguguaucuguuggucagugaugaccagguggcuaugguaggaaaugucugcgaggguagagcaguucuaccaagagaaauugcugccaugaaugaacuccucuccauguuuaccgaagcucagaagggagaguuugcccagggacacgcccgugagcguccucucaucuuuucuucaucuggccagcuucccgugcggccugcgacccauggaaggagaguggugacaucucggacagcggcagcagcacuaccagcggucacuggagugggagcaguggugucuccacccccucgcccccccacccccaggccagccccaaguauuugggggaugcuuuugguucuccccaaacugaucauggcuuugagaccgauccugacccuuuccugcuggacgaaccagcuccacgaaaaagaaagguacgugauuguggugugagugggagcccaggcuggagcggaugaugucuguguggggacagccagccguggagagcaggggacccugcaggcccuagauagucuuggguucacucccauuucgguuuuuuauugcugcuucuguuaccuggugauauucccaggauucuccuucuccuauuuaaagccucuucuguuuuagccuccaccccaaucccugccuucuuuccuguguuucugcagaggucugcgugggagaggccuccaguagggucuuagccacagcauggagcacugcuguuggccacuaggaccaucucuuagauuggggcuuucuagccccugguuguaaguuucucuggucccagagaaccccuuuccuggagguuuuuguugggucaggccggggacagcagccaguuugaguccccacuggguaagguugagcgagggauaaggagaaagacauauccacucacccugucuuccuuuccuguagaacucugugaaggugauguacaagugccuguggccaaacuguggcaaaguucugcgcuccauugugggcaucaaacgacacgucaaagcccuccaucugggguaugugcgagcccagggccucuagccuagggucgcgugugggugucccuccacccugccgagucccugugacccacagcccacagugcuuucaggaacguggcuugcugggaacacccccuggugucucuuccuggcccccugagaaagacauccuggugaacauuguugcuguugaugggaagggagcucuguccaucuuggggaugugucuucuugccucauugcaggaagcaagauguuuuaguucuggguagaaacggggucauuugguuuaguugcuggugagaccccguuuccaagauguuuaguggccaagcacugcaccacccacucuuccuugggagugggucuccgcuagccccacccuggugccuccgccguguucugugcagagcgaguuugcaggcugcuagugguaggagcugacucauggcccugggggagaaagcgugacugcaggcagguggggcccagagagggcucguggucgugcucagugugggaugccuccugccagaggagagguuggcacauguuccgggagagaaugagccuuaggugccaggaaaaauaauucccguugaugugcaacacauaauccuggugacacccgucaggagcgaggcaccuggguguucucuugggcuccgucccuggcuugcuggguggccucaagcaaucacuucccucccuaccgcgguccccgcuggguuugaagggggcagggugccccugauuauaccgcaucucccucccacacagggacacaguggacucugaucaguucaagcgggaggaggauuucuacuacacagaggugcagcugaaggaggaaucugcugcugcugcugcugcugcugccgcaggcaccccagucccugggacucccaccuccgagccagcucccacccccagcaugacuggccugccucugucugcucuuccaccaccucugcacaaagcccaguccuccggcccagaacauccuggcccggaguccucccugcccucaggggcucucagcaagucagcuccuggguccuucuggcacauucaggcagaucaugcauaccagguauggggcggggcucgcuggaggcucaggcucauagcugacucaucacgggccagcuugauuacaggcuaccgaccacccugauggaaggcugagcccuuuggccaaauugcuaaucucuucuacaaggaaacaaaaggaaaccgaauucacugcucaauaaaugugggaauuccuggaguuaucuacauuggcagcugucaugagugguuacuaggaaucuagcuaaaucccuaaguaacugggcgauggauuugggugggggaauugucacaccucugcuuauaagagaggauggagucguguaguugggcuucccacgugacgucuagguccuagaauuguguucuguggacagacaguccagcacgcauguuuugaauacuuccugcgggccaagaauuggacuaaguaagacuuucagguugaagaaggcuuagucccugcccuuguggagggcaugguucagauugagagagaaaugaauauguaacuaugguuaauuauaauaaccagucaaaguacuaauuacuagaggcaugagaagguguuguagguaccagagggaccaaccuauuuugcccuuguggaugagaaacuuaucacagagggugauauuuaggauggucuucgcugcauguaguagguacucaaggaacaugcagcuugcugugugcugauauuucuuaaaauucuuuugugccuauuuuaucagucugugggccaauuugcaaauuaguuauuaaaagguauugcuuucagugagaaagcuuuaugaaaugggccagcccuccuccuuguuagaaugaguggccgcuuagcgauuucauguuuggcccacuuggagcuguggcugaccuauggggcccagacauguagcugguguuuucacaaauagcccugaaccuggauacccaugagcacacuacuacucucaagcaguugcuggaagaucccauaucuuaucccagccaugcccccuagacgcagaaggcuuggggccucuuuuggcacgugccauggcauguucuugguaggugauccaguugagaaguuaaaucuucugcggugauuaagucaugaggcuagcacguagaccagcgcugagggaaggguuccaggaugagauuggagccucgcaauaaggagacuacugcaaggcauuggaugauacuccaguguuguccucgagaaagccgagugugucccagcucuuucuggucauugcacuuacgcagagaugcaccuucugcugcugucaugaggcuguggggauugugggcagacucugaacacuuccugagcuagaauccgggcugacacccucgucuuccgcaggcucugccauccuuccagaucccagucucaccacacaucuacaccagugucagcugggcugcugcccccuccgccgccugcucucucucuccggugagugugcgggcagcacggcuggggccucguauggccgagggcucucccacacaucccagggcuggaggccaucccuugggcacggggcacguggccacaggucgguguggccaucuugcuuucagcccccaaacguguugaagauguccuugugcugcccccucccuggcacuccccaucuggccauagccccucgcggagguggaaggaggcgcuuguagaggauguccagagcaagcagguuucuugccaagaaaaucaccaggcgaggcuggggucaguugccccaucagcuccuagugcccguggguguuuuuaggauuuuaaugcugaggagaggaagggggagaauguggaggcugugugggcugggucagaaaucucaaggccacuggagacaagggccauagguggacccccaacucaaguaagcgggaagucauuuugaacucuaccuagcaggcgcuggucuugaguuaucuccugcagggcggugucacacuguaaaucagauugccagugaugccacugaggcagugugaggcuuccaggcauagcggcuccgucuaaguccccugcaggagagccucagagggggccagguccaguggcuccccuguccuuguccuuggcuggguccugaguguggcaugaaggccugcuccuuccucacucuccugccaagagcuccccucggcuggaguguucucccugagaaggugcgaggccuucugcaccaggagcuggggacggguggcugccugucuuuuaggauagcucccucaccuuuccugaaugucccugugcucacagccccucuccccacgcccagguccggagccggucgcuaagcuucagcgagccccagcagccagcaccugcgaugaaaucucaucugaucgucacuucuccaccccgggcccagaguggugccaggugagauguccgcugucguccccugccuucugguuucugugcccugucuccaguggcguggacuccgaccccacccagaugaagucaccaggguuaguccccagagaggagcccagauggcggaugcaccagaugggaugacuguuugguccucagagccucuggccccugguccuggugacuuuugccgggagcugccccuuuggccucugcuuguucucccagccccacuuggccacucuccugggcccaccaccuguguggggcucgauuugcauuccucucuuucugcaggaaagcccgaggggaggcuaagaagugccgcaagguguauggcaucgagcaccgggaccaguggugcacggccugccgguggaagaaggccugccagcgcuuucuggacugagcugugcugcagguucuacucuguuccuggcccugccggcagccacugacaagaggccagugugucaccagcccucagcagaaaccgaaagagaaagaacggaaacacggaguuugggcucuguuggcuaagguguaacacuuaaagcaauuuucucccauugugcgaacauuuuauuuuuuaaaaaaaagaaacaaaaauauuuuucccccuaaaauaggagagagccaaaacugaccaaggcuauucagcagugaaccagugaccaaagaauuaauuacccuccguuucccacauccccacucucuaggggauuagcuugugcgugucaaaagaaggaacagcucguucugcuuccugcugagucggugaauucuuugcuuucuaaacucuuccagaaaggacugugagcaagaugaauuuacuuuucuuaaaaaaaaaaaaaaaaaaaaaaaaaaagaguuucuggcugaugggugacucagagugcaggacugccuggccguggggcagagggguuugcccuucucggaggguaccuccuguucccugucugagcauccugcauggaagucaaaggaaaucccuuucuuggugacgacuuaaaucuggguucccucagacauuggguugcaccccaacaaauauuaaauggcuucuucuuaaagcccagagaaagagguuuuuuaaaagacugucgccaaauagcugagccaaaaggcugaucagaauucacuuuuuggaauguggcaguuaaacacuaccuugaucauucucuccucuuuccucgaggaacuccuggaggguuugagcgucuggaaacucucugcucugacccgaggaagcacccuccugacgccgccuuccuccgguuauugaaaggacgccucagaaaugcuuuguuuucuuuuacgauguauucagaagccuuuacugauuaaaguuuucuuuuauuuggguggccgggagagacccagggagguucuggagguuccuuucugucuccuggccccaccagggauuuccccauuucuguuugcugccugaaagcaggaugaggaaggccaaggagaguccuugcacccgugagcgucaggaugaggaaaugacaggaggaagacguggguuuggguuaguggcugcuggcguuuuggcccuugguguuucuggagccuccagggaucuaggggagccugggcugcgugcaugucgauaagcagagcuguucuuggggagaaggagggaggucucgggaguguagcaccaugccaaccagcccugcgcgaagacagagugagccacgcccggauggcagggcauguuucuguuuuggugucucacuuuccucccagcgugacuuauuuggggauuccucagggccuacuggaaugugacugcccacugcccagcugccucggguacaaguccuggcccuaugucccagcugucaggggcucagggaauccuacccagccaccuguccugggauggagugucagcauccaccccuugguugucaucgaggccgcccucccaguccugggugaagauauuugggccaccagggcucccuuggccccuucacguaggaaauagacacgugcuuuuuaaugcaggacacuuugaguguuacaaaaucuguagaccuggcaguagggucaugauguugggaaggguguagugcccuagguuggugacagaagggacagacacuugugcacaggugucuuuggugaugggguuuuuuuuuuuauaacuuaguaaaaaaaaaaaaauguauguggaauucugucucuugguaaagcucaaagccaggcuagccugagguggcgcagggcucuccuuccugucccuucgaucuccuugagaauuaagagcuggcagcugcugaugguguuucccaaccccccucacuucccaagacaacccccagcuucagguccucauggggaggggagggcacguucuugacacaugggaacuucgcucaggagggccuccccuuccccucucccucagaguuuucacugccgucucgucuuuagaaagcuguuugaauuccccccgcccccaguuuggaccguguagauauaacuggauauacggauuuuucucuuugugcaggcuucuuaugccguugguauacagggcaggaaagagaggaauaaagggagagagcaguguggaaaccacggugguuuugcuuuguucuuacuagguuuuggugccaccuucccugccugcgcuugugcccccucuccuccuuggcacuggcggccuccuugccucccuuccacccgugcugccaucccgugccugucguguugguucuucacacgugcucuguucucgggguuguuccauucaugccuucuuggagggugaggguggcuugggaaccgacccagugaucaugccuacuuucuucuuuguaucucccuccuucccagcccacccgggcagcagacucugauggaaggaaggugccguaggugggcuuuuagaaacuaacgggacugguuuucaaagcaguuaucuugggaaacuguuuauuccagcgaugugacuuuuuucagaauauuucuuggaaucauauucagagucuggggcuguguguugagcagccuuaaggaugcuagacacucauuuagugcccagggaguccagcgaaugacgucuguggccaagcgaggucucaggugcaaagcaaaaggaccauuuaaaguaaaauagcuuggauucaaucaugugacuuuuaaauuggcucagaaagcaauuuuguaauuucagagaguguuuugagccauggccacguugucauugugagucuauagcuugacuccuuggagaacaauauucauuugguuguggagacugauuugcugggagaaaucuguccuguuacuuucuggucaucccagguucugacuuuuaccaggggcaaaaaaaaaaaaagcaagagggagauaaaucccaucugugaguuugucuuauuggcgccuuuuuccucagcugucuuccaaguauuauuuuuacuguuaaaaaauuuuuuaaaaaugugaaauguaauguuuuuacagcaacaauaugaaauauauuuuauaaggaauaaaaugguaccuugucugau

SEQ ID NO: 17629 - RNA, 1171 nt, Homo sapiens
ggaacacacuuugccuugaguagagcuugccgggagaaagugaaggggaguggccauccauuuucuucuguaugugguucucucacuucuaccagacaccuagagggagaugaggccaggacuauguugaauugucuuugccuuugagaugaugcugggcugugguugagauaguugcuuucagggaaguaaaucccaagaagggggcgcaauaugacauugcuguucagagaugauuauccuuugggauuucagagggcaguucaguagacagaaaaauccucauucaggcaguuauagcuuuucgcuguugcgugucccugcagaugguaucaaaaagaaaaauaacagaaaaaaaugguuccauuucuccuaagaucuguguggccccuugucuggccugugcucaccacauugggauuguggaaugaggacugaauuuacuuaagccuguggaauuaaucugcaccucuacacugacgaaggugcagacugagacaucgaacagugaaauagugggauuguaaggccguuugaagugagcagacagcgugaguucaagguagcaaggaagaguuccagcuucuuaucugggucucagaaaauuuuuaauuuuuuuggucagugaugacaagcacuguggacucaggcucagaagguuuggcugcuaguucacaacuagauauguuucuuuaguuuuuuguuuuguuuuguuuuguuuuguuuugcuuuuugagacagagugucacuccaucaccuaggcuggagugcaguggcaugaucacaacucauugcagcaucgaccuccugggcucaagcgauccuccugccucagccucccaaguagcuggaacuacagguguguaccaccucaccuggcugauuuuuacacuuuuugcagagacaggggucuucuuuguugaccaggcuggucuugaacuccuggccucaagugauccuccuugcuccaguuaaauguuaaagccagaguuaaucuggauuaagaguacaucuaugagaugcacacacaaacccucccacccauguguguaucauauagaugagaguguagaugcagccuaucuagaguguagacagauugccucuucccuuuggaggugacccugccccugaugcauguccuacaggcuuugaugggcacuugcuucuc

SEQ ID NO: 17630 - RNA, 98062 nt, Homo sapiens
uacgauacauugaccgacauuuuacgacaggcgggauuguuuuguggcugucagcuuuccccguggucugaguuuguggcugcauuuuuaucucugguggcucugcuacggcggcgcagaaaugaggcagaagcggaaaggugcgaaaggggaaggagaugggggaaaggggugguccgaaaggggcgaacgcccaggcaaucaaaugcugaaccgaacuuuuaccgcgagaauccgcuacccaguccagucgccccgccaccuagggucaguguguccauucugguccccgagccuucucguuuuuccuguuuugcuuuuugaagcacccuacccuuccucucuuccucuuuggcagucacguggugucuuguuugaauggcagggaaaccauuauuccaauauaugcccuccgaggaguuaacgucgauuuaacggguuguaggacuuuucauuuguuaagauuuguuucacgacacauuugacguguuagagaguuucuuuuaaagccuuauuuuaagauauuaaaaaaaccuuaauuauccuuggauucaguguaagaguugugcaugcaauuauucccauuuuuauuacaucaugaguuagcaaugaacaauuccaccuuugguuuuucaacaggacggauucaaauuugaaauauucucucacagguucuguuccuauuucuguaucucacagguucuguuccuauuucauuugaccagcuggucuaaucaugguaauuguugucagaauaauagcuaccauuuauugagcuuguauuuugaagucgguaucauuuccauuuuacagaugaagaagcugagauucaaagaguuaaguaacuuucccagaccaaaauuauacuuagauauggagcuggcuggucaggcuguaucugugaccucaaaaaacauaaaaugaaaaauaaauacaucguuaaucccuaugcuucuugacauuaacuguuauuuuucuuucuuccaagcaacaauucuaaguguccaaguuaccuuagauuaagucuugucauauuugcaugcccuaaauuaauuuguuaucucacucuaacuugcuccuucucaaucuaccaggauucuuuuaguuucuucugucaccaagucauguugauucuuacuuagaaauuacuucuugauauaguuuauuccucuucauucuggccgccaaccuccuaacccaccuucaucacuaacuaauauuugaaugguauuucagcuuucauauacauuauuuauuugagucuuagaaugguuuugugaaauuuggauguauuaccccaauuuuacagacaaggaaaugggcacucaaaaguuguugaucuuggccaggcgcgguggcucaugccgguaaucccagcacuuugggaggccaaggcggguggaucacuugaggucaggaauuggagaccagccugaccaacguggugaaacccugucucuacuaaaaacacaaaaauuagccgggcgugguggcaggugccuguaaucuaaucccagcuacuugggaggcugaggcugaggcugaggcagaggcgggagaaucacuugaaccugggagguggagguugcagugagccgagaucgcaccacugcacuccagccugggugaccgagcaagacucugucucaaaaagaaaaagaaaaagaaaaaaaauugucgaucuuuuccguuaccacacagccaguaggcauugggacuggauccugucuuagauuuuguggguuuuuuaaaacaauguugccuuucaagagccauuugaguaguauccauauuauauguauucuuuuucacuuucugaaucauucuuuguaccgauaauauucuuaccuuccuuaaacguuacuuucaacuuuuuauuuccaaaguugagaauaugcaauucuucacugucuguugcauuccauuucaaugccuuugccuaguggccaggguccccuguaaucuguucuuuauuacacccuguuagaaagcuggauuuuaguuaggcugugcuguuucacacaaagauagguaauuccuaugccugacauuauuucuucuggauugccuucuguuuugcauguccaaaucuugcccuaucuuuaaagaucccugugccauuuccuucaugaagucuuuuccuacucauuuacucuuccaguucuugauacacucaagagcuauacaagugguuuccaaaucuuaucuguucuuaucagccgauccccuuuuacccuccaaauaaauucuuacacagaaccucaauauauaaacagcugaaagcagagcugcugugguggaaauaaagagaccuccuccuuuuuuuccuccaugccuuauuuuccucuucccuucucccuuccucugccaugaccaccaccaguccuaccucuguugcauggccccugaggcaccuuuguagaacucuggaagugcugaguuacaugguuuggaaagcauuuagccuuugaguauagauggacuuuauuucucucaaaaauuguuguguauauguuagccuugccucauuaaauuagaugcaguguguuacagugaaaaaagcauggaaguuguggugaaaagagcuggauuugagucuuggcucugcuguuuacgauagcuuguuaacuugccuuagccucauuuuucacaucuauaaaaugggauaacaguaccuacccuccguguuacuguaaggguucaaaugagauaaaguaaaugugugggcuccauaauugccagggccuuccauccacgcuuucauuauguuuuagcuuucucugcagugugaguccucagcccccugggccacggaccaguaccgguucauggccuguuaggagcugagccagacagaagaaggugagcagcaggcgagcaagugaagcuucaucaguauuugcagccacuucccaucacucauguuacugccuaagcucugccuccugucacaucagcaguggcauuagauucucaaaggagucugaacccuguugugaaccgugcauguggugggucuagguugugugcuccuuaugagaaucuaaugccugaugaucugucacugucucccaucacccccagaugggagugucuaguugcaggaaaacaagcucaggguucccacugauucuaugggaacagaauucguuauggugaauuguauaauuauuucauuacauauaacaaugcaguaauaaaaauaaagugcacaauaaauguaaugcacuugaaucauccuaaaaccacccugcuccccuggucuguggaaaaaucaucuuccauaaaaccaguuccuuuuaucaaaaagguugggaaccacugcucuacaggugagaagcuugcuugcugacagcuuccaagcugauaucccacagcuuuugucccuggaaaaagacuggcauuuuuuaccuugaagaaaagagcucagauuggccuggcuuagagauaugcccauccuugaaccaauccuugaacugugcuugaguggauggcgucauacaagaaccugucagcuucugcuguugccuuuggaugagaccgagagccccaguugccagaaguucaugaugguggacagacaauauuuuagaaaugcauuaagauucuuaggcagauaccuggguuugaguuucaacuuuacuccuugauagcaucuucauguaacaggcacauauucuuguucugucuaccucuguucugagaauuaccugaauucaugcaucuaaauguucuuuaugaacucuaaaguauuaugcacauauuaguaauuacaccucuggagauaaagggaagagaauuacuuugguccuuuccugugugauuaaguucuuucuccucacauuguuucuacuccuguauccuuuccuguauuuauuuuuaauaaucucauagaguaugugcuucuaaagggagcuuuucccauauauauguaaagccacguuuguuuuaaagauacaaaagauaugaucaaauuguaaacaguagagauuuagcaucuucugaacuugagcuauucauuuggcauauuuguaugguuucggauggaaaacugcuacuaaaucagauuuuaaaaucuugauugaaugauacgauuuuugacauuguugaauauuaacuuuccaggagaucucagcccugcugagcugaugaugcugacuauaggagauguuauuaaacaacugauugaagcccacgagcaggggaaagacaucgaucuaaauaaguaaguggauauaaagagagagcaagcuuguucuuagguagcagaucucuuuuaugaaauuaucuaguacuacuuguuuuccagcucaaguuuuauuuuaguugagaauuuuagcuuucugccuugccuugucauucauuucuuuuuuuuuuuuugcaaguuccgccucugggguuaacgccauucuccugccucagccuccugaguagcugggacuacaggcgcccgccaccacgccuggcuaauuuuuuguauuuuuaguagagacgggguuucaccguguuagccaggacggucucgaucuccugaccucgugaucugcccaccucggccucccaaagugcugggauuacaggcgugagucaccgcacccggccgucauucauuucuugauggcaaaauugucucagcuuaagaauacuaauagcuucuaacauuuauugggcacuuacuguauuccagacacuguugcuaaugcauuguauguauuagcucaguuaauccccucaaaauucugugagauagguacugauaccagccacacuugacagguggguaaucugagucagagagcaguuaaauaauuuguccagggguaaguaacuaguaauuggcagagcugggauuuggaauuaggucagccgucuccagagcccauguucuucugugcugcaucgcugcacauccuacuuuccuucccuacugucucagcugaagcagcagcuuucugucaggaaaacccucccuuuggggccccugaucuaauccaacccuccccugcuguagaaccucuuugacacauucauccacuuccucuccauaaucauuuucagcuuggacuuuccuacagucucaaauaagaguugucuuucaucucugcaucuauuuuuuuuuucaaacuauaauauauauucacucuauguagaucuucccuaaugaaaggguucucuccccaaccccaggucgucuaaucaucacauacaggaaugaccuuuucuuagacucucuucucugauacuugagaugcugcaauauuuuaccccuuccuugaauccucaugcuuaguaaauauuugcuacaggaauaaguaaauauccucuuuugacuauaaaguuauuguauuuuacugauuuuucuaccgugucuuuagaaguuuuucuuucuuuuuuuguugguuauaccccugauuauacaaaucuuuaauuucuagugaacauuucuacaucuuauauauauuuguuguucucuuuaauuuagcacaucuaaagcuaaagcugccaucguccuuaaaacucgccccuccucagaugucaccagccuauuacuggaaggucucucagucuggcuucaaccugcuuuuccaaguuuuuaaaccucuguaccuuuacauugaaaaucuucugcuuucugucaaguuggucugcuuguauuucuuaaaauauaugcauuccuguuuuugcaucugcacauaaaucagccugucugcccuccaugucaucuuugugucuuuagugacugagaccuacucuuucuucugugcucauuuccaugaauaucuccccagcacacaucagauuccucccugaacucuggaagcauucauuguugguauguguguguguuuuaugacauauguuuuaaucauuuauacauuaauuuucuugguacgccugucugcaaacauguaaacauagaacaugaaaggacugugccuugcacauuugaacauagcagguauucaggcagccucuuguacguguuagguccucaguuaauauuuguugacaaauaugugagcacuucacagauauuucuagauggauuaaaguuagaagacagggugacuguuaagaguuuggcuaggaggcacaaagaaaagcugguaaaaguuuuuuuuaaacuuucaaaaauauguacuuuauuuccuauuugguucugcauagccauccuugauuuuuuuuuuaauuguuguuguuguuuugucuaagacaguaguugucaaccaggggugauuuccuccucaggacauuuggcaaugucuagggacauuuuugaguguuacaacaggaagacaagaagaaggcugguaguacauagagaccaaggaugcugcuaaacaucccucaauucgcuggccaccugccacagcaaagaacuguguggucccaaacaucaguagugcugagguugagaaagguggagucagaauaguccuuugaagcugcagcacuauucugaacuagaucuauauugugucaucguccagggacccuucucccuccauaguccucugguuuucuuucugguacucaagggugggaaguagucauucacucgugaauuuuauucuucuauuucccugauagucacagaucuuaaaacuauccuugucacguggugaagggauuggagagugacaguuguuaaugauguuguuuauagaucauccucuugguagcuuguccuuaaauaaccguaaucuugauaaugugagaugcuuuacuuucagggugaaaaccaagacagcugccaaauauggccuuucugcccagccccgccugguggauaucauugcugccgucccuccucaguaucgcaaggucuugaugcccaaguuaaaggcgaaacccaucagaacugcuaguggggugagugauucgacucaugagguaucgacacacuggguaucuguucuggcagaagucccugcuccaugugacgcccguguagugagguagagguuggggauucugaacuaaugaagucccuguauuaggauaugugcuggaguggagaccugugcugaaugcaaggagagcagagagagaaaaaaauauaauugugauuaaaggaguagaugauguuuugaccucuuuaaaaauauagauuuaggcuuggugacaaucauaacaggauaaauguuggccaucuuaagcugguagcuuucaauauaauugaugcuuaugaaagguacuuuugaaagguaguuaauggugcaaaguaguucuguauauggugauuaugagcacuguggaaguccagacaacagcgaugucccugcagcaaaaggggcuggggaaggcccaguagaaagcacacagcuugcuugacccauaagccaagaagagcaggcucuaagugucaugggagcaaggacacaggggcuaaggcacagagguagaaaugacaggaagggcguggugcacgcaggaaauagcgaguacgccagacugaaggguguuaacaguucaggagaguaggacugugcguugaacagguaguuugggaucagcuuguaaaaaucuuaagugucuggcaaagcagcuagauaauaggaaacaaaaguuuugaaaaagguaguaauaugaacaaaguagauuuucagaaaauuaauuuggauacaacaugcaggguaguuuggagacaaaaagacuagcuuagaugcucuugguaugaugucaguaugcaguguuaaggacuugaguuaggauggagacucuaggaugaaaaaagaugagugugagauacaugcacagaaauugauagaauuaagacccuccuaccauaugguccccagcaccaaauucuguuccuaaugugaucccacaaguucauucuguuauuugaauugggauauuauauuccaggcagcuuguguugacuuggugaccauaucuccuggaucaccuuacguuuguggcuaauuaaacccuaaaauuuuuacauacaauguaccaccaaaccucauauccucuucuuuguacuuaaguguuuuuguuuuguuuuguuuguuuguaucuaguguaaaaagcuuguuagccaggcacgguggcucacgccuguaaucccagcacuuugggaggccgaggugggccgaucacaaggucaggucaagaccauccuggcuaacacgacgaaagcccaucucuacuaaaaauacaaaaaaaaaaaauuagccgggcguuguggcgggggccuguagucccagcuacuccagaggcugaggcaggagaauggugugaacccgggagguggagcuugcagugagcugagaucaugccacugcacuccagccugggcgaaaaagcgagacuccaucucaaaacaaaaaacaaaaaaacuuguuaagaaaaacuaauaguccaugccccucaccucccuuuuucuacccuagggcaaccauuuuuaacucuuagccaauuucuuuagcauuaacuuccauauccauaaauaaaauaacauucuuuacauaauagauaagucuugacuuucuuuuuuuuuuuuuuuaccugagacagucuuguucuguugcccaggcaggaguacagugguacgaucuuggcucacugcaacuucugccucccagguucaagcgauucuugugccucagccucccaaggagcugggauuacaggcaugugccacaaugcccagcuaauuuuuguauuuucaguagagacaggguuucacuauguuggccaggcuggucucgaacucuugaccugaggugaucugcccgccucagccucccaaagugcugggauuacagacgugagccacugugccuggccgacuuuuuagaguuaagcauuaugugugggcuugccauuaaagaagacagaaacuuagcaaccuuucagccugacuggcaaaccgaggcuucugugauaccacccucucuguuucuuccucugucucugaucauuucuguccuaucuuggcuaccuuauugugcuuaccucuaaaaguugauguuuucuguuguccugggcucauuguguuugguauuuuacaugcuuucuuugguaaccucauccauuugaugauuuuaguauugauguaugcugacucccagcaugaaccauucccugagcuucagacuccugucagauugucaguuaggcaucuguccuuugacugccugagaaccuccugaaguauagcauaaccaaaacuaauaccagacuugcuuauucaccuuuccuguccauguuaguucaugguaccaccgugcacucaguuuccaaaaaaugugaaaugcauuuuccguuccuacugccacugguaagaaugcuuuggccuuuauuauuucuuguuuagauuauuucagucauuuccuuacgcaucuauuuuguccuaccuacaugaaaugcaucuuuaacagugucacaagagugaucuauugaaaguaucagaaacacacagcugguggccauucccuaucuacugccauucucaccuccaugcuuuuauucuugcuguuuuucugauggugcuuuguuuauuuuauacaguaguuuuagguuuauagagaaaaaaaauuuauacacuuccucuagcaccuucaccccuaccccaguuucccuauuauuaauaucuugcauuguuugguacauuuguuagaauugaugaaccaauauuguugcauuauuauuaaccaaagccuguacauacauuagaauacacucuguguucuacauucuguagguuuugccaaugcauaaugucauguauccacuauuacugugucauaugaaauaguuucacuacccuaaaaucuccuauuuguggccgggcgcaguggcuuaugccuguaauccuagcacuuugggaggcugaggcaggcagaucagcugaagccaggaguuugagaccagccuggccaacauggugaaacccugucucuacuaaaaauacaaaaauuagccgggcaugguggcgggcgccuguaaucccagcuacuugggaggcugaggcaggagaauaguuugaacccaggaggcagagguugcguugagccgagauaaugccauugcacuccagccugggugacagagcgagauucugucucaaaaaaacaaacaaacaaacaaacaaacaaaaacagcuccuauuugucccuuucccucugcauguucuagacguaaccugacuuccacugauuguuuuauugucuuuaauaaaguuugcuuuuuccagagugucauguacaguaauuggaaucauacagccuuuccacuuagcaauaugcauugaagucugccaugucuuuuugugacuugguagcucauucuuuuuuuuuaauuacugaaugauaauccauuguacggauguaccacuauuugcuuauucauucaccuauugaaggacaucuugguugcuuccaauuuuuggcaguuuuaaacaaagcucugugaagguuauuguguccaccuacauuuucagcuuacuugaguaacugucaacaagugcaacugguagaucauauaguaagacuauguuucacuuuguaaaaaacugcaaacucuuccagcauggcugcaccauuuugcauucccaccagcagugagugagcacucugauguuccacauccuugcuaacacuuggagaugucgguguuuuggauuuuauuuaauuaauuuauuuauuuuaagacaggguuuuguccugucacugaggcuagagugugguggcaugaucacagcucacugcagcaaccucccagguucaagcuauccucccaccucagccucccaaguaacugggacaacaggcaugcaccaccacaccagcuaauuuuuguguuuuuuguagagacaggguuucaccauguuaccuaggauggucuugagcuccuaggcucaagggauccucccagcuuggucucccaaagugcugugauuauaggcgugagcuauggugcccagccaguguuuuggauuuuagccauucucauaguugaacagugguaucuccuuguuguuuaguuuguaauucccuaaugacaugauguugagcaucuuuccguauacuuauuugccacuguauaucuucuuuauugagauaucuagucacaucuuuugcccuguucuuaauuggguguuuucuuacuagguuuuaagaguucuuuguauaucuuagcuggaagugguuuaucagguaccaauuaugcagauauuuucuccuagucuguggcuugucuuuucauugucuuucucagagcacaacuuuuaaauauagacaauuagguccauaacccauucugaguuuguauuugaguucguguuuguguucuugaaacaccaugguuguuaacuuggauacauuacugucaucuaagccucagaccucacuuaaguuucaccagccguuucaauaacaucccacagaaccuaguucagaaucaccuguugcauuuaauugucauauaucuuuagucuggacauuuccuuugucuuuuuuggacuccguuaucuuaacgcuuuugaagauuucuggcaaguuauuuuguagcacgucccucaguguggguucaucagcuguuuucucaucaugagauucagguuacgcgucuuuggcccgugccucauagaagcagcacuacguucuucucgucaucucccauccaguggugcgcagguuugguuuuccuaucacugauguuccucauuuugaucaaggugcuguccaccagacuuacccucugucaaguuauuuuuuuccacuuuguauuaagaaguguuguauggagaaauacugagaaacuagguggauauccuguuucucaucacguacccaguucacuccuuuauuugugugaaggaauuaaugguuuccuauuugguggguuaucaucuguuacuauuuauuuugaugcacaaauuauuguggacuugaccagugggagccuuuucaagcugauuucuaugucuuuuuaaaauguccucaucauucuuugagcaguuucuagcuuucuagcacaauaaaauguuccaggcuuggccagacaugguggcucacgccuguaaucccagcacuuuggaaggacgagguggguggaucaccugaggucaggaguuugagaucagccuggccaacauggcaaaacccugucucuacuaaaaaaaaaaaauacaaaaaauuagccaggcaugguggcacaugccuguaaucccagcuacuugggaggcugaggcaggagaauugcuugaacccaggagguggagguugcagugagccaagaucacgccauugcacuccagccugggcaacacagugagacuccgucucaaaaaggaaaaaaaaggaaaauguuccaggcuuaucuuagacuuucuuugcuccagcccuggaaucagccauuuccccaaggagcccugguuucuuuuaguuggagaaggauauuuagauacuaagaccuggguccuaggugugcuuacugcuguuaggguguugcugcugccagacucucucaguggaccaagcgaggacauauauauguauagcugcauacauaacaugcacacauacauguaacacauuuccauuuguauuuauuuaucagucuaccauauguugaacacucugauuggccacaauaccuuuaauuccacccagcccacagaguucauucugcuucucucucuuuccauguuuauagcuacuucucugauaguaagaagccuggcuugcuuucacuuuuguaaauggccagauuugaccaagugcccuggauguaaccaaucuugcgucucugccacugccuccugucgucaccucacugaggcucugucagaccccucugagguuauuuacacccagacccugaaacaugaagcugcuaguuuaauaguaccugcugcaaauauugagauccaguguguucaugaggcguuugagucacaaagguuagguuuauauauaauuucauagaauugcuuaaagaaauuuuuuucuuacaggcuguuuacuaagacaaucagagagagaaagacuaagaaucacuuuggcuuuaacaguuaauuuguuauuuuguacuuaauuuauuguaaaauggaauauaacuucacauauauauuacauacggacaauuuaaagaugauuaauauugaacagagaucacucuuguacccauugcccagcuuaagaaauacagccucggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuaccugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaagaaauacagccucgucaauaccuuugaagccccuuuuugccacucucugguugcauuccucuccuuccuuccgagggauaagcacucuguggaguuuuauauuaauuauccuauaauagcuuuuuuauucaucuuucuuuuauagauugcugucguggcugugaugugcaaaccccacagauguccacacaucaguuuuacaggaaauauauguguguaaguauggugauuuuauuaaauuguauguauguuuuaauuaagcuaaauaugcccccucuagcccuuagucaguacauccugguaauguuuaaaacuucagcuuaauagauuuauagauuacuccuuucaaacaagcaaccauugguagauauuuuagugcuuuaaaauuggaauauauaaggccgggcaaaguggcuuacgccuauaaucccagcauuuugggaggcugaggcagguggaucaccugaggucaggaguuaagacgagccuggccagcacugugagacuccgucucuacuaaaaauacaaaaauuagccgagcgugguggcaugcgcuucuagucccagcuacuuaggaggcugaggcaggagaaucguuuaaaccugggagguggagguugcagugagccgagaucacgccacugcacuccagccugggcaacagagugagacuccauaucaaaauaaauaaauaaaauuagaacauaugaauauuuuaauuuauugcaauauacaauucuaaaaauguagguuauggaacucacaacaguagacauugggauaugcaacucaaaacagcacauucuguuaaacucauaaaugaaacaugggaauaugagcugccuaaauuccacgucagaaauuuaaaaugaauuuggaucagaaacauaucaaaauaaaaaauuauccuuauacguaaccuuuagauuucucaaacucaccuauuugaaagaauuagcggaagaguuugcaugauucuggguaggaagauaaaaggggggaaagauuuucuugagugugguucccaagagaacacugaguauugauucaaacuuaggaaaacuucauuucuguuauuugccccuaaaagcuuaaaccucugaaauaaacacaacugcaguuauuuugaaaauggguguaauaaugucccuuuacauauuuaucuuauuuacuucuugguagaaaauacauuauuuacagauacugcaaagguagauucuucuguuaggauuugaaaaggaagcucauuuguuaucaggauucuuuggagaugguagaugcuuggaacuagcugauugaacucaguuuugcaucugacauucuuguucuuuuguuguacuggcagauacugcccugguggaccugauucugauuuugaguauuccacccagucuuacacuggcuaugagguacaguaacuuugaggcuguccugaugaaauguugcaucaugcuuuaccuguaguaugguuuuaccaguacuggcuuucugacaauuuuuuguuuuuguuuuuguuuuuuucugauuuuaaaagcuguucauucaccaaauauuugccagugucuacuagugcccuauauuauucuagccacuagagaaauacuuacauaagcauaaauaauacuuacuucuuaucccaaaugcuguucuaagugcuuuacaacuguaaaccuuauugcaguguuuugaagauagacacuaucaugaucccaguuugccaaucaggaaacuagggcauagcaggcuuaaacagcuggcccaaagacacacuauuaguaagugacaaccagguuucgaagucugugcugcuuaccacuacauuguacugucacuuuagcaguggaaaauggacagggucccauugucuucuggaauuuacauuuuuuuuucuuuuuuuuuuuuuuuuuugagauggagucucacucuguuacccaggcuagagugcaguggcacgaucuccuucacugcaaccuccaccuccuggguucaagugauucuccugccucagccucccgaguagcugggacuacaggcaagcaccaccacgcccagcuaauuuuuguauuuuuaguagagacaagguuucaucauguuggccagccuggucucgaacugcugaccuuaagugauccgccugccuuggcuucccaaaauguugggauuacaggcguuagccacuguacccagccuggaauuuauauuuuaauaauggaagguagacaguaaagaaacaagaaaaaguaucaggcacucaaaaaaugcuaagcagagauguaaaaucaaguaaggugauggcagcugagaugguuuagcuguggucguuaggaagggauucugugaagugagauugaaguugagucugaaugacaagaaggaccuaguccuaagaauaugugaaaggggcauuccuagcagagaagucacuagaaugaggcccaaggaaggaaagacauggggguguugugcagugcagggggugagggaagcaugaggcugggagugcaaaugagcugggguuuguaagcaaagguaaggaguuuccauuuuagcguaggagucaugagaagcuauuaggauuuaaggcaggggaaugauacaauccaauuuagguuuuuugaaagaucauuuugauggccauguagagaaaggguuagaguggagaccagaaagaaggcagaaggccagugaggugcuuuugaaggagucacccuccucagaacaccucagaagccaggaaagcuugugacuuuuuucucauaucuguuuucauuuuuuuucuuguuuucuaggguucaaauuuuuuaaaauacaagaggaaugauuucgugaaaaggcuuccucucauuccuauccccuagccacucuuuuucacucuucccccuaccaguuaguguuguuuguuauuuccuccccauccuucagggauauuuuagggaacacagcauacacagguugccuaucccuuaugugaaaugccugggaccagaaguguuucggauuuuggauuuuucuggauuuuggaauauuugcauauacauagugagaaaucuugagaguggaacccgaaucugaacaugagauucauuuuggguuuauguacaccugauacaccuaggcugaauuaauuuuauacaauauuuuuaauaauuuugugcgugaaacaaaguuuguguuaaguacuauguguggaauuuuccaguuauggcaucauguuggcacucaaaaaauuaugagguuuggagcauuuuugauuuuuggauuagggaugcucaaccuggacguauucuuuauuugacugauuccauauaagguagcauaucagaguccucuuucacuuugccuuuuauuuuacaauaucuuagugaacauuuuaugucaguacauuguuucguggcuguagaguauuccacuguauggugguagccauuacaaacugugugguauuuuagaagcuuacuuaaaaguuacuuuauuauaugauucugguauauguaugcacaucuaugucugugagcagaacacuuuggugacccugggauuccagaaguguuuauacaaaagacagaugugauccaaggagacacccugcuguugagguguuuaugacagcgugaguggacaccugccagaugcgauucaggacauuauuuugaacccugacaagacugagaaaaauuaaugcggguacaagccacguuuucaguguucggaaccauggagaguuuuuuuuaaaauacaguccuuuugaaacuacuuuuuaguuuuaauucaaugugggcauaacaauauuuuucucuucuagccaaccuccaugagagcuauccgugccagauaugacccuuuccuacagacaagacaccgaauagaacagguacauuuuuaaaaaacauguuucuuaaaaauuagguguuuauacuuaguaagaagccauuguugcuugauucaaauugaaccugaaauaagaaugaaaaagguguuuuuccucuuuguaaguuuucaauauccauuugagggagggagaauuugccaugccuagcaaggucaaaaacacuacuuucuuuaaagacuguauuuauuguuuaaggguuuuauauucucuaaguuuuuuugaauuuguagaaagucauuuguaguaugaaauuuguggaauaaagauguaugaaaguucuuagacaauggguggguguguugacuuuuaauuuccaaaagucagauuaagaaguauuuugacuggccaugcgcaauggcucaugccuguaaucccaacccuuuggaaggcugugacagcaggucacuugagccuaagaguucgagaccagccugggcaacauagcaaaaccccaucuacaaaaaauacaaaaauuagcauggcauuguggugugcaccugaagucuuagcuacuuggaaggcugagguggaaggaucccuugagccuggaaggucaaggcugcagugagcugugaucauaccacugcacuucagccugggugacacagcaagaaccugucucaaaaagaaguauugugacagauuuguuggguggaaauaggaaauuuccuacaaaggaguacaaagaacuagucgggguauggcauuguucucuaucauggucaugguggugguuacauaacucuaaauaucuaucagcucucauccauuguacacuuaaaguuaguggauuuuaucguauuuaaauuauaccucaguaugguugacuaaaaacaaguacuauguacaugaccuugcaguguucaagaaaucugaacauuaauacagauuuccuuuauuuacaaguuuauuuuaaacuuguccaauuuaaaaaauguaaagcacuguccauaguuguaauaguaauguauaguaggcacauccaagucuaaaguagauaaugguacauaaccauaguggauaaguugucucuggguuuguuuauuggcuuauuggugaauacuguucaguuuuaauauccacuuugcugucacccaagcguaugaggaacaggauugucggugacaggagaggacuccaucugggggagcccacauuuuuccaaacaguggguucuaaacugaccuuugcuucaauuucuuuuugggcuaugauaguuaauuuauuuaaaauguaaaacuauugagcaugaaaugcuuauguuuaccaaaaaaaggagcauaguuuacaagauuuagaaaugaacauagagcagugauucuuuucuuaaaugcacuagaauuaccugaguaacuucuccaaaacgugucacaucuucaccucgggagguucugauuaagucugcuuuaagguccuagcaagauauuuuuaaaaacuaccaggguaauuuugaugaguaucucuuguaaagaaccauagauacagaaauagaguauucuuuuaguguugauauauauguacacacaugcauauauauaguuuuucuguauacguuuuuugccauuuucagaaauuaguguuaauuucaauaccuauuuuuaaaaauuagaaucuuggcuuauuguagucaacaaaaugaaagauuuguaucauucucuccacuaguagaggagaccuaauuuuauuauuauuauuuuuuuuuuuuuaaacagagugucacucuuguugcccaggcuggagugcaguggcacaaucuugggucacugcaaccuccgccuccugguucaagcgauucucuugccucagccuccagaguagcugggauuacggcaugucuggcuaauuuuuauauuuuuaguagagacgggguuucaccauguuggccaggcuggucucgaacuccugaccucaggugaucugccagccugguccuccuaagugcugggauuacaggcaucagccaccgcaccuggccugaauauuucauuuuuaaucagacuuucacuuuuuuuuagaaagcagacuugaagugccuccugugccuggaaucauccaucaauuuuagacugcugucuugauuuuucuuuccaaucuauucuuuuuuucuuccauuacaucaaauccuuauuauguuacauaaucauucauguaucauuguugaccauaaaugccaccuuuuuguccucuaggcuuaccaccaagucugacauaaaauacaugaucaauaaauacuuacuguuuugcaaauuguauuauauuugucuuuacugcuuucuaguuuauauucuucguguuuuuaaauuuccgcuuuguagguauucaagucaagccucuuauuuguuauuuuauauucucauucucccuccuuauuugaguuguacucacuuuuuucuuucagacuugggccuauuuuuuauccacagaauuagcuaaguguguuucauuacuucugauuuuuaaacuguacugaugaaaacacugcaaaauaagagauuugcaaugccuucuuagaguaguuccuuaugcuuauaucauucuaaugcugaugaauuugucuuucaguuaaaacaacuuggucauaguguggauaaaguggaguuuauugugauggguggaacguuuauggcccuuccagaagaauacagagauuauuuuauucgaaauuuacaugaugccuuaucaggacauacuuccaacaauauuuacgaggcagucaaguaagaaauucuuauuuuaucauagucuccagagugguugucaguuuaugcuccuagcaguagucuacgagaaugccuucugcccugcauccacauucuuacuucucauaaucuuucuuguuucaugggaaaggauuauuucagugaaaauaaugcuuucgcugaaauaaucuuuuccagugaaaauaauccuuucacugaaauaauccuuuuaaagaaaaaaugaauacaguuuguugacauaguaguauucucaaauagagagauucgccaaauaugguccaugaaugucuuuucagcccacccaagaagggggcugggaguauuuuagcugcuguaaaaucagcaaaacaagguacuguuauuuaaaaaccuaauuuauaguaaauauuucauaauuauuaaauaguaacuguuuaugauugggaucuuagucuguguugugcugcuguaacaaaauaucugagacuagguaauuuauaaugcacagaaauguauuggcucacagcuuuggagguugggaaguccaaugucaaggugcuggcaucuggcaagagccuucuuacuacgucaucacacggcaaaagacaagagaaacaaaaagcggaccaauucacccuuuuauaauggcauuaaucuuacccacaaggucagaucgccucucagaggucccaccuguuaauacuguuacaaugacaauuucaacaugaguuuuagaggggacaaacucaugucugucaaaucauguguuauucaaaccacaaguuaauuuagucauuuugaauucuaguugacaaaauuaugcaucauuuugacaccuuguuuuuagcaagaagaauacuacagguuaguauguaguucagugauuuaagaagugaaagucuuaaaauaguuuuuguucucaggaguugcaggaacaccuggauaguuacuauuuuccuuauuuaacaaauccuucuugagggcccacuagauacuaugugcuguuuuagauacuggaaaguggugauauuuaggcugagaccggaaguacaaggaggaguuaggccaacagcaagaaagauaaaauaaaggcucugaaaugggaagcagccugggguguucuagggacagagaggaagccagcaugguuagauccuguguuaauccauuugugucccuauaaaggaacaccuaagacuagguaaguuauaaagaaaagagguuuaauugguuccaguucuacaggcuucacaugaagcauagugcuggcauuugcuucuggugaggccucaggaagcuuccaaucaugguggaaggugaaggggagccaguacaucacaugacgggugcagggaggugccacacucuuuuaaacaacaaaucucacgugaaacaacugagcgagaacucacuuaucaccaaggagauggugguaagccauuuauuuaugaggaauccagccccaggacccaaacaccucccaccaggccacaccuccaauauuggggaucacauuucaacauaagauguggaggggacaaacacccaaaccaugucagaucccagugaacaagagaaagaacgucaugagacgggguugaaguguuagguaagggccaagauacaugcuuuuaaggaguugaaauuuuauuugaaaugcaguagggagcagaugaaggggaaguggcaaguucugguuaacagguagggucauuccggcuacugucuggcuaauggauuagaggaguaccagggugaaagugggaaaccagauaggaggccaucugauuacauccaucccugcucagaugggggcggcagcaguggugauggagaggagauugagauggggguaagagaaaagaagggaucaagccugacacuaagguuuuggcugucagaaaugguaggaagguaggguagggcuguauacugaggugggaaagauagcgggaagagcagagaaaaucucagagggagaaaaucaagaguucuguuuuggaugugugaagucugaagagccugugauacauucaaguggagaugucggugggcucugaaugcaagagaagucugagcugacgguacgaaacuggggauuaucagcucauagguaacauugacaaccauguaaguggaggagaccaccucaugggagaguuguggaucuccaagguauacuaagugaaaagcaauuuuuagagcaauucuuauaguacgaucccauuauuuguguguucaugcacauacacacacacauaucuguauauaaaugcauagaaaagguggcagaauaauggucaucauagaccuuagagcugaggaggaaaggacaugggaaauggcagcaaaggaggauauuuacauuugcucuguauacagugggccagguguugucauggguguuuaauauucacuuauuuaguacucauaguuagccuuugaguuaaguguucagauuaucucuguuuuaugggugaggaagcugaggcacagagagauaagcaauuugcccaaaguugcagaggugguuggugguagaaugggauauaaaucccagguagcuuugcuuucagagccuaacuuugcaagcugugcuaggugucagaaugugagugugucuguauguaugugcacaugugugugcacaucaucagagcuugaagaucuuggaaggaauauggccuguuuuuccuugcccuccuucccuaccacccucaggcuuuucucuggcuucucuuuuauauggggugaggguuucauauagcuaauuauaagguuguucaaauagugccaccucuuaagauuuuuuguguaggacaaaauuuuggauagaccuaagagugguuuuuauuacccuguaaguaaagcaguucuuggcacauaguaagcacaaguaaaugcgugaaugaauuuugaaugaacaguuagcuaaugaccuggguaggguugccucuuggaauugggggcagccacaucuuuuugugcccucgcuacucccccuacccccuuaacuuccuuuguucuccuuggguuuguaaaagugaaaagaagagaggagcuuuuucauaaaauuuaauaccaaggguagcucaaagagcccaucugaaagguuuggcagcugggagaguuuguguggacagcagcccacuucuguuugauugacucuagggaaugcaacaggugaauucuguguccgugaaucuggaccuguagcauugugauuucuucgucuuacaggggcuuuaguaauagaggagauggcgacugcauuguuacugcucguucaaaacugaucaagaggccgggcguaguggcucacgccuguaaucccagcccuuugggaggccaaggcgggcagauagcuugaggccaggaguuugagaccagccugaccaacauggugaaacuucuucucuacuaaaaauguaaaaauuagcugggcauggaggcuggugccucuagucccagcuacuugggaggccgaggcacagaaacacuugaacccaggaggcagagguugcagugagccaagauugcacuacugcacuccagccugggcgacagagugagacugugucucaaaaaacaaacaacaacaaaaaaaacugaucauuaauaugagucauacuuaguaaaugcugaagucuucaaacuuuagaggaguaaugauaucauccagcuaauuacucuuaauaauacugaaaaaucaaacuauaccuuagauaaaaugugauugaggaaaaacaaccuuuauuaguucaaagccaggcgacggggauggcagcagaagguucucucagaggguugcugaccacaguucauucagcucugaaaauucccuggcagggacaucuaugaagauaaguuuuucucugcaagcuuauauacuucuguacucauuucuuggaccuuaauauguaaggucuucuuaucuugaagaccuuacauauuaaguggaauugagcuguaaauaucuuagacuugccucucucccccauaaaaauuugccacuaagcuuuucaucuccuacaguuuggguccccugagguauaugaagcaggccaacuaagaucugcauagugaacuuuuaguauguaucuaguuugacauuuucaucaauugaaaguaaaaauuuuguuuuauucuugguguaacauuuuauuuuugcagaaauguucuagugcuaauggugcuugaauguaaguuuuccaucauuggguugaaaauaggguugucuaguccagcgagcucagugcagaucaugauguguuuguagaaaaagcccuguggaagagaaauccucuuucaguaauauucuaggcagugccaguguuguuuuguuucuguucuugaauuuaccucaagagggcaacgaacacuuuauuuucagauaaaaauuuauauaugauuugggucuucauugcaacacaucucaugaaugccucuugagaaguaaugaaaguacaaucugggagccauaaaaccauccauaaauuacacugaauucugccaacacacacuuuaaauguuuugcucuuuucucucagucucuauauuuuuaugagaucaucuggaaaaaaaaaagaccugauuuguggcguguuguugcuuuguuaagguaaaguuuuacuacaaaccccucauaauagaguuuguauuuguuuugagggaaacuuuguauuugaggaaauaauagucuaguuugugcuauagaacuagagacagaaaguauuuucaaguguuggcauaauugugaaauaaaaagcagcccagagaaguugugguuuugacauaauguggcccucggaaauguuuggauuugaccuugcccuucucucucauccugcccagagucuaugagugaaaacugguugguuugcacagcguagcccacugcucuuagauguaaggugaugaacuucauguuuauuuuacuuuuguuuuugcuugcugacuacauagauguaaacugacuuucauuagcuuagcaggguuuuuuaaagauuaauuuuaaauuagguuaaaaaugauguauugugaccuaugagucagcaagcagcauuuaagguuaauagucuguucacguuagggucaaguuuuacugcuguguuggcucaggugucccugcuauguuuucauauguugaaccugauuaaaguuuugcuucuuaaaagaauaggaguuaagguaaagaaaagccccagcaagcagagccugguuauuauuuauggcaagcuaguagcaagcaguguguuauauauauucucguggauggauaaauuggaaaguugagugaacagagaguucaaggacaaaacagguauggcuuuugugaaggcucauuaaaucaagcaaagugcuaaucacucaguacuaucagcuggacugagauucuucaguagucuccagagagcaacaauuacuggugacugucaucguguaacaaucaggcucuggagaugaaaaagaccgguagugggaucugagucacccauucacuagaaugcaaauguugccaaauaacuccaacaaccuuuuaaaauaguuuuauuccuuuuuaaucagcuuugcccagaagcaguuuuacauucaaucuuuaaugcuccuuggcuguuuucacaagaugcaauuuaaaggguaguuacccauuaaaaagugagugagucauacuuucucccuguggaauuuuaaauucauuucccguuccuuccucuucccccgccccgccccccacgccccauuaaugacuuuagauccuccaacuauguucuuaccugucugagaaaagcugaagugcuagguaaugcuagguaccaggcccagaagacaauuucguagacuugcacagcugcaacggaagcaaaaggaaccuacagagaccugagagugagugacuguggcccugcugcccugggcgucauuucuggcaggccucaggaccuucugcauuucugggcuuugacgcugacacugcuuaucucucacuuuuucuauugaccauuuuacuuucucuuuuggucacccagauuuccauacauggugaccaggauccuuaacauuggccagagaacauaggauacaaucuuagucacuuuaagagaguugauaugguuuuucuuucagcauuuuauuugaaacaaaaauuaaacaguuuuuagugagcauccacauacccaucaccuagauucuacgauacuugcuuuaucacauaucugucaguuccacuauccauucaucagugucucucgcgugugcuugcgcugucuuuuuugaugaauuucauaguaaguuguaugcuucaguacacuucucccgggauacuucaucaugcauaucacugacuaguguucacugucugcaguguuuuucuuuugaaguaaauuuacauacaguacaaaacaacuuguggcguuuuauauauauauauauauauauauauauauauauauauauauauauauauauauauaugaacacauauauuaaguauaccauuugauuauuuuugacaaaugcauauaccugugcuacaaaguccuauuaagauacagaaugucaccgucaucccagaaaguucccacaucccacuugccaguaaauccuccccugcgccucccagaggcagccguucuucugauuuuuuuccccaucacaaauuaguuuugucucuucuagaacuucauauaaauggaaccauauagcauacacuuguaggccucucucacugagcauaguauuuugagauuuauccauguguugggugauucauuaguuguuaccuauuuagugcugaguaguauuccauuguaugcagagaucacaguuuguuuaccauccuucuauugauagacgccugagcuguuuuguuuguggccauuaugaauaaaacuucagcguacguucuuguguaagucuuuuuguggcuauauguauuuauuucucuugggggaauaaauagacauagaauugcuauguaaguuuaguuuuacaagaaaccgccagucauuuucccaaaauggcucuacuauuuguacucccaccaauaauguaugaacauuugguuguaccacaucuucaccaacauaugguguagucacucuuuuuaauuuuagccauucuagugggcguauaaugguaucucgugguuuuaguuugcuuuugccugaugacuaaugauguugaacacuuuuuuaguaugugcuuaugcuauuugaguauauuuccuuugugaaguaucuauuaaaaucuuuugcccauuuuugauuaggugguuguauauccuagcugccaguccuuugucagcucuauauuuugcaaacaugaaaacccagucuguaguuuggcuguuuguuauguuaaugauaucguuuagccaaaguuuuuaauuuugauaaaguagaauuuagcaguuguuuucuuucaugguuauugcuuuucuguauugucucuaauaaaccauugcacguucccaaggcacaaagauauucuccuguguuuucuucuaauuacagguuugagcuuucacuuacagguuuauguuccaucuugaauuaauucuuauguguaauaugagguggggaucaagguuccuuuuuccccauauagacagcuaguugcuuuaacaucacuucuuuaaagauuuuccuucccuauucggauuauaucacaccuuuguuaaaaaucgaaggacucaguaaaugugggcugggcucuuuucuguuucaucgaucuguuuuucaauccuuaugccagugcuacacuguuuugauuacuguggcuuuuuaguguaucuugaagucaaguaauaugagucuucuaacuuuguaauuguuuuucaaaauugcuuuagaaauucuagguccuuugcauuucuauguaaaauuuagaaucagcuggccaaugcucuauuaaaaaguauaauggauuuagaauuguguuaaaacuauagaacaaauggaaagaauugacaauuuauugcuucuugcaauucaugaacauagucuaucuccuuguauacuuagguuuuuaaauucucuuagcaaucuucauuguugagauuguauaagccuuuuguaaacaaauucuuucaaaauauuuguauguguuuuggugcuacaguaaaugaaauguaaauuucauuuuuaaauuuuauuauuauuauuauuauuuuuuuuuuuuugaaucggagucuugcucugucgcccaggcuggaaugcagugacgugaucucagcucacugcaaccuguaccuucugggcucaagacauucuccugccucagccucccgaguagcugggauuacaggcauccaccaccaugccuggcuaauuuuuguauuuuuaguagagaugggguuucaccauguuggccaggcuggucucaaacucccggccucaggugauccgcccacuucggccucccaaagugcugggauuacaggugugagccaccacgcccggccauaaauuucauuuuuucaaauuuuugcugcuaauauauauacauacgguugauuuuuauauauuaauguuaugucauaagaccuuacuaaauucacuacuuaauucuaaaagcuauuuuuguaaauccuuuaauauuuacuuccuaaacaaucaugucaucugcaaguacagugcauuuuacuuuucccuuuuggauuuguaugcuuuucuuucucuugccuuacugcacugccuaggaccuuuucuuacaguguuaaacagaagugguaagagugggcgucucugucuuguucccagugauacagggaaaacauuuuuauuucaguauuaaguccaguguugccuguggguuuuuuauaguuacauguauuagauugaauaaguuuauugaaaggguuuaucauuaacucauuugucugaugcuuucucugcaucuauuuaaauggucauaugauuuuccuccuuuauuugguaauauggaucauuuugauuuuuuuuuaacauuaaaccucacaugccuaggauaaacccuauuauaucaucaucuuuacauauuguuggauucaacuugcuaauacuuuguagaggauuuuugugucuguguucauacagggugguggucuguaauuuucuuuuuuauaauuuuguugucagguauucguuguugguauuaguguaacgcaggcuucacaaaacaaguaaggauguguuguucccuccccuguuuucugaaaguguucauguaacaugaauaugauuucuuccauaaacguuugcuagaacucaccagugaaacuaucuagggcuggaauuuucuuuaugggaggguuuuagaucauaauucaguucauuuaauagauauagagcuauucauauuuucuguuucaucuguguccauuuuaaaaaguuacguuuuucaaggaauuugucuguuucauucauuuugucaaacauuuugguauuauguugccuuauuaggcuuuuaacaucuguggaaucuuagugaucaccccuguuucaacccugauacucaucaucuguguuuucucuuuuuuucuuguuuacccgaguuagggguuuaucaauuuuguuguucuuuucaaagaaguagcuuuugguuuuauuuccucuacucuguagacuucugcuuuuauuuuuauucuacuuucuuuccguuuaauugcucuucuuuuucuagugauuuaauaagguauaaaagcuuggccaggcgcaauggcucacgccuguaaucccagcacuuugggaggugaggugggcggaucaccugaggucaggaguucgagaccagccuggccaacauggcaaaaccccgucucuacuaaaaauacaaaaguuagccaugugugguggcacgcaccuguaaucccagcuacuggggaagcugaggcaggagaaucgcuugaaccugggaggcagagguugcagugagccaagaucacgccacugcccuccaggcuggauaacagagugagacuccuucucaaaaaaagagaaaaaaagcuuggccaucauuuuagacauuuuccucaaagcacugcuuuagcugaaucccacacauuuugauaugguguauuuuaauuauuauucaauucaaaauauuuuuucauacccuuuauauauauguauuugauccauggaauguauaggaaugggguguuuaauuuccaaauuuccagacaaugagguuuuucuugauaucuuauuaauuucuaauuuauuuucauuuuggccagagaaccuacucuguauaauuuugguguuuuaaaauuuauugagacuuguuuuguggcccagcauauguggucucucuuggugaacaugccauguguguuuguaaagaauguguguucucaguugcugggugucauguucuauaaauaucaguuaaaccaagaugguugguaguaguguucagguaaauuuuguuuuuuauucuuuuguaguucuaucaauugcuaagagauugaaaucuccaaguaugauugaggaacucuguacaucucucuucauuuauauugauuuuuacugaauguauuuuguaaaucuguuauuagguacauacacaucuaugauugcuguguuuuccugauguaugagcuuuucaccauugugaaauuaccucuuuaucaucaugagauguccuuccgcaucccuggucuugcaguuuacuugguguuaauuuagccgucaugugcuuacuguuugcccuguguauuauccuuuuccauacauuugcuuuccacccauguuucuuuaucuugaaaaugcauuucuuuagacagaagucuacaguaauuggcucuuuuuuuuuuuauccauuuugcucgugugugccuuuuaauuggaguguuuagucuguuaacauuugauguaauuauugauacaucaguuuaagcugaugguuugauuuauaucugccaguuuaaucaucuccucacuuugguuuucaguagccaagaauaauaguuguaaugaauacuauuauggucuaauucuuuauaauguauuuuuucuauauccuuuaauagggaauaucuucuuaagagaaagguagaggacuccuuauaucuaguacaaugccuuaagcauagaauucugguacuuaauaaaugcuaagugaaugcgguggaaagaacugucccuuaagaaucaggagacauagucuccagacuuauuuauauuauuauuuugcauuauuaccugguuuaauccacuuauuuugugugugugauuuaguuuccucaucuauaaaaaugaggagguuuaggacuauauuaucucuaaaauuauaccuuucugucaucuaugauuugaagcuuucuaaugaagagaauuuuuaucuaaaagauauguucacaaguuauucuucauuuagcaaccacuuucugacaaucauuuucuauaauguuuuuauguauauaacccuuaaauuucaauguggauauaauauuaaaagaaugcaauaucugugauucuuuuuuucuuuucuauuaauaauguguugcugcugguucuuuagcuacacgaggggacuacaaaaugauaguuuuugucagccaugaaaaaaaucaaaccucaaacaaaauguuauaagcuguuuuuauauaucuuaagcccugccagcuaaugugauagggcacaagggucuuugauuagucuguaagcugcagugccaccagguugguuuuucauagguaguacucauuuuuaaaucaaaauucugucguuacuucauuuuguguugggcgugguuaauuuauagaaccucaugauauaaccaccaauaucgaggaagcagacuugacuaccaucucaaaaaaagauuggggguaauaguuauuuuuaaauccucaagcacaucaaacauccaacucaguuaagucuagagcaucacuagcagagcauugggcagaacuucaaauuuuauugagguauuuucaagauaggguaauaguuaagaagaggaauuuguucauggugcugcugccaaggaguuacaccaauaacucaagguguuaucaacaauucaaacaaaucuggcuguucaaagaagugaguaaacuccacugacuuguuuugggaccguagauggagaagagauuguauguugugacuaacgaaaaugaauauuucaucucuguaccauuuuuuacugugcaauuugguuugaacagguugaguaugagguugcagcauguccacacagggaauguucuguaagccauucagcaacuugagccuugaguucuugugagaguuuaagcaggacuagacucaggcacauccaguugcaguaaggacagagguuuugaaagaggagcugccacgaauuauuuguaaugagaggugcccaccucuuugauaccacagcuucuuggagugaaacaaaagauaguuuccagaagauaauaaagagacuuuaaaaucagugugcuaucuuccuuccaucagugucccccugguugggcccuuagugcaaggagacaguaauaauagauagugcuucugucaaaaggucgcuuucuucuuuccagaaauagaaacaugcuucccaagaaauaaucuaaaucuauuuauauuucugccacuucuagcuuuuuguucuguagucauuucucuuuuuuuuuuuuuuuuuuuuuuucuguaugucuuauccccccagcuagauuguuaagcaugucugggacaggaacuauuauauuuuuacuuucugaagaauaccuggccuacugcuaggcaccuucuaagguuaacuuuuugcaagaggaaagauaagcgguagauguaucuggaggcugcuguuggagugaagagagaccuccuauguucccaguuaugccuaauucauuuauuccuucuucaaauuuguaauuuuuuuuuaaucaacggagaauuuuuaguguugaagccuuuuagccucuagacauguuugagccugcuggcuuucaggggcuuccuguccagauggagagacagacauaaccacaaauaacaaggcugacuacuuguagugugggcagggugcuugggaaugggagcacugagaucucacugaggguggagggguucugggaagaugucauuaggggagaaauguauuggagcucuguuuugaaggcugguagccuuugguuuuuguuugcuuuuaaauuccuggguuauugucccauuucucuucaccccugcuccacaauuuuuaaaaauucugucaacguaagguuuugacuuaagcuaugcuucacagagaacauagcaucuuuuauagcuggugccacuccuauggcauacagaaaagcguaggauucaacauaaccccacaguguugagcuguacaggcuuaaaaugaaccuguaauaccacaaaaagagcaguggaauuggaaucagaggaucccuuuugagucuuggccuugucucucgagaaguugacagaguugcugcaugccgaagaacuuguagcccccaaagagguaugggaguugaacuagguacugaaggagagccaugcuuuuggauggcugucuaaguggcacauacuguuggauagcuaccuaaaugauacagggggaucauauuaauaccaggccauaaagugucagcacagauugguugaaagccuguaugcgcauauuugcauauuaaagaacaguuauguugauauauuuacaucucuguuaaaugaagaaucagauuuggugagauguaggauuagauauaguaucaaaaaauuuucaugagaauacaguaagccuaugggaaaaauucauuguuuugucauucaaauuugauacaaauuucuguuuaauugcuuuucagaugcaaauacaauucuggaaagaggaaauauagugaaagccuuuuuauaaauauaaaauauuuuuucaaaacuugaguuguuuuuuucuuccaccauuucuguugcugcaaaagguaaugacauuucccgccugaggaaaaacauuuuugaaauggaguuaaauuauuauuugagaauaagguuuccuucuguggccuguacuauauucugaugacuuauaaagagaccuugugcagcaguguccucuguauguccuugguggggccuuugacacucugcaauaggaagacuagcuaauaaauuuucucuuuccucuacacaaauucccauuugugcaauugccuccccucuaguuuuucccagugauguaagcuacuauuaugccaccacgcuugcuaacuuaaugguaucacuuuuaagaaauacugcagguuuuuuaaaaauaccaguuggaaugccucauucuaggauauucucauuuacuuuuaaaaacgucauuuagagcuuuuugcuuucugggguuuuuugguacuuuuuuuucaaccuuuguauggugugcuuucuccauaauauaugaauauuuauuuuuauuugaaaaauguuuucccucaaacccaauaauugaugcuggaggaagguguguuacgucucuccuguggcaucauguacuguuacugcgugccuuaguacccaccuguuuaagaggcacaggaccugaugauucuauuguuucagagaagccaaauuaguuuggauccugucuuaggcaagauuugauaagaucugagcccuuuuucugucucauaguucaucuuuuagugacuuugaacuaguuguuuaccuuuaguccuguugccugugguaauccuaccuaaaaccucgcggaauacagaaauaaacaaugcaaaagaguucaaauguccagaaugaaagauuugagaauuuguucucuagauuggugauucuuagcuuucuuaauuauuauuggcaauaaauaaguccguuuuuauugacaauuaagagugaaagagugaaccucauggaauuaguuacaaaaauuacagaaauuuuaugauuuuuacuuuucaguaaagaacaaugaacuucuucagaaagaaggaaaauaaaugggaaauuuuuuuuaaaggcuucucucauccuccccccaaaauugagaacauuguagaagggugcacuaagaagaaugaugggguucuaagaauugagagauguuggccgggcgcaguggcucaugcccguaaucccagcacuuuggggggccgaagcagguggaucauuugaggucaggaguucgagaccagccuggccaacaaagugaaaccccgucucuacuaaaaauacaaaaaaauuagcugggugugguggcacgcaccuguaauccuagcuacucgggaggcugaagcacaagaaaugcuugaacccaggagguagagguugcagugagccaagaucgcgccacuguacuacagccugggcaacacagugaaacuccgaaucaaaaaaaaaauugagagauguugaaaagcagagaagucugggguggguccacgcugaguugucuaagcagugugguaacuggaauacagagcaaggacuuugaagucagguggacccaacuucagauccugacuccgauuuuauuagcucugugcccuugaacaugcuguuuacucccuuucagcuucaguuucaucacuugugaaauggagguaauaggacacacuucauagagcuagugggaggauucaguacuagaguguguggcacagagcuuggcccacaacagccucuguaaaugugagcuccugucgccucacuucacuagcccugcuagcaagagacuuacuucucugccucuuuggccagcauuaaggccacuaacugagacagcaugaaucuaaaguggugcucgcuacucugauacaugauuuuaguaaaagacaaaaaugauugguaauuuuguaaaucauugcuaagauuaauagacuaggugaaaaggcuuuuguguauauagaagacauuucaucuaaaauauuccuauaaucauuacauaugcccuccccccuuuuuuuucuuucauuuaaaauauagagugggaaauaaauaauguagaugguuuucacuuaugugaaaaaugguugcuaggaauugaaaaauagguuuucacaguugaaaucacugcuuucaaggagauuaugguugcagcuuacugcaggagaauaauaaugauaaugaugauaauaacauuacuaugcuagcucagucacgucaaucuuaugagguguagauaguguauuauccucauuuugcaguuaaaggaaccgaagcacagagguuaauagcauccccaugugcauaguuaggaaguagcagagccaggauuugaacucaggcagccuggcuccagagccuacacucuuuaccacuaucucauacuaggaggacagagagaaggcaguuuuuugagacagaguaaugucuuaaaaccugcaacagguuaauuauuuuagauuugcucuacagguauucugagagaagccucacaaaguguauuggaauuacuauugaaaccagaccagauuacugcaugaagcgacauuuaagugacauguugaccuauggcugcacaaggcuggagauuggggugcagaguguuuaugaagauguggcuagagacaccaacagguaagaugguggcaggugaucuugcacaagucuuccuccaaguucaccauuuucucuacauucauacccagccuuucuuccuucugaccacucuuagggaaagaaguauggguauuccuccuuuucagaguucuuucuucugucuguguucuuaauuccauccccucuuucccucauuuucagucuuucucuagugggucuuuuccagcagccuguaaacacacucaucucucucccucuucuuguccuaagcagccuuguccauauagagagcaggggagaggacucgggguuaguaguuuaaagcaggagagaaggccaagaacaaagaaaagaguuugaauaaaaaggacaucaggguaauguuuaagagauucauuuuuguggagcaaauaccaacuagcaaaaaguuuggugaugccaugguuguaaacuuugagaaauuugggagugcaagaaaagaaggaaguaagaguuguuagagcuuuauuauguucccucuagaaguauaucuuuuaguugaaaagaaaauacccgcgaaagguuaacuguauaaggaacuucacaguuaauugcuaaauuaguggaguaggggagacaauugagaguuuauuaggcagcugagaugauugaccgagaauucuaacggugggcuuuggaggaaggauguguugaguuggauguuaaaggccccuuuauucuguaggauuuggguaggugugauugguguugugccaggagaaggaagcaaaggggaacuagggaaacaagcacugaucagcaucuuagaaacaaccaagaggaaugccaggccgaggaggauggaauuuucccuuaaggaauagagaucuguugaauauuuuuuagcauggggaagaaucucauggauaucauguuuaauuaagaaagaguaaccgaauaggaugcucuuaugugggaaaaggcuucaaccagggaaacuguggagugcuguagccuucaagggcugugcuagagagacaguugugcagauggaggggaagggggagcuuucugaagaauacgacaucugaguugggacuucauggaagagucugaguuggucaggugcagaagaggaagauugaggcagaaagaaaauaaugaacuccuagagaugggagugccauagcacauuugaggaauuuggaguggcuuaguuugauuagaaugugaaauaggagagugauaagaggugaggcugaaaagcaggcagaggggcugauuauuaggggccugaggagucagcccagggaggcuggacaugaaucuaauggagcaagccaccagcacgcauaaagcuacaaugugauggagcauaucugcagcuuagaaagaucgcuuacaguguaaggggcagucagagaagagcaaguuggaagggagaucagguacgaggcuguuacagaaauuaagcaggaaauacugauguccuggaaagaagugaaugguggugauuggugacugauuggaagugaggauaagagagaaugggaagucaaggaggcuuggagagaauguggguuucauuuggcuacacuaaguuucagauaccuguagaauagccaagugaagguuugcuuuagagcagggcuaggcaauagacaguucagcagugaucaaaauguucugugccugcaacugaguuuuccauuuuaauucuucuaaauauaaauuuuaauaaccacaugugccuaguggcugucauuuuaaauagugcugcuuuaaaguauugguuauuuggguuuggaauucaugagagaggccuggccuuguccuaggaauugggaagucaucagcaaaaagacauuagaaauugaagccauggaaaugguugggagcauucugagagagugagauggagucugugguuucuaggauccuucugccgugaaugggaacaccuucguggcagaaggauagccacaagacuucaguuuaguugcccaaaacuauuguuaggacuuguuuccugcuggauuggcucuagaaugccaaguuaagaugauuuauccacgugaccccaaaugacucugccuucucacuaagucauucucucuuucuacuguuauuuaaggauccuccaaacccaccagugaaaucuauuuuguaucauagguuucacucuuccucccugucuacaaauaauuucacaagaucuuuaaaggaaagaacauagcagcuugcugcuucugcaugguuuugagcucauuuuaauuuuuaauacagguauuuacauucauaagcuuauuuugacuggugaugcuaaaccaaauaauuuuaauacacauuaacuuuugccaucccaaugcuuuacuuucaagacuuuaaguagauguguaagagaauuucugagaaauaucucagaaauaaaguuauuuacuuccaggccuccugagagguggggauguaaaaaaugacuuucugagaugucuuuucccccagccauaugauuuugguuauggaacuucuguuaccugucucagagauuguuuuccccuuguuccuuguguuaacuuugucacccauuuauuuguguaacagauguuacacaaauagguagugauuuucacagguagugauuuucuuuccuuaggggccacacugugaaggcagugugugagucauuucaccuggccaaagauuccgguuuuaaagugguggcccauaugaugccugaccugccaaacgugggacuagaaagagacauugaacaguucacaguaagugugacuucagccaggcgcauucagaauggcucugcauguuucuuaucccaucuggucuuguugcuuguucacuguugauguuuuccaguguuaaagaaaugcauccuuauuauagaauauuagaaacacaguaggguaagagacaucacccauagccccaucagacaaaacucuuaacauuuuaaugaauucuuuccaagauuuuucuaugcauagguuuuuuggggggugagguuguuuaugcaaauauaacacagacauacaaauauauaugacauaggaaauuauuguaauaguuuuuucacuuaacauuuuaacaagcauuuauccauguuguagccuggucucuguuaacauguuaacauauuuaaaugucuuuuuaauuuaauaugucauaccuugcuuaaacccuugcaaguuuuucagaauuuaagauauacugguuuuuuaauauuauuuaaaaaacacugcagguaaaugacuuuauguguauaauuuuuuuuaguauuuagguuuaucuguuuaugauaaauuccauggaguagaauuaucagguaaagguagaaacauuuuaagaaucucacuguauuaauaaguugcuuugcagagaguuauaacaauuuauacucauuucagcagaguuuuucuucccaaauaauucucuccuguuuauuuucuauauaugcuuauagaugcauaugcacauauguacauauauuuuacuguuugcuaguuugaucaauaaaagugccauuuuaacuugcauuuugaaauuguaauaauacauuuuucaaguuuguauuuacuaauuacauuucuuucaucuuuuuggaauuguguguuuuuauccucugacucauuauucuauugagauaagaauauuuuuaguauuaguuuauaugaauuuuuuagguaaggagauuauggacucauugguuuuuauauuuguuuuaaauauuuuccuuaaccuauuguugaccuuuuacuugugcuuccauuaagucgaucuuuuuuuuccuuuuuuuuuuuuuucuucaaaugccucuaagcuuagaacugccuuucuguucuuugaauuuuaacucuggguuguuuuauuguuguuauuuuaacucucacaguuucuugauccauguuaacuuuguugugggaaaugagauuggucaggccuuuuguuuuucuucagauucuccgauagggcaaguguguuuuaagaugaugacgauauuuaucaaguuauuucaucuauaaaaguacuuuuaauuugcucuguuuagaaaaaugcaguuuaccaugucuuauuugugaaguuaauaauucuuuccucucaagaaguuuacuuuuauuauuuuuuaagcuggugaacugcaccugaggaccuguuuaugagauaacauuaauucacagauaucccucuucguaauucccccacaauggauauguaauagacugugagucuaguauccuccccucaguaacuaauagccaggugcucagacaccaggccaaaaaggcaccugaaacacacuuuuuauuaucaugauuauuauuauuauuauuauacuuuaaguucuaggguaugugugcacaacgugcagguuuguuacauagguauacaugugccacguugguuggcugcacccaugaacuugucauuuacauuagguauuucuccuaaugcugucccuccgccugccccccaccccacgacaggccccgggguaugauguuccccacccugugucccagugugaaacacacuguucuuuagcacagcuccuagggagaccaguaggauagccagaacucauaaaguuuaagugcuccugaaaaauauaguauguuucauacuguaggaagccauagcaaauagcugagucucaguacauauuuuccuuggugucuucaacauaaggaauaguucaguaauaacauugcaaggacaaccuuucuuguaaacagauuuauuugcuuguuuguagucuuugcagggaaacucacagggaauaugaguggaucauauuucuuuucuaacugcauccuaguaaagaguaacagaagggagcuaaaaugaaaaaucugaguucuuucuagagaagaauucucuacaaauuaaauuguuuuaaaauaaauaaguuuuagaaauugauaagaggcaaacagcucaguaggaaaaugggcaaaaaacuugaacaagcauuucacaaaagagaauauucaaauagccaauaaaccuaucaaaaaguucucaaaguaauuaaucuucaaaaaagcgaaauuuaaaacuacauuuggucucaguuuucuacagcaccuuggucuuguauuguggauauaauuuaucuuuucuuaucucucugaagaaauuuauuacagauuuuuuuuauacauuuuauuuuucuguaugcauugccucuguuuccuccaagugccuuuuguuuucuuuuuguuuugguuggccccuuaauguacuuggcuuuccccaaguuuaugaugaucuucaaccaguuucuuaugccuuuuuuuuuuuuuccuugagacggagucucgcacugucauucaggcuggagugcaauggcacgaucuuggcucacugcaaccucugccucccggguucaagcaauucuccugccucagccuucugaguagcugggauuacaggugcccaccaccacaccuggcuaauuuuuuguauuuuuaguagagacgggguuucaccauguugaccaggcuggucucgaacuucugaccucgugauccgcccgccucugccucccaaagugcugggauuacaggcgugagccacugcgccuggccuaaagcgauuccuuaugcuuuuaagaguagggguuugaaaagccggauggcaaggccugugugccuagcuugcaggcgugcuucacugaagaauguucuuuuagcaauaagcgcuucuuucuuuaugggauuccuaaaugucaguaucgugaacucuuacguagagccauuugauucauccagagaugaacucuccaacuuccugcuuugggcugaguggccugaguauaucucaggaaguugguugcugacauccagagaguagggcggagaguccaccagucuaugugcuggcuuuucccuguuuucagccuuggucuucaucuagaccuuccuuuguaccuggaaucucagagcgcagaggcuuuccaguuucuccagggacuaaauguucucaucugccuguucgggaaaggcuaaggguuaacggauaauucccucuauguacacacuugauccaguaccccuguuuuuauuuccaugucucuccuccauccugcccaguucuugguaccucugauccgugagccuuucuggaacucugcagugugauugagcaggccuuucguuacugucuccuuuugcuauuuucuuuacuugcaaagucauucacaagccuuccuaguuucugucuuugaagaauuuguugccaucuugggucucauucuugccuccuuucuuguucucuuuguucuucuggguuuauacuuuuuaaaaaauucuuuccuguuccuuuuuuuuuuuuuuuucuugagauggagucucgcucugucacccaggcuggagugcaguggcacgaucuuggcucacugcaaccuccgccuccuggguucaagcaauucucgugccucagccuccucaauagcugggauuacagacgcgcaccaccacguccagcuaauuuuuguauuuuuaguagagaugggguuucaccauguuagccaggcuggucuugaacuccugaccucaggugauccaccugccuuggccucccaacgugcugggauuacaggugugagccacugcgccuggccccuguuacuuuagugugguuuuggagggaaagaaaauaaacacuuuuuuaaauucucuaguguaacugaaaauugagaaccaaucaauuuucauucuuuccaaaggaauguaucagccuguaugucuccgaaacuuauuauacaagcaccagaaauacuuuucuaaaucccauguucaaauguagauucagacugggugaacaauggcuuccauacgugcucuuugugggauggcugcagaauauuuauuaaagaccugaugauucuuuaaaauauaaauguuacaggaaaaucacacaauuacagaagaagaucucugaaacuaaauaguacauaaagaauacagcauuuaagaacgugacagaugucaaugagagauggaaaagucuauuguuauauuucuuuguaaagcaaguuaaacaaugaagagcuuuggaagacuaauguggcaaagauaaaaaguauuuuuccaguuuacaagauagagcccugccagcugaguagauacucccaccaaggugggagugagaggggacugugaguccacuuucauuucuccaaaauauauuaugcaaaacaagauuagagcaaauuaucagugcaaagucauggaaaggagaaugccuggugucucauugcuacaucccaaaauaaagaaagaaagcagccagcuggggugauguaguauaagaaaugacuugccaaaaguaguugaguuagaucuauugcucaguguccagauaacaaauggacaagguguagcccaggauaggaauggugccaguugguuuagggacagaguagucauauccagggaucagcaaacuuuuccucuaaagggcccuauaguaaacauuuuaaauuuuguaagcuagaugaucucugucacaacuuuugaaauguaagcaauuaaguauauuccauuauuaaagaaagguauacucuagaggugaaggcagacauugaauagauugucaugugaugauaagaaagagguaauacuggguucagugggauuuuuuuuaagugggacagcuaguauuugaaagucagaggggccucucugaagaaguggcauucaaacugaaaccugaagauuagcuagauaaagaaaaauugaugaacuuuccaggcaaaggaaauugccuuugcaggaguggaaaggccagauggugagggguggcaugagaugagauugugcaggagacaagcuggaauggugagggccuagugcaguccagcacacacuugcuuugccccagugagacuacagaaacaaggaguuucuguucugucuguacgcccuaccuggucagaagcaaaggcugccccagggccuacugggugugccagagaagcugucagggguugagauuucacccucggugaucucugcauaacuaauggagaagucauuuucuguucucuauucacaggaguuuuuugagaacccugcuuuucgucccgaugggcugaaacucuauccuacccuggugauucgugggaccgggcuuuaugagcuuuggaaaucaggaagauauaagaguuacucuccuagugaccugguugaauugguggcucggauccuagcccucgugccuccauggacucgaguguaccgaguacagagguaguguguuaucuuuuauuccuaaaauaguuggugacuagucuguuuacuauuucucauggaaauagucugauuucauauugaggguuuuggauuuuucuuaauggaaauaagauaacuggaaugcuaucuguaaauagggagggauggaaaucauagcaugucuaagccacuuugccaauaacguauuuauuuaucuacccauucauucaugagccuggagacagagccaugacggucaauaggcauggugcuugcuuccgagcagcuuauggucuaguucaguguuuccucuuccaggucugcuuccaucuagaugcaguaauggguaugagcauaagaaguguggccgugugugcaaucucuguucuagagccucugaaagaaaaaguagcaacaaucacucuuuacagauauuaauguaaauguggaggaaaggugacauauuucugauggcuugaagaaaacaaaauaaucugaacugcuuucuuccuagaaaagagaaaguaagaucucauuuacaaucaggaaccuuaucuaccuauuuauacuuacauacauacauacauauauacuggaaacauaacaucacagaaaaauuuuagaagccauaaaguuacccguauaccuacaauccuaacaaagccaauucccacacacacauucccaccacccugccaaaaacuacccagguuccaauauuacaaaugcaaggccagaaggagacugcaaaugcauuacaaucagcugcuagagcaggacuccacugagcacagaaacugugugacugaucauguaaagcaaugaacacugaaaacaagccgaauuaacuacuuaaggagaauuaugaaggauauaaaguaacugacuugcuugaaggucaaaggacauuuacaugauacuucugcugcauacugauuucucaguuuuaaaaucauuggccaaacugcaggaucugaauugccuauauggucucuauuuuuaaaaauacaccuaagaauacuaaggagauuuuaauagaaaaaucaacuguugaaauugcuuguguggcccuuccccuuguuguucaacccuucugaagcaauucaguccaaaggacauuagguggugcggagcaguguagguauccacaugcaggaggcagggagccacaggguccagagcagggugagaaggucacucauucacaugcaggaggcagaggcguggugcaggcugaugaagucagaauguggcgaaaagggcauucauucccaccaagggcagaucugguacaggaugucagagcuguacguccucuagggguggguuggggguauaugcagaagaggagacagcaagaaaagaccaguuacuuacagggaguugaucuaaucagcagauauauuaaggauacugggugcuagguuuuuuuuguuaucuuagaagucaauuacaaaaguugaaaaaggagaaaauuagugugagcacugugguguuuuggaacaggagauaguggugugaacucaugguuuccaacauauagguacauguagaaauaaguguaaauguaaugaauaacaacacagguggcccuucauaucuucggauucugcauucuacaaauucaaccaacugcagauggaaaauauucagaaaaaacagugggugguuauugcaucuguacugaacauguauagauuuuuuuuucuugucauuacucccuaaacaauacaguauaacaacuaguuauaguacuuacaguguauuagauaucaauaaauaaucuagaggccaggcgugguggcucacgccugcaaucccagcauuuugggaggccgaagugggcggauuaccugaggucaggaguucgagaccagccuggccaacauggugaaacccugucucuacuaaaaauacaaaaaauggccagacgugguggcaggugccuguaaucccagcuacucaggaggcugaggcaggagaaucacuugaaccugggaggcggagguugcagugagcagagaucaugccauugcauuccaaccugggugacaaaagugaaacuccaucucaaaaaaaaguaaucuagaggugauuuaaaguauacaggaggaugugcauagguuauaugcaaauacuacaccauuuuauaugagggacuugagcauccauggauuuuggugucuuugggaguccuagaaccaauccccuuuggauaccgagggacaacuguacauauuuuguguguguguguguguguguguguguguguguguguguguuuuauagcaaucaguguacuuaguuuccagugagcacagcugguuucuagaucuuggucucuaaaugcucuccauuacuaaaaggaaccucuugugccagaaaguaaggaaguauucaaagaagaaaagggaaucuggcuuaaagggcucccauuggccaaaucugggacaauuugagcaucaaaauaaauauugauauuaacagauuauaaccagcugaauaaaauaggaauccacuaguuuauaccaauauuccuaauuaauaaauuguaagugugauucagaaacauaauauuugcagucagucuucaucauucucagauuccuuauuugcaaauuuuccuacucacuaaaauucguuugugacucaaauccaauacuggcauuuucacagucauucuugggcaugcuuagcagugaaaaauuugaguugcccagcauugucaccagcugaggucaaacagguggugcucugccuucucauuucagcgcucacacugggagccaauguccuucuugcagucuguuucaugccauguuuuucaaaguuuugugcaguuuuuugaggauucgccauuuaguauggcccccaagcauaguacugaagugcuggcuauugcuccugagugcaggaaggcugugacgugccuucuggagagaauacauguuauguaagcuuuguucaggcaugagugaugugccauuggccaugaguucaguguucaugaaucaacaauauauaucagauaagguguguuuaaacagaaacacacauaaaacaagguuauguauuaaacagucgacaaaaauauugugaccagggccucacgggaaccuaaccuuguauuuucccuaagagcaauuacucaguauacaguguaaguguguuggugacacucgguguagaauguuaacuacuuauugccugcuaacagaacuagaaccaacuaccgacuguacauaguugcagaguaucucccccaccauacuuagcaauugcagagugaaagagaauaaccuaauagugggaaaaccuggcagcugaucaaagugaacauuaucaguaauaggacaaaucacaauucuaggcugccugauagaggguaugagaacguagcaucacuucucuguuacucagccagaacuucacgaucugaauccaauagucaggagacguuagacaaaacaaaauugagaaacauucuaaaacauaacuggcccguaaucuucaaaaguaucaggaugaagaaaagaguucuaacuugaaggagacuacacagacaugacaauuaaauacaauguucugaacuggguccuuuggcuguaaaggacuuuaaugggacacuggugaaacucaaauggggucuaggauuagacacuagugaagcauccauguuaacuuccucauuuugaugguucuuuugugguuauguaagagaauauccucguaggaaauauuuaaaguauucucagggcguugggacaucuuauuugcaaauuaacuuucaaauaguucaggaaaauaauuauuuguacugcacuugggacuuuuuauguaacuuugugauuguuucaaaaucuaaacuaauacacuagacaacaaagcugcaguaaauagcauucacagagacaaaagaaaaagacgauuugcauguauaacugacucaagcaaccagaaagcaguaaagaugcagcuucucagccgcagagcauggcaacagauagcacaaaauaguuagcaauuucacauccagaaauaccgaaaguaacaaggcauggaucccacaggcaaucagaugaagaauuugcauuuucucccuucguuuucggcuuaaauuucuuucugcuguaaccagugagucaaaagcagcagagacauugcuauacuauuaaaugcuuaauuuuauagacuuuuaaauaccacuaugcgacauuauccuggccuaccaacaacugagaaaauaaggacuugaagaaaacaagggcagcagaaauagucucuauaggaaaaauguaaaggagugaugacaggaagaguggagaacacuuauaugauacaaccgaaaggucauaugauaagaaaggcaugacauuauuaauaagcaacauaugaggccuguuaaggaaaccuggcuguucucaguucuucugauaugaccccguuacacuuauccuauggagaauuggcccauaggagaguccacaagcucuaauuucaggaggcccaacugucacauauguuucucuaucaauacaucacuuauggagcuugugagugaggagugguacagguggauguaggcuuaagauuucgaagugacacucuuacuucacacauagguggguggauuaaaauguaauggaauacuguaaaacaagaggcaguggugcaaucucuuucaaaauguggaauuaguaauguccucgaugagucugaggacaguuuauuuuuugaagauagugaugacucaguuccuaacacaguaaggccauuggugaagagagucauccagagucuagcugugaugucagguuuuuaugcuuuaggauugauaauguaguuaacugugaauaugaucauuugcuagauuuuuuaguacaaagacuaauauguucauaguauuuuccauuuuguuuucuuauuuuuuauguaguuuuggugcuuuuaacuaugauauuuguugucacacacguuucuguuagaauucauuuuuuuuuuaacguaccuuacuguggacugagguucaguaaagcauuuacuuuuuuguaagcaugaggagaauuccuugagaugcauuauguuacuuuauguuuugcauugaguguuacuaaacuauuacucugacugccugcguaagaacucauucauauuuauuauauuuugcuacuuccuuuuuacucauuucuuuguauauaccacauugaaaaaugauucagauuuauuuuauauuggaacuugcuuuuuauucuuaacagccacugaaaucacugaaauuuuagacuaggcauaugcagugcugagguagcuuaugagauuucacguucuagucaauguauuacaucuuguguuucugcuguguagcaccacucccaugaucucauacacuucuuuuuugaucaugugauuuuauacucccccccaacagucuguagaauauuacuaauuauccagaacuuauguuucuuccugauuucuagccauaaaauauucuauuuacaugagcaaaauaauguuuucucuguaaaacuacuaaaccacuuucaauauauguauuaauaacaaguuaacauuauuuuuccaaaaauuuccuuacaaaguuggagugcaucuuuacguaucaguauauuuuauacacuagcaaauuugcuguuagcacuuucauguuccauuuccuaaggauuuagaauaaucuucaugguuauaaacuuaauggcagcauaguacucugcaauuuuaauuugucuuuuuuaguaaacuguucgccuuguuagaaauuuaggucgcuuccagguuucuuugcuuucuucuuccuuuuuuaaauguaauuauccuggccuccacuacagcuaaacuucauagaacuuucuacugcuguugaaguaaucucuuagaguaguauaaucugggagaaggauuacgcaugguaaagggucuaagcaucuuuucauuauuauuauacuucuuaaauccuuucuggaacaaggggaaaauaaauaaauguuacaguuuuugcuaugaauauugauauggcuuuccaaagggauuauaccaguuuaaaguaaacauuuacugguuuuaucacaaccucuauagaauugggugcuuuauaguauuuuuauuuuauuuaauuaaggguauuaauuugcauuucccuaguuucccuuguaacugauuauuauuuguguuucuucuuacaucaguuguauguuuauauuuaauuugccagucaugaaauuuggauuauaaauauugucuuuuuauugagaaagcucagaaaaaguucauaaauguugccucauuuugaauucuuuccucucacccaaacgaauaggagacuagggaaccaagaggccacauucauguucguauaggacacuuagcacauaauaacaaucugauagcuguuuucuaguaaaacagcuucauaucucuauuuaaaaaccuuaaauucggccaggcacaguggcucucguguguaaucccagcacuucgggaggccguggcagguagaucgcuugagccuaggaguucaagaccagccugggaaacacggugaaaccucaucucuaccaauaaauaaaaacauuuuaaaaauuagccagaugagguggcacaugccuguagucccagcugcucaggagucugaggugggagaaucacuugagccugggagguugaggcugcaauaagauguaauugcuccacugcacuccagccuaggcaacagaguaagacccugucuccaaaaacaaaaacccugaaauuccauuucaaaguguuucaaaauuuauauucagauagaacuagaauuugguaacuagaauuuuggaauucagacauuaucuaaaaugucuagacuuuuagaaagaaacuuguaucaggcugggcgugguggcucacgccuguuuucccagcaguuuggaaggccaaggcgggcagaucaccugaggucaggaguucaagaccagccuggccaacauggcaaaacccugucucuacuaaaaauacaaaaaaaauuagcugagugugguggugggcaccuauaaucccagcuacuugggaggcugaggcaguagaauugcuugaaccugggaggcagagguugcagugagcugagaucgugccacugcacucagccuggugacagagugagacuccaucucaaaaaaaaauaaaauaaaaaagaaaccuguaucaaaagcuagauaguaaaauuuugaaauaaaagugcucagaaaaauguuaauugcuaacuuaaacauuauagucaaauguguaugagaaggcugaguguuuauacagcaucaaguggcugagaagcuuucugauuugggaagagagacucauggggauuuuacucagcaauguuuuuuucuagcuucagccuuaaaguuuuagagcaauucugagacuguagaaaauugcuguuagucuuaagacuacaguuaagcacccugacucuguuuaauuugauauuaguuaugucuugcuaggaagaaaccacuggcaaaggagaaaagucuccuuccaggauauuuaguccagaugauuuuuaauaauuauaguuuauuuauuuuuguuugaaaucauuguaaaggaaaaucauuugugucuuucuguucagugccuuuagaaaaucugcauagccuccauggagguucaccuaguggcagcuuccaccaauuauaggcaacacacuguugacuggugaagcugaacuuacaagguuuauguggagaaggaccuuuuuuuuguuguuguuuugagacgaagucuaacccuugucaccuaggcuggagugcaguggcacaaucucagcucacugcaaccuccgccucacagguucaagcaauucuccugccucauccuccugaguagcugggauuacaggcucccaucaccgcgcccagcuaauuuuuauacuuuuaguagagacgggguuucgccaugucggccaggcugguuucgaacuccugaccucaggugauccaccugccucggccacccaaagugcugggauuacaggcgugagccaccaugcccggccaagaagaaacuuaggcagguaucagaagggagaauggaggaaaggaagauaauuugagugagaacacaauguuucacacuuuuaaaauuuuacuguauuuuacugauagauuacuugauguuuuuaauugguuauuuuccccacccugcccuacccauuaccuuuuuuuuaaaaagacuauuuauacuuuuuaguuuuaugacaguugaguuaggaacaucuuccaggguguuuuuaugaagcagcauccuaauagaagauucuguguuccagcccugaagggugcagucaaugauuaaauguaaaauucuguccagacacaugauggagccauauuaaacuguugcugcccucaggcuauuugacagcugucugcugaugugauauuuaaaucaucaugaaacauuagaauaggaauaccaauucacaacccaagcauguuucugaaguaugagcaacugcagacaaaaaaaggccuagacaucacuugaaagguuucugaugagcaaauugcaaauaucagcaccucuaagcuugaaauguuaccuguugaaauagaacagugaauguucuuguauguaaucgaucuucaggccaagaaaguggaacuagauugaaucaaauggagaaacguaaaaauaauuuuaacuccuaccuagaugaaugcagcaagcucagauagucaguaaucucaucuagguuuucaacuccuagaagacuguaacaaugccugcuuauauaguccagauugcuuacugcaguacucuguccauugaacauguucagcauacauagaauuaucucuuuucauuuucagugaaaaagacuuugucacugaaacuggcaauuaccacauuucuguuccuuaaugaggaaaaacuuccaucugguauacucgcagcacgauacuaccaaagaccauugaauccauguugcauucucauaguggcagacguaaauuugaggacauuugugaauugucagcaucaaugugaaugccucuguuaccagguccucacugacuugugcucucugguaaucagggccagcuucaaggauaugugacccaugcagucucauagggucuugcacuuggcuuaauauucugcugucaccgucuugaaauuauuaauaauuuuuuucacaaggacucauguucucauuuugcaccgggccccacagauucuguagcagccuccugggucuuuuuaucauacaguucugcuuaccaacacuguauguaaaaccuucccuagagaguuuacgucuauugaaauuuuaaugucuuuugaaaguaccaguuuguuauuaaaaauauuuguagagaucaucuccccuuaccuucccauccccucuucccacugccuguggagacagugcaccugaagcguggccagcagcgugccuggcaccugacugaugcagagguaaggagagggagugcagagauggcaacugcaguuguugggagauuaguuacauugagcaaagaaguuauuugauuuagcaaaugaguagauguccuaaagauaaggagagccaguuuucucacucccugaagggauuuacaaacauuuaaaaggugaaagcugaaaagaacaccaacguaccauguuaguauuggaauuaucaguaugaacuuacggguuuaaaaauuuauauauagaaauaguuauagcguguauguuuauauauauaaauauaugucucucucuguguguguauguguguaugcaugcauauauuucuuaguaguauguacugagagguucuagaggcaaugacacccagcaguaauaaacacagugaguuccaagauuauaguuucuaaagccacucuccacuaaaagaaaucagugcuuagaaaaauggccauuuccagggcugggcagcaaacauacaggaugaacacagaacaucuugucuuuccagagaguaaguaaauaaucaaagaaugacaggucaugucagaaggacccagaaaccagccugaaugcauacccacuggcaaaaaucuaaugucagcaacaaaauaaauaauguuaauauuaguuaaaaacuuguauaaaauaggaauccauaaguuuguacugauauacauaaaugaauagauaaauaggaaagaagggaaaagucuuccuuacauacaaggucaacuaguaaauauagaagggaugguagaaauaguaacuauuuggcaaccauuagauuaguaguaaaugcuacuacuaauagcauuuacauugguguaauacuacaguacuacacuacauugguguaauacuacaauagcauuaggugauagacacaggagucaucagucaauaugagacuaguaguuguagguuugaugaggaacaggguguugucaugauauugacauuucuucccauaaaauauuacucagauguaaagggggaaauggugaccaugguguagauagccggcagacgcagucuugaccagggcauccugugaugaaacaggucaauauagcaugccuauauuauucacugagacagggcaucauuucugugguauuccugccaagaauucauggccucuggucaugaggaaacacuagacacauccagugagaauaaagacuuucuaacuggauaccauuaaguaugguguuagcgauaggcauuuuuagauacucuuuaucaaguugaggaaguuccccuuuauuccuaguuuacugagagcuuuuaucaugaauggguguuggauuuugucaaaugcacuuucuguaucgacuaauauugugagauuuucuacuuuagcucauuguuuugauaaauuaugauaaaucgcacuugguuucaacauauucuuuuuaugcauuugauacauuggauuucauuugcuaauauuuuguugaggauuuuugcaucuauguucaugagagauguuggucuguaguugcugugaucugaauguuccucacccacaaaaaaauaaaaauucauguguugaaauccauaccaucaggaggugggaccuuuugggaugugauuagguuaauaaggcagagcccucaugaaugggguuaguuacucaauauaagaggccccagagaacugccucauuccuuccaucauaugagacacagcaagaaggcaccaucugugagaaagugggcccucaccaggcacugaauaugcaaguaccuuaaucuuggccaccagaacuggaagaaauaaauuccuguuguucauaaucuaaacaguucaugguauuuuguuagagcagcucgaacagacucagacaguaguuuucuuguaaguucuuugucugguuuugguauuaaggaugcuggccucacagaaugaguuaagaacuacuaagaaguauucccucugcuucuguccucugaaagagauuguagagaauuggcauagucuugcuuaaauguuugguagaauucaccagugauagagucuuauucagauugaguauuucuucuugugaguuuuggcagauuguaucuuucagggacuuuguccauuucaucuagguuaucaaauuugugggcauagaguuguucauaguuuuccauuguuauccuuuuaauguucgugggcuccguagugaugucuccucuuucacuucugauacuaagcguuuccauccucuccuuuuuguuagcuuggcuagaggcuaaucagcuuuugauuggucucuucaaagaaccaguuuuugguuucauugauuuguuucuccguugauuuccuguuucaauuucaauuuccacucuaauucuuauuauuuauguucuccugcuuacuuuggauuuaauuuacucauaguuuccuaagauggaaauuuagauuuuuuauuuuagauuauucuucuaauauaggcauucagugcuauaaauuuuccucuaagcacugcuuuugcugcccucguucuuuguuucuauuuuugucuuccauucuuuuucugcccuuugugguuuuaauuaagcauuauguauuauuccauuuucucuccuuucuuagcauaucaguuauucuucuuuuuuuacuuuuucuuuccagugguugcccuagaauuugcaaugugcauuuacuacuaaucugaauucacuuucaaauaacacuauaccacuucacuucacagguaaugugauaccuuuauaauaacaaaauaauccuaauuccucccuccuguccugugugucauugcugucauucauuucacuuaaauacaugcauaaguaagcauuuguauauauguauguauauacacacacauaagcuaucuauagcagcauacauaauugaauacauuguugcuauugaacaaacucuguuagaucauuuuaaaauaagaaaaaggaaagguuuuauuuuacccuuguuuuuguucaacauuucucuuuauguaggucugaguuucugacccauaucauuuuccuucucucuaaagaauuucuuuuaacguuucuugcaaggcagaucuauuagcaacaaauucccugaauuuuugucugagaaagccuuuuucucuccuuuauuauccuuugaaagaauacuuucauaggauucagaauucuagguugguggcggguguuuuuuuuccuaucagcacuuuaaauacuucacuguacucucuucuugcuugcaugguuucuuaggggaaguuggauauaauuuuuauuuuucucuauacguaagguguuucccccccuccccagcuucuuucaggaauguucuuuaucuuuuuauuuucuguaguuugaaaaugaaaugccuacauguagguuuugggggcauuuauccuguuugguauucucugagcuuccuggaucugugguuuggugucugauauuaauucugggaauuucucagucacuuguuucaaauauuucuuauauuauuuuguuucuucucuuucugguguucuuauuacacauguuacaccuuuuauuuauuuuagagacagggucucacucuuacccaagccauucucccaccucagccucccaaauaaucgggacuacaggcaugugccuccguuuuuuguggggauguggucucauuauguugucuaggcuggucucaaacuucugggcucaagugaucuuccugccucggccuuccagagugcugagauuauaggugugagccaccguacucggccugugugacacauuuuguaauugucccacaguucuuggaaauucuguucuauuucuuucagucuuuguugucuuugcuuuuccauuuucagaguuucucuugauaauaucucaagccuagagauucuuuucucagccaugucugucuacuaauaagcccaucacaggcauucuuuauuucuguuucggugauuuuuugaucucuagcauuucuuuuuaguguuucuucagauuuccaucuuucugcuuacauuccccucuguccuuaaauucuagcuaccuuuuccgucagagccuucagcguguuaauuauaguuguuuuaacuuccuggucugaugauuccaacaucccugccaugucuguuccuuauucuugcucugucucuucaaguuguaucuuuugccuuuugguaugccuucuaauuuuuucuucauagucggacauauaauguucuagguaaaaggaauugcuguaaauaggcuuauaguaacccgaugguaagaugaugggggagaaguguucgcuaguccugugauuaggucuuagucuuucagugagccuaugccccuggacugugaacaucacaaggguuucucaguuuuuccuacgcccuuagaugggacaggaugacuagagugggcaggaguuggauauuuccuucccccaggucaguuaggcucugguuaacuaguuucuccugcaggaaggccuuaauuaagaaaagcagugcuaggucauguuucaaaaugguuucuuuuccccucucccagccagaagcagaaggguuuauuucucugauauuuaaugugaggaucuggccagguuacuggagguaaaucucacaauauuguaggaguuggcccauccggaguguuuaacucucagacuugucugagccuccagcaguucaucgguuagaauucagguuuucuuaccuuaguguugguuucucacagcaguuuccacucaggagucucugcucuguuaagccacgacuuccacuaggagucucuggucucuguucugggaagccacaacucccucuauuugccucucugucucuccagccccggggcaguaguuuaccuugugucuuccccucuuauagguccagaagaguugugacuuuucagaguguugaccuucuauuuguucaaguagaguagcaacuuacaagcuccuuaaaugcagaaccagaaacuggaagucccuucucugccuguuuuucacuuggguugucuuuuuguuguugaguuguaagaguucauuauauaugcuagauauaagucccuuaucagauacaugauuuacauauauuuucucucauucugugaguuauuuuuuucacuuuuuuauugguaugauuugcagcacagacgucuuuaauuuugauguagucuuuuuccuuugucacuugugcuuuggcgucauguauaagaagcucggcaguggcugggcacaguggcucaugccuguaaucccagcacuuugggaggccgaggcagguggaucaccugaggucaggaguucaagaccagccuggccaacauggcaaaacccuaucucuacuaaaaauacaaaaauuagccgggugugguggcaggcaccuguaaucccagcuacucaggaggcugaggcaggagaaucgcuugaaccugggaggcgaagguugcagugagcugagaucaugccacugcacuccagccugggugacagagcgagacuccaucucaaaacaaaaaaauaaaugugcucagcagcaugaaguuuacuucuguguuuuauucuaacaguuguguaguuuuagcucuuacugcauuuaggucuaugauccauuuugaguaaauuucguauaugguaugagguagggguccaguuucauucuuuugccuauuuguugaaaagacuauuauuuucucauagaauugucuugguaccauaaaugauuuuuaauguguagguccuacauccuaccuuugaaaccauuacugaacauccagguagcucugacuaugguguuuuaccagaugucauauccuagaaaauccuugugggguuuacaugucauuugcaagcuuuaguaguuuccauaaugaggcagacucagggucugccuagccaaauugucauuugccagcagagaacuuaaaguaccaaagaagggccuaauauucuucccuaaugucaaauuaaggcuccaaagugccucagcuuuuuaugauuguaaauuaucagucugucuagaugaauuuuuaguuaauguuuuaccuuugccacuuaucagauuagugaauuccauguguuuaauaccuguccacauuugucccuaucaaguuucaaaguaugcuguuuagaaauuagaacaguucuuugaauucugugugccagugaaaagagcaagcaugaaguugugcauaugaauuaauaaguaaaucaguuucgucauagguagggaggaaguuuaauuuggauguagggaaggggcaauaggauaagagcaggacaacagagcaucauuuaugacuggggagcuaauggagggaaguuguccuguugguugagagauggguucugcagccccuucugugggcuggguaggcuccgugggcgagucucuuacacaucguuguccuggauuaucuccucugaguccauucuacaaaggagacucuuaaaaaccguguuuucuaccuaugguaacagagcugaugagaguuuaauugaugccucuuuuaaggguuugagauuuuuuaauugguuuuuggugcauuggguaauuaacuucucagugaccaguuuccuacauacagucauccuucaacccacagaggcccuaccuuuaggccucugcucucuuccuauguccagccauccaugguauuccgcaccucuucauucauuuucuucuuaauuaacuaaggauacagagaggagcacugccccaaguguaguccugagaugcuaucucauguuccuaaaugcaagaaggcuguugugugccuuagagaaauuacauguguuagguaagcugcuuugaguuauagcgcuguccuugaguuauagugcuguccaugaguuauagugcuguggccaugaguucaauguuaaugaaucagcuauauguuaaauaaggugccuuuaaacagaaacaugcaucaaacaagguuaugcauugaucaguugaagauguuuuaggggcucacaggaaccuaacccuguauauccccuguggacaaugcuuuaguauucacuaauucaguauucacaacagcacaacuaucaugaauaacaagaauuaaauguauuugucauguaaugggcgcuaacacugguugccacugacuuuaucagauuaauuuugugcuguguaugauguuuuaaauuuuaaguuuuauauauuucuuauauguguauauaugagauguauagccauauauuuaaucuauaugauguauagccacauauuuaauaauuuauauauuugugaguucuuuauaaauuauuucaggguaaaaaagggcauuuagaagacuuuggcuuguacaaucugaaacaguaaaauuuuaaaaauauacauauguuccuugccaaaauuaaccauauuuuuuacuuuaguagccuucauuuagcgucaucugauuacuaauuuuaaaauguauuugauuuuaagaaaauuauaguuccaaagauagaaauuuauuuuacugauaacuguuaaguaagccauauaugcuaacucuggucacucuaauauauacauuuuaugucacucucaguuugaaagcuccaaugugucuuugccuuaaagaauuuugacuuaucuuugauuuauagaguuuguauggcaacucuccuggcuuccagagccuaacagacuuacuuguauagcuuuuaaagcuaaucgauuggcuuuugauacuuuugcuggaggaauaucuuauuaaaaucaaauggaugaaguagcuaauuguauuuaacauuugaagggauaagugaaaagaggaggaaaagacucaaguugauucaaaagcaaaaugagaagaaaagauaauuggcauauucuccacaucuuuccucugaucaaccacauaggagacaaaacaaauuagagacuugucuuugaacaggaagcagaugugccgagcauauuuuuacuucagauuuuguuaacuauuuuaucuuuagauacugauuuuugucuagaggagaguguuggagcaacuaaaauggaacucauaacuucagcucuugauggaaguuuccuugaugccuggcacuuuaugcuguauuaaugccaggaaauaaauuuuauuuccuccugucuuuaggcaagcuguuauuccucuaaugcacagucacuuuuaacuuagauuuuugagaaacaaggaaaaaagauuuaaucuuugagaccaguuguuggcuaaggcaggcguuugagcaucccaguuacuugucauucagcagcugugugggaaaauguaagcuacauuguugaacagauuuuguaaaggaaaaaauuuauuucuugauuuauuugguacaaaugucucuuuacucaaaaaaucuuuacaaaugguuauugggcauucagucauuugcuuagcacucuguaauuuuauaaagugauuuccaucaggugccuuucacagaaacccugaaggucaggggaaaucauaauuuccuugaugagaaagcugaggcauagagaagcuccuuguuaggaggcuuugccucugauuuccuggucagcuucauagguuuuuugcuuuuuuauuuuuguucuuuuuaacuuuuuuaauauccuugccuuacugcuguggagaaugauuucuauuuugcaacagcuuauguuuuucuccuguguacagggauauuccaaugccuuuaguuagcucaggaguagagcaugguaaccugagagagcuggcacuugcaagaaugaaagaccucggaauacagguaagagcaaauauggcggucaggccacaacuguugagaaaaagagaaaucugaaacacgaaagacuuugccacuaccaccccuaaaaccagacuugcgggucaggucagaaagcucccagauguugaaagcauagucacugaacugugucggagcugaagccaguggugcaggggcugccuccuuuuccuucauucccuucugcuuucuucugccugcucagauugccaacugugugccccacuccaguuuuuaaaaacaguuuuucuuuugaaguauuagguauucaguuauugacugaaggaaaaggagacgugaauccugaaaggaaaguauaaucauuugaaaagacaaguauuaugugcaugaaauaauugccaaaacugcuauugccccacauauaccagucuccuaucccucuggccauugaagucccuucuucgcucacagauauuuacuaaacaucuccucugugcuggcccaggauauacaaagagcccaagaaccugcaacuuaacagucucugugggaaauucuuaagucauaggaagguuuaaaacuccagugcucaggaacuucuuagagcugcuaaagggauaaaccaggagugguguugagaccaagggccgacuccugggcucugccuucauagauucuggaucaguagauugggaugggaccuaucuguuuguuauccagcacuagguacaugguucucaugcacaauucagauuugggccacacuuugaaagacaugguuccaaggauugcauaugguguuuguggacuuaaccuaagacauuuuauucucucacucaaauuauuagggagaaaauguuucagaagauuguucaggggagaguuugugaauauuauuggcauauucuaccaaaaaaaaagugaacaauuuuauguuccagaaaaauagcaaaggacaccaaacaagauugugugccugcuuugccuccaaggcuccagcuguuuguguucuccaucuccucucgccuccaagaaggccacugaccuucaagaaggccaaggugacugaccuggccugguuaucccaacaaucucguuauccauccaucuucuuuaacccucaccccucauaagccuuguuagccucuauuaaaguaagcugggauugaguccaaaggcuggaauucagucauagccaaaauauaucuaguuccuauaggcaacaucuugagcagaaaauaagcacacaccaaucucugccuuuaaaaaaagcaugccaaaaaaaaaaaaaaaacagaaacagcaugcagauguucauuaagaacauggaacaguaauacauucccaugcuagcuacuauauagaacuauuguagugaaaggacagcagcuacauuaaguagauuaauaauuacagagauugaucaucuucgucugcuguacaguuuuuguuuacuggaauucauggacucuacaucagcaaagcauugucuugagcuaguuccugggguguggaaguagcuuuaguuuucuacaacugaauaaugagcucuuauuuuucucuuggaauucuguacauauauagcaguccuucauaaaaauacuauuacuagaaaagcuuaugugacaucaucaaauuucccacagugaucuuuucuuacuggaagaaaauguuuaugguuuguucuaugggggggaaauauaccauaagauauauaauugaauaauuacaaugauuuauaauaaugaaaaggauuguguaauuguaaaugucugguagcauagcaugcacuguggguuguggaauagaagugagagccacaucacagaugcuuggccaugcagaccagacauugcauuggcauugucugcaggcagcuccaugccuucucagauauucaagagccauuugugauugugcuucaaaguauguaauacauagcucuagguuccuccucccucccucccucucuuccuuccuuccuucuuuccuuccuuccuuccuuccuccuuuccuuucuuccacagugcccuucuugcaaaaaaaaaaaaaaaaaaaagccaucuucaacauguaauuuuuggauauuccuaaaaugauacaaauauggggaugcuaaaaauguuaacugccguaaaauggagguuuuaaacauuuaggaauuuacuuuuuacucuuuauauacauacuucuggauuguacuuucagauaguuauauccccuaggcaaaccuguuucuuacuuuuaugacuuacauucuuuacugcuaagauuauauuauauauugaucuuuuucgaauucuaaauuuauuuuaaaagcacuacuguacuacuucauacauuccuacucugguuuccccauccucagauucauuaaaggugguuuuauuuugaaauucagcucuuuuaucucacugcaaguuauaugcaaacuuaauuuugagcccaggguuugguggagagguuuaaauaaaaauaaagauugaauugguuaccaguuuuauauuuguaccccucccaccccccaaccccgcucacgccauuuuuuuuugacagugucgagaugugagaaccagagaaguuggaauccaagaaauucaucacaaaguacggccauaccagguuagucucuucaugucauagagggccuagguacuguccuuagaucuuugccaacccugggcccacauauucuuaaccaaggacagagccccaggagugaauaacuaagagcagagacuaaucgaggauuagauaccggugucaaaccgugaaagccaaauacaagaauucuagaagagccagguuaggaaaacgaagucugaaccucauucuagauuagcacuguccaguggaacuuucugcaguguuggaaauguucugugaucugagcuauccaauauccaauaugguggugacuguugagcacuugcaauauggcuuguacaaaugaggaacuaaauuuuuaauuuaaaauaaauucaauuguaaauaguccccugugacuacgagcuacauuugggaagagcauaguaugaucugcuucucucuuuauguguaacuauucagcuguuggcccaauggugauaagcaaaugaauagaucagcccuuacccacaggcuccacaaaaauuaagcauaaugccuuaaggcauucaugguauguaaugaauuaacuuuucucuuauacucuuauaaugucuagcuguaugccagauuuucuguaggauuugauucucuuguggaaccccauuugagaaaggcuggaauagaugaucucugcauugauauuucuguucucagcaugaaucaguuaauugacauuuuucacauuuaggaccuuuugagagaaaaaguagacccaacacaauuugccagauucuugugcuguucaguuauuuagcaaacauuguugagaaggaauauguguuagucugaauuguucaccuugcucuggguaccaucuccccaucuaccgaguguuucugcguguggccauguccauauguauacuuuucucugugcgugcaauauuguuacauauggcuucuauuuaagaaaaguacaagagccauuuguacaaugagcugaagagccaaaagccugugcagacugcuaccacaaagcuuccccccagaagcuacccuccaugacugaacuuucucuaacauuuuuaucccauaauuaugcauaauauuuaagugcccugugggaggccacacuuccuugaaauuucgucaaggugcaggugaccagcaucacauuuuucuuccccaaagauagguuucaguggaggcgauaaggacuagaagaugaaacccaaaccauugaacaccugacaguuuugagacaaaggggugcuccugagagcuacgcaugagacgugauuuugaaauuuuacauuaagagacucuucauggggagucaaaugcauggaagccuuuacugagcuggaucucuguaagagucucaagguuaaugaaguucaaguauuugugaaauuauacaguuauuuuccuuuuauaauaguccaugaacaaggugugaacuuuaaucuuggugcuauuugagaguagacaaguaaaaagaaacauaauuagugauuauucauuccuuaucccuaacuagauauuaaccuaaauaaauacauacaauuacaaaaaugaauuugguucuuuaauuuugaauaauauuuuuuguggcuuuuuacuaaauagguugaauugguaaggagagauuauguugcaaaugguggcugggaaacauucuugucauacgaagacccagaucaagacauuuugauuggccuccuacgauuacgcaaguguucagaagaaacuuuccguuucgaauuggguggaggugucuccauaguacgagagcugcauguguaugggaguguggucccugugagcagccgggauccuacuaaauuucagcaucagguauccuguauuccauuucuauuugacuucuaagaaacugccuaaguaggaaaagagaaaaggaauggggugaagagaagaggaagaggcagaggagcaggagaggggaaagagaagcauagaaacagaggagccaguguuuuaguuguucagagauguuuucucuccaaauuguauccuuuugggaggaaaggauaaacugagauucagucaguuggaacauaacagauugaaccacauggaauugguuuuuuuugagacagagccucacuuugucacccaggccagagugcaguggcgugaucuuggcucacugcaaccuccgccucccugguucaagugauucuccugccucagccucccuaguagcugggauuacaggugugcaccaccaugccugacuaauuuuuguauuuuuaguagagaugggguuucaccauguuggccaggcuagucucgaacuccugaccucagaugauccacccaccuuggccucccaaagugcugagauuacaggcaugagcuacugugccuggccugcaguuaguauuuuugaaaguaagaaaucgucuaauacuggcaaucucauaugggucaacuuauuguggagucagguuagacaguaaugggaaagcacuuaugaaacacuuccuaagguuaagccauauuauacauaggggaacccuauucuaaccccagacaaccuaccuuaauagcucacuuuuaaaaauuuccagaaaauguguuaaaaccuaauggcggauaugauauacgagccaaaauugauuauuuaagaauuuugccugguuucucaacucuuagaaaguagagagguggccgggagugguggcucacgccuguaauuccagcccuuugggaggcugaggcagggggaucaccugaggucaggaguucaagaccagccuggccaaccuggugaaacccugucucuacuaaaaguacaaaaauuagcugggcguggcggcacgugccuguagucacagcuacucaggaggcugagauaggagaaucacuugagccugggaggcggagguugcagugagccgagauugagccagagugaucucgcccaaugcagugagccacugcacuccauccagccuggacaacagagggagauuccgucucaagagaaaaaaaaaaaaaaaaaaaguagagaggugacuaagaaauuaaagacauacugccccagacuuccaucauuuagagauugccuagaacccaccuaaaaagagacugaauuugagagggaauuacugucuuccugugaauagauuacaucauccacaacauaccuuuugguaguucuuguucaaaaguuacaccuuuuucaguugucugcuacaguguaccuuugguaggauugaaugguuucuuuuuccuuacucccauaagugggcuuuuucacucuuaacagauuuuagcaacuacuaaaguauauagccuucuuguuuuauggaccccucuuaaugaacuuccuuccuuuuuaauucccacuccccauuguugcuccgugcagggauuuggcaugcugcugauggaggaagcagaaagaauagcuagagaagaacaugggucugggaaaaucgcugugauaucagguaacugggggagggcgaaguucaugauuccuucccauuuugaacuuggcaccacagugaaaacuauguugguacccucuugccccuguugaugguuauuacguucaaaauugagcugagcugacuggcgaaggacuugugcucaaacaaaauucacaaaagcaguuuaguggaauagagauuuccgagcccucugagagucaggaccugugacccauaugcccucuucugcacucucugucacacuggucagcauggucgccuccucuuugugcugugcccaguuacuguaucugaggaaauggaauuugaugauauggacaggagaaaaacaugaguguuucucacuguuguggagauuaucacuauuguucagaaauuaaaauagaaccucaguugccaguacgagcuguuuaaaggccaaauucuugcucuuucaauuuuguucucaguaacuucaauccuggggaacagcuuuccccuguuugggaguaaaaaaguuuuccccagcccucuuagggucccuggcuggguccgaaaauuaaacugacaaaggcagauuaacaggggaaaagcauacacauuuauugcauauaaauuuuauggaacaggaaagccuuuauaaggaaauaaagacccaaagaaauggcugaaccugaguguuuuuauacgagugcaaagucaugaaaaaauaagacaggacacaggaguaagagcuaagggugauaaacgggaauguuuagcaaggccuguucauuuagaucccucaaggugccccucugccuucagagaugaagauguuuguuugcuccagguggugugaggacaccuuccucaugaacaucucaugaccugcgucaggggagaaggaaggggaaggucuaaggguccuuccugcaucugccauuuucugauuccuucaccuuaagauacucaguaugccaagacaccgucuuuugcgguaguguguucugaaccccaucaggagcuuccccauuccuuaucuaggacagcaggucacuggggaagugggcaugaaaaggaaaauucaguacagcaugugugaguggagcaaaaaaugacguagaccccuuucacaucugcuguuccauaguguauccuuacagaaaucgcuguucccauaagaagcuaacagggugagagccaugaucaaaauguagguuauuuuucauccagcauguuuguuuucccauuagacuacuacauuccuaaagcuaaaauacgccuucugagaaaaucaucucuucugaaaaugaaaguugaaaugagguuuuuuaaaaaaaaauaaguuguugccaaucaguaaaucaauacccaugcuuggguuuuaaugauuauaauuaugaaaauguaaugacucaggcucacuuauaaucauuuagugugguugagguuuuuggcauuauccagacagauuccuaaagcuuuuuuuuuuuuuuucacaugucuagcuuuauuuauuuauuuuuuuuucuguuaucuuucaucgcacaaagagguaacuaaauaaggcucacuugauugguacuguuaccuguaauuaaaaaagguuuacuucucaacuguuuaaccugugguugaucagaaguaccaggcaagggccagacugacuuagaagcccucugcacaugugucuguguagaguugauaacaccugaaauuuccauggccccuuuugucagagcacuguuagcguucuaguaaagugcuugugaaacuucagugugcuuacaaaucaccuggagaucuuguuaaaaugcaggcucugucucagugggccuggguggggccugugcucccaggugauaccaugcugucuucagaccacacuuuguacacaaggaaggcuuuaguauucucuuccaaguguauucucuuuucagucacugagauaacgacaacgcucugugauccuugcagugcuacacucccagagucugauaauagucaagugacuuucuggugucugugggaaccuaaucaaauuuaaaauggaagagcaugcauauuccaucacugcucuacaucauuucgucugccuuuaugacaucugugucuuuuuacacuguugcaugcagagaggaccccuggcuugccugaggucauauccaauugcucauaagagccucaguuucugcuuuuuaugagcggggugauuuccauuuucuaaguggaaaucagcaucugcccucuuucugccauaucuaucucccuagcuuuuuaucauaaucuaaauaauagcucaauuucagaucaucugcauguagaguuucucaaauaacaagaagagacuugcucaaauuaacagggaagaaccuuucucuugucagcugguaugauaggucuacuucauuucuauacaagggguuucuuuuggcaguggguuucucugggaacagcccuggaaugccuucuugggacucuagugaguucagaagggaggaugccguaagcauuacuuccugucacccugccuggaagccccaccauugcucucuauaggggaaacuacguacgccuggacuuucuguuugacuuaagcucuggucacccuucaaaugaaagaacaagaacauuugcugucuggaugaugcauuuuuauuucuccaauuuaguaaucuauuacuguucuguguaaguuucugaaucagaugccggagaaguuaguccauuauuaagaacuucaaggagggcagaugugaagagcuuauuauuauaugguguuuuuaauguuguguuuuuccgguuuuugcauuuugacuuugguuucucugaugugaguacagugaugugugugcguguguuuuaguuuuuuguaaauaggcaguuauucuccauaaauuaauccuuagaaugaaaaucucuuuaugaccgugcuggugucugugggcugcauuuugucagcguuaccucauuggauuagcugagaagaggcacugauuuggaugggagugggguggggaggacggguggccaggauuccauuccugcuuugccaguagcucuucuugugaucuaggauaauuuuacuuacucuccaugggccuuuauuuccguauuuuaaaaaaguggaugugguuaucuuuuacaguucugacucuagaauucuaccccuuaguaucuucuuuaguucucagcaugaccaauuauguuuuccuaauuaaauuguaggugggaccuuuucugugccauauuaagagacucuuuaauuucaucaauaauagaucucggucucguuguagguuggguguuugcugaugaaaauggcgauaguuucccauagguaguuaauccuaugcuuugugaaugccuguuaacuuaggucacaacuggugauacuguuugaccuaaguguuuacuuuucuuccgaccuuguccucaguuuguaaauccauccuuguuccaggucuguaggcuuuuguauaaguuguacacagugguggccuagauacucuguccuggcauaacuaguaagcuugaguaagggaaagauagaaucauuuaucauuuugguuacuguuguguaagaguaaugcauuuagguagaauuuuuuaauugcauuuugauucauuaugacuucccuucaucuugccagauuuucucuguaacuuggguuuaugaucuuggauucagccucuagacaauauuaugaacuacacaguagaucugauuugagucacuauagaaagacucuggguauucuuuuuucuguauuuaaaaacaaauugguuuuuuaucugugcuacuucaguagacuuuguuuauagguauauacuguguauuuuauagcagauuaucuuuuuaaaaagaugacuaccuuuauggcuacaugagaaaauugaaaacuuucucauuuaucaaaaucaaaugaagcaauuucuugaaaaagaggccuuuagguuuauucuguuuuuuucuuagugaacuguguuuuaaagugaaccaucaacucuaaaugugaaaauuaaacuaaaaaugaaauguucaguuucaucagcaucaaagucaccguguauugagggcucacguaugaaaugaagagacauaugaaaaaagaagaugugugaaaugucacccugcccugcgugaacguucguguugggcuauaggaaacucacccaccuuccccucguugauugucuuugacugcagaggaagauaaguuuucucccuacuuagacuccagauuaguucauaacucaagauuaauuacuucacaguaagaaaauauuauuuuuuuacauauaaaaauggacaaaucaguguuaugagaaccaccaguuuauaaaauaauguguaggcaagaaauaacagcuaauugcugcuaaauaucuaagcaauuaauuagucccuauuaauuccaagugguaucauuugccagcuuaauccauauagcuucuaucaacacacgucuguucaagguuaacaaauuguguuuacuuaaaaaccacgauguuuaucuacuugggugaucagcauucuuuccuuuaaaaauguuaacaugagcaguuuuucugucuccucucuuauaauguaaagugcaaggaauuauacuggagaagcuaaccacaacgucugaaaugccaucacuaauaaucaccguggaaacggagaucucugaugucacacugccuguaccauuuccaaaagggcaaauagaacugugauagucacuauuuaaaaagccauuuaacacccccaacagaaugaguuuuuuucuucuggcaguuuuggcuagguaucagauccaaucgugugacuguuucaguuugccaagcuaauugcuaugcagcaagaugaccagcuauuccccaagcucgucugacuaccuucaucauaagcaguauucuauuuguguccuuucaaguagaaaauuaauauggccauuggccaagaaucguacaaggccgauggaucacacagugauggugaagaauaaggaaaaugucugaauggucaaugacagaaaucacugaagucagagacugauagccauuuuguuuaaaucuauuaaaaagccagagaaggggagaggagagaagaauuuaaauauagggugauuaaaugagucacuauggagaugaaaucauccuuaaucaugauggucuuaguuauaugacccuaaaacuacaucacagugccuccuggucagaaaauaaguguaccugcgccuuauacaauccaauauggcuuucuaggacugcaguuaauggucuuguuugccagaaccacugauuaauaaaaucauaugugggcagaaaauagcaguuguuuuguugaagcauuuaaacuacaaauggcugagauuuacuuauucgaccuucaccugucucucaggcuacuacacaucucccucaguuucaggagaagauaguuuuauuccuugcauuguacucuaguugaaaagaaggguacauucauaacuacguuugucugaaaauggacucauaauccuuaccaaaaugccuggaaaagcauuucuucauuguagcauaucuauuugcuaauggacacaggaagccugccaaaugcagaccaguuuguggcaccuacacgaguguuagucuauggcuucucagaaaggaagggaaagaguguuuguccuuuuguacuaucuuugugacaaauuauccccuaaauguccccuaauuaaauguacauuuucuggguucuguauauuccucuguuccauuuugguauucuaauaaagaucauauauguuucuuuuuuggugcauguuccaguaguauuuuuaaaaucauuauuaauaucuucuuaaagacaauggauacaauauaaaguauuucuuuacuacaggaauucaauuucaacaucauuauuaaucagacuggaauugaugauauggaauacuacuuugcuagauaauguauuagcuagguguuugcuuauuggugucuguuguagcugcacuguggcagcauuguuuuguagcuccucccaggaaucuguauuccaugacuugacauuuacucauuugaaggugaaucagguaccaguuuguaguacaccgcacaucaagugcauuagaccaucucuaacuuggcaucacagacuauguuaauuaguacacauguuuugaauauuauugaauaggccacuaaugaguuucuacuguuuggaucuuggaggcaacugaauuuuuugugauguuucccagccagaagcuagugauacugauuuggaguggcugauuggcauuugaaguacagcauuuggcaaaugcuguugcuaaucccagguccaugcaguccagccucuuacauuucagagugugcauguugagaucuugaaguccagccuugccaguguagacacaacagcacauuuguagacuuuuuguccccauucuuguuccucuuaguuuauggauauagggaaucauggucuuaugcuuuugcuuaggaggaauaggguuauaucaugugauuccuaauaacauuccugaaaggucuggaagcuuugagaugaaugacuaccuuuauuuaaaauuagacacuucacaggcuuuuuucugaggaagcaagcccucuccaaaaguggcccaaccuaugcuacucacuaccagcugucuaucagaaagucuguuuuaauaguuuguugcaauguugacuccuuaucaauguaacuugaauaugaauaguacuguucuuuucucuaaauauuugacauugccuuaauucauucaauuugauaaagcuuuucuauuuuagaucuguuagaggcagagauuuggcagguuauucuuugggugaacagguauuacugaauaaugcuggaaaauauuggugcugccuuccuuagcagcaaccaagauacuaguuuuguggagccuuuuaguuuagagauuucuaauuccaacagaacacaugcaaggaauuucuuauucuuuaguuggccuggcuuaagcuguugucucugaccaacaacucacauuucuaagacagugccuguuagacauagaauuguaguuuguggccaugggaucauuuccuuaugcaccccauccucuagucccuaagcagaccacuguccacuuguccaccauucaugaauaaauugcugggguucaguaaagcaguccacaugccccagaucucuaccugcgugaucuguugccucacugcaaauccuaauaauuaguguuuguucugguuauuuauuauaacauaccaccccaaaguuuagugacuuaaaacaacaacccucuuauuuccuuaaugauucugugggucagaaauucagcagggcauagaggggaugguuccugucuguucugugaugucaagggccucagcugggguggcuuaaauggcagccaguuggcugggauggugugucugaaguuucaguucugacuggggcuguccauaugagcagcuugguucuuguccaccugucugcuccauguggcuugggcuuuuuaauagcacaauagcugggguucuaagagggaggagcaaaggccuggucuuagaaguccuagaaugucuauauuaguuaucugucauuguguaauaaauuacccaaaaacuuaauggcugaaacaacaagcauuuuuuaucucaugguuucuguagaucaggaauaugagagugacugagcugggugccuuuggcucaacaucucuaacaaggcuguagucaaggugucagcuggggccauaaucaucucaagaguccauuggagcugaaggauccccucccaaguucacugugcacuuuuuggcaggcaucgguuccucacaagcuguuggucuuggggcugugguuccucgccaucccucgugggcccauuuauagggcugcuugucacaugaugugacagcuugcucucucagugggagugaucagagagagagagcucauucaagauggcagccauaguauuuuuauaaccuaaucucagaagaguguuaaugaguccaccucacccucagggggaagggauuagacaagucugugaauacccuagguggugaacuuugggggucauuuuagagacugccuaccacaauguaucuucugccuuguucuguuggucagagucacugggccaggccagauuuaagggaaaaggaaguaaauuccaucucuguaagggagaaggcagccaucuuuggaugcugucagccguagugguggaauacuucuccauugcuuugugauuaguaggcauucaguaccucuaaugccuucuccaaagauagacccuuugggcagaccuaaauucaagaauucuugucccaaccagauuuucauauagucaagcauggcaacacaaucacaccucacacuuuccuagguagagcuuggcagguccaacaauacucagccugcaccugacccuuugugugccaucucucuuccgugaggacaugccucucuguuucccuuugcaacccuauuuuauaccugaugcuuuaggugcgcgugcuggccauuuaucuuuuucuucuagguaauggaacauagaagccugguuuugggcugaggauacaugguuucccucuggagcuuuccuacccuuaaauacuuauuuucccccuacaaacacauggagaaauuuuaugcauuguaagaaaauuuuuuucauuuggggaguugauaaaucauagguaaaguagaauuugccauuuuaaccauuuuuaaguguauaaaucaguggcauuauuuacauuuacaguguuguacgaccaucaccauuauuucuaaaauuuuuaacacccuaaacaaacugugaacccauuaagcaguaacucccaguuccccgcacaguccucuaaucuauuuucugucucugugaaguggaaucauagaguaucuguucuuuuaugucuggguuauuucacuuaccauaaugucuucagugcucauccaugcuguagcaugucucagaauuugcuuccuuguuauggcacaauaauauuccauuacauguauauaccacauuuugcuuaucauccaucagucugauagacauuucgguuguuuccaccuuuuggcuauugucaauaauauugcaggguguacaaauaccuguuugaguucugcuuucauuucuuuugcauauauacccagaaguguaauugcugagucaaauuguaacucuauguuuaacuuuuugaggaaccaccaaacuauuuuccacaguaacugcacuguuuuucauucccacccacagugcacaaggauuucaauuucucuacaucuuugccaacacuugagauuuuucuuuuuuuuuuuuuauagccauccuagugguauaaaauggcauucugugggagguuugacuaauauuucuguaaugauuaaugauguugaaugucuuugucauuuuuaucuucuuuagagagaugucuauuugggucuguugcccauuucuuaacuggauuguuugucuuuuuguuguugaguuguaggaguucuucauauuuucugaauauuagaccauaaaauauuugcaaauguuuucuuccauucuguggguugccuuuucacuuucuugauacuuuccuuugaugcacaaaaguuuguaauuuuaaugaaguccaguuuaucugucuuuuguuauuugugucuuugguauuauauuuaagaaaccauugccaaggugaaggacauaaagauuuuccucucuguuuucuucuaagggcuuuauauaaaguuauagcucucaaauuuagaucuuugaccuauuuugaguucauuuuuguauaugauauaagguaagagucuaauuuaauuauuuugcauguggauauccaguuuuucuagcaccacuugugagagagacuuuucuuuucccauugaaugcucuugacacccuugucagaaaucagucgaaaagaaaagugaaaguuuauuucugggcucucaguucuauuuugcuggccuauauguccaucuuuacaucaguacuaugcuguuuuaaucacuguagcuuuguaguaauugggaaguaugagucuccaacuuugugcuucuuuuucaagauuguuuuuggcgaucccggguuccuucaaauuccauaugauuuuucacauggcuguuuuuauuucagcaaaagccacuauugggauuuugauagggauugcauugaaucuuuauauggcuuugggugguaucaucaucuuaacaauguuaagucuuccaggccaugaacacaggauauccuuccauuuauuuagucuucuuuaauuucuuuuagcaaaguuuuguaguuuucagugugccagucuugcaccucuuugcuuaaauuuauuccgagauauuuuauucuuuugaugcuauugugagauuuuuaaaauuuuguuuuugaauuguucauuguaagcauauagaaauaaaacugauuuuucuuccauauugauuuuguauuaugcaacuuugcuagauuuguuuauuagcuccaauaauauuguauguguguggauucuuuagcauugccuacauauaaggucaugucaucuugaauagagauaguuuuacuuauuccuauccaauuugggugccuuucauuucuuauucuugccuaauuccucuggcuagaaccuuuaaguacuguggugaaaaugggcaaccuuaucuggcuucugaucuuagggggagagguuucuguuuuucacaauugagcaugauauuauuaucugugaguuuuucacauauggccuuuacaauguuaaggaaguucccuucuaugcuaauguauuggguguuuuuaucaugaauggguugugaguuuugucaaaugcuuuuucugcauuugagcugauuguaugauuuuuuuucccacuuaauucuguuuugguuuauuacauugauuuuuguguguugaacuauccuugcauuccagggauaaaucccacuugguugugguauauaauccuuuuaauaugcugguaaauucaguuugcugguauuuuguugaggaguuuggcgucuguauucuuaaggggaugauggucuauaguuuucuuuguagugucuuuaucuggcuuugauaacagaguaaugcuggcuuuauuaaaugaauuauaaaguguccauccucuucaguuuuuugcaaguauuugagaaggauugguauuaauucuucaauuguuugguagaauuuacuaguaaagucgucugauuuugggcuuuuucuuauugggacauuuuuuauuacugauucaguuucuuguuauguauuuauguagacuuuguuuaugagucaguuuuuauguuucuagaaauuuguuucaucuagguuaucuaacauguuggcguacaguuguucauaguauuuucuuauagaauucuuauuucuguacaguaaguaguuaugcccccucuuuuauuucuguuuuugugauuugagucuucucuuuuuuaacccaaucuaagguaaacauugcuaguugaucuuuucaaagaaugaacuuuugauuuugauuuuuuuuuuuaauucucuaucuucacucuaaucuauuauuuucuuccuucugcuagcuuuggguuuuguuugcucuuuuuuuuucuaguuccuuaagguguagaguagguuauugauuucagauauaucugcuuuuaaaaucccaaaugugaucauauguaucugcuuuuuucaugugagcauuuacagcuauaaguuucccucugagcacuguuuuugcugcauccuauaaguuuggaauguugcauuuugucuuucauuugcugaagguguuuuccaauuuuccuugugauuucuucuuuagcccauugguuguuuaagaauguguuaauuucugcauacuuaugaguuuuccaguuuccaucuguuauucuaguuucauuucuuugugaucagaaaaggcauuuuauauaauuucagucuuuuuaaauuuauuaagacauguuuuccugaccugacauaugaucuaucccggaaaauguucugugugcacuuauggaaaauguacauucugcuauuagugguagcauguucuauauaugucuguuagauuuaagugguuuaaaguguuguucuaguucucccuuuccuuauugaucuuuugucuuaauuuuuuuauuaauuguugaaaguggauauugaaguauccaagucuuaauguagaacuauuuauuucucccuuaaguccugucaaguuuugcuucauauauuuuggggcucuguuguuaggugcauauauguugauaauuguauaaaucuuccugaucauugaacauuuaucaccauauaauggucuucugucucuuguaaccuguuuugacuuaaaauuuguuuugucugauaauauaaucacucuaugacucuuuugguuauuaguuguuuucuuagugguuaccuuggggaucauaauuaacauuuuaagccuccagucaguuugaauaauaccaagugaguuuuaauaguaugcaaacacucugcuccuauacaucucugucccucccccucuguauuguuauugucacagauuacaucuuuuuaccuguguauccauuaaccuagacuuaaaauuauuguuuaaugaauuugccuuuuaaauaauauaggaagaaaagaggaguuacaaaccaaaagugcaauaauacuagcuuuuauguuuacuuauguaauuaucuuuauuaauauucuuuauuucuucauaugguuccaaguuacugccuauucuuucaauucagguugaaugacuuccuuuagcauuucuuauagggcagguuuaguaguaauaagcuucuuuagcuuuucuuaaucuggaaauguccuaauuucucuuuuauccuugaaggauaguuuuguuggauauagaauucuugauuggcagauuuacuuuuuucuuucagccagcacuuuaaaugugccaucccauugccuucugaccuccauaguuucuaauaucaguuguuagucuaauugaggauuccuucuaugugaugacucauuuugccucuugcugcuuucaagauucucucagguuuucaacaguuugacucauauugugaucauuguggaucucuuugaggcuauccugcuuggaauuugcugagcuucuugaauguauagauucaugucuuucaacaaauuugggaaguauucagccauuucuuuaaacauuuuuuucuacccuuuaugucucucaucucccucugaaacuccagcaaugcauauauugguaugcuugaugguaucccccacgucuuuuauuuuucuacauuuuuucuuucugcuccucagacuagauaaauucaguugcauuaucuuaaaguccacugauucugucugcugccuccucuuaacugccauugaacaccucuagugaauuuuuuauuuuuacuaucauacaucucugugccagaauuucuauuuuuuaauauaauuccugucuauugacauuccuuuuugauaguauccccuugauauccuuucuuuguccaugguuucuuguaacuccuuaggcauauuuaauacaguugauuuaaugucuuugaguaguaaucccagugucuggauuuccucaggaauaauuucuguugaauucuuuuuuccugugaaugagccauucuucccuguucuuuguaugcuuuacaauuuuauauugaacuacugagaacuacacaauuaguauaaugugguaacucuggaaaucauucuucucuuucugaggaguugcuuuugaggucuguaaucaugcauuugucuagugacuuuuuuuuuuuuuuuuuuuuuggggagucagucuugcucuguuacccaagcuggaguacaguggcaugaucucggcucacugcaaccuccgccucgcgguuucaagcuauucuccugccucagccucccuaguagcugggauuacaggcaugugccaccaggccuggcuaauuuuuuuguauuuuuauuagagacgggguuucaccuuguuggccaagcuagucucgaacuccugaccucaagugauccaccugccuuggccucccaaagugcuaggauuacaggcaugagccacugcacccggcccugucuagugacuuuuccaaacuauuuuugcaaagucugaguguucuucauuguguguguagucacugaaauuucuguucuuaucucuaugaucagccugugaccugagagggauuuuucuuaaaugucugguucaaaaaaagaaaaaaggauguguaucucuucaaaucuuuugauacacuccacgaaggaagugagauggggucaaaacaaagacaagugucugcacugguccuuccaggaaccuccaaagugaacauaauacacagcccuauauuuuuggaggacuagguccuuauugcccacuccaguuccagccagcugcuccaggaaaauaaguuaccauuccuguggcuacgguggagcuaaggaaugggggaugguugguggcuuaagcaugcuguucccugagugaaguuuuacagccucucccucaucagacacuccccuagucacuguaaguaucuuaccaaguuccagcauuccaaaauaguugguugcaauuauuuuuuuuccagcguaaucgucguuuuagcagaaggaugaaucucugaaaauuccuaccuugccauuuucccucuugaagucuguauuuaaagagacuauaaauagaaggggucccucuuccuaccagguuauaagaugguacagucuaacuucugcagagacacacuaaugauuuuugacaugaguaaagaagugagaaugaugugugacauagcaaacauccugcacugauagaaacagagacccucuauuuuugaaucaguugauugugggccauccuaugucacaucauaggccagacucccugaaagaaaaaaacucucuaagagcuguaagauaacccaccagcaucacccaacuguaaguuaccaugguaguaucuauuuagauucuguauaccuccuuuguaaauuaccuaauuuuauucuuuguucuuaucuugguagccuuuucaaaauguguagaagaaccuuuaggcugcuggguaggagacucucuugagguacucuguauuuccacagugauggagaauaauguauacuguguuaguugcaauaaccaguuugaagaacuaagauuauacauggguaaccuuuguaugauuuuuuuuuuaauagaauggggaaaaaauucugaaagguuuagggucguguaguuaauugguucauuuucaaacauucaggauagaaaccuuuucccaacuuugauaucaguguacauuguugaagaguaaaauaucgccauccuggcaggagaucaaugagaaauaauaaagucucauuucaauagcaagugaaugaaacuaaugaauauauuuccuuguguuaauguugguagauacaucaaguaggcaauaguugauuaauugaacccaaaagcaauuaaaacaguuuaauuuguuuuuauuucacugauuucuuuuaauuaaacaaucauaaaucaucugaauguuuugcaucuaaucaaaacagaaauuugagcuuuaaaggauagauuuacaaguuuggcugugagaaugugaugugggcucaauuuuaauucugucuaagaacacauuacuagcagugaaggguggccuauguccuaacaaguaagcaucaaagaacaagaaugcaccuguaauagcuaauucauuuuccugcuucagacaugaaaacauuuaaauuauuaagccaagguuuuucuuaaggaauuccaagagauaaaacucuucaauuuccaggcuccuaguacauacugagcaaauacuugaucaauuaaacuuauuucuuccucuguuacaucacauuaauaauuccacguucauucuuuauccaguuggaaucacaacccuggcucacuuguuuuuccauagaugugaagaauugauuucauuccccauuuaagcagucacauaguugagauuauuuaaucuugccuucuuuuucauuuuaaaaguuuacuggaagcuguaacaaauagcagaguuuauaaaauguuaaauaacaccuguaugucuuagcucacucaggcugcuauaacaaaacuggguaauuuauaaaugagaaauuucucauaguucuagaggccucgugaccuaauugucacccaaagaccuuaccucuuaauacuauugcauuggggauuaaguuucaacauacgaauuuugugggggauacacauucggaccaucgcacucucuaacccccacuuaugucaauaaccagcauccaagaagugccucuguuggcccuucccucuuccuucccaguauccuaacuuuuuugguauuuucuucguaaguauguaucccuuaacuacauggucuaguuuuguuguugcauauuuuuguucugguuacuuuugcucaacauugcuguaagauugagucaacguuguaguagcuguauuucauuccuuuucauugauauaugggauuccauuaugcugauaguucacgauuuauccgucuuaacucuugcuggguuuccagguuagaguuaugaauauucuuguguauguauuuugggacacauaaggacauauuucuguagaauguacaccuaagagugcaauugcuggguuguagagaguacauagauuuagcugaggauucugccaaguggcuuucuaaagugcuucuacaauuuuucacuacuacaggaaauguaugaguuuuaguuguuccauucugaugaauaugaguggcauuucuuugugguuuuaauuugcguucccugauaacugaugauuuugacuaccuuuucauguguuuacuggccauuuggagauccucuuucugaaguugcugugugcacaugugugugugaguuuuucuaaaauccacaagauaucauuauuauguacaguuaguauucauuuagauuuacugauaaaauugacccuuaaacaacacagguccacuuauacucggauuucuuucaaccacacacagauugaaaacaguguuuguggguugugaaaccugcguauacagaaggcugacuuuucauagacgcagcuucugcagggccaacugcaacacuugagugugugcagauuuugguauauaagggugguccuggaaccagccccccacauauaacaagggcaacuguauauuuaccacuucuuugcucuucuaucuuugcuauaucuucaaaguauuuucuucauuuucauugacauguaggacuccaugauguacuacaguuuaucuguuuuacuguugauggauauuucgguaguuugcacacauuguuuucuuuauaccuuuaguugguagcaaguuguuccaguuuugguuguauacaaaugucuuuacuuugcauuauuauuaaagcagugguccccaaccuuuuuggcaccagggacugguuuuguggaagacaauuuuuccacagauaguaaggggguuggggugaugguuucaggauucaagugcguuacauuuauugugcacuuuauuccuauuauuacauuguaauauauaaugaaauaauuauaugaaucagugggagcuccaagcuuauuuuccugcaacucagcagucccaucuggggaugaugggaggcagugacagaucaucaggcauuagauucuuauaaggagcacacaaccuaggucccuugcaugcguaguucacaauaggauuugugcuccuuugagaaucuaaugccacugcugaccugacaggaggugguuacugcuccucaggcaguaaugugagcaauggggaguggcuguaaaugcuguguggccuggggguuggggacccuugucuugucuucacuagguauaguauucuggguuugcagguauuuucuuucaguacauuguaucuaucuuccccuuauuuccuggcuuuuaauguugcagguaagaaaucagcugucugucuuugaggauauucccucaggcuacuucugugguuuuuuagaaaauauauuauuuuuauucuuucagacugucuugguuuuucucuaguuuuacuaggauauuucuagguucuagguauggauuucccguuugggcuuccuugggcuucuuuaaucagugaacugguuuuuaaaaucaguucugugugauuugcagccucuaacacaugcauauugacucuaucccauucucccucaccucucuuccugugacuccaguuaaacauauuuuagacauauuuauuguauccacugugucuaauacccucuuccccaccaacguugcuuuguuguccauaauuucuucugacuuaaucuuucagguuacuaauuuagcugugucugaucugcuagacccauccauugaugcauuggucccacacuuuaacauuuccuaaauuucugguaucuuuuuccauucuguaaugucaucuuuuaauguuuccaguuguuuucagacauugaacauaguaagcauaccuguuugcagucugugucacgugaugucacaucuggagucucugcuguuucuugucauguccugucuuaaaguguaccucaucauuuuuuaucauuugcugagcauuuuauaugagaauuugcuuucaggaauacuucaagaccuaggugaugcuagcuuccuccaaggaagaccuguuuccuuuagccaggcaucucagagucguaguugucuaggaccaaggcugugguuuaucuagaagauuccuauccccaccacaccaaucccuccucccaauucagagccuuucagaauacaauccagaagagggggugcuaugcuugggucccugucugugccaggcucugaauucagacccauguugcaucuccuugagccuccucaagguacggaagcaacucugccucucaguugcuuccacaccuccuaaacagcagggcacugggggaguguuaugacugcuucucugcuucugguggccgcaagacacugcccccacgcccccaguaucucacgugcccuuccuagaucaaacacuucuacuccccucuggaagcucacauuuucuccuuauuauuggccugacaacuaagagcucuuaacagucucugauacuuuccuagcagaaacauuuucaauuuugucuaauauuuucauugucuuuggcuggagcguuauucuuaauuuugucugccauaaucaagccugaagucaucuguucacuaagcuuaaauacucacgacucuucugcccugccucuagcuuccaucauugaaccuucuuuguuguuuuccuccaaacucuguauuguagugcuugucauuuuagaaauggugacugcaauuuaucaaguuguuacugaaaaguaucccccuucccauucucacauuuguaagcugaaucuguuuacaaaguuuauuauugccuguuaucagacccuuuucugugauuuauucuucaguuucuuacuaagccauauuguuaacaauggaaauagccaccauguuuguuucaucuaaugaguuaucaaaggacauugaaaaacuggacacagauacaggaggugaggugaucaagacaaauggcaaguucuuucuuuaccagaaaagaagggaugugcuuucccacgaagacuagaggugcaagaccagagucaggggaguugagugggccuaccccaucacauaggugccaggcgcauuagaaacgcucugggccauggggucaggcaggcugggucucaguuacuguucugcuucccuauaguguggccuugaguuaugacccauucugaaacucaucuuucuccuaggacaauaauugcaaucuuguuacauuuuaaauaaauuagugcauggagaggcuuuagcaauccagugccuggcagguauuuaaaucucccucuaacuuuauagucacuuagcuaucaagugguuuucuuuguuuguuuguuuguuuugagauggaguuagaaucacaagcuagguagcacuuagguucauuuccugcucuugauuugugauuuauuuucccuuuuagaggaaagguauacuuauuuuuaguguccaaaggcuuuacucugguauugcauuuauccccuuagaacagaaggcugcaguaacuuggaggaacaaagaguugguuuucagugaacucagguaccacacagacuggcuuacucuaucuccccacucuuuccccuacaauuucucucuaaaauagaaucacagcagaauuuaaguaaacaucuagguuugcggccgggcacaguggcuacaccuguaaucccagcacguugggaggcugaggcacauggauugccugaggucaggaguucgagaccagccuggccaacauguugaaacccugucuccacuaaaaauacaaaaaauuagcugggugugguggcaugcaccuguaaucccagguacucuggaggcugaggcaggagaaucguuugaagcugggcggcagagguugcagugagccgagaucacgccauugcacuccagccugggugacaagagagagacuucgucucaaaaacaaacaaaaaaaccacaucuggguuuguucuccacccacccccccuuuuuuuuggccuuugguuagucuaagguugugugauuugauuucccauuuuuacuaaagagcauugagcagcccaggaugagcgugcuccugcagccagaggcccaggcuccggcauaugcauugccugugauuuucccccuuucccgaauccuuugaguuagcagauuaagccacguggugcguaucuuuuggagagggacauggaaucaaagcagaggauuucuuucucaucaugaggggcuugaggacauuugguucagaaaaggaucagagagaugcuguaccccugggucuccuccggguuggagauucacagggaggccaggggcucuuggcagccagccuuggagcaguagccagaggucauccuugggaagggggcuuucccacugagugcugaauaacucuacuccucucggcccaucccagagcaagcaguguccucugccuuuaauguaaccccuuuccaugggucuaucuauaauugaucuaaagugugugcaguggaagucauuuuaauaacuuacauauaguaaagcucguguacaaauaaacaggcuuguuuucuucuccccaaagggguggauguccuggggcagaggcagaggggaggccaccacagaagcuguucacucuaggcacuuugcaagguauucuuuuuucaccuaacucaucaucauugcugguugaauggggaagauaaaauauuuauccugccuacagaguagggaaaaggucauguaggaaagcucaggguguagaugagugaacuugggaggauaaaacaaagccaguguuuggacucccccaacuccugccauucuuucuugagagagucucgcugugucccccaggcuggagugcaguggcacgaucucagcucacugcaaccucugccuccuggguucaagcaauucucaccccucagccucacgaguagcugggauuacaggcacucaccaccacacccagcuaacuuuuugcauuuuuaguagagacaggguuuugccauguugcccaggcuggucucgaacuccugagcucaggugaucuacccuccucagccucccaaagugcuacaaaacaaagccugcguuuggacucuccccacuccugccguucuuaaugcuggcucuguagcagggcacccugaggccgcugcauggagugaguuccugcacauuccccaucccagggauuuggcagaaccccacgcaggccaucggguggagcacuugguuccuuguacagccugugggcgccucuccucuggcggaggcagagcaguuaggcugagggcucggagacgguccaggcagccugcaugucaguccaggaggguggcugacgucagcucugaaggaugauugcuuuuucuuggcuggcuaacaaaaggaaaguuacuaugacagaggacuuucugggagcccugcugagcauggagaggggaucagagcagagcaaggcccucacccagccuugguggcuaagugcagggguaaugccuuucccaaccuguucugcagguuguagaaacaggaggaaauuuuucuuucaaaaaacaagaggcagaaagaaauuuagcucuuuaggugagcagagguuagaguccagacugacuagaggugaaguucccuucccuggaugccagcacuucucagaggaccuggagacaguguuccaucucagggcugagcucgccaucucaggccugcugcgucuuauugaaaauaaggacaagaacuucaauauacagcuuuccuccaaaaggcccaucgugaggccugagugccccugcccaaggugguaaucguuucuagggcacacccccuguagaaaggaaaaaguagaaggcccaaggagccuguagcuccgugggaaucaugaugagaaaugcuuagauguaccccaguaaagcagcucuuuuaaccagcaugcuuaagaaaucagggcacucuugauuguugaacuuucugguuauccaaggacuguccaguccuguguuagauguaaggaacucuucucucucaccucugcagccauuuaugguagacaaauauagguugaugcauauuuuuggaaguaaagcacuuugaccaacaauuacacaucuuccaucuuaaaauuaggccaucauuuucauuugacagaggacauauaaaagagcaaaacuaaacaugucuccaggaacugagcugagcagaaccaaaaggaaauguuagagauguuuucuaaguucacgugaguagaaagcucgaaacucagaagucuccuggguggaaggcggagguugcagugagccaagaccaugccauugcacuccagccugggugacaagagcaaaacuccaucucaaaaaaaaaaaaaagagagagaucuccugggugaauugucccugcuaaagcugagugaugggugcagggagguucagugcacugucuucugcacuuuuguguguuugacauucuccaagauacauuguuuuaaguccauggaaaacaguaucuguuuuguaaaaguaaaauagaaacauaaaaagccagaaguauuucugaaagauuuggggcaguuuuuguuagauagagauaauaauauaagucaggaagcugccucuuaaucucucagcuaacaagguaggaaauuuguaccuagguuaagaagucauccugcccuucagcucuuguacauugaaucauuccauuacccaacacccaacauagagccaauuuuuuuuucaaauacauccuccaggaacacauuucuuuguauauacacaacauaagaauagcugaacagcauaugagagaucugcaaacauuuauugcaucuugauuauaugccagacacugaugauagaagccauugacuuuaaagagcugacauccuagggagggagacagaccugcgcagugugauuacuaaaacaguggaacucuaauuaaggcacacagccagccuggagagagagugcugugaauucuggcuucuuuguagauaggggaaguaucugcacaggucuccuggugggggaugagugggaggguggcugggagggccuuagcagacagaaugggcggcugcugagggaagcgcccagaggcaguggcugagcccgcguggugaugcugggcugguuugcugauccuggaccuagucaacugugccaggaacuaaaguugaagggucugggcaggaaagacuuuguggaucaggcuaaggaauuugaacuuuaucuugggacacaucauuagugauucuaagcaggagagcaguguguucagaauuacuccgaauucugauuuuaaauaguggcuugaccucauuuguuuuucucuuccuguccucaagcuuccuugucaguuaugauacuuuuaguuaacaaguaacagaaaacucagcucagugacuuauacccaacauggaugaaccuugaagacauugugcuaagugaaauaagccaguuauaaaaggacaaauauuacaugauuccacuuacaugugguaucuacaggagucaaauucauggagacagaaaguagaacggggguugucaggggcugggagagggggagcaaguaggguugguguuuaguggguacagaguuucagcuuuacaagauaaagaguucuggagauggaugguggugauaguuguaccacagugugaauguauuuagcaacaccgagcuguauacuuaaaagcaaaaauauccucaaaauggcuuaaaccaaauggaaaauauuucauaagaaauauauagagaagcuuugggacugauuaauucaggguucggcaauuucaaaaaggagccagguggcucugccuucucacucuucaucaccacuucagccccuuggaagacaacugcccccguccgaaauuaccuugcaaagcaacauccaagaaaagagaccgucccuaaguccauuuucgauugcuuauaacaggauaccugaaagggaauuuauuuauuacaguuuuggaggcugaaaaguccaaggucaaagggcuggaucuagugagggccuucuugcagguggggacuuucuguggaguccugcgguggcacaggauagcacauggcaucacacagugguagggcugcaugugccagcucaggacccuguuccucuucuuguaaaaccacuagaacucauuauccuguuaguccaugaauagauuaauccuuucaugagggcagagcccucacacucuagucaccucuucauagccccaccucucaguaauagggauuaaguuucaacaugaguuucagaggagacaaauaccuaacccauagcacucccugugucucuuuaagaacaacaaaagcuuccaaaaucagagucuucagcaucuuggcaugaaugucuagcagccauuccacaugcagccugacuggagccccacuccugauuccucuugcaagcucuucccaccaucuccucacucccaggcagugguggcuccuguuucuccagacucuuccuuuacucaggcuaaauacccuggagucgccuuggcucccgucacaccccacauccguuggcagauucuuuucacucugccuuccacauaugcccaggcucuggguacuuuucaccacugugacucagcccgagccaccaccaucucccaccuggauuauugucaucgcuuccuaccugaucucccuauuucugcccuuggucacauauccauucagugagcaaauauuuaccguguaccucacaugugacaggcaucacucuggguacuggcagcucuacagugaauaaaacaaaaucccugcccuccuggagccuucauucuguucucaaaacagcagucagaucaugucccuccuuugaccagcauccucucauucuuccaucucacucagaauaaaagccagauuccuuaggagaccugcaugauggugccuccuuguuccuugaguaaguugagugcacgcccgucucaggacuuucacauuuguuuuuccugcucccuagaauccugucccccccauguagccucaggccuuucucuuucauuuuauucaagucucuugauuuggaauuugacagaaagaugggaaugaguugcccugaacaacuggcaguggaguggccauuuacagagagggagcuuccugcggagggagcuugcggggcagguuaccaggaguuggguuuuugaccugcuacaccuuccaugcaauuuagacauucaggugggucaugcagcaccuguggacgaaucugaggcucaaggagagcucugagugacagauuuagggguugccaguguauacauagguuuacgcucagugucacaggaagcgcgugcacagaagagcugcauauugcagugauuucaguuagggauacgaggaggaagcagcaaaggagacuaaggaagggcagccagcgagcuagaggagaaucaggagaugcacuucuccaaagcccagugcagggacgugcagagagggagggaaggacggagggagugccuguggcaggugcugcugaucgcucuccccgcccagccucagcugucucacucccaggcacagacagccgggcuguuugaggaaugcguccaauaugcagggguaauggaccuuuaguaccaacuucaacuaguucauguuccuugaauguugagacaucauaaaaaauauaauuuggucucuguuccugguuccugacauagagcuccuaaaacccuuguaauuuucugagcugcagggguucaaggggcaucuuuuguucuaaucuggugacucuuggugggcuccuggguggggaccugucaccagaaaaaugaagccaugaggagaggguugaaccuucagccccacccucccuccuccggggagggaagggggcuggaaauggaguuaguaauugaucauaccuacacaaugaaacuccauaaaaaucccuaaaagaugggguucagagaacuuuucauuuuggcaaacacauccacuugcugggagcauggugcaccccaacgcgguggggacaaacacuucugugcucgggacccucccagaccucacccagugugccuuuucaccuggcuguucacuuguaucuuuuaucauauccuguaauaaacugguaaacguaaguaaauguuucccugagcucugugagccauuaugacaaauuaucaaaucugaggaggggcuuguaggaacccuccauuuguagccaacuuggacagcaguuguaggcaaccugcagccccucugcuugcaauuggugucugaaguugggggcagucucuggacugagcucagaacuggggggccuugcgcucaucagaguagguaggguccaaauugaguuaaauuauagaacacccaguuggugucaacagagaacuggacaguugcuugguauggaaaaccuacacuucucuucacaaaccacacuucaugagccagggccaucccagcaaagcugcuucuuugacaccaacugaugaggaaaacacuuuuuccuguuaagccuuguauacuuccaacacuucugacaguagccacaaguguaccuucgcuacuggggcugaguggagaucccauuuuuucccccacucuucucucuuuaaaacuucugggaaaccgucuaucguuuggccucaucuggagcauaggcagcucagacaguaaauccaccucuucuccuucaccuguagcaccuaagguggugccugguguugccaguaggguagugaauacgcaggcuccaacacacgggugcacacguuugcuguugccugugagugugugugucacauacccugagcuugaguuaaaaaucagggaaagagucuucuucucuccacuuagcaguuucuauauuuuaaugcagccugaauucaaaguaauaauguuccaaacuuauuaagcugagauuuuaugugggagagaauuuggucucugggugggagagaguguaaggcugagggaagcacaugccgacuuuugagaauugcuaaagugaaugcuccuuuuuuaacuucgauuuuucugcaggggucggcaccaggaauuauuauagaaagaucggcuacagauuacaaggcccguacauggugaagaugcugaaauaauggccacaccaguccacucuucugcaguauccucccuggcagaacacggagaaucaggauuucuuaaauacucaacagagaggcugagcagagcaaauggggggcuucacccucaucccgcagcugcagagacuggaaacugccuucaaggccacggcuggucaucugcugaccacaccccagauccgcccucuccugcgugcaccccaaaaaaucacuugcguuuuugaggcuuaaaucaucuauccaguuucuacauuuugcaugaggccugcagguggccuauuuugacucagacggugaaaaaagcaaauuaacucauuuggacaccauaacucaugcaauaaaacugauugucauucgaggagcaaacuuaagaguaguuuauuuauauacccuggggacagaaagucagguugaaacaggaaaaccaccagacucuaaucucagcccuuuaacgacauacgcauuggagcgcaaguuaggaaaaugagcuuuuguuuucauggaaaucauucugauuacagugcugauguuuagaaauaaauagcagugugacugggaaagaggaauugcaguugugggggugugagccuggcagcagccagccagcagccucucccaggcgggagucuaccauccgagacggcgaugacaaagagcuucauuccacauucuuuguuaucucuacuucccacccucuuggcaacuacagagcagugugggcagccccaagugugguccccagagagcguuuggcuuuccugucugucuauccugagcggguggagucucagguugugugccccuaaaucaagauuugcuuccacagaagccauuacuugcaauuuuuuuuuuuuuucugagaaagucucgcugugucacccaggcuggagugcaguggcgcaaucucacugcauccuccgccucccggguucaagcgauucucccgccucagccuccugaguagcugggauuacaggcacccgccgcugcuaauuuuuguauuuuuaguagagauggggguuucaccauauuggucaggcuggucucgaacuccugaccucaggugaucaacccaccuuggccucccuaaaugccgggauuacaggcaugagccaccgcucccagccuuugauuuuuuaagguggauuuugguuguuauaaauggagaaagguaagaguucaaguucaacccgugugugaaagcaaaacaauggaaaacaggauuggcuucuucaaaggcuccucuuguagaacugccucuuugaaauuucgagguaaucuacuuuggagacucugccuggagagggucaguuccuaaguuaaaagcaucgcuuaaccuuggcuccuguggcauuuuacaaagguuuaaaggaauugauuccucugaaagggccugaaaauaaaaagucuuuaacauacaaaga
